United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 36

SEQ ID NO: 156833 - protein, 287 aa, Glycine max
  Coding DNA Sequence Number=SeqID_40055
  Gene Ontology: Mol. function=metal ion binding
  Homolog annotation: Hit_ID=Q6AUI1; Match level="QueryCoverage=90%, HitCoverage=68%, E-value=1e-99, Identity=72%"; Hit description =Unknow protein
  Pfam annotation: Domain name=zf-C3HC4; Domain location=140-180; Score= 40.6; E_value=5.4e-09; Accession=PF00097.15; Description=Zinc finger, C3HC4 type (RING finger)
MSTNCTLVNKLLMHNAINYLQLPEVGTKWGFLIWLLFSYCGLLCIACMSLGKWLTRRQAHLLRAQQGIPVSEYGVLVDMIRVPDWAFEAAGQETRGMGQDAAAYHPGLYLTPAQREAVEALIQELPKFRLKAVPTDCSECPICLEEFYVGNEVRGLPCAHNFHVECIDEWLRLNVKCPRCRCSVFPNLDLSALSNLRAEPEESSASVVTTTRYVRGQPSSQSYRLRLQGLLRPVGAEIAGPVGDIDNVLENAENGSVSIVTQNASSGDHASSVECMPVTVSHSSAQS

SEQ ID NO: 156834 - protein, 82 aa, Glycine max
  Coding DNA Sequence Number=SeqID_40056
MFMTMVTMVVVAAMITTTVILVTTMTTVDNHGGVAVADLKEEKLQVFRGRLMKKRKEKALKKKLKIGTTRLAYKISPAHHLA

SEQ ID NO: 156835 - protein, 78 aa, Glycine max
  Coding DNA Sequence Number=SeqID_40057
MLNRNEVAHLEDYCIGPNRKQFYPVATTQLVPRHQGISLGPREDFPPSEESKFKSTPTGKALSDLPEEGCPLSKETDF

SEQ ID NO: 156836 - protein, 543 aa, Glycine max
  Coding DNA Sequence Number=SeqID_40058
  Gene Ontology: Mol. function=DNA binding; Cellular component=nucleus; Biological process=regulation of transcription, DNA-dependent
  Homolog annotation: Hit_ID=Q9S7L2; Match level="QueryCoverage=66%, HitCoverage=91%, E-value=2e-86, Identity=48%"; Hit description =Transcription factor MYB98
  Pfam annotation: Domain name=Myb_DNA-binding; Domain location=223 -269; Score=53.6; E_value=6.5e-13; Accession=PF00249.21; Description =Myb-like DNA-binding domain
  Pfam annotation: Domain name=Myb_DNA-binding; Domain location=275 -320; Score=62.5; E_value=1.4e-15; Accession=PF00249.21; Description =Myb-like DNA-binding domain
  Pfam module annotation: Pfam domain module=Myb_DNA-binding::Myb_DNA -binding; Domain location=223-269::275-320
MRSQSLSPIKEHKRRWLETQMLPSVSVTPLMDIETNLTENCASQSQPMDLHENYLKPSMEDQLPFGTPSTQGFLQDFHHIDHQFHVNGSSSSNPIFGVQTPNFDPFDQNVTCESAPPDFEAYECKPLAESNGIGHAHLMNNFQYAGYSLNLPRTNQLDLMVANQSYMTFNALETKPLNFVVPDEVSCISPPNYYKRVGLNKNLRESPSTRRTFKARKKSNIVKGQWTSDEDRLLIQLVEQFGVRKWSHIAQALPGRIGKQCRERWHNHLRPDIKKDTWTEEEDKILIQAHAEIGNKWAEIAKKLPGRTENSIKNHWNATKRRQYSKRKCRSKYPRGSLLQEYIKSLNLDKNPPIDYRKKSAKNANANTNSNGKAAAQPQCSDQFCLNSQMVPRYDFNEVPDFCLDDNLFEEGCSIDSLLDDMQSASTMDEKGFDEKIMQCAPTMEGKQSHQGGMQCVHVVDVDVHHETEMMAHTNGIEVKKELDFVEMMSHMNGNHYRIESLDSVLILLLLYVHTNGREKYRDFLPSRKGRKTGNSINNNKLK

SEQ ID NO: 156837 - protein, 234 aa, Glycine max
  Coding DNA Sequence Number=SeqID_40059
  Gene Ontology: Mol. function=hydrolase activity, acting on ester bonds; Biological process=lipid metabolic process
  Homolog annotation: Hit_ID=Q9FM04; Match level="QueryCoverage=66%, HitCoverage=54%, E-value=1e-40, Identity=53%"; Hit description =Similarity to isoamyl acetate-hydrolyzing esterase
MAGCTLVLPSKANILNAFWECSPTMVIVLITPPPLSEEGRLAYARSVNGENATKIPERTNEVTGQYANACVEVAKEMGVWYINLWSKMQETDGWQTKFLSKINSNTFLENYGRFHLTLMFCCIRDGLHLTTEGNAVVYEELIKVFDEAGLSAVNMPMDFPHHSKIDSKHPERAFQQHVTATQTQATTQTQATTMAATQTQEQDEYTETTTEQRVQLVARPKRAVIKPSYLKDYV

SEQ ID NO: 156838 - protein, 239 aa, Glycine max
  Coding DNA Sequence Number=SeqID_40060
  Gene Ontology: Mol. function=transporter activity; Cellular component= integral to membrane; Biological process=transport
  Homolog annotation: Hit_ID=P93390; Match level="QueryCoverage=52%, HitCoverage=40%, E-value=2e-40, Identity=73%"; Hit description =Phosphate/phosphoenolpyruvate translocator
  Subcellular localization annotation: CTP_CleavageSite=34; ConfidenceScore=5.52e-01
MSTMFSCFFFFFFSIFQTRSLSFSPLSPCQSSLRAGEKRRRVLRRQHSGTWSPVWALDHLQHLQQTGLKGLPFPFNPILPLALVHTLGNLFTNMSLGQVAVSFTHTIKAMDPFYSVLLSAMFLGEIPTVWVVSSLVPIVGGVALASATEASFNCCNCHRNAVVESLKPLTLPPKLNLTSIFENIAIMCRIPRNIPKAVDQGYPTTIQRILTHNPPAGTAIALASVFLYSRVKRLKPKKV

SEQ ID NO: 156839 - protein, 711 aa, Glycine max
  Coding DNA Sequence Number=SeqID_40061
  Gene Ontology: Mol. function=inorganic anion exchanger activity; Cellular component=integral to membrane; Biological process=anion transport
  Homolog annotation: Hit_ID=Q7X9F3; Match level="QueryCoverage=97%, HitCoverage=96%, E-value=0.0, Identity=71%"; Hit description=Boron transporter
  Pfam annotation: Domain name=HCO3_cotransp; Domain location=7-553; Score=-103.2; E_value=1.3e-12; Accession=PF00955.11; Description =HCO3- transporter family
MEETFVPLRGIKNDLKGRLVCYKQDWTSGFRAGIRILAPTTYIFFASAIPVISFGEQLERNTDGTLTAVQTLASTALCGIIHSVLGGQPLLILGVAEPTVLMYTFLYDFAKGRKDLGHKLFLPWTGWVCVWTAVLLFLLAILGACSIINRFTRLAGELFGLLIAMLFMQQAIRGLVEEFGVPQSQREGTNQIALQSSWLFGNGMFALVLSFGLLFTALRSRKARSWRYGAGWLRGFVADYGVPLLILVWTAVSYIPTNKVPMGIPRRLFSPNPWSPGAHSNWTVIKEMLNVPLIYIIGAFIPATMIAVLYYFDHSVASQLAQQKEFNLRKPSSYHYDLLLLGFLTILCGLIGIPPSNGVIPQSPMHTKSLATLKHQLLRNKLVSVARKSKQKNTNLCQLYRSMQEAYDQMQTPLARQIPPALGLKELKESTIQLASSHGYIDSPVDETVFDVDNDVDDLLPVEVKEQRLSNLLQALMVAACVAAMPLLKKIPTSVLWGYFAFMAIESLPGNQFWERILYLFTAPSRRYKVLEKQHAALIETVPFKTVAMFTLFQTAYLLLCFGLTWIPIAGVLFPLLIMLLIPVRQYFLPKFFKGAHLQELDAAAYEEAPAISFNLSFDINVYPPHRIQEVRQQQSIIIVGKFLTKLLQGVVGRSASIKNQGVQLQNHVKTLYLLMEISQRIHSSRVTKFRRKSSLGSNHDHGGDQVQEEC

SEQ ID NO: 156840 - protein, 309 aa, Glycine max
  Coding DNA Sequence Number=SeqID_40062
  Gene Ontology: Mol. function=pantothenate kinase activity; Cellular component=cytosol; Biological process=coenzyme A biosynthetic process
  Homolog annotation: Hit_ID=Q8L5Y9; Match level="QueryCoverage=94%, HitCoverage=36%, E-value=1e-111, Identity=77%"; Hit description =Pantothenate kinase 2
  Pfam annotation: Domain name=Fumble; Domain location=71-309; Score =252.7; E_value=7.6e-73; Accession=PF03630.5; Description=Fumble
MAHTGNTVQCTGPVHGLSWISAKQKFKETSKRSIQPFCYPISLMIYLTSLLTLELGLTEGASLPQLGEPSSTLLRAGLSPILRSYPILGGRLHFVKFETSKINECLDFINSKQLHCGEGESRYSDATTDSNAIIKATGGGAHKFADLFKERLGLSLDKEDEMNCLVAGANFLLKAIRREAFTHMEGQKEFVQIDTNDLFPYLLVNIGSGVSMIKVDGDGKYERVNGTNVGGGTYWGLGRLLTKCESSNFDELLELSQKGDNSNTDMLVGDIYGGMDYSKVTSEKKGLDDYRPEDISLSLLRMISYNIAQ

SEQ ID NO: 156841 - protein, 1016 aa, Glycine max
  Coding DNA Sequence Number=SeqID_40063
  Gene Ontology: Mol. function=serine-type endopeptidase activity; Cellular component=nucleus; Biological process=proteolysis
  Homolog annotation: Hit_ID=Q9LFE2; Match level="QueryCoverage=81%, HitCoverage=93%, E-value=0.0, Identity=64%"; Hit description=WD40 -repeat protein
  Pfam annotation: Domain name=Ins134_P3_kin; Domain location=798-1016; Score=-31.9; E_value=2.2e-09; Accession=PF05770.2; Description =Inositol 1, 3, 4-trisphosphate 56-kinase
  Pfam annotation: Domain name=Utp13; Domain location=680-815; Score =205.0; E_value=1.7e-58; Accession=PF08625.1; Description=Utp13 specific WD40 associated domain
  Pfam annotation: Domain name=WD40; Domain location=134-174; Score =20.4; E_value=0.0064; Accession=PF00400.22; Description=WD domain, G- beta repeat
  Pfam annotation: Domain name=WD40; Domain location=185-266; Score =11.1; E_value=1.9; Accession=PF00400.22; Description=WD domain, G -beta repeat
  Pfam annotation: Domain name=WD40; Domain location=329-368; Score =0.1; E_value=36; Accession=PF00400.22; Description=WD domain, G-beta repeat
  Pfam annotation: Domain name=WD40; Domain location=372-413; Score =19.1; E_value=0.016; Accession=PF00400.22; Description=WD domain, G -beta repeat
  Pfam annotation: Domain name=WD40; Domain location=442-481; Score =38.6; E_value=2.1e-08; Accession=PF00400.22; Description=WD domain, G-beta repeat
  Pfam annotation: Domain name=WD40; Domain location=495-533; Score =34.9; E_value=2.9e-07; Accession=PF00400.22; Description=WD domain, G-beta repeat
  Pfam annotation: Domain name=WD40; Domain location=50-88; Score=23.1; E_value=0.00097; Accession=PF00400.22; Description=WD domain, G-beta repeat
  Pfam annotation: Domain name=WD40; Domain location=537-575; Score =41.3; E_value=3.2e-09; Accession=PF00400.22; Description=WD domain, G-beta repeat
  Pfam annotation: Domain name=WD40; Domain location=579-617; Score =37.7; E_value=4e-08; Accession=PF00400.22; Description=WD domain, G -beta repeat
  Pfam annotation: Domain name=WD40; Domain location=621-659; Score =24.9; E_value=0.00029; Accession=PF00400.22; Description=WD domain, G-beta repeat
  Pfam annotation: Domain name=WD40; Domain location=92-130; Score =51.1; E_value=3.7e-12; Accession=PF00400.22; Description=WD domain, G-beta repeat
  Pfam module annotation: Pfam domain module=Ins134_P3_kin::Utp13::WD40: :WD40::WD40::WD40::WD40::WD40::WD40::WD40::WD40::WD40::WD40; Domain location=798-1016::680-815::134-174::185-266::329-368::372-413::442 -481::495-533::...
  Pfam module annotation: Domain location=50-88::537-575::579-617::621 -659::92-130
MEPLRLKTNYRCVPALQQFYTGGPFVVSSDSSFIACACGESIKIVDSATAAIRSTLGADSESFTALALSPDDRLLFSSGHSRQIKVWDLSTLKCVRSWKGHEGPVMCMTCHPSGGLLATGGADRKVLVWDVDGGYCTHYFKGHGGVVSCVMFHPDPEKQLLFSGSDDGGDHATVRVWDISKTKKKNCIATLDNHSSAVVTLWDLHDYSSKKTVITNEAVEAVCVLGSGSPFASSLDSYQQNLKKRDGSQIFYFITVGERGIVRIWNSKGAGCIFEQKTSDVTANIDEDGSRRGFTSAVMLASDQGLLCVTADQQFLFYSLECTEELLQLNLTKRLVGYNEEIVDMKFIGDDEKFLALATNLEQVRVYDLASMSCSYVLSGHTEIILCLDTCVSSSGKTLIVTGSKDNSVSFLPFDLKIVLKALNFLLWEKVLEVRLWESESANCIGVGIGHMGAVGAIAFSKRKQDFFVSGSSDHTLKVWSMDGLSDNMTMPINLKAKAVVAAHDKDINSVAVAPNDSLVCSGSQDRTACVWRLPDLVSVVVFKGHKRGIWSVEFSPVDQCVVTASGDKTIRIWAISDGSCLKTFEGHTSSVLRALFVTRGTQIVSCGADGLVKLWTVKTNECVATYDHHEDKVWALAVGRKTEKLATGGGDAVVNLWFDSTAADKEEAFRKEEEGVVKGQELENAVSDADYTKAIQIAFELRRPHRLFELFAELCRKREAEDHMDRALKGLGSEELRILFNYIREWNTKPKLCYVSQFVLFRVFSIFPPTDIVQIKGIGEFLEGLIPYSQRHFGRIDRLVRSTFLLDYILSGMSVIEPQVQPTESKAELLLQSEIDIPDKENGIEKKDHTHEITASKKRKSNKSKHGSHKKVKNVAYNKQVVVNEPKPFDFHKFQELGLRFPVIAKPLAADGGAGSHELRLVFDDEGLHTLSVPTVLQVFVNHGGVVFKIYVAGQRVNCVKRKSLGDITEEKLRTLKGSLPFSRMSNLGVEDQDGAVENAEMPPQGLVVEGGIGT

SEQ ID NO: 156842 - protein, 314 aa, Glycine max
  Coding DNA Sequence Number=SeqID_40064
  Gene Ontology: Mol. function=zinc ion binding; Cellular component =nucleus; Biological process=regulation of transcription
  Homolog annotation: Hit_ID=Q0GLD8; Match level="QueryCoverage=51%, HitCoverage=90%, E-value=6e-58, Identity=67%"; Hit description=Dof14
  Pfam annotation: Domain name=zf-Dof; Domain location=36-98; Score =140.5; E_value=4.6e-39; Accession=PF02701.6; Description=Dof domain, zinc finger
MAGTIHEECGVDNSSSPSGEMLPCSRPMTESRLRPPQEQALKCPRCESTHTKFCYYNNYSLSQPRYFCKTCRRYWTQGGTLRNIPVGGGCRKNKKVSTKKHNDQHQPAVNQNQPHPGPSYLHNHKDLQLPYLDVQFPHLNNLLGTNAGALQGNPSFMESKYNMGMLENPRPIDFMESRLDGMSMIRGSTRSFELLENSDMSVGGGVGFGDVSGYNGLPLNYQGLSSSAFGGMSLDGSINNVGTYIMDSCQRLMLPYDGGDNTLNGSIDVKPNPKLLSLEWQDQGCSDAEKLSLGYLNGSGSWTAYGSSTANPLV

SEQ ID NO: 156843 - protein, 53 aa, Glycine max
  Coding DNA Sequence Number=SeqID_40065
  Subcellular localization annotation: CTP_CleavageSite=21; ConfidenceScore=5.38e-01
MSQVAALVPSALQVAFLSGTSAGRVSSPKKTTMVLVVCVGAGDKNLKGLVKFM

SEQ ID NO: 156844 - protein, 291 aa, Glycine max
  Coding DNA Sequence Number=SeqID_40066
  Gene Ontology: Mol. function=NAD+ ADP-ribosyltransferase activity; Cellular component=nucleus; Biological process=protein amino acid ADP-ribosylation
  Homolog annotation: Hit_ID=Q1T4R9; Match level="QueryCoverage=87%, HitCoverage=93%, E-value=3e-61, Identity=45%"; Hit description=IMP dehydrogenase/GMP reductase
MDPLGKRPAAEDDSLISDCESGVSAGDTPPPFVENADLVRTRFVRGLVAHCFKPEVLAVRRNVCSSVMALARQHSFHVFARAVAELRGGNANVKFACVKSSVVDEDGLRHLLLCRVILGKTEVVPRGSYQCRSSSQEFDSGVDDLSNPKEYVIWCNQINTHVLPEYVLSFRLPSPLKGIVKIGEPLRPSSPWMAFPALISMLSKILPPSEVASIAKFHKDYREKRISRHELIQKVRVIAGDKLLLSVIKSFRAKKIPANFKDDKAKEWQADSQQLERNDCSYGSSISYYRK

SEQ ID NO: 156845 - protein, 108 aa, Glycine max
  Coding DNA Sequence Number=SeqID_40067
MRINSEAAAGKMKHNAKQSGSPQYSCEYGDFSILMIIRDAKKHGKREGTLKLKEKDNIGLGEEGKLLNDENTKDQADVLMMPKDHMRLKALFKTKQLKIFKMDDQDSL

SEQ ID NO: 156846 - protein, 58 aa, Glycine max
  Coding DNA Sequence Number=SeqID_40068
MVAPKNNAIQIMFSLRSHRKKEKAYSYMDNKSPSKESKEVTRESLIAISNSLPHKTLE

SEQ ID NO: 156847 - protein, 78 aa, Glycine max
  Coding DNA Sequence Number=SeqID_40069
  Gene Ontology: Mol. function=cobyrinic acid a,c-diamide synthase activity; Cellular component=chloroplast; Biological process =selection of site for barrier septum formation
  Homolog annotation: Hit_ID=Q9MBA2; Match level="QueryCoverage=89%, HitCoverage=22%, E-value=4e-29, Identity=88%"; Hit description=MinD
MLGLPLLGAIPEDTEVIRSTNRGYPLVLNKPPTLAGLAFEQAAWRLVEQDSMQAVVVEEQPKRGFFSFFGGINSELLT

SEQ ID NO: 156848 - protein, 231 aa, Glycine max
  Coding DNA Sequence Number=SeqID_40070
  Gene Ontology: Mol. function=cobyrinic acid a,c-diamide synthase activity; Cellular component=chloroplast; Biological process =selection of site for barrier septum formation
  Homolog annotation: Hit_ID=Q45RR6; Match level="QueryCoverage=76%, HitCoverage=53%, E-value=4e-66, Identity=73%"; Hit description =Plastid division regulator MinD
MSSPFIISEAGDAVGVAEAGDVGGGDEDGLVGGSDGGDEAGVDAGGAIDEDEVRGALWTRFQRVHEPGEGFTAEAEGELGAGFGDAEEFEVGPALVADEGLVEAAVAVEDLDDGVVDAVLEAEEEVEVAEADVGVDGDHGEAQAGEGEADVGGGGGLAHAALSGGNDGDARDGAGELGLAVPLEEGTGGFGFGFFGGGMWSWGRWWRRGEGGERALGRGEREKEKKKKHSG

SEQ ID NO: 156849 - protein, 107 aa, Glycine max
  Coding DNA Sequence Number=SeqID_40071
  Homolog annotation: Hit_ID=Q1S8R9; Match level="QueryCoverage=47%, HitCoverage=11%, E-value=1e-08, Identity=62%"; Hit description=Beta -Ig-H3/fasciclin
MPNHCLSITDLDKLMVGTALQTLEQGQSLLNTTFDRGETVVLMRINYIRCKTLILEVDLAEGNKRLSPDYDDKDYDNDPFAPKKAETKAEEAFGVTTGMILSLHESL

SEQ ID NO: 156850 - protein, 213 aa, Glycine max
  Coding DNA Sequence Number=SeqID_40072
  Gene Ontology: Mol. function=DNA binding; Cellular component=oxygen evolving complex; Biological process=DNA integration
  Homolog annotation: Hit_ID=Q1S1B7; Match level="QueryCoverage=94%, HitCoverage=42%, E-value=2e-32, Identity=34%"; Hit description =Integrase, catalytic region
MDKYKAWLVAKVYTQQVGIDISGIFSLVAKLTSMKDLFEEVYMDLPLGYKTTTSGLVLGSLKYFLGLEIAKSSKGISLSQRMYTLSLLDDTWYLGSKLAQLPMDPNLKLNLTDGDPILDPSLYRRLVGRLMYLTILWLDITFEVHKLSQGTRKTTIGFCVFLGDALISWKYVKQGTVSKPFAESEYGALSLVAGEVVWLKHLLGHFEVDIGST

SEQ ID NO: 156851 - protein, 94 aa, Glycine max
  Coding DNA Sequence Number=SeqID_40073
MTKARQKGVQKENRGGACHPARPGKPGCFLQKQPPSGGTSWRPKWAWLRNLTGHVITPFLAFGMSRKLTDCVTILPFDFRHVTEFHGLRNNASF

SEQ ID NO: 156852 - protein, 264 aa, Glycine max
  Coding DNA Sequence Number=SeqID_40074
MARTKAVAIKNPSNSSSLESEFVHSPSHRTLDKGKDKAIYISSEFDSEATMTLTPPHAKDIVIDSPRKICIKEKFDKSWVQKKVVYGRYIDLLEIKKNGWDVLYFIKKLKWIGFFEMYEPVYLSLVRAFFVTIEEEEEEDLYEPQNELSTTNEGGQLVQNEEERARNAEDNDVDVAQNAPEAKEDVPHVHILIHPTVVAEPSSKTMNELFERFLKLEGWILDKATPTLIPEFVTMQHEPPPPPRATTMLSLSSSSTNSSPTKPI

SEQ ID NO: 156853 - protein, 74 aa, Glycine max
  Coding DNA Sequence Number=SeqID_40075
MAIIGNALCQAFMMKHEYRSLREEDKAWGKLQRPIMVASVAIIMLAIIVFIVICLKIVFPSSDGRRTFYVNRRL

SEQ ID NO: 156854 - protein, 57 aa, Glycine max
  Coding DNA Sequence Number=SeqID_40076
  Homolog annotation: Hit_ID=Q1RY20; Match level="QueryCoverage=98%, HitCoverage=6%, E-value=6e-13, Identity=65%"; Hit description =Proteasome/cyclosome, regulatory subunit
MALDPNCAGTSASTNAVEDDTVTKKKVENEDVSDEDLSLKQQLELYVERVQDPDQGL

SEQ ID NO: 156855 - protein, 554 aa, Glycine max
  Coding DNA Sequence Number=SeqID_40077
ANVMDCSDMSNSTIGLGGSDSGGSIEQPIIRSGGASRPRRGVWPSDATGKPVPVNVILPPSSFGGVRRHSGGGDWVRDDVLKYKSCLTSVARVTALKRQVLGVILPLTAFRCSAGALECGPFPTLPKQLSDATDVMANDMPLMLNRGRDPCYPFYWKSNPTSDPLAALDVECLTLPSFVFEVKPVGGTVPPFIVAPSVGEGGQPAGEVGPVAEAVWPQEVEGPYEYLCPEAGCRAFAATFATPATIAPSPPPIVFVQEVTPTITEAVVPATQADYVMALLSTIATPLLSAGVAATSAPTVLPYSSATLVASPSVVLATVASSSLSSRLHILLDHLYTSSDADSLWAFNKNLIRSTRVQNATDSAKVAIARTLWRVEHPKGANATIAFAKAVRSNRQLPAKIGGVLVKLLCTRLDGDKLFRRYKDLHVEKMNLGGKVESMVAEKDGLAKGGSMELKEELILYKKEVVEQHEKGFQKADRGGLVKSRMTRSHLRFKFNLVKGLVTHLVGFPSIVWSFSPDGCEELCLTRPWLKVLPNQCRDRSIDRLSSSSDGYEE

SEQ ID NO: 156856 - protein, 426 aa, Glycine max
  Coding DNA Sequence Number=SeqID_40078
MLMTSEVPTEPCALPRFRSELQLDKLFNGFRAYIRGVDLRIYVKLSAQAGLALGWEDMVLPSSFLHSTIVLAFAPRELVLTESGHQVHVAYGLNSLAFKVEEWNGVRVDSVGGTALVDEDPGHHEVSYDDGDNHRVVLVDGVNALEVVALAAIAGVFVCLGLLLFFCLLPMLLLLMSFESWSYLGPTVFGVVTNTVVISAVFGVCNARTWALCREAGVYLVCASCLTCVSQLWSVLRACCASARLGGLHSGIETFLPSGYSPCLGHGMQCYLEVEISDLDGCALKFVHELFEGFIVCLSQTSQDGRGHAVRPASGVLHTESFDECVKVVCQPRFNYVRKACRCSSGSMVPSYCLRLSGFTLRSSVVFPVRQGCDSPWVRSGKVWANCSSPWGRLTRASSRSWSAFSFVDMNPHGTRADLGSSRIRP

SEQ ID NO: 156857 - protein, 286 aa, Glycine max
  Coding DNA Sequence Number=SeqID_40079
  Gene Ontology: Mol. function=RNA-directed DNA polymerase activity; Cellular component=intracellular; Biological process=RNA-dependent DNA replication
MLGIHPGIIFHKLAIYPYAKPISQKKRKIGEERRKAVKEEVNKLLHANFIREVLSFLETYFGYNQIRMHSPDQEKTTFITEDANFCYKVMPFDLKNAGATYQRLMDREVFRELCKYNMGLNPEKCTFVVGGSKFLSLMITRRGIGANPEKCTIILEIRNPTNIQEVQKLNGRLASLSRFLLKLVEKAKPFYKLLKKTEPFSWDETREQAFLDFKKTIVTPPIMSRPKPGVPLFLYLSLADKTASSALVQEEKRHWPPIFFTSHMLHDTEKHYQMIKNVALALITSA

SEQ ID NO: 156858 - protein, 66 aa, Glycine max
  Coding DNA Sequence Number=SeqID_40080
  Subcellular localization annotation: CTP_CleavageSite=41; ConfidenceScore=5.28e-01
MGEARSYVWCVSPMEKAAPSMSARIASSTGGTVHVNPVSPMAMAAHAFSPLSLAASMQKRTPSVNT

SEQ ID NO: 156859 - protein, 111 aa, Glycine max
  Coding DNA Sequence Number=SeqID_40081
  Gene Ontology: Mol. function=helicase activity
  Homolog annotation: Hit_ID=Q1SRJ5; Match level="QueryCoverage=100%, HitCoverage=11%, E-value=1e-17, Identity=55%"; Hit description =Probable helicase [imported]-Arabidopsis thaliana-related
LHLFVDHLSSKHVVDFQGGNIAAPLSGNAHALGMQKFSNMLLGRYISIDSSSAHILLKIESDVGENRRIPAIKILLNFILISKRSCDTVRTFVDVFEQIFNGCTLITPFHV

SEQ ID NO: 156860 - protein, 65 aa, Glycine max
  Coding DNA Sequence Number=SeqID_40082
MWRPIGVVAPCGACRPWIFFINGVFGFLKINGSGMKEESYGSALIQDQVQDSPLSVFRCHEACKA

SEQ ID NO: 156861 - protein, 261 aa, Glycine max
  Coding DNA Sequence Number=SeqID_40083
MVGCQCVIAKCEGKRLQASSYLHTQGLEGCVPFSIIHQLRKTFKPLRAYTLETEGLFSLLDHSSTEQDFKPLCAYALKLGGLYVKSLHAYALKARGLCTLHNRSPTEDNFKPLCAYALEAGGLCTLPGCLSNGLGFPKHICFKLVIDHAYDCCHYIALVTLLSLFEAIKVEDNDHQSERKTLLIRILLSNGVANNHSTSGTPIISTMLESLMAEMRIQIEVSKRIVSKALRGQDTRCLQNEEARRIVDEALQAQGVCAVVE

SEQ ID NO: 156862 - protein, 143 aa, Glycine max
  Coding DNA Sequence Number=SeqID_40084
RVKEFDGTCISEGLIVCLSWTSQGGLGHAVRPTSGVLRTESFDEGVEVVYGPRKTSRCSFGSVVISYHSRLSGFHPKIIYSVACASRCNSPWVHSGKEPLAGHGQPLALSTLPNDVAPSPRCGFGVVVECLCLSWLPDEDESL

SEQ ID NO: 156863 - protein, 849 aa, Glycine max
  Coding DNA Sequence Number=SeqID_40085
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q9C9W6; Match level="QueryCoverage=99%, HitCoverage=97%, E-value=0.0, Identity=76%"; Hit description =Putative trehalose-6-phosphate synthase; 46897-44149
  Pfam annotation: Domain name=Glyco_transf_20; Domain location=38-529; Score=891.4; E_value=4e-265; Accession=PF00982.11; Description =Glycosyltransferase family 20
  Pfam annotation: Domain name=Hydrolase_3; Domain location=577-837; Score=-88.3; E_value=0.053; Accession=PF08282.2; Description =haloacid dehalogenase-like hydrolase
  Pfam annotation: Domain name=Trehalose_PPase; Domain location=578 -831; Score=304.5; E_value=1.9e-88; Accession=PF02358.7; Description =Trehalose-phosphatase
  Pfam module annotation: Pfam domain module=Glyco_transf_20::Hydrolase_ 3::Trehalose_PPase; Domain location=38-529::577-837::578-831
MNRRIPRIMTVAGLISDVDDDPVESVCSDPSSSTAHRDRIIMVANQLPIRAQRRPDGNRSCWSFEWDENALLQLKDGLGDDDIEVIYVGCLKEEVHPSEQDEVSQTLLETFKCIPTFLPADQFTKYYHGFCKQQLWPLFHYMLPLSPELGGRFNRSLWQAYVSVNKIFADRIMEVINPEDDYVWIHDYHLMVLPTFLRKRFNRVKLGFFLHSPFPSSEIYKTLPVREEILRALLNSDLIGFHTFDYARHFLSCCSRMLGLTYESKRGYIGIEYYGRTVSIKILPVGIHLGQLQSVLRMPQTEEKVCELIRQFSDKGRTLLLGVDDMDIFKGISLKLLAMEQLLIQHPEYREKVVLVQIANPARGRGKDVKEVQAETKATVKRINETFGKPGFDPVILIEEPLKFYERVAYYVVAECCLVTAVRDGMNLIPYEYIISRQGNEMLDAVLGLASSPKKKSMLVVSEFIGCSPSLSGAIRVNPWNIDAVADAMDSALEMADSEKELRHEKHYRYVSTHDVGYWARSFLQDLERTCSDHVRRRWWGIGFGLSFRVVALDPNFKKLSMEHIVSAYKRTATRAILLDYDGTLMPQSSTIDKSPSSKSIEILSSLCRDKNNMVFLVSARSRKMLSEWFSPCENLGVAAEHGYFLRMKRDEEWETHVAATDTSWKQIAEPVMKLYTETTDGSTIEDKETALVWCYEDADPDFGSCQAKELLDHLESVLANEPVTVKSDQNNVEVKPQVCIIDQRKDKELKEESLSGVSKGLVATRLLSAMQEKGMCPDFVLCIGDDRSDEDMFEVITSSMGGLIAPKAEVFACTVCRKPSKAKYYLDDTTEIVRLLQGLACVSEQIDK

SEQ ID NO: 156864 - protein, 134 aa, Glycine max
  Coding DNA Sequence Number=SeqID_40086
MAPPYSIPTVEQFSEMVAWPRTQPSLHKEDEGPTAQVPQHMEDESSEATIPKPFNIGEEAEETQVRQVAATTPERSLEATSEPSALVVNLPLPHPVADPSTPLLQMPEDPTTPVLAVDTSPPTIVVLQLTDEED

SEQ ID NO: 156865 - protein, 91 aa, Glycine max
  Coding DNA Sequence Number=SeqID_40087
MARGAGVHREIDAWEVACNVLMSSSLSFVLRQVRHRGLCFAWDPPARGCLKLAAKLVGRATFRALIGSAIVLGTRGMFLAVRRRIEIRHCF

SEQ ID NO: 156866 - protein, 425 aa, Glycine max
  Coding DNA Sequence Number=SeqID_40088
MSMLASTPQENVEKSFGNEEPDKEGGGNGFGSREHGGLMRAIDGDIKEQEAALEGLKKVLERGRTSTMRKLIMVKIKGICRALGRVIERALRSEVSGDADETHQRQRSIASVHRQRAATLVAEDVEHVDHAADEVHDQPQEAVVDVQGFPGRPHNTLVLMDYIHHVVVMERPGLKLSSYERKVQKFGRFAPEIEGIVVVTGLSPLIAYSLDTGHKGIISAFAESYAWGVVALIDMYENLNDGSKRSASQIVGYITLLQCSIYEHFPTVVSSIVVEGYHERKPCACYWKSGKILPVSAYHKRLDTLASHVTILPHPIAQSLFIEDIDDRWIQFSKYLTLVGQICVALGQHPLVMHDDTFVEPYHPQQLVATTAMPEPPTAAPTDVDMHRHTLRVVTEGTEAYTVIEEYLRMAKGVTAQGNVYVRSR

SEQ ID NO: 156867 - protein, 301 aa, Glycine max
  Coding DNA Sequence Number=SeqID_40089
GVWLEEEEDIKHMVSEYYHDLFIDNGVEKYAITEFTFLAVLLKEKISLNGPFKIEEIKNALFDMSLWKASGLDGLPASMVVPEVEREKLKEKDEKAGAIQQIDDVFGLVDSEVSDFCAVKVVKIKTVVGRMGGTVAGASVAVAVAALMPRLIFPNQTRFIPTGSTYDRMQWPFIKNVMEEVVLPADLIKGLLQGGLLSPYLLILGMDKLFHLILKEVNNGEENLWTQVLKGKNGRSSNFEDALVLKPLDSTLRKVVASYYPFLKENEIISSLSYNKLPDLVNDGGDWNIELLRDILPREIV

SEQ ID NO: 156868 - protein, 369 aa, Glycine max
  Coding DNA Sequence Number=SeqID_40090
MANSEMCPITLHNVRLDATPPVEFVFMNREGMNIDFFTCTITCFVICMPVAEKDHFYDLVGNPLFAFYWYRCPWWYDNSSANWTPRPHEVLADVVSLADKDLRGKKHKKQSHQEHRNDLGEHFGHQEGTSWEKRLKHPMLRFQPTAATTLGNISALMNQGFFNHSFWPDRLIQQEWALVIAQHLQGLSNANALKDQLLKGEDSLNLILQDNMKLTGDNKNLEDWVLLLTNDAKGLQTLALNDEALIRSQYTEITRLWSALVDANKETKEVNAEMEHIQQKALNDVYNAHEANFDHGIWQVLHMCYVFDPKVFNISKDIYEGELVLIDDIPKEDVALSPPRSVTPTDEPQVKGVEDAEDGEQVGPRDWVS

SEQ ID NO: 156869 - protein, 275 aa, Glycine max
  Coding DNA Sequence Number=SeqID_40091
  Gene Ontology: Mol. function=sucrose transporter activity; Cellular component=integral to plasma membrane; Biological process=sucrose transport
  Homolog annotation: Hit_ID=Q84RQ3; Match level="QueryCoverage=97%, HitCoverage=52%, E-value=1e-104, Identity=67%"; Hit description =Sucrose transporter 4 protein
MLGKDHRRTRVANAYYSLFMAIGNILGYTTGSYSGWYKVFALALTPACNISCANLKSALFLDIIFIAVTTYISIVAAKEVPLSSSGALPVEEAAAGESGTAGEAFLWQLFGTFRYFSTPIWTILTVNALRWIGWFPFLLFDTDWMGREIYGGEPNEGPNHDTGVRMGALGLLLNSVVLGVTSVLLERLCRKRGPGFLWGISNILMAVCFISMLVVTYVANNIGYVGKDLPPTGIVIASLIIFIVLGFPHAITYSFPYALISTHIQSLGLGHCGQD

SEQ ID NO: 156870 - protein, 513 aa, Glycine max
  Coding DNA Sequence Number=SeqID_40092
  Gene Ontology: Mol. function=RNA-directed DNA polymerase activity; Cellular component=chromatin; Biological process=chromatin assembly or disassembly
  Pfam annotation: Domain name=RVP_2; Domain location=199-328; Score= -64.5; E_value=0.1; Accession=PF08284.2; Description=Retroviral aspartyl protease
MSRNGYFPSWRAMLQALESRFAPSYYDDPQGMLFKLWQTGTVTEYLTEFERLANHTFGLTPSCLLNCFMSGLIPKLRRQVQALRPMSVPQATKLARLQEDKMLDRRSNHRSYSSPSPAPPKPHPPSANPTPRLPIKRLMAEELAVRRDQGLCYHCDDKWSPGHRCKMRLHLFIANEDFDFSSDPLVSPLHATPEPALVPQISLNVMEGTPAPQTFHLLGSLRNHQVVILVDGGSTHNFIQMRMAKFFALSFVSTLVVCVMVGNGNTLDCDTQSLQVSISIQNHCFTLDLFHLPICGANIVLGVQWLKLLGPVTTDYQSLTMTFNHLGRDITLCTDAPPCPSSASTHQLKRLLQTQSISALFHITYKAPPISIPVAFKLQLPESSWIHPVFHVSLLKLHQGPLPPSPAALLAYTIDNHPLVVPLTIVDWKWDTFVHPPLKRVLVQWDSLAPEDTSWELWDDLCQTYNLEDKAKEDCKEAQLPAGLRLKSTKAINKGVRSHELVKQIPLSIHSTK

SEQ ID NO: 156871 - protein, 69 aa, Glycine max
  Coding DNA Sequence Number=SeqID_40093
MVSVEGSSLRKSLRAKSEVRRWVKALRLWWWPLLLRWGHPRGLLLGLRSASAIGEVSASPNHTSGVHVG

SEQ ID NO: 156872 - protein, 1513 aa, Glycine max
  Coding DNA Sequence Number=SeqID_40094
  Gene Ontology: Mol. function=RNA-directed DNA polymerase activity; Cellular component=chromatin; Biological process=chromatin assembly or disassembly
  Pfam annotation: Domain name=Chromo; Domain location=1397-1447; Score= 8.7; E_value=0.091; Accession=PF00385.14; Description='chromo' (CHRromatin Organisation MOdifier
  Pfam annotation: Domain name=RVP_2; Domain location=325-447; Score= -39.0; E_value=0.0011; Accession=PF08284.2; Description=Retroviral aspartyl protease
  Pfam annotation: Domain name=RnaseH; Domain location=839-960; Score= -29.2; E_value=0.03; Accession=PF00075.14; Description=RNase H
  Pfam annotation: Domain name=rve; Domain location=1094-1250; Score =125.0; E_value=2.1e-34; Accession=PF00665.16; Description=Integrase core domain
  Pfam annotation: Domain name=zf-H2C2; Domain location=1035-1076; Score=16.3; E_value=0.0025; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1397 -1447::325-447::581-750::105-195::839-960::1094-1250::1035-1076
MADHGTRKTTTDRLEDAIARLTNSQASITERCNDLDGKIDSILQHLHLQASENNNNATNHQAHHHHRHAVKIDIPWFDGHDPLGWIFKVTQLFQYQQTPEEERITVASLYLDGPALSWYQWMHSNGLITSWNGFLQALESRFAPTFYDDPKGALFKLTQTGTVNDYLTEFERLANRVVGLPPPFLLSCFISGLKPDVRREVLALQPLSFLQASALAKLQEEKLRDRALTPARNSLPPRPFVPNTSNIPAKVRPPFVQRTPAEMAFRREKGLCYNCDEKWSVNHKCKGKVLLFITDEHSPLPESTTHDSEVSTATVPETDSEPPSDVDSHISLHALAGVPSSDTFRIYGMIKHARLTFLVDSGSTHNFLQPRIAQFLKLSSQHTALLQVMVGNGSMLTCDQICPSTQLTLQGHPFVVSFHLLQISGADAVLGVDWLRRLGPVTTNYADSVMRFKHLSHDITLTADVSTKPESTSAAQLKRLLQTGSTSAFYQLHVLPINQPDPPTQSHPLPAVDHLLLQHDHLFQNPSQLPPPRQIMHRITLKPNTPPISVRPYRYPHFQKNEIERQVSELLAAGLIRPSTSPYSSPVLLVRKKDSTWRLCIDYRALNSATIRDRFPIPTIDELLDKLGQASWFSKLDLRQGFHQILMNEGDIEKTAFRTHHRHFEYLVMPFGLYNAPSTFQSAMNQLLRPFLRRFATVFFDDILVYSTSLALHLHHLELVFNTLNQAAFFLKRSKCLFAQNTIEYLGHIVSDKGVSPDPSKIQVMLQWPTPASVRELRAFLGLTGFYRKFVRDYASIAAPLTSLLCKDAFEWSPESQQAFDRLKRAMTSAPVLALPNFSEPFVVETDASGIAIGAVLLQQGHPLAYFSKCLGPHMLHASAYLRELHAVVAAVRKWRQYLLGRPFTILTDHKSLRELMTQVIQTPEQHYYLSKLLGYEYSIQYKTGATNIVADALSRVPPQAGQLLILSIPQLDFLNEIKHSLNANLEFQNLTQAIQSNPTLYSDYSLGDGLILFKGRIWVNHDNPFIHNLITEHHSTPLGGHLGVTKTTHRLEASFIWSSLKHDVKKFVRECVTCQQSKNVHKRPAGLLQPLPAPEGVWEDLSMDFITHLPTSNGFSVILVVVDRFSKGVHLGALASGFTAFKVAKLFLDIVCKLHGFPKSIVSDRDPIFVSKFWTELFRLSGTRLRLSTAYHPQSDGQTEVMNRIIEQYLRCFVHDNPSSWFQYLTLAEWSYNTSIHSGSGLTPFEITYGKPPPTMVDYLPGATKTEAVQTMLETRQALHSKLKHKLQKAHDTMKKHADTKRDDVSFLEGQWVYVRLRPGRQTSLTGPLHPKLSKRFFGPFQILERIGPVAYRLLLPPESLIHPVFHCSLLRPHHGPPPTTTYTWPLQVRDAQPLRRPLCFLDYKDDTTTTPPTRMVLTQWEGEPPEDTSWEEWSDLCQAYHLEDKVVFGEDGSVNNAGNCNSDNEHLRHDTNPRPVRIRGAPARLRDYHVQYPQEQKNKLVHTIIEGACTD

SEQ ID NO: 156873 - protein, 537 aa, Glycine max
  Coding DNA Sequence Number=SeqID_40095
  Gene Ontology: Mol. function=drug transporter activity; Cellular component=membrane; Biological process=multidrug transport
  Homolog annotation: Hit_ID=Q1S7F1; Match level="QueryCoverage=92%, HitCoverage=89%, E-value=0.0, Identity=71%"; Hit description=Multi antimicrobial extrusion protein MatE
  Pfam annotation: Domain name=MatE; Domain location=285-448; Score =146.1; E_value=9.7e-41; Accession=PF01554.9; Description=MatE
  Pfam annotation: Domain name=MatE; Domain location=64-224; Score =132.6; E_value=1.1e-36; Accession=PF01554.9; Description=MatE
  Pfam module annotation: Pfam domain module=MatE::MatE; Domain location=285-448::64-224
MCNPKPSSSSPFLCPTKNHIITPDPKLINHPPPVDDQLKDELHRWPTPNEVIAEMKAIGKISGPTALTGLILYSRAMISMVFLGYLGEMELAGGSLSIGFANITGYSVISGLAMGMEPICGQAYGAKQLKTLGLTLQRTVLLLLSTSLPISLTWLNMKNILLWCGQDQQISSTAQTFIIFSIPDLFLLSLLHPLRIYLRTQSITLPLTYCSAISVLLHVPLNFLLVVHFKMGVSGVAIAMVWTNLNLFIFLSSFVYFSRVYKDSWVPPSTDCLRGWSSLLALAVPNCVSVCLEWWWYELMIILCGLLLNPKSTIASMGILIQTTALVYVFPSSLSLAVSTRVGNELGANRPAKARISMIVSLACAVALGVAAMLFTTLMRHRLGRFFTSDREILHLTSIALPIVGLCELGNCPQTTGCGVLRGSARPTVGANINLGSFYLVGMPVAVLLGFVGKMGFPGLWLGLLAAQASCASLMIFVLCTTDWNAQVRRANELTNANSAPFKQTEYCNNVRLREIVATEDHDHEITNRPSHYTHYK

SEQ ID NO: 156874 - protein, 77 aa, Glycine max
  Coding DNA Sequence Number=SeqID_40096
METTAVGPVVRGFEGEGEDDGVSQTCWRSPDTYWSWVGVVTEMLAIGVAVAGIVNNVPFIDHSSSGLGVSPEVVGKW

SEQ ID NO: 156875 - protein, 104 aa, Glycine max
  Coding DNA Sequence Number=SeqID_40097
MSNISLGSGPWDQLFGGGNSPAFGVAAVAALASGLIAVLFIPRPGDEFLHKHPISILSTVYPIVEKNEILMAEVALTAREEKKKEFIWSVLVNNGAEVVLFPHI

SEQ ID NO: 156876 - protein, 252 aa, Glycine max
  Coding DNA Sequence Number=SeqID_40098
  Gene Ontology: Mol. function=nucleoside-triphosphatase activity; Cellular component=cell outer membrane; Biological process=ATP -dependent proteolysis
  Homolog annotation: Hit_ID=Q39FF0; Match level="QueryCoverage=66%, HitCoverage=20%, E-value=6e-62, Identity=74%"; Hit description =Peptidase S16, ATP-dependent protease La
  Subcellular localization annotation: CTP_CleavageSite=47; ConfidenceScore=5.20e-01
HRRDISAGKCSGHAARNHHTRRAYAPLQGASHSPFRLRNCWEGRSVRASSLLRQLAKGGCAARRLSWVEKRIRGRVKRQMEKSQREYYLNEQVKAIQKELGEGEEGADLEELDKKIKAARMPKEAKKKADAEFKKLKLMSPMSAEATVVRNYIDTLVGLPWRKKSKVNNDLSNAEQVLDTDHYGLEKVKERILEYLAVQQRVDKLKAPILCLVGPPGVGKTSLGQSVARATNIKLIDTVDLEGGPGTSFCSL

SEQ ID NO: 156877 - protein, 88 aa, Glycine max
  Coding DNA Sequence Number=SeqID_40099
MEREMITMIMDTLPVFYCEKMVGYMPSSSADFVFAGERIKVGLRIDKFDYAALMNRKPRVNGENKKEGETHAVTIIPTWPNFPLAQQY

SEQ ID NO: 156878 - protein, 91 aa, Glycine max
  Coding DNA Sequence Number=SeqID_40100
  Gene Ontology: Mol. function=protein binding
  Homolog annotation: Hit_ID=P0ADK8; Match level="QueryCoverage=92%, HitCoverage=70%, E-value=4e-25, Identity=68%"; Hit description =Hypothetical protein yibL
GNPELIAQHTKEKEKLATEIERLKNVRGEKLSAEAQKLSKLPFSREITKKEQADMGALKKSARGLIVVHPMTALGREMGLKAVTGYAKKAF

SEQ ID NO: 156879 - protein, 247 aa, Glycine max
  Coding DNA Sequence Number=SeqID_40101
  Gene Ontology: Mol. function=methyltransferase activity; Cellular component=cytosol; Biological process=metabolic process
  Homolog annotation: Hit_ID=Q1LFR9; Match level="QueryCoverage=95%, HitCoverage=97%, E-value=5e-75, Identity=55%"; Hit description =Methyltransferase type 11
  Pfam annotation: Domain name=Methyltransf_11; Domain location=51-141; Score=106.0; E_value=1.1e-28; Accession=PF08241.2; Description =Methyltransferase domain
  Pfam annotation: Domain name=Methyltransf_12; Domain location=51-139; Score=63.0; E_value=9.7e-16; Accession=PF08242.2; Description =Methyltransferase domain
  Pfam annotation: Domain name=Ubie_methyltran; Domain location=24-200; Score=-147.2; E_value=0.076; Accession=PF01209.9; Description =ubiECOQ5 methyltransferase family
  Pfam module annotation: Pfam domain module=Methyltransf _11::Methyltransf_12::Ubie_methyltran; Domain location=51-141::51 -139::24-200
MTTPTHSIHHAAAEGYQANADRYMKGRPDYPPEIAAWLRETIGLHAGMTVIDLGAGTGKFTPRLLETGAQAIAVEPVPQMLEKLSAALPQVKTLAGTAEAIPLPDESVDAVVCAQSFHWFATPQALAEIRRILKPGGKLGLVWNMRDARVGWVRKLNQIVDRHEGDAPRFYTGEWRKLFPFKGFEPLQEQVFMLSHRGAVEDVIYNRPQQEQVIEQLRQLVAEEEELRGQDTVTVPYQTKAYFTTKA

SEQ ID NO: 156880 - protein, 76 aa, Glycine max
  Coding DNA Sequence Number=SeqID_40102
MNCVFVHVSSTFEFGAMRSVCIVQSSILQSFSSSRADPLDWKIKEEGVETRVIIMERAGRTKSVSYLCFPLISDKR

SEQ ID NO: 156881 - protein, 276 aa, Glycine max
  Coding DNA Sequence Number=SeqID_40103
  Gene Ontology: Mol. function=ATPase activity, coupled to transmembrane movement of substances; Cellular component=integral to membrane; Biological process=transport
  Homolog annotation: Hit_ID=Q1SMD9; Match level="QueryCoverage=68%, HitCoverage=67%, E-value=3e-90, Identity=73%"; Hit description =Cyclic peptide transporter
  Pfam annotation: Domain name=ABC_tran; Domain location=56-230; Score =109.8; E_value=8.1e-30; Accession=PF00005.17; Description=ABC transporter
MFETIARKPKIDAYDTNGVVLEDIKGYIELKNVHFRYPTRPDVQIFSGFSLYVPSGTTAALVGQSGSGKSTVVSLLERFYDPGAGEVLIDGVNLKNFQVRWIREQIGLVSQEPVLFATSIRENIAYGKEGATNEEVTKAIKLANAKKFIDKLPQGLETMAGQNGTQLSGGQKQRIAIVRAILKNPRILLLDGYERPAHTGNMPLLFSSGKKKTNTQEFYTGSAITRAYIQSPSDLRSLRFLFNIVNSFTSKDPQGMYPPLFSLNNLVDASSTRTDP

SEQ ID NO: 156882 - protein, 67 aa, Glycine max
  Coding DNA Sequence Number=SeqID_40104
  Homolog annotation: Hit_ID=Q8HVY4; Match level="QueryCoverage=65%, HitCoverage=6%, E-value=2e-18, Identity=100%"; Hit description=DNA -directed RNA polymerase beta' chain
GAGAIREQLADLDLRILMDSSLIEWKELGEEGSPDNENEWEDRKEKLVQEAVDTLLDNGIRGQPMRD

SEQ ID NO: 156883 - protein, 63 aa, Glycine max
  Coding DNA Sequence Number=SeqID_40105
MAFVDNWAVGKEKEWQSQHGLLLHPHPLHLPQFSHLSKAGLLNLPLFRPTSILSQAKTKSAKL

SEQ ID NO: 156884 - protein, 190 aa, Glycine max
  Coding DNA Sequence Number=SeqID_40106
QIAQSSTSRLGFPTLIIALCDIQGVVSDTLIFESLRPAINLAYVKKNCWNPADPSITFPGPRRTRTRASASASEAPLPTQSPSQPSQRPRHPPASTSASMDTHGQMLRSLHVGQQLIMENMHRLSLHLQMDPPLTTPEAYRQRVAWPGDQPSTDRGEEPSGAAEDPTVDEDLIADLATADWGPWADLGGG

SEQ ID NO: 156885 - protein, 246 aa, Glycine max
  Coding DNA Sequence Number=SeqID_40107
  Homolog annotation: Hit_ID=Q84VH5; Match level="QueryCoverage=88%, HitCoverage=41%, E-value=1e-96, Identity=69%"; Hit description =Envelope-like protein
ELGRDALECKEIMDLIKAAGLLKTVTKLGDCYESLVREFIVNIPSDITNRKSDEYQKHQIAKEITAKQVQHWPKKGKLSAGKLSVKYAILHRIGTANWVPTNHTSTVATESFAVKLPIAFPTVLCGIMLSQHPNILNNIDSVKKRDSPLSLHYKLFEGTHVPDIVSTSGKAAASGAVSKDALIAELKDTCKVLEATIKATTEKKMELERLIKRLSDNGVDDGEAAEEEEDAAEDTESDDDDSDATP

SEQ ID NO: 156886 - protein, 67 aa, Glycine max
  Coding DNA Sequence Number=SeqID_40108
  Subcellular localization annotation: CTP_CleavageSite=22; ConfidenceScore=5.34e-01
LSLAHQWAKRASTAKRSFSALSATEESNRASISRSRAKREISELSATVVFSQAQHTTGAKLKSTYSR

SEQ ID NO: 156887 - protein, 191 aa, Glycine max
  Coding DNA Sequence Number=SeqID_40109
  Gene Ontology: Mol. function=ligase activity, forming aminoacyl-tRNA and related compounds; Cellular component=aminoacyl-tRNA synthetase multienzyme complex; Biological process=glutamyl-tRNA aminoacylation
  Homolog annotation: Hit_ID=Q4UVN8; Match level="QueryCoverage=82%, HitCoverage=52%, E-value=1e-45, Identity=63%"; Hit description =Glutamyl-Q tRNA(Asp) synthetase
MAVPMPPVPPVTSATRDVMECCPGIRWGKGDSATSARKVRRLAAGCRYVAAALGRRHSERPPAACPDRAQVPALQVLGRAVARAGAARAAGANCPPAAPPATWTACGPGHRAAAAGASSAVPPAPRPAAAGSAVPWSRAGRHRAPLRSPPARRHRPPPAAGRPSSHRRGAARSRRPRHARPAAAGRAGHRR

SEQ ID NO: 156888 - protein, 177 aa, Glycine max
  Coding DNA Sequence Number=SeqID_40110
  Gene Ontology: Mol. function=acetoacetyl-CoA reductase activity; Cellular component=cytoplasm; Biological process=poly-hydroxybutyrate biosynthetic process
  Homolog annotation: Hit_ID=Q5GZ89; Match level="QueryCoverage=100%, HitCoverage=70%, E-value=2e-76, Identity=79%"; Hit description =Acetoacetyl-CoA reductase
  Pfam annotation: Domain name=KR; Domain location=1-142; Score=-73.2; E_value=0.0041; Accession=PF08659.1; Description=KR domain
  Pfam annotation: Domain name=adh_short; Domain location=1-125; Score =52.3; E_value=1.6e-12; Accession=PF00106.15; Description=short chain dehydrogenase
  Pfam module annotation: Pfam domain module=KR::adh_short; Domain location=1-142::1-125
MTERGYSVSIFPGDVSDPGSAEALVRAVEAALGPVEILVNNAGITRDTTFHRMRADQWHDVINTNLNSVFNVTRPVIEGMRRRGWGRVIQISSINGLKGQYGQANYAAAKAGMHGFTISLARENAGFGITVNTISPGYVATDMVMAVPEEVRAKIIADIPTGRLGKPEEIAYGVSFL

SEQ ID NO: 156889 - protein, 226 aa, Glycine max
  Coding DNA Sequence Number=SeqID_40111
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=94%, HitCoverage=50%, E-value=1e-121, Identity=98%"; Hit description=PSI P700 apoprotein A2
  Pfam annotation: Domain name=PsaA_PsaB; Domain location=1-219; Score=- 137.0; E_value=0.00028; Accession=PF00223.9; Description=Photosystem I psaApsaB protein
MYSLPAYAFIAQDFTTQAALYTHHQYIAGFIMTGAFAHGAIFFIRDYNPEQNEDNVLARMLDHKEAIISHLSWASLFLGFHTLGLYVNNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRGAFLIASTSGKFG

SEQ ID NO: 156890 - protein, 115 aa, Glycine max
  Coding DNA Sequence Number=SeqID_40112
MASDRMQLQNMCKKEHESFKEYTQRWRDLAAQVAPPMMEREKITMIEDTLPVFYYEKMVGYMPSSFADLVFAGESIDVGLRRGKFDYPALMNRKPGANGENKKEGGIHVVTIVPT

SEQ ID NO: 156891 - protein, 173 aa, Glycine max
  Coding DNA Sequence Number=SeqID_40113
MEAMKEKMTTMMEAMISMRKMMEVNTATVIATSTTTEVDPTYPSSLNQVNRPVSDMVGQGGEALGSTGGPHFVQVQSKHSFSPYGLPPNYTPPNVAHIPNENVDNSAPILIESQHPQFGHGQVPQPMGETHEVPQDHTLIDFEPHLGYATEGQAFGGIPLPNTLGGLQYHLQP

SEQ ID NO: 156892 - protein, 50 aa, Glycine max
  Coding DNA Sequence Number=SeqID_40114
MENCTKQSLRMAPNTKMEDILMKTQFMGLRKTLRMENCTKQSLRMAPNSK

SEQ ID NO: 156893 - protein, 805 aa, Glycine max
  Coding DNA Sequence Number=SeqID_40115
  Homolog annotation: Hit_ID=Q1R1A4; Match level="QueryCoverage=31%, HitCoverage=96%, E-value=4e-81, Identity=61%"; Hit description=Short- chain dehydrogenase/reductase SDR
  Pfam annotation: Domain name=Abhydrolase_1; Domain location=200-411; Score=61.6; E_value=2.6e-15; Accession=PF00561.10; Description =alphabeta hydrolase fold
  Pfam annotation: Domain name=Cupin_1; Domain location=40-174; Score= -23.8; E_value=0.07; Accession=PF00190.13; Description=Cupin
  Pfam annotation: Domain name=Cupin_2; Domain location=78-153; Score =54.3; E_value=4.1e-13; Accession=PF07883.2; Description=Cupin domain
  Pfam annotation: Domain name=DUF1234; Domain location=208-315; Score=- 85.2; E_value=0.033; Accession=PF06821.4; Description=AlphaBeta hydrolase family of unknow
  Pfam annotation: Domain name=KR; Domain location=415-600; Score= -60.8; E_value=0.00079; Accession=PF08659.1; Description=KR domain
  Pfam annotation: Domain name=adh_short; Domain location=414-583; Score=50.8; E_value=4.7e-12; Accession=PF00106.15; Description=short chain dehydrogenase
  Pfam module annotation: Pfam domain module=Abhydrolase_1::Cupin _1::Cupin_2::DUF1234::KR::adh_short; Domain location=200-411::40 -174::78-153::208-315::415-600::414-583
MSQVENKAGVKPQDLSMENWVESRIARFEGRKYDWNALKFQADFDPKYRRAQMRYIGTGATGVASDANTIPAGNFTFSTMVLPSKCEGPLHLHDDVEEVFFMLKGSITLMIQDGEEYYETRLKERDLISVPAGVYRGLFNHGEEEALMCVMLGTAKPEIPTYPADHPLSKGRPVVLLHGISSGSASWIKQLNDSGLTDGHRLLAWDAPGYGGSLPLADPQADAAGYAAALAALIDELQLAQPLIVGHSLGALIGSAYAAGYPDGLCGLVLADPAQGYATAPEEKRRQVYGQRQQMIETLGPVGYGEQRAAALLREGADPQDIAWVRNGMQQLDPDGFLRAAWMLANDDIGRYLARYRGPLEVWCGEQDRITPPEKAAELAREQDATLRLIAAAGHASYLDAPANPTMNFQLENRVAVVTGGSSGIGFETLKLLLAEGAKVAFCGRDPDKLAGAEASLRADFPQAEILALRCDVLDAQQVAQFAAQVTAHFGGVDLLINNAGQGFVAHFDQTPREAWLHEAELKLFGVINPVQAFLPALERSAIASITCVNSLLALQPEEHMIATSAARAALLNMTLTLSKELVGKGIRVNSILLGMVESGQWRRRFDERSDKDQSWEQWTAAIAERRGIPMKRLGKPQEPAQALLFLASPLASFTTGAALDGPIKMKKIMMIGYGAMAKEVIARLPEGVEVGADPSRAVFAAAGSGAGVRQPAGGGGVRRSGAAARLAAGADLDRRAGGRRIATAAAAGLPPPSRAADRAVRCGGGDGWAGVGARRRAGERDLSGQQKSGQLARQPGGAADRPRC

SEQ ID NO: 156894 - protein, 280 aa, Glycine max
  Coding DNA Sequence Number=SeqID_40116
  Gene Ontology: Mol. function=thiamin pyrophosphate binding; Cellular component=chloroplast; Biological process=branched chain family amino acid biosynthetic process
  Homolog annotation: Hit_ID=Q1R1A1; Match level="QueryCoverage=99%, HitCoverage=51%, E-value=2e-82, Identity=56%"; Hit description =Thiamine pyrophosphate enzyme-like TPP-binding
  Pfam annotation: Domain name=TPP_enzyme_C; Domain location=114-261; Score=122.7; E_value=1.1e-33; Accession=PF02775.11; Description =Thiamine pyrophosphate enzyme, C-term
CDLTLVAGSRLRSNETRTWTLPLPRPLVQIDIDPAAANRNYLADEQINGDCAALLSALAARLSPGEKVNAEWDAEIAGAVQQAERALRQQSGEYAKLNDAIDAALPQDGLLVRDITVSGSVWGSRLFRAISPLCNIHSLAGAIGMGLPMAIGTAIANPQRKVVGLVGDGGLALGLGELATMAQEQVNITLIIMNDGGYGVMRGIQDKYFAGRQYYNELHTPAFTQIAEAMGLKAWKVDAASQFNGVLAEAINYPGPSVVEVDMKQVGPLTFAGPPQKTLY

SEQ ID NO: 156895 - protein, 67 aa, Glycine max
  Coding DNA Sequence Number=SeqID_40117
MGQCTGDPICLVLGRSVTRGGETTSGEFGEGDGTTRTLWSELSRGQGEEIGRTSWRDEEWSTEDENK

SEQ ID NO: 156896 - protein, 124 aa, Glycine max
  Coding DNA Sequence Number=SeqID_40118
  Homolog annotation: Hit_ID=Q1S1B7; Match level="QueryCoverage=40%, HitCoverage=7%, E-value=9e-17, Identity=80%"; Hit description =Integrase, catalytic region
MSVLSHLPHQIHLKLSLHLWLPIYPGQDRLDLQYLKPLLMILVLLQPVLHSWILPRLSLLLLILTHIDPLPSGKALENNGTWELVPLPPGKMTVGCRWVYTVKVGPNGKVDRLKARLVAKGYTQ

SEQ ID NO: 156897 - protein, 173 aa, Glycine max
  Coding DNA Sequence Number=SeqID_40119
  Gene Ontology: Mol. function=chitin binding; Cellular component =extracellular region; Biological process=chitin metabolic process
  Homolog annotation: Hit_ID=UPI00006A17C9; Match level="QueryCoverage =64%, HitCoverage=100%, E-value=1e-14, Identity=33%"; Hit description= UPI00006A17C9 related cluster
LHAPTFRGLYAFAFRGLHVLPFRGLHIIPFRGLHVLHFKGVHVLPFRGLHILAIKGLHVLPIRGLPVLKFRGLHFLPFEGLHALAFRGLQILGFSGLHALTFVGVHALAFIGLHICAFRELKTNCASTTREGGYHVATVHNGARFHLCRYKETSVDHAHQHDPSYKDMDDVAT

SEQ ID NO: 156898 - protein, 69 aa, Glycine max
  Coding DNA Sequence Number=SeqID_40120
MARTHDAILYYNGKWNMSPQNKFVGCAFTGKNPKKFQIPSTCTIDELKNLIKQVAPKGIPHLGIHESQT

SEQ ID NO: 156899 - protein, 106 aa, Glycine max
  Coding DNA Sequence Number=SeqID_40121
MEETHEIPHHNLADFEPWLGYATEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 156900 - protein, 64 aa, Glycine max
  Coding DNA Sequence Number=SeqID_40122
MEQVSIGYQNWGEFYRLFTAKFLPWLVFWFVLKVVFSIGCVEGKEKGCYWLSNDIVGLVGNLAV

SEQ ID NO: 156901 - protein, 147 aa, Glycine max
  Coding DNA Sequence Number=SeqID_40123
MALGSKRVLHPLMMKATNQLKIIPLFFESFWKSSMVFKLLLVTSLIIWNCKSTCGLMSWNQGSPKKKKMSPSSVLALIHHHRLHHPLSLYVIIKTKYCHHQKGGDCRQRIKLKVLMMPKDYMNHMLLKDLLKTKQLELIKMDDQDSL

SEQ ID NO: 156902 - protein, 40 aa, Glycine max
  Coding DNA Sequence Number=SeqID_40124
MSRMYKFYSLTLSSCLRHARLLEDIEFGVEGNTRSVVFKE

SEQ ID NO: 156903 - protein, 99 aa, Glycine max
  Coding DNA Sequence Number=SeqID_40125
  Subcellular localization annotation: CTP_CleavageSite=78; ConfidenceScore=5.48e-01
MLNANYSAKQRTKKRDKRVFSLSFLNPSSPRLAFGSPRLPNYFRVKEPAHLGELLLAWVSMLGRLRRGSKVQRVRKLREERKKKKKKRKRSRGATESRP

SEQ ID NO: 156904 - protein, 249 aa, Glycine max
  Coding DNA Sequence Number=SeqID_40126
  Homolog annotation: Hit_ID=Q47522; Match level="QueryCoverage=30%, HitCoverage=91%, E-value=1e-14, Identity=60%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGIRCSDSGKLQVRTPSGRYNVHNVSYADPHILITDPFMWNCDDGENYRPTRPFSLDTSTRFKLSPHNEYLFFNCSEDHVIVKPKPIFCERFPERCDSSCDSGSIKLIDTVDLEGGPVGKPVVPAALMNRPTRGERRFAYWALAECILAYYVGTDEGVSEVLHVAGEKRLH

SEQ ID NO: 156905 - protein, 63 aa, Glycine max
  Coding DNA Sequence Number=SeqID_40127
  Subcellular localization annotation: CTP_CleavageSite=41; ConfidenceScore=5.14e-01
MSVKNLVGHLRVHDKTNHTLASQVTLTRLKRALKPGVFTPKAYTPKSPSGSLPPDSGPTQKTF

SEQ ID NO: 156906 - protein, 69 aa, Glycine max
  Coding DNA Sequence Number=SeqID_40128
MHGAIGDGAFDRDEPRGCVATVTGDSSDVATCNGALAMQGGVAGQTSASLRVCFLQVQLLLKTPAPLAI

SEQ ID NO: 156907 - protein, 224 aa, Glycine max
  Coding DNA Sequence Number=SeqID_40129
  Gene Ontology: Mol. function=transcription regulator activity; Cellular component=nucleus; Biological process=regulation of transcription
  Homolog annotation: Hit_ID=Q9FLI1; Match level="QueryCoverage=76%, HitCoverage=97%, E-value=1e-08, Identity=25%"; Hit description =Arabidopsis thaliana genomic DNA, chromosome 5, P1 clone:MIO24
  Pfam annotation: Domain name=HLH; Domain location=13-65; Score=33.9; E_value=5.6e-07; Accession=PF00010.16; Description=Helix-loop-helix DNA-binding domain
MDQLGIIQPSSSTKVERRLVEKNRRNQMKILCNKLNSLLPSYNPKEALPLPDQVDEAINYIKSLEAKVKMAQEKKECLQGIRKRSRDCFSNNSTNFAATSAGFPKSPQLEIHEVGSSLQVVLTCGLDHQFIFSEIIRMLHEENIDVRSANSSLAGDSMLHVVHAEIPQSLLQFGATKVSQRLKRFVNGSCSDVETQPELWDFEIGTDDMWGLYILQGCILPNVV

SEQ ID NO: 156908 - protein, 112 aa, Glycine max
  Coding DNA Sequence Number=SeqID_40130
MINDGTYEFGDSTVMWLRMPLDSWVTVTKGGVVDKSRAFAPTYPQFVMRNSDLRNTGSNKDRRKSLKVYQSHTGQGLTFSPWVKVYDKLGFWLKACRTAGHDICQVWPTVRG

SEQ ID NO: 156909 - protein, 161 aa, Glycine max
  Coding DNA Sequence Number=SeqID_40131
  Gene Ontology: Mol. function=magnesium ion binding; Cellular component=membrane; Biological process=metabolic process
  Homolog annotation: Hit_ID=Q1T1D0; Match level="QueryCoverage=75%, HitCoverage=29%, E-value=3e-42, Identity=55%"; Hit description =Terpene synthase-like; Terpenoid synthase
  Pfam annotation: Domain name=Terpene_synth_C; Domain location=1-161; Score=21.7; E_value=9.1e-07; Accession=PF03936.6; Description =Terpene synthase family, metal binding domain
MVHALELPSHGRVPYGLRWWENLGIKEDLSLARNRLVESFLCAAGVAFEPNYTSGRKWLTKVIIFVLVIDDVYDIYASFEELKPFTMTFERWDEKDLEELPEYIRICVHALKDVRNEIAYEILFLRMLSEMKLPYLKKVVMVLLMTAPSVHFYLTFKVIII

SEQ ID NO: 156910 - protein, 84 aa, Glycine max
  Coding DNA Sequence Number=SeqID_40132
  Gene Ontology: Mol. function=magnesium ion binding; Cellular component=chloroplast; Biological process=metabolic process
  Homolog annotation: Hit_ID=Q1T1D0; Match level="QueryCoverage=89%, HitCoverage=13%, E-value=2e-26, Identity=75%"; Hit description =Terpene synthase-like; Terpenoid synthase
MKQAERERGDTASSILCYMNEMNVSEEKARKKIQDMINKAWKKINGHCSTQVASMKPFLNQAINAARMAHTLYQNEDAWFWYPG

SEQ ID NO: 156911 - protein, 177 aa, Glycine max
  Coding DNA Sequence Number=SeqID_40133
  Gene Ontology: Mol. function=DNA binding
  Homolog annotation: Hit_ID=Q1S0F5; Match level="QueryCoverage=85%, HitCoverage=31%, E-value=2e-14, Identity=35%"; Hit description=IMP dehydrogenase/GMP reductase
MVEEFEEILGCPLEGRRPYLFSGFYPSLARISKIVQISAQELDHRKQVKNGVVGIPRKYLEAKARILAGKGEWAPFIDILALLIFGGVLFPNVDGLVDLAAIDAFLAYHDHKESPIVAMLADLYDTFDRRCEKSGTRIVCCTPALYVSLVSHLFRQEVRHACSLESHHSCTEKGGAN

SEQ ID NO: 156912 - protein, 402 aa, Glycine max
  Coding DNA Sequence Number=SeqID_40134
  Homolog annotation: Hit_ID=Q5KS41; Match level="QueryCoverage=90%, HitCoverage=76%, E-value=4e-36, Identity=28%"; Hit description =FOLDED PETALS
  Pfam annotation: Domain name=DUF1298; Domain location=238-392; Score =19.8; E_value=4.6e-11; Accession=PF06974.4; Description=Protein of unknown function (DUF1298)
  Pfam annotation: Domain name=UPF0089; Domain location=2-190; Score= -104.6; E_value=0.0068; Accession=PF03007.7; Description =Uncharacterised protein family (UPF0089)
  Pfam module annotation: Pfam domain module=DUF1298::UPF0089; Domain location=238-392::2-190
MRWKRVQVNPEEHVKVPRFPECNSAELYDHYFDEYVTRILNERTPQNKPLWEVHLIKYPTSNAAGTIIFKFHHSLGDGYSLMGALLSCLQRTDDPSLPLTFPSRVSSNPQHAKKTIFKKLHSVISSFFSSMLDFGSSVIKAKMIEDDKTPIRSGYEGTKPQHFTLSNISLSLDHIKAIKSNLGVTINDVITGIIFYGIRLYMQEIDYMTRKANSTALVVLNTRNIRGYQSVKEMQKPKVKGLWGNKISFLQIPIPKLDQPKISNPLEFVWNARKQIKRKKHSFSVYLIGLLLDLEMKLRGPEVASKTFYNTLGNCSVLISNMFGPLEQMALANHPVRGVYFAMSGGPQNVNVAIMSYVGELRITLKTLKGFIDEQKFKFCIEKAFDEIFKDAMEIYEIPNKI

SEQ ID NO: 156913 - protein, 142 aa, Glycine max
  Coding DNA Sequence Number=SeqID_40135
  Gene Ontology: Mol. function=hydrolase activity, acting on carbon -nitrogen (but not peptide) bonds, in cyclic amides; Cellular component=mitochondrion; Biological process=pyrimidine nucleotide biosynthetic process
  Homolog annotation: Hit_ID=O04904; Match level="QueryCoverage=79%, HitCoverage=30%, E-value=1e-50, Identity=80%"; Hit description =Dihydroorotase, mitochondrial precursor
MPLSRDNDHHVDNCYQTVQVLVILPWAIVSAVTSGSKRFFLGTDSAPHDRRNKECSCGCAGIYNSPVALSLYAKVFEEAGALDKLEAFTSFNGPDFYGLPRNKLKIRLRKAPWKVPDYLSFPFGDIVPMFAGETLEWEALPC

SEQ ID NO: 156914 - protein, 73 aa, Glycine max
  Coding DNA Sequence Number=SeqID_40136
MVTKQNKHWQNQCETAQEITLKPSGDRDLNVGRQKRELHGLTELDAGGDGRTESDWKTANGGRSGGRRRRLTQ

SEQ ID NO: 156915 - protein, 149 aa, Glycine max
  Coding DNA Sequence Number=SeqID_40137
  Gene Ontology: Mol. function=hydrolase activity, acting on carbon -nitrogen (but not peptide) bonds, in cyclic amides; Cellular component=mitochondrion; Biological process=pyrimidine nucleotide biosynthetic process
  Homolog annotation: Hit_ID=Q8VXS9; Match level="QueryCoverage=89%, HitCoverage=38%, E-value=4e-56, Identity=75%"; Hit description =Dihydroorotase
MELTITQPDDWHLHLRDGSLLQAVLPHSAKQFGRAIVMPNLKPPITTTSAAVAYRESILKAIPKDSNFNPLMTLYLTDMTTPDEIKLAKKSGLVYGVKLYPAGATTNSQDGVTDIFGNCFSVLEEMAEKNLPLLNVITTYGTNFGACPL

SEQ ID NO: 156916 - protein, 116 aa, Glycine max
  Coding DNA Sequence Number=SeqID_40138
  Homolog annotation: Hit_ID=O22958; Match level="QueryCoverage=40%, HitCoverage=18%, E-value=9e-17, Identity=80%"; Hit description =Expressed protein
MYSNGSKQYNQNFLSFNPPFLEYHIGRGHIGATMKAKLYHLLEHRASECRYFVIPLWRGSGYTTMFIQGPGQFMDSYKLLLTPFEYTLPIKKSNSNLSLHMAKDMLPLNKFSTYKN

SEQ ID NO: 156917 - protein, 129 aa, Glycine max
  Coding DNA Sequence Number=SeqID_40139
MERQRLNQNEETDKRKRSIALKAPSSMQEEEESDDEEDFSLFVKKFHKFVKNRRMERSHNFNNGKRSQEANCPSNESWPEKNEKKSYKERRSKKAYMAWDDDDSSDGLKKEINLLSKGYESDENISQEV

SEQ ID NO: 156918 - protein, 109 aa, Glycine max
  Coding DNA Sequence Number=SeqID_40140
MWAIIDQYKEKLSLVEAHEQRLEDEYAKVCIHLEWKSRASEIASQSQGENTITKHALRHPYRTYSKTRVMGDVEEVQEQMKADMVTLKDQMASMMEAVTTRLVTTVSTL

SEQ ID NO: 156919 - protein, 33 aa, Glycine max
  Coding DNA Sequence Number=SeqID_40141
MTDSIGNSNRRPNAIPSLGTQAFSFNARKHTYG

SEQ ID NO: 156920 - protein, 198 aa, Glycine max
  Coding DNA Sequence Number=SeqID_40142
  Gene Ontology: Cellular component=fimbrium; Biological process =pathogenesis
  Homolog annotation: Hit_ID=UPI00005F9DAB; Match level="QueryCoverage =70%, HitCoverage=82%, E-value=2e-21, Identity=39%"; Hit description =COG3539: P pilus assembly protein, pilin FimA
  Subcellular localization annotation: CTP_CleavageSite=39; ConfidenceScore=5.14e-01
MVTRVRQTAAALLLCGSSVMASAQAATVKVSVTVMQPLPCTINGGRPIEVDFGDEVMTTRINGNFYRMPIDFSFTCNNPYKNAMRLQVQGGTANFGQGLLGTSRDGLAILILQRQGGDQLPLNSWHNFSYPNPVKLDAVPGAALAAEEVAMQFRGGLIAPPPCTINAGAKIDVDFGSRVGIKKVDGVNYRQAIDYHLD

SEQ ID NO: 156921 - protein, 112 aa, Glycine max
  Coding DNA Sequence Number=SeqID_40143
  Gene Ontology: Mol. function=iron ion binding
  Homolog annotation: Hit_ID=Q6D8J9; Match level="QueryCoverage=69%, HitCoverage=86%, E-value=7e-36, Identity=89%"; Hit description =Probable Fe(2+)-trafficking protein
  Pfam annotation: Domain name=Iron_traffic; Domain location=34-110; Score=158.7; E_value=1.6e-44; Accession=PF04362.5; Description =Bacterial Fe(2+) trafficking
MWLSLDAAGSGMDEGAGLWYNLAQPPSVGLAAPRDAEGQDFQLYPGDVGKRIYNEISKEAWGEWMKKQTMLINEKKLNMMNVDDRKLLEEEMIKFLFEGHDVHIEGYTPPSE

SEQ ID NO: 156922 - protein, 450 aa, Glycine max
  Coding DNA Sequence Number=SeqID_40144
  Gene Ontology: Mol. function=hydrolase activity, acting on glycosyl bonds; Cellular component=outer membrane; Biological process=cell wall catabolic process
  Homolog annotation: Hit_ID=Q8ZHE6; Match level="QueryCoverage=77%, HitCoverage=98%, E-value=1e-164, Identity=81%"; Hit description =Membrane-bound lytic murein transglycosylase C precursor
DANVEFIRDNVELVPIGQAEGRIAAEGALPVGRRGAALLPGAGRGHQPPAGLLAGVAGGLHREKRSRLEAHLRLYDQAIEKGPVRTGPSHLSTRNALLSAVALLRGIHFHQIAARLGGRVLGGQRLIHVARLHGVDDAHRARSVAGEHPQHAAGAAVVGGDHRIAARGRVLNAAQVVVLQDRQVGGAGVDVVLRIEQVAAARGAPLAAHLEHILAGGVLHHLHQAQRVRTAHRIRVEARFGLHDSQDQRLVHAVFFRRLAHHRQIFVRTFVQVVRHQLDGDRVDHVQAGGAFLQLGLQQVIGEVRRAPFPADRRALVIQHLAVQERFFADLDIVGVGIEIDGARIVTHQQRADDRLAQVRGRIGGGDGLDGNGAGVEVDVAAGLVLVGIFDVVFRPGDQNFVQTPDVLDVVGELAHQNVEAVGIFNPGFVDFFTFFAGTGDQQRRYYEQS

SEQ ID NO: 156923 - protein, 456 aa, Glycine max
  Coding DNA Sequence Number=SeqID_40145
MSSFLFDSTIGIGDSDSGDSIQQPLMDREVISIGGSFLEDTRCGTSDSESSFSKRVRASCRTDGGTSCLHERAWPSADFGEPISINVILPSSASGEVRKVRDDVLKYRFVLTFTANVVALRCQVKMASLEDCYKITVHACGSDDFPFLRVASGLVLSLVIFQCALLEQLNVASSQLYPNSWAMVRTFEFLCPFFNIQPNVSVFLYFFLMKLAGKIGWIFLNNVSKKLFEFDSKVFRRFKDCFFKVLDSGVVTDGFPLMLNKDKEPHFPFYWEVDPTMFKSFDEDLLVLMEKMHKAILKLELTLARVVVARFAGIMGDFAWRPLMKQVGLAVGIMPPSATAATEGGQPVVEIGPIVVNTAKIAPNAPSLPIPLYGLRGSRMIVLVAYYALKRSTGVSKLSMDLGGSPPYQASICSCGSMVSSYCSKLSGFQPKAFSAPPHGVAPSLQCSFGVAEEYL

SEQ ID NO: 156924 - protein, 83 aa, Glycine max
  Coding DNA Sequence Number=SeqID_40146
SVWKCNSSNKVLAFSWKLLHDRLATKENHDYEGPSSQDEITTSPSSSESEEAKEEESSEEIDSQEERDLLMVRRLLGGQSCNL

SEQ ID NO: 156925 - protein, 111 aa, Glycine max
  Coding DNA Sequence Number=SeqID_40147
  Homolog annotation: Hit_ID=Q5KS41; Match level="QueryCoverage=62%, HitCoverage=14%, E-value=3e-09, Identity=42%"; Hit description =FOLDED PETALS
MERTPQDKPLWEIHVIKYPTSNAAGTLIFKLHHALGDGYSLVGALLSFLQRADDPSLPLLFPSRKPSASPSSTKGFFRWSTVKSSIIVEDDKTPIRSGEEGVDLRNFIIPS

SEQ ID NO: 156926 - protein, 78 aa, Glycine max
  Coding DNA Sequence Number=SeqID_40148
MKLGGRRKYPSGYPHKHSFATYKTQRMIVCVGTYPSAGGRLETRGGEFQERNTHGVATNVYLRKTSEKPKKTLSTNFK

SEQ ID NO: 156927 - protein, 100 aa, Glycine max
  Coding DNA Sequence Number=SeqID_40149
MTRTLQIAFKCVLWSNLGARVSKYLDQQQQTLFHLFLSGVVVKELRLGFAARLAKKAEVRAMFWVGSDERSLHNIVNLIDAVEYSLSLLRKGQLPPRYIK

SEQ ID NO: 156928 - protein, 130 aa, Glycine max
  Coding DNA Sequence Number=SeqID_40150
MNSKFLSLLSKGSSHGINVNFTSISEVVISLNQDRALNEYHPLSEAAARLASKRNLERNLSRQHALSASSARSARRLSLLALSVPGSLSQNPLTRAKRENDAKYAFELKGDILPWKAKPPQLENPTGNLT

SEQ ID NO: 156929 - protein, 107 aa, Glycine max
  Coding DNA Sequence Number=SeqID_40151
  Gene Ontology: Mol. function=electron carrier activity; Cellular component=membrane; Biological process=electron transport
  Homolog annotation: Hit_ID=Q2PER5; Match level="QueryCoverage=62%, HitCoverage=21%, E-value=2e-18, Identity=58%"; Hit description =Putative early nodulin-like 2 predicted GPI-anchored protein
  Pfam annotation: Domain name=Cu_bind_like; Domain location=35-105; Score=42.2; E_value=1.8e-09; Accession=PF02298.8; Description =Plastocyanin-like domain
MAIFHRFLGLLILMAPMLLLHVVARQFDVGGKDGWVLKPTEDYDHWAQRNRFQVNDTLHFKYNKGIDSVVVVKKEDFDSCNINNPIQKMDGVVIQPSNFPILAFFTS

SEQ ID NO: 156930 - protein, 47 aa, Glycine max
  Coding DNA Sequence Number=SeqID_40152
MGHGGGFGPQQGPGTVAIPANNAGPKLAGVVAGLCGEAGEEGCFGTW

SEQ ID NO: 156931 - protein, 67 aa, Glycine max
  Coding DNA Sequence Number=SeqID_40153
MGHGGGFGSQQGPGAIAVPTNTAGTELAGVAAGLLGEAGEEGGAACNVLENDNSLLVTSTDQCYFSM

SEQ ID NO: 156932 - protein, 165 aa, Glycine max
  Coding DNA Sequence Number=SeqID_40154
MKDKRAEEEKLEKQKKKKDSKALSSKAKGKEKEEKDSSKKIVKKENHFATKGHITRALLLKQSFYLLKHPLAPPYLLSLRNNQHENKEKVIKGLPMDPKRIKVIPEWPTPPSVQERIHEFQEPLDLRSNPCQGGGNDAILLPQGHWIEDSKKIGPKMQEKALGLS

SEQ ID NO: 156933 - protein, 220 aa, Glycine max
  Coding DNA Sequence Number=SeqID_40155
  Gene Ontology: Mol. function=DNA binding
  Homolog annotation: Hit_ID=Q1SFS3; Match level="QueryCoverage=89%, HitCoverage=44%, E-value=3e-15, Identity=28%"; Hit description =Lambda repressor-like, DNA-binding
MVEEFEEILGCPLGGRRPYLFLGLYPSLARISKIVQISAQELDCRKQVENGVVGIPRRCLEEKARNLAGKGEWAPFIDIVVMLIFRGVLFPNVEGLVDQAVIDAFLAYHSHKESPVRHACPLESHHSCTEKGGANWDQLLANKEGASIKWFPRWKEGRTRVLISCKGFPNVPSMGTRGCISYNPVLAIRQLGYPMRGAPLEEEIAPVISRGFNKTNMETL

SEQ ID NO: 156934 - protein, 128 aa, Glycine max
  Coding DNA Sequence Number=SeqID_40156
  Gene Ontology: Mol. function=calcium ion binding; Cellular component =flagellin-based flagellum; Biological process=ciliary or flagellar motility
  Homolog annotation: Hit_ID=Q93YA8; Match level="QueryCoverage=70%, HitCoverage=57%, E-value=6e-20, Identity=57%"; Hit description =Calcium binding protein
MLRNFTDYLTMGVKYLEVVKRRLHATKQWSPDEIRVIIIVLNSLKLMYPSPSASMDLIMSRHSSTEHLRPRWLSARWSPATEIRPFLLWSLRSTVGRGVRATKGGKLCEADEAVAVSVKVFYDAVKIL

SEQ ID NO: 156935 - protein, 56 aa, Glycine max
  Coding DNA Sequence Number=SeqID_40157
MAAVRGAGLDDEGMSSVLALFLDAICKKGIQTTAKVKVVQLKKFRNELHLAYGSSA

SEQ ID NO: 156936 - protein, 45 aa, Glycine max
  Coding DNA Sequence Number=SeqID_40158
MTVVVGSGSGSDNKDHDRHSSEGGMINDGASSNNDYGGGTYNHEI

SEQ ID NO: 156937 - protein, 392 aa, Glycine max
  Coding DNA Sequence Number=SeqID_40159
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=7e-47, Identity=30%"; Hit description= UPI00006A17C9 related cluster
LTLHVLAFRGLHALAFRGLHVLAFRALHILAFKGLHAVAFSGKHVLTFRGLHVLAIRGLHALTFRGLHVLTFRGPHALTFRGLRTITFKGLHVLAFRRLHALTSRGLRVLAFKGLQALTFRGLRTLTFRGLPVLAFSGVHTVAFRGPHALAFRELHVVALRGLHALTFNGLHVLAIRGLHALAFRGLHTLTFRGLRSLTLRGLHILAFRGPHALALRGLHVLALRGLHALTFRGLNVLAVRGLKALTVKGQHVFAFRGLQALTFRGLHVLTFRGLHILALTGLHALAFRGLHVLSFRGLQVFAFRGLHAVSFRGLHVLTFRGLHVLAFRGHHALTFRGLHVLAFRGLHAPTFRGLHVLTIRGLHALAFRGLHVLTSEDYRSSPSEVCPSSPS

SEQ ID NO: 156938 - protein, 91 aa, Glycine max
  Coding DNA Sequence Number=SeqID_40160
MLRLIFSLVLQEYNRMKPCKVSYQNIKQKMKFGNQELPGIICALYNVCIADNQGVPLLTKVSPSGKGYTAFVLLLEPHKGVYTNFKDLCLA

SEQ ID NO: 156939 - protein, 151 aa, Glycine max
  Coding DNA Sequence Number=SeqID_40161
MMASKKRKATATPSKVRYDRSKFTYPEAWERKNWRGRRWDEELTSFDEGSIDVAIVEFYANLYDPKDKSPKQLCIPGRGFKLNADGQPLKILKKNMTILAQTWSILSYSILIPTSHTSDCRSKLYDESRLIQRVLMITKKMTKRSNVKNTS

SEQ ID NO: 156940 - protein, 141 aa, Glycine max
  Coding DNA Sequence Number=SeqID_40162
MMDYIAIKITTCPSNFTAQNYPCHVMKLLPEDHRDYPYLFNDEYESWDVQGNTQYQYNLMRAQIQGYQWFFSEEDKLFQKEKKDKEIYEASGCHGQQTPHFPSIDLSMEDSSDIFCSGNIQDEEDVTITKASKSLRPMYPA

SEQ ID NO: 156941 - protein, 297 aa, Glycine max
  Coding DNA Sequence Number=SeqID_40163
  Gene Ontology: Mol. function=nucleic acid binding; Cellular component= nucleus; Biological process=transcription from RNA polymerase II promoter
  Homolog annotation: Hit_ID=Q5WMW4; Match level="QueryCoverage=99%, HitCoverage=39%, E-value=1e-109, Identity=58%"; Hit description =Uknown protein
  Pfam annotation: Domain name=DEAD; Domain location=10-182; Score= -14.0; E_value=8.6e-05; Accession=PF00270.19; Description=DEADDEAH box helicase
  Pfam annotation: Domain name=ResIII; Domain location=6-176; Score= -13.5; E_value=0.00062; Accession=PF04851.6; Description=Type III restriction enzyme, res subunit
  Pfam annotation: Domain name=SEC-C; Domain location=241-261; Score =21.0; E_value=0.0021; Accession=PF02810.6; Description=SEC-C motif
  Pfam annotation: Domain name=SNF2_N; Domain location=12-261; Score =139.2; E_value=1.1e-38; Accession=PF00176.13; Description=SNF2 family N-terminal domain
  Pfam module annotation: Pfam domain module=DEAD::ResIII::SEC-C::SNF2 _N; Domain location=10-182::6-176::241-261::12-261
VPASINCKLLEYQREGVRFLYGLYKNNHGGTLGDDMVLGKTIQAIAFLAAVFGKEGQSTLNENRVEKRDHALIICPTSVIHNWESEFSKWSSFSVSIYHGANRDLIYDKLEANEVELLITSFDTYRIHGSSLLDINWNIVIIDEAHQLTNEKSKLYKACLEIKTLRRYGLTGTAMQNKIMELFNLFDWVAPGSLGTREHFREFYDEPLKHGQRSTAPDSDVQKRVYRRMLQLPDIQCLINKNLPCSCGSPLTQVECCKRLVPDGAIWPYLHRDNHDGCDSCSFCLVLPCLVKLQQVE

SEQ ID NO: 156942 - protein, 180 aa, Glycine max
  Coding DNA Sequence Number=SeqID_40164
  Gene Ontology: Mol. function=protein serine/threonine kinase activity; Biological process=protein amino acid phosphorylation
  Homolog annotation: Hit_ID=Q336U5; Match level="QueryCoverage=45%, HitCoverage=9%, E-value=3e-12, Identity=44%"; Hit description=U-box domain containing protein, expressed
  Subcellular localization annotation: CTP_CleavageSite=30; ConfidenceScore=5.10e-01
MCLFVPLNVGLSIGPRQQPLATVFVRVKVVLDVKRNPHTCRYRAPISISSPSLTLFCFCLHDRHLGYRKIRAIPRFGFLYHSDPCIIHGNSKPSKVLLDANFATKLNDLGIPSLVQQSLDSTGISTICNNPNERLEYMDPEYFVTGKLTPESDVYSFVVILLQLLTRRPLLGLVRGTSLI

SEQ ID NO: 156943 - protein, 164 aa, Glycine max
  Coding DNA Sequence Number=SeqID_40165
MKGSVKVKVPMFIVAVVGSSAAANEIKLIHKAFTDQTLQINLICNLVHGQNYLRIIFILTYTNYGRPKSLCGSILSYEVHYKTKNGSTNIEGRTCLPQHQWSSTTRRRTHKVKSTTTTSPTIVKKQQPRRRKQERAKPSRGRGSKNAQKEEEEEALRSRKEEEE

SEQ ID NO: 156944 - protein, 58 aa, Glycine max
  Coding DNA Sequence Number=SeqID_40166
MLKSGNNGDNILSGGDNIDENDGGVNNNDSNDGNDNDDVGNNDNNNNNVGNIGGDQIS

SEQ ID NO: 156945 - protein, 81 aa, Glycine max
  Coding DNA Sequence Number=SeqID_40167
  Gene Ontology: Mol. function=protein serine/threonine kinase activity; Biological process=protein amino acid phosphorylation
  Homolog annotation: Hit_ID=Q7XIR5; Match level="QueryCoverage=84%, HitCoverage=19%, E-value=1e-12, Identity=46%"; Hit description =Serine/threonine-protein kinase bub1,checkpoint-associated-like protein
MELIIYRLLSFRSLSPANSYWNIELWKTFFTKMLNQYPHDDDRSLLQDLKKSFQDYLSSNPQLIKKLKELLSKQRASLCSA

SEQ ID NO: 156946 - protein, 419 aa, Glycine max
  Coding DNA Sequence Number=SeqID_40168
  Gene Ontology: Mol. function=protein binding; Cellular component =cellulose and pectin-containing cell wall; Biological process =protein amino acid phosphorylation
  Homolog annotation: Hit_ID=O49448; Match level="QueryCoverage=79%, HitCoverage=85%, E-value=1e-130, Identity=66%"; Hit description =Extensin-like protein
  Pfam annotation: Domain name=LRRNT_2; Domain location=57-96; Score =17.6; E_value=0.013; Accession=PF08263.3; Description=Leucine rich repeat N-terminal domain
  Pfam annotation: Domain name=LRR_1; Domain location=130-152; Score =15.3; E_value=0.23; Accession=PF00560.23; Description=Leucine Rich Repeat
  Pfam annotation: Domain name=LRR_1; Domain location=154-177; Score =8.1; E_value=8.9; Accession=PF00560.23; Description=Leucine Rich Repeat
  Pfam annotation: Domain name=LRR_1; Domain location=178-200; Score =12.6; E_value=1.3; Accession=PF00560.23; Description=Leucine Rich Repeat
  Pfam annotation: Domain name=LRR_1; Domain location=201-223; Score =3.6; E_value=60; Accession=PF00560.23; Description=Leucine Rich Repeat
  Pfam annotation: Domain name=LRR_1; Domain location=224-246; Score =3.2; E_value=71; Accession=PF00560.23; Description=Leucine Rich Repeat
  Pfam annotation: Domain name=LRR_1; Domain location=249-271; Score =9.7; E_value=4.3; Accession=PF00560.23; Description=Leucine Rich Repeat
  Pfam annotation: Domain name=LRR_1; Domain location=273-295; Score =16.2; E_value=0.12; Accession=PF00560.23; Description=Leucine Rich Repeat
  Pfam annotation: Domain name=LRR_1; Domain location=297-319; Score =10.8; E_value=2.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=57-96::130 -152::154-177::178-200::201-223::224-246::249-271::273-295::297-319
MASASASYSFTISVLFLIFVHLSCFINNLNAKHTNASSHNHHHKHQHTQNPSLNTRLHMAFLGLQAWKQVIYSDPNNFTSNWVGPSVCNYTGVFCAPSLDDPKVTVVAGIDLNFADLAGFLPNEIGLLSDLAVLHLSNNRFCGILPKSFTNLTLLYELDLSNNRFVGPFPLVVFSLPLLKYLDLRYNEFEGPLPPQLFNNTIDAIFVNNNRFISTIPPNLGKISASVLVFANNKFGGCLPESIVNFADTLEELVLINTSLSGCLPQQLGFLYKLRVLDVSFNSIVGPIPYSLSGLSHLEQLNLGHNMMSGTVPVGVCELPNLANFTFSYNFFCEEEGICKNLTSKRIVFDDRRNCLPEKPLQRSEKECKAKLEHPVDCSELCCVVGSNNNNVSAAGSVAVPPAAAAMPVSAPLLAPSHP

SEQ ID NO: 156947 - protein, 39 aa, Glycine max
  Coding DNA Sequence Number=SeqID_40169
MDGYKDGVPYLPTPSSTCMKRFQVGIESIFRIIAPSVQY

SEQ ID NO: 156948 - protein, 393 aa, Glycine max
  Coding DNA Sequence Number=SeqID_40170
  Gene Ontology: Mol. function=protein serine/threonine kinase activity; Cellular component=nucleus; Biological process=protein amino acid phosphorylation
  Homolog annotation: Hit_ID=Q7XIR5; Match level="QueryCoverage=52%, HitCoverage=55%, E-value=2e-62, Identity=56%"; Hit description =Serine/threonine-protein kinase bub1,checkpoint-associated-like protein
  Pfam annotation: Domain name=Mad3_BUB1_I; Domain location=10-123; Score=65.0; E_value=2.4e-16; Accession=PF08311.2; Description =Mad3BUB1 homology region 1
MLSYSPPRFRIAAVDAHHDPLLPFLRSIKKALEASDDSASSLSNLLKDCIRNFKNNDRYRNDVRFLKIWLLYMGVSDDFDSVFKEMLDSNVCTNNSSLYVWSASFFELKGRLHDALTIYQLGICRNTEPIEWLKKARTLFLSRISEIQNAASTQKVDDKESKNLEDNGINPWGTSTMDSLLKKIYPLIMKFDGYRSSTKPYTGKVALSTLKNSSRNKVLEIDNHVTEWFILELGGMKYHIKGCAGQGGFAQVYKANVDSDPDNVVALKIQKPAFPWEFYVYRLLDKRILDRERSSYGFAHRIHVYSDCSILICDYLANGTLQDVINSYVVIGKSMEEVLCIYYTIEMLHMVETLHGVGLIHGDFKPDNLLIRYARGDLTEDGFLSRSGPWCDQ

SEQ ID NO: 156949 - protein, 463 aa, Glycine max
  Coding DNA Sequence Number=SeqID_40171
  Gene Ontology: Mol. function=zinc ion binding; Cellular component =cytoplasm; Biological process=protein amino acid methylation
  Homolog annotation: Hit_ID=Q0PY38; Match level="QueryCoverage=74%, HitCoverage=78%, E-value=4e-63, Identity=41%"; Hit description =Putative zinc finger protein
MNITLWVVLDRKSNFMMNSFLCYVWLGEKKVRKERKVLHLNRSGQRNLDDDETQGDWKHRHNLICPIYSLLQLWIIILAKSGMHIIFGSCKISFHSHGFCCHFLILYPSVSFGECIDKSMRLGNNECPACRTHCASRRSLRDDPNYDALIAALYPNIEKYEQEELEFREEDKNRNKQIQASIAKVVQRQSEALVKRRRDTPGSFVTRSQRNQRNVLSRRQNQGMDNQGSEDNEEENDNNEKDSSSTDERCTELRQRRRKRRTRGRPSQPSSSTASPDGGCIESDMDIRISSRLVSKPQKLTWGRGGFRSHTRHGSGNGSNSKSSRSSRLAKLVDYLHSLNENTDELDVHLILLSLDKQITPSLQQPHLCCRPTLSVKHLCEYVAHQTPLLVEEVEILAVKGCCSTVCDKSFDETSSSDELTTLVIDPSKDELETLQGHESLAGIKSKCISKREHLILAYRRKE

SEQ ID NO: 156950 - protein, 761 aa, Glycine max
  Coding DNA Sequence Number=SeqID_40172
  Homolog annotation: Hit_ID=UPI000065FB42; Match level="QueryCoverage =62%, HitCoverage=82%, E-value=2e-17, Identity=25%"; Hit description =Homolog of Gallus gallus "Restricted expression proliferation associated protein-100.
  Pfam annotation: Domain name=TPX2; Domain location=656-712; Score =65.8; E_value=1.4e-16; Accession=PF06886.2; Description=Targeting protein for Xklp2 (TPX2)
MAVTTEETGGGATVIDHTYEFSAPRFFDFVRGESDEESLKAELWFDTALSYAPSPAFMPKIKTGRSITVDTLCDFNEADKMQKMLASVDDNVLETNIQQQSMTTKAKEDEADKVQKTSANVEDIVLETNIKPQCVTTVKEDDAPCPDKERSENDYKEDSACLKVSSGEAFVEVAKDACTPKPALLKKVATSTNSKKTQNKKMATNTKTQLKSATVKSIAGTPHLVQENQAIKRQKLDGGKSRQILNAKHQTLPHNKSKLGLTVSASTSKYNKEDRKVYVRETPTTPASVPFVSMAEMMKKFQSSTRDLSLPSFVSHTKPKLTLTRPKEPEFETSQRIRPPRVKSSAELEEEMMAKIPKFKARPVNKKILQTATLPPVPRSTPQLPEFKEFHLETLARAHQNADTASIASTEVSHKQSSWKHHITEPKTPLLQTSLRARPPKVKSSLELEQEELEKIPKFKARPLNKKIFESKGDIGVFYHTKKHVTEPQEFHFATDERIPPPAAMADLFGKLSLKSEPSRNHNPIPRNTTPNPFHLHTEERGAEKEKKLVVDLLQKQWEEENARIPKANPYPYTTDYPVIPPKPEPKQCTRPEPFQLESLVRHEEEMQKEHEERRRMEKEEAQMRAFKAQPIIKEDPIPVPEKVRKPLTQVQEFSLHVNHRAVDRAQFDERIKEKEMMYKRYREESEAARMIEEEKELKQMRRTMVPHARPVPNFDNPFCPQKSSKDITKPKSPNLRVLHRKERRKVFNGTAFSSPAANMR

SEQ ID NO: 156951 - protein, 56 aa, Glycine max
  Coding DNA Sequence Number=SeqID_40173
MNHKKDWLDRMPMQNGNREIDEARIWRERGRENMSTKDREGEHRLERSDKDSSDYD

SEQ ID NO: 156952 - protein, 489 aa, Glycine max
  Coding DNA Sequence Number=SeqID_40174
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=74%, HitCoverage=49%, E-value=1e-155, Identity=70%"; Hit description =Putative CRK1 protein
  Pfam annotation: Domain name=Pkinase; Domain location=136-420; Score =314.6; E_value=1.8e-91; Accession=PF00069.15; Description=Protein kinase domain
  Pfam annotation: Domain name=Pkinase_Tyr; Domain location=136-419; Score=32.0; E_value=2e-14; Accession=PF07714.7; Description=Protein tyrosine kinase
  Pfam module annotation: Pfam domain module=Pkinase::Pkinase_Tyr; Domain location=136-420::136-419
MGCICSKSSAIEDSKESVTKKFQSYSTRPSELNVLRLNSTRRVDEGGVKDVLIDGGHVKGSLIERKANGSGQLYGDHHDVKKKLEKPGLTVVDHIGPGRVPKAIEGEQVAAGWPAWLSSVAGEAIKGWIPRSANTFERLHKIGQGTYSTVYKARDVINQKFVALKKVRFDNLDPESVKFMAREIHVLRRLDHPNIIKLEGLITSRMSRSLYLVFEYMEHDLTGLASNPDIKFSEPQLKCYMQQLLSGLDHCHSHGVLHRDIKGSNLLIDNNGVLKIADFGLASSYDPHHNVPLTSRVVTLWYRPPELLLGANHYGVAVDLWSTGCILGELYTGRPILPGKTEVEQLHRIFKLCGSPSDDYWLKLRLSHSTVFRPPHHYRKCVADTFKDYPSTAVKLIETLLSVEPAHRGSAAAALKSEFFTSEPLPCDPSSLPKYAPSKEIDAKLRDEARRQRAVGGREQKVASGVGQEKGHRANVATKDNADPGLLVQ

SEQ ID NO: 156953 - protein, 112 aa, Glycine max
  Coding DNA Sequence Number=SeqID_40175
  Homolog annotation: Hit_ID=Q2QNK6; Match level="QueryCoverage=30%, HitCoverage=5%, E-value=3e-09, Identity=68%"; Hit description =Flagellar biosynthesis protein FLHA, putative, expressed
  Subcellular localization annotation: CTP_CleavageSite=50; ConfidenceScore=5.30e-01
MFAHSIKGCRPLGRTCGVLIPSPCVNTTPEPFNLKVRRSRLFRFFRCFPRINVGGDSARIPFVEHASRESRVALPPKDSLGKWSISLPTKGQPTIIATLVKKPITTTGKRLG

SEQ ID NO: 156954 - protein, 62 aa, Glycine max
  Coding DNA Sequence Number=SeqID_40176
MGEERGNKEVSLTLLPETLSTKLLQPNNITSASLPFVLPYEDLQSTEARSKDDKMKRDLNFS

SEQ ID NO: 156955 - protein, 41 aa, Glycine max
  Coding DNA Sequence Number=SeqID_40177
MGRQAKVSVAGAASLKQDVPTKGGQGWGQDAVLEINEERWL

SEQ ID NO: 156956 - protein, 84 aa, Glycine max
  Coding DNA Sequence Number=SeqID_40178
MDLNKFGMFDAYDLVNIIAEDMGLLSCHPFVLRFRCTNSGKILPVETDNVTATKIGQKVANDTDLEFSKGGNEDEYDYEVSMKV

SEQ ID NO: 156957 - protein, 209 aa, Glycine max
  Coding DNA Sequence Number=SeqID_40179
  Homolog annotation: Hit_ID=Q9FG92; Match level="QueryCoverage=56%, HitCoverage=34%, E-value=1e-20, Identity=45%"; Hit description =Genomic DNA, chromosome 5, P1 clone:MQD19
YFPKNEKYLPLFTAGDDSEIVDRRNGLRKQIEDRLIAAAASGKDLEETGSEDDGLLDLSDDDFFLAGSSSDEADADDEWTDKSAREQASSASGKGVSGMSSDEKNQRQISARALMPPPRPSNMKLSRFGSSSGQNSSRQRSEISTSSNTSNSKSSSDFKVRGPSRSGTGHGSSLSSNSDAHKPRRKRRPKKKKKQEGLETSLHTLVMFI

SEQ ID NO: 156958 - protein, 675 aa, Glycine max
  Coding DNA Sequence Number=SeqID_40180
  Gene Ontology: Mol. function=mannosyl-oligosaccharide 1,2-alpha -mannosidase activity; Cellular component=membrane; Biological process=RNA processing
  Homolog annotation: Hit_ID=Q86IK7; Match level="QueryCoverage=75%, HitCoverage=42%, E-value=1e-107, Identity=41%"; Hit description =Similar to Arabidopsis thaliana (Mouse-ear cress). Dbj|BAA91806.1
  Pfam annotation: Domain name=Glyco_hydro_47; Domain location=44-546; Score=463.3; E_value=3.1e-136; Accession=PF01532.11; Description =Glycosyl hydrolase family 47
MEGIIQIRSVLLLLSITMASLTLAVADGVSREEAKELRDEVKDMFYHAFNGYMDHAFPLDELRPLSCAGHDTLGGYALTLIDSLDTLALLGDRQRFSASVEWIGKNLRFDINKTVSLFETTIRVLGGLLSAHLIATDYATGMRVPLYDNQLLNLAEDLARRLLPAFDTPTGIPFGSVNLLHGVDKHESKITSTAGGGTLTLEFGVLSRLTNDPSEFAIFPLGLLKAYIMQGIQFLNKLPRMQCVDFGHGVQSLTWSVLILMFLQVNGHKSYYSYLFGYLQDAGIGTSIDSFYEYLLKAYLLFGDEEYLYIFQEAYAAAMHYLYHDPWYVEVNMDSAAIVWPLFNSLQAFWPGLQVLAGDINPAIRTHAAFLSVWRRYGFTPEGFNLASLSVQDGKGTSEISNTTMLLINETLLKKHKQYCEEKCSVLQTLRSSCLVLGHGQKSYPLRPELIESTYWLYKATRDPRYLDAGRDMVASLQYGTRCPCGYCHISDVENHQQEDHMESFFLAETVKYLWLLFDLAVGPDNLVENGPYKYIFSTEGHLLPATPQISLVREHCLYYGAYCRSGDLRQTYFVPESDKDKKESNDTGFYESWTKPTYSSDYTTVEPSAVSGLIKTAWVDVLASYPLWSVSHNATDSVKFQHWSNILLTFHQSMLQCQASRVNFSQACFNLEVT

SEQ ID NO: 156959 - protein, 78 aa, Glycine max
  Coding DNA Sequence Number=SeqID_40181
MVDSDDGDDMDSEDLVKITAEVVDFRRPYVVLRRSSRYHLNKFTWVKGSHSFHCYQIKLIKNIFGSKQGRSHLQKNSR

SEQ ID NO: 156960 - protein, 237 aa, Glycine max
  Coding DNA Sequence Number=SeqID_40182
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=93%, HitCoverage=17%, E-value=2e-74, Identity=66%"; Hit description =Similarity to kinesin heavy chain
  Subcellular localization annotation: CTP_CleavageSite=34; ConfidenceScore=5.34e-01
MDSTLCGSSKTLMIVNVCPSISNLSETLSSVNFSARARNSTLSLGNQDTIKKWRDVANDARKELYEKEKEIHDLKQEGLELKQALKDANDQCILLFNEVQKARKVSSVLQTDLKSEHVLLSDKHNIEKEQNNQLRNQVAQLLRLEQDQKLQIQEQDSTIQSLQAKIRTLETQLNEAIKSSESRSTFVSEPEFADQSNSRPTGDGIDSSAVTKKLEEELKKRDALIEVCYAWQLRLIA

SEQ ID NO: 156961 - protein, 74 aa, Glycine max
  Coding DNA Sequence Number=SeqID_40183
MASRRADEAFGTGLAGFRRREDGAWWPRAGEGNERRGRVTARRKGQLDETSHTAVFYNKLSRKTKKAKQQKISQ

SEQ ID NO: 156962 - protein, 348 aa, Glycine max
  Coding DNA Sequence Number=SeqID_40184
MTMRRMQGQGDRRIGRVKEITKGKYHRRKIQQEDLEAVNSIGKGVSKLSGPQCPILKVFHFVVGFASDGFLGDCLIKYGALKVTIVAMVHVLRPVQFVVFFAHFHLGCKFQLFYGFPVIPSTTPKLLSLFLLHLLIAECWMVLYLLHFLALLFMQVVPKAIFCPFPSPSIRGVLKIQLMLLFLPAAGCYSSLVSNSLLASKLAINQLVEWKQQLNERMHLLKELSPVLFGHNNWISGMRDPIMTRPCILQFIAAFHNEKMLPPIAAIHLPSCGFHMTILRKFGPPLHWPIVPLGPGFHGKYVAEPWYRFLAEGDFVHGDELLFYYRSREDIWEMVIRKQRNWGDNDDW

SEQ ID NO: 156963 - protein, 74 aa, Glycine max
  Coding DNA Sequence Number=SeqID_40185
VTTDWVCEKVDTGLEKHSDTMVSVLGLRGGHDDGNDGQRSPILVNMKVETGSEEHSESRVDLQDGVQAGKGFGF

SEQ ID NO: 156964 - protein, 169 aa, Glycine max
  Coding DNA Sequence Number=SeqID_40186
  Homolog annotation: Hit_ID=Q53L77; Match level="QueryCoverage=42%, HitCoverage=18%, E-value=1e-10, Identity=45%"; Hit description =Transposable element protein, putative
MHRSPTGNLVPLDLEIEATLRRNRAERRRKLLQDRTIASILEEEAQSFDSTSSDSLSSRESAIYLPKASVVDDEHQQRVTLDDYSSSSVSQFFTSITRPEGNLFHGLPIEDSYAHLATYIEICNTMKIAGVPDDAIRLNLFSFSLAGEAKRWLHSFKGNSLRTWEEVVD

SEQ ID NO: 156965 - protein, 130 aa, Glycine max
  Coding DNA Sequence Number=SeqID_40187
  Homolog annotation: Hit_ID=Q6YVX8; Match level="QueryCoverage=34%, HitCoverage=7%, E-value=3e-09, Identity=62%"; Hit description =Putative Ligatin
MGKNKEQCYLKNLELVLTRRLIVNTIANAFMSSGDVCFILFKKAVEAKSYQRLSGADRKKLRRSIKDKFPRVFYSDLDALLPPKTSRFLYSLGQEPTLPGNAKFLLQDGYCAVGFNPYLWPPRKGGHPLF

SEQ ID NO: 156966 - protein, 141 aa, Glycine max
  Coding DNA Sequence Number=SeqID_40188
MPNFLLILSPTMSLIQCNTEQSKPAIEKVFVRLVKHVCNLIEKQNSKNQRHAYLHEHSKGLKNQRLRLRRGTGGVSSGSRREGLHGDNQNMRLEAGQSSRRKEVVQGLGFSSSRVSTFMQARGLVLTARLYINSNIYDGAS

SEQ ID NO: 156967 - protein, 65 aa, Glycine max
  Coding DNA Sequence Number=SeqID_40189
MGVKCSRVINNSPRTKLQSIYIPHFAKYTPIFCVLYRSFSRMPRNFMDSIGTGLKCSKVVKRVLK

SEQ ID NO: 156968 - protein, 65 aa, Glycine max
  Coding DNA Sequence Number=SeqID_40190
MGGELSKKEGALGSFLRKPPVRLGEQSSPRRVRRQTPPLFPINRGRLFWVKKHIFVKKNRVEVLS

SEQ ID NO: 156969 - protein, 85 aa, Glycine max
  Coding DNA Sequence Number=SeqID_40191
MTRQLGSYIITLVIDYNETSPNGRIIKEAQGLIILHHHHHSPSGDLPTPPNPYLSSPRFLTLFSTDVQHGVNFMTKKLPYYPELV

SEQ ID NO: 156970 - protein, 35 aa, Glycine max
  Coding DNA Sequence Number=SeqID_40192
MGVCLWIHDSGDSCEVYGGISLSSGAICQGDIVIH

SEQ ID NO: 156971 - protein, 156 aa, Glycine max
  Coding DNA Sequence Number=SeqID_40193
  Gene Ontology: Mol. function=DNA binding; Biological process=DNA integration
  Homolog annotation: Hit_ID=Q8RUQ2; Match level="QueryCoverage=92%, HitCoverage=13%, E-value=2e-19, Identity=37%"; Hit description =Putative retroelement
MLSNLGLNKSLWAEAISITCYLVNPSTSTVIDFKNLIEVWSNKPAEYSMLKVSKSLEPRKDSLWAIDGVKGFQVWFPFERKVILSRDVVFEKLFMLHYKPDEDLGKVKDVTKQVEFESFKIRNVSDQKQFEAPDETGRVLQMHHQHQNSTTTEGTD

SEQ ID NO: 156972 - protein, 145 aa, Glycine max
  Coding DNA Sequence Number=SeqID_40194
  Gene Ontology: Mol. function=transcription factor activity; Cellular component=nucleus; Biological process=regulation of transcription, DNA-dependent
  Homolog annotation: Hit_ID=Q1S1X7; Match level="QueryCoverage=95%, HitCoverage=12%, E-value=9e-20, Identity=41%"; Hit description =Integrase, catalytic region; Zinc finger, CCHC-type; Peptidase aspartic, catalytic
MKDIVAAKKILGMEIKKDHVQKKLFLYQKEYIQKVSNRFGMISSKIVCTPLTMSICLFELNIAQLELEKEYMSRVPYASVVAQAVSIASGYMGNLEKEHWQAVKRIFKYLKGTTDIGLVYHVDTTCAPTGYLSSSYAVDLMQEDL

SEQ ID NO: 156973 - protein, 74 aa, Glycine max
  Coding DNA Sequence Number=SeqID_40195
MDELGIAGSKLLFGFQQALVVEVHAWGAGTMLMRTQRHNERVDSTGKSKANTGGFYRLQQCESVLHTRVLNLYH

SEQ ID NO: 156974 - protein, 122 aa, Glycine max
  Coding DNA Sequence Number=SeqID_40196
  Gene Ontology: Mol. function=transition metal ion binding; Biological process=cytoskeleton organization and biogenesis
  Pfam annotation: Domain name=Transposase_21; Domain location=1-122; Score=55.1; E_value=2.6e-19; Accession=PF02992.5; Description =Transposase family tnp2
MACRWQKNDGFLQHPVDSPQWKTIDNLYPHFGEEPRNLRLGLALEGMNHFGNLTTNHSSWLVLLMIYNLPPWLCIKRKYIMLCMMIVGPRQSGNDIDVYLTLLIEDLRKLWENRVDVWDGNL

SEQ ID NO: 156975 - protein, 135 aa, Glycine max
  Coding DNA Sequence Number=SeqID_40197
MVNTIKIKKFIGKNCFNLWHIKMHALLKEHRIWAPLFGQPWKVDKENRYCIMDKAGETFHDKINLQQVAFEMTFVWPLNERRNFGHEVEQISIKIGFLHGRLEEDILMQQLEGLEVEEVPLWLEAISKVVVQVIS

SEQ ID NO: 156976 - protein, 111 aa, Glycine max
  Coding DNA Sequence Number=SeqID_40198
MIIWLNGFIGLYRQNLTCYFFDNVYNKLKDFLFYSSLIRNGVAECGCGANSCLLRSSSKPLLGWAAFLNDGTKPTSYIGSFVCFTVSHWGTLALRTCYGGKVGLAPLKCKG

SEQ ID NO: 156977 - protein, 108 aa, Glycine max
  Coding DNA Sequence Number=SeqID_40199
  Homolog annotation: Hit_ID=Q9LSA9; Match level="QueryCoverage=32%, HitCoverage=10%, E-value=4e-07, Identity=74%"; Hit description =Similarity to uridylate kinase
EIRTVDMEGKTVKLQIVSILRKSEIPSMSHLRLSMNESSKPSFKWRRVLLKVSGEALAGNHSQNIDPKWDGAGQERFRTITSSYYRGGDAKDTSRSSKKNSIEEEIET

SEQ ID NO: 156978 - protein, 77 aa, Glycine max
  Coding DNA Sequence Number=SeqID_40200
  Homolog annotation: Hit_ID=Q8W0W5; Match level="QueryCoverage=43%, HitCoverage=21%, E-value=1e-08, Identity=85%"; Hit description =Repressor protein
MSKIIKEMLPPDVRVARDAQDLLIECCVELAIVVLHRCVAAMGPSIEAHPLPGVLWIAATLTAICFVVSAGTTLTID

SEQ ID NO: 156979 - protein, 94 aa, Glycine max
  Coding DNA Sequence Number=SeqID_40201
MSNNDDHWLEERQKATRHMLSGSRGLDFGDHNTRYFHGVTKLRRSLIRSIFGDLSKISDLDETIVALIPKVEVVVNIKVMDKIIDLYKCSFIHK

SEQ ID NO: 156980 - protein, 165 aa, Glycine max
  Coding DNA Sequence Number=SeqID_40202
  Gene Ontology: Mol. function=phosphoinositide phospholipase C activity; Biological process=intracellular signaling cascade
  Homolog annotation: Hit_ID=Q43439; Match level="QueryCoverage=59%, HitCoverage=16%, E-value=4e-38, Identity=76%"; Hit description =Phosphatidylinositol-specific phospholipase C
MRRKKRRIIVTKEVLEESFEVEAITSEMEMHEAIDNGLHIFFSGLLLPLYFNQESLEMQICHELILRVLIEYGLDFLRCLLQHQLELPPPAEAHATCLFKHHHLLLHLWCLQHRWKWIDASAQTPLLEKCAYLAFGTSGYFLAARLTRAKWARGGFDGRRSLTSG

SEQ ID NO: 156981 - protein, 277 aa, Glycine max
  Coding DNA Sequence Number=SeqID_40203
  Gene Ontology: Cellular component=endoplasmic reticulum
  Homolog annotation: Hit_ID=Q2PYX0; Match level="QueryCoverage=57%, HitCoverage=64%, E-value=2e-34, Identity=44%"; Hit description =Putative 24 kDa seed maturation protein-like protein
  Pfam annotation: Domain name=Reticulon; Domain location=60-205; Score= 66.5; E_value=8.6e-17; Accession=PF02453.8; Description=Reticulon
TMSEKTTADNLIENLVDTFVDKKKSVSFFEDDKSDSVSSQINRLFGRQKPVHHVLGGGKSADVLLWRNKKISASVLTSATIVWVLFEWLNYNFLTILCFALVLVMLAQFLWSNASGMFNSSPSNVPRLVLPEELFVNIATVVGGKVNMGLRFLQDAACGGNLKHSSLSQTGLRFRDCNHIVEIVFVESKKTRKGKSPGKGTPRAFLLFLLLPEFVFVAKWAALPSKKTRKGKSPGKGGTRFWKSIVPGFKTPREAIEGMSLLYVNDENPLFNGLSLL

SEQ ID NO: 156982 - protein, 93 aa, Glycine max
  Coding DNA Sequence Number=SeqID_40204
  Homolog annotation: Hit_ID=Q7XXN8; Match level="QueryCoverage=54%, HitCoverage=92%, E-value=3e-07, Identity=47%"; Hit description =Hypothetical protein ROT4
MAQIRFDEFYKNYVDVRTWQQDILINTDYTTWKVITMIFPANKNCDTASKDIEPGPMLLLQPGASSSEGFEGSTNVRVVVFLLHHSIASKLVN

SEQ ID NO: 156983 - protein, 621 aa, Glycine max
  Coding DNA Sequence Number=SeqID_40205
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=81%, HitCoverage=29%, E-value=1e-112, Identity=67%"; Hit description =Similarity to kinesin heavy chain
  Subcellular localization annotation: CTP_CleavageSite=52; ConfidenceScore=5.39e-01
MPYFQLSSPLAHGSANVQPRDIGRNGTNNNTSSRSMDVLPSPLATDKNDGTVALVKTGSEIVKTTPAGEYLTAALNDFDPDQYEGHAAISDGANKLLMLGNYTNPKVRAHYTRETPVVWDTTPVFVDCKVTSQRASAWPTWMDVGAVECGSWWDAKILLQLCMRVKTPEKYTGNGKALPAKETRGQLAPCTGSEPLIMGSETVLAAVIKAGASREHEILAEIRDSVFSFIRKMEPKQVMDTMLVSRVRILYIRSLLARSPELQSIKVITVEAVGFLFEKKISSNKVFAVYFWDALLSLVTNTGRSRSSSRGSSPGRSPVLYVDEQIQGFKVNLKPEKKSKFSSVVLKIRGIDEDIWRQQVTGGKLREITEEAKSFAIGNRALAALFVHTPAGELQRQIRSWLAESFEFLSLTGEDASGGSTGQLELLSTAIMDGWMAGLGAALPPHTDALGQLLFEYSKRVYTSQLQHLKDIAGTLATEEAEDAAQVAKLRSALESVDHKRRKAMLSITGVAAERPPSAMGMDVAARFNVAVGTAAIAAERHGIWIGFLRRYTEAVEIPKMPSLNAGKLRHPGEAATPATLQHRQAPPPPPCPGARCESATLFIPFFPNTLRVCDTVSLLE

SEQ ID NO: 156984 - protein, 239 aa, Glycine max
  Coding DNA Sequence Number=SeqID_40206
  Homolog annotation: Hit_ID=Q10RD6; Match level="QueryCoverage=78%, HitCoverage=21%, E-value=2e-57, Identity=58%"; Hit description =Expressed protein
MPDNGDPQARSMIQFMSLYIILRMTHKQLYDLMINVGQAVLPHVFQICSATSLPFACVSNALNKPKPLNLDVSLPSIHDIRWSLARLLYLFNMQLDRNVAMFLAVLLLVCFSFVVVGGLLFFKFRGNKNSLEDCLWEAWACLCSSSTHLKQTTRVERFIGFLLAIWGILFYTRLLSTMTEQFRSSQQSNMQKLRDGTQEQVLETDHIIICGMNSHLPFILKQLNKYQEFAVLLGTATAR

SEQ ID NO: 156985 - protein, 382 aa, Glycine max
  Coding DNA Sequence Number=SeqID_40207
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=65%, HitCoverage=19%, E-value=2e-95, Identity=70%"; Hit description =Similarity to kinesin heavy chain
MVVKTHTTTACYAWFERQQEGLFSWGGGAMTLLPLGVGGGVSVVSAAYVRNNRMRAKRRKVRVKKEGAVAAMSISMCLLLECELGPNTTPKVNSWVEGCPPLVYFILVLFLSDMRLGFFTIYPLRPTLLGLILQQMKSDIALLTLENGGFPIQNPSTAAEDARLASLISLDSILKQIKDMTRLSSVNILTKSKKKTMLASLNELTEQMPSLLEIDHPCAQRHIADARYMVESIPEEDDPIQDISHDRMPSTDLGSGSETDVTQWNVLQFNTGSTSPFIIKCGANSNSELVIKADARVQEPKGGEIVRVAPRPSVLDNMSLDEMKQIFNELPEALSLLALARTADGTRARYSRLYRTLATKVPSLKDLVGELEKGAALRDVRT

SEQ ID NO: 156986 - protein, 307 aa, Glycine max
  Coding DNA Sequence Number=SeqID_40208
  Gene Ontology: Mol. function=heat shock protein binding; Cellular component=integral to membrane; Biological process=protein folding
  Homolog annotation: Hit_ID=Q9ZU99; Match level="QueryCoverage=54%, HitCoverage=58%, E-value=7e-32, Identity=41%"; Hit description =Expressed protein
  Pfam annotation: Domain name=DnaJ; Domain location=80-143; Score =25.2; E_value=1.6e-05; Accession=PF00226.21; Description=DnaJ domain
MKHETDNINNNNGTHDGSEDSVLRPCLSLLKCRSFAACHVSANKISRSDPNVSLHVDQILAVADVLAAAERRRVPSHPHDWYSILRLLPGDGDNRDLTRQHFKTLVRLLDPNKNKLPFADEALMRVREAWFVLSDPTRKARFDKEINDAAKTKTTSFWTMCPYCWYLHEYERKYEDCTLRCSNCKRTFHGAAVTSPRPEAVAAGNEEYYCYHVSLPVRYPVGGERCRFGDGARKRMRVKTVANRMKKKGFVVDANNDESDLDGMRKTNLGFREVIGKYLALMNSWKDFDSLVEEDLVLFFNLLEYEL

SEQ ID NO: 156987 - protein, 190 aa, Glycine max
  Coding DNA Sequence Number=SeqID_40209
  Gene Ontology: Mol. function=RNA-directed DNA polymerase activity; Cellular component=chromatin; Biological process=chromatin assembly or disassembly
MMVFVLPEKLNILLWGVASYFHNKFTNHHTSIQCSPYEVMFGRPPPIYLPYLSGESKVEVIDRSLQKREEALKLVKFHMKRAQERMKQLADKKRSDKSHEIGDIVYVKLHPYKQISVAFRPNAKLAPKYFGPFQIKGRIGAVASKLKLPQGSKIHDVFHVSQLKRHVGEAPVSNFLPTVLMVLWEAKNFN

SEQ ID NO: 156988 - protein, 1250 aa, Glycine max
  Coding DNA Sequence Number=SeqID_40210
  Gene Ontology: Mol. function=RNA-directed DNA polymerase activity; Cellular component=chromatin; Biological process=chromatin assembly or disassembly
  Pfam annotation: Domain name=Chromo; Domain location=1200-1250; Score= 11.5; E_value=0.042; Accession=PF00385.14; Description='chromo' (CHRromatin Organisation MOdifier
  Pfam annotation: Domain name=UPF0029; Domain location=65-136; Score =34.4; E_value=5.7e-10; Accession=PF01205.10; Description =Uncharacterized protein family UPF0029
  Pfam annotation: Domain name=rve; Domain location=928-1086; Score =39.8; E_value=9.1e-09; Accession=PF00665.16; Description=Integrase core domain
  Pfam module annotation: Pfam domain module=Chromo::RVT_1::Retrotrans _gag::UPF0029::rve; Domain location=1200-1250::693-925::276-363::65 -136::928-1086
EEEKEKAMVSNERNAKSSYSYQHRIYALLFSITKAKKTTMASTNSSNSGGAFTTIQERVTFEKEIKKSKFIAIAGPIPDEKSAMSFLSQVGDQYRSNDDGEPSGTAGKPIQTAIDSSGIDRVMVVVISSVVPRIFSIPSSTFISGISLDLPLAVMAEATRNQAALREQEEHLEHRITSKLEACIMEITSSIRKAIDSSIDRRILETLQKNFDSEINAMDRGPHHRDERHANSNYSCGTRLAQIDFPRFSGDAVQQWIYQCETYFAIDGTPAKFRVKLVVIHFEGKALQWHTSFVKTLPEGNLPKWTEFTNILIDRFGEVCDDPMAEHMQLRQNGGLKKDIQMIVKMFQPQDVRKAFQLAKLYESASSSYIPTKTFPKFQKTQPSTKAILPTPNPTHKPIDSQFTLNPTQRQPNKKLTPAFMAERRSKGLCNFCDEPYSPNHALTHKKLEIHVLEVSDTEEEIVDQFDNTTHNFLDEGVAKKLGCLITNIPTLSVAIVDGARVNITSTVKQFSWILQNIGFTLDMLLIPLGCYDVVLGIEWLVTLGDITWNFDRLLMQFYVQGKKLVLRGAAGARLKPARKKQLQKTIASGVHLSMLQLCDADNNFLLHSLTTHATNQATPESIEELLLQFEDIFQEPTRLPSKRKGHDHKIPLVAGANPINKRPYRYAKQQKDVIDKLVQDSLKSGIIQKSSSPFASPVVLVGKKDGSWRLCVDYRDLNKQTIKDRFPIPLVDDLLDELHGSKMFSKIDLRSGYNQVRMENSDIHKTAFKTHGGHFEYLVMPFGLTNAPATFQGYYRRFVRGFGGIARPLTNMLKKNNFHWSDEAKATFQSLKDSLIQSPVLALPDFSKVFVVEVDASGSRRLSNNHNSHTGKQHVEQNHSSWQADPGIQKLIQDLQTDASSHKHHTWNHNELRRKRRLVVGKDLTLWNDLLQWIHAGPTSGHSGLANSKGKQVIYVVVERLSKAAHFMSLTHPYTATEVAQSFLDNVFKLHGFPGSITSDRDPIFVSQFMKDLMAFQGVQLQLSSAYHPQTDGQSEVVNRCLETILSPYEVMFGQPPPIYLPYLSGESKVEVIDRSLQKREEALKLVKFHMKRAQERMKQLADKKRSDKSHEIGDIVYVKLHPYKQISVAFRPNAKLAPKYFGPFQIKDRIGAVAYKLKLPQGSKIHDVFHVSQLKRHVGEAPVSNFLPTDSDGVMGGKELQLIMDRSTVKRGNRAVTKVLVKWKHQLIEDATWEFFYDLKMTYPTFNP

SEQ ID NO: 156989 - protein, 127 aa, Glycine max
  Coding DNA Sequence Number=SeqID_40211
  Gene Ontology: Mol. function=hydrolase activity
  Homolog annotation: Hit_ID=Q1RXP4; Match level="QueryCoverage=96%, HitCoverage=25%, E-value=1e-20, Identity=84%"; Hit description=AAA ATPase
MDVPIKEFKITEVKQPYIGEVKPSSVTAEVTYSVSSYKAHITSQWDALKEHDVLLKNGMHCRVSNLPIKQVEAIICGIQPGLTMVVGPPSIGKTDTVVQILNVVYHNCPSQRTLIITHSNQAFSAPI

SEQ ID NO: 156990 - protein, 83 aa, Glycine max
  Coding DNA Sequence Number=SeqID_40212
MASSNSLNTENTLRSVSIVVLWKERKREAMGACNGATYDSGNSDERTVQQSLSHLDLRAPIRYNATILFVKVLKFKLKVELYW

SEQ ID NO: 156991 - protein, 115 aa, Glycine max
  Coding DNA Sequence Number=SeqID_40213
MVGGIDRESNENEKRILSGEGDGRGTGVEPAQWAKEEAAKTLTNQELGKIEALATTEGRMLAMNSSTPMTQAKMASEIVMMPTTGPSLVVLAVVLAEAEVEVEPEAVESERDRKK

SEQ ID NO: 156992 - protein, 47 aa, Glycine max
  Coding DNA Sequence Number=SeqID_40214
MLDLTNFQESVEIGDFGMGFSHALWFELAAHCASVVLRFLMKELEPI

SEQ ID NO: 156993 - protein, 272 aa, Glycine max
  Coding DNA Sequence Number=SeqID_40215
  Homolog annotation: Hit_ID=UPI0000503967; Match level="QueryCoverage =94%, HitCoverage=82%, E-value=1e-07, Identity=26%"; Hit description =UPI0000503967 related cluster
  Subcellular localization annotation: CTP_CleavageSite=38; ConfidenceScore=5.10e-01
MNCVLIHVSSTFEFGAMRSDCLVQFSILNLFRSPMNCVLVHVSSTFEFGAMRSDWLVQFSILNLFRSPMNCVFVHVSSIFEFGTMRSDCLVQFSILNLFRSPMNCVLIHVSSTFEFGAMRSDCLVQFSILNLFRSPMNCVFVHVSSTFEFGVMRSDCLVQFSILNLFWSPMNCVFVHVSSTFEFGAMRSDCLVQFSILNLFRSPMNCVFVHVSSTFEFGAMRSDCLVQFSILNLFRIPMNCVFVHVSSTFEFGAIRSYCLVQHSILNLFGSP

SEQ ID NO: 156994 - protein, 53 aa, Glycine max
  Coding DNA Sequence Number=SeqID_40216
MLAIVSKYQEELNLATAHEHKVADEKNAITKRAPRHPYRTRSKSKTMGDQEEI

SEQ ID NO: 156995 - protein, 61 aa, Glycine max
  Coding DNA Sequence Number=SeqID_40217
MHLFQPSTSQVGFEYIKSATEERKKQALALVKDESEDTSAQSSSTPGLHCISTKYQMIQKP

SEQ ID NO: 156996 - protein, 174 aa, Glycine max
  Coding DNA Sequence Number=SeqID_40218
MRNCIRCCISCILPCGALDVIRIVHSNGRVEEIGGTIKASDVMKAHPKHVLKKPCSSAADAAEGGVGGGVPKIVVVPPDAELQRGKIYFLMPLPPSPPQEKNQQRRKKKKKEHRERTRNNTNVSTTMSMTSLLVSDRYLNDILSEKVSTQRDRRRGRVAVWRPHLESISESPPH

SEQ ID NO: 156997 - protein, 280 aa, Glycine max
  Coding DNA Sequence Number=SeqID_40219
  Gene Ontology: Mol. function=cysteine-type endopeptidase activity; Cellular component=endoplasmic reticulum; Biological process =proteolysis
  Homolog annotation: Hit_ID=O64458; Match level="QueryCoverage=86%, HitCoverage=82%, E-value=1e-101, Identity=62%"; Hit description=Bd 30K
  Pfam annotation: Domain name=Inhibitor_I29; Domain location=30-72; Score=-2.0; E_value=0.026; Accession=PF08246.2; Description =Cathepsin propeptide inhibitor domain (
  Pfam annotation: Domain name=Peptidase_C1; Domain location=104-257; Score=119.2; E_value=1.2e-32; Accession=PF00112.13; Description =Papain family cysteine protease
  Pfam module annotation: Pfam domain module=Inhibitor_I29::Peptidase _C1; Domain location=30-72::104-257
MGFLVLLLFSLLGLSSSSSISHRSILDLDLAKFTTQKQNNLNCIRDMNANRKSPHSHRLGLNKFADITPQEFSKKYLQAPKDVPRHINMADKELKEEQHSCDHPPASWDWREKGVITDVKHQGFGTCNSNRRPCSLSEQELVDCVESEGCSSGWPDDSFVWVLEHGGIATDADYPYRAKECRYKANKGIYGGGNCSKYWVNHFVLLVGYGSADGVDYWIAKNSWGEDWGKDGYIWIQRNTGNFSGVCGMNYFPVYPTKKKSETLVSAGIKAHRRVDHSPL

SEQ ID NO: 156998 - protein, 520 aa, Glycine max
  Coding DNA Sequence Number=SeqID_40220
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=94%, HitCoverage=76%, E-value=0.0, Identity=71%"; Hit description=Protein kinase
  Pfam annotation: Domain name=Pkinase; Domain location=227-489; Score=- 37.0; E_value=2.3e-06; Accession=PF00069.15; Description=Protein kinase domain
  Pfam annotation: Domain name=Pkinase_Tyr; Domain location=226-489; Score=-76.1; E_value=8.4e-08; Accession=PF07714.7; Description =Protein tyrosine kinase
  Pfam module annotation: Pfam domain module=Pkinase::Pkinase_Tyr; Domain location=227-489::226-489
MEDSFVIPLKGALKNYLKAVIAVALPLFKLGKATPHAYEEKYCKNLTSSDESDFGHDESEFGQNVPNIINSVRRKLFDQSSNLAAAPFSGGPTIEISSVPITQSSGAFPAVPDTNKKQNQSPAPLPSSSNSPPVNQASQQNSPNGASGKLWKYIIIIAGVAVLVIVFVIMLCIWRKRAAKVIKPWKTGISGQLQKAFITGVPKLNQGELETACEDFSNIINSFDECTIYKGTLSSGVEIAVDSTIVTSARDWSKNMETAYRKKIAALSRVNHKNFTNLIGYCDEEEPFTRMMVFEYAPNGNLFEHLHVKEVEPLDWSARMRVIMGTAYCLQYMHHDLNPPVAHSNLNSIAILLTDDFAAKVPSNISPFYCSQISEISFGKHAKTNTTGDESQKSSELPPQADPETDVYNFGVLLLEIISGKLPYSEEQGHLANWAAEHLNDKRSIGYLIDPTLQSFKEEELEVICEVIKDCLQSDPRLRPTMKDITPRLREVLHISPEQAVPRLSPLWWAELEILSMEAT

SEQ ID NO: 156999 - protein, 129 aa, Glycine max
  Coding DNA Sequence Number=SeqID_40221
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=80%, HitCoverage=16%, E-value=5e-39, Identity=70%"; Hit description =Protein kinase
  Pfam annotation: Domain name=LRRNT_2; Domain location=30-71; Score =50.4; E_value=6e-12; Accession=PF08263.3; Description=Leucine rich repeat N-terminal domain
MESIWGPFGLWLRIYVGLISLWGTRQCWSLNDEGLTLLEFRGRITSDPFAALANWNPNDCNPCKWLGVRCVDSQVQTLVLPDLSLEGTLAPELGKLRHLKSLCIIFIFLNHTMPTFPSVWNVAINSGDQ

SEQ ID NO: 157000 - protein, 74 aa, Glycine max
  Coding DNA Sequence Number=SeqID_40222
  Pfam annotation: Domain name=Collagen; Domain location=5-64; Score= -15.7; E_value=0.0018; Accession=PF01391.8; Description=Collagen triple helix repeat (20 copies)
MQRLPERRVRRKGDTWQHLGRALRTGATGSAAAAGASGRVGYPGATGRAGDPGATGRAGDPGATQLGLGVGTSM

SEQ ID NO: 157001 - protein, 64 aa, Glycine max
  Coding DNA Sequence Number=SeqID_40223
MYPDSLPDGLNRMAVARDSAACRSLVGAFRMLRWWGARFVVVNHEGNDEVSLPCDSKLMFVITS

SEQ ID NO: 157002 - protein, 69 aa, Glycine max
  Coding DNA Sequence Number=SeqID_40224
  Gene Ontology: Mol. function=hydrolase activity, hydrolyzing O -glycosyl compounds; Biological process=carbohydrate metabolic process
  Homolog annotation: Hit_ID=Q8GTJ2; Match level="QueryCoverage=82%, HitCoverage=9%, E-value=5e-16, Identity=72%"; Hit description =Endoxylanase precursor
  Subcellular localization annotation: CTP_CleavageSite=40; ConfidenceScore=5.09e-01
MDFKAWIQVSEGSNVPVTAVVKTTTRLKFAGASFAESNCWSMLKGGLTVDESGPAELYFEVLPIVLQSS

SEQ ID NO: 157003 - protein, 600 aa, Glycine max
  Coding DNA Sequence Number=SeqID_40225
  Gene Ontology: Mol. function=microtubule-severing ATPase activity; Cellular component=microtubule; Biological process=cell division
  Homolog annotation: Hit_ID=Q5ZCG1; Match level="QueryCoverage=99%, HitCoverage=72%, E-value=4e-73, Identity=31%"; Hit description =Katanin p80 (WD40-containing) subunit B 1-like protein
VSGVRSIAFHPDGQILFAGFEDSLKVYSWEPVICHDAVDMGWTTLGDLCIHDGMLLGCSFYSNSVGVWVSDISLIEPYNGGLETEKKESTKQKLSLQGRQMEKVEAGVGPAFGLCSMSADNESKEIKNIYIDSSGGNPDTLIRSRSYNSPKVDLPEESKEMLNWSPATRAHAKQNEQTLRKSYIMPNFVPRDIVNGKNSATFSKTKPGMLLKPVHVQGASTDILDVDGFSSDLDSRTFCDTGSKSDSPKDPNFQMKLGSQNEVRESIEDKHPIKSVTEKFEKTLTPDRFSDQDKCNQSSPYSKEMSPVKYVNGVAVLQGRTRSLVERFERRERTPTDENQANATPTTIFENKEKILKEDQTNASPITSITSEKGERFPFGDDQNNMPNVPNTTSETDKSANFLKVEPQVLGSDSNSANDGEIIEGLMQTHDVTLSNLRSRLTKLQGYRKKGSGSPKVVQHFWERNDTKGAISALRKLPDQSVQADVISVLVDKMEIITLDLFSCLLPVLTGLLDSNIERHVKVSLDMLLKLVAVFGPTIRSTISAPPSVGIDLHAEQRRECSNQCFMQLQKIRMILPILIRRGGILAKSAQELNLVLQQP

SEQ ID NO: 157004 - protein, 347 aa, Glycine max
  Coding DNA Sequence Number=SeqID_40226
  Gene Ontology: Mol. function=protein heterodimerization activity; Cellular component=microtubule; Biological process=cell division
  Homolog annotation: Hit_ID=Q9FT96; Match level="QueryCoverage=94%, HitCoverage=34%, E-value=1e-103, Identity=57%"; Hit description =Katanin p80 subunit-like protein
  Pfam annotation: Domain name=WD40; Domain location=103-141; Score =28.6; E_value=2.2e-05; Accession=PF00400.22; Description=WD domain, G-beta repeat
  Pfam annotation: Domain name=WD40; Domain location=145-183; Score =39.8; E_value=9.1e-09; Accession=PF00400.22; Description=WD domain, G-beta repeat
  Pfam annotation: Domain name=WD40; Domain location=187-225; Score =51.0; E_value=3.9e-12; Accession=PF00400.22; Description=WD domain, G-beta repeat
  Pfam annotation: Domain name=WD40; Domain location=229-267; Score =43.9; E_value=5.5e-10; Accession=PF00400.22; Description=WD domain, G-beta repeat
  Pfam annotation: Domain name=WD40; Domain location=25-64; Score=27.1; E_value=6.1e-05; Accession=PF00400.22; Description=WD domain, G-beta repeat
  Pfam annotation: Domain name=WD40; Domain location=271-308; Score =13.4; E_value=0.82; Accession=PF00400.22; Description=WD domain, G -beta repeat
  Pfam annotation: Domain name=eIF2A; Domain location=75-245; Score= -82.7; E_value=0.0078; Accession=PF08662.1; Description=Eukaryotic translation initiation fact
  Pfam module annotation: Pfam domain module=WD40::WD40::WD40::WD40::WD4 0::WD40::eIF2A; Domain location=103-141::145-183::187-225::229 -267::25-64::271-308::75-245
MAKTGYKLRILFYIYKFCASENAFCCNVEEFAAHSGNVNCLKLGRKANRLFITGGDDHSVNLWMIGKPTSLMYSKIVWALGIVLTTSTQSSEMVSAWLTQPTHLGSKSLCGHTSSVESVTFDSAEVLILSGASSGVIKLWDLEEAKMVRTLTGHRLNCTAVEFHPFGEFFASGSLDTNLNIWDIRKKGCIQTYKGHSQGISTIKFSPDGRWVVSGGFDNVVKVWDLTGGKLLHDFKFHEGHIRSLDFHPLEFLMATGSADRTVKFWDLETFELIGSTRHEVSGVRSIAFHPDGQILFAGLEDSLKLIEPYNGGLETEKKESTKQKLSLQGRQMEKVEAGVGPPFGLC

SEQ ID NO: 157005 - protein, 53 aa, Glycine max
  Coding DNA Sequence Number=SeqID_40227
  Gene Ontology: Mol. function=oxidoreductase activity; Cellular component=chloroplast thylakoid membrane
  Homolog annotation: Hit_ID=Q8H4J8; Match level="QueryCoverage=87%, HitCoverage=12%, E-value=2e-15, Identity=75%"; Hit description =Aldo/keto reductase family-like protein
ALTGKYTPDKPPSGPRGRIYTPEFLTKLQPLLNKISEIGEKYDKTPTQVHAAP

SEQ ID NO: 157006 - protein, 1639 aa, Glycine max
  Coding DNA Sequence Number=SeqID_40228
  Gene Ontology: Mol. function=RNA-directed DNA polymerase activity; Cellular component=chromatin; Biological process=chromatin assembly or disassembly
  Pfam annotation: Domain name=Chromo; Domain location=1355-1407; Score= 47.5; E_value=4.4e-11; Accession=PF00385.14; Description='chromo' (CHRromatin Organisation MOdifier
  Pfam annotation: Domain name=Pkinase; Domain location=1300-1635; Score=-39.2; E_value=3.1e-06; Accession=PF00069.15; Description =Protein kinase domain
  Pfam annotation: Domain name=Pkinase_Tyr; Domain location=1418-1635; Score=-73.6; E_value=5.9e-08; Accession=PF07714.7; Description =Protein tyrosine kinase
  Pfam annotation: Domain name=RVP_2; Domain location=313-421; Score= -43.6; E_value=0.0025; Accession=PF08284.2; Description=Retroviral aspartyl protease
  Pfam annotation: Domain name=RnaseH; Domain location=801-922; Score= -21.3; E_value=0.0056; Accession=PF00075.14; Description=RNase H
  Pfam annotation: Domain name=rve; Domain location=1052-1208; Score =119.7; E_value=8e-33; Accession=PF00665.16; Description=Integrase core domain
  Pfam module annotation: Pfam domain module=Chromo::Pkinase::Pkinase _Tyr::RVP_2::RVT_1::Retrotrans_gag::RnaseH::rve; Domain location=1355- 1407::1300-1635::1418-1635::313-421::543-712::48-138::801-922::1052 -1208
MTTTGVIVARYHMDHVSDHDGTVVVTNGGILAGEGSWRSLFLRVMMLTGVMIAMEDRALNWFQWWEDQTPLRSWEEFKEAVIRRFQPGILHNPLGPLLSLKQDSTVMEYREKFEMLVAPLRREERGMLDSIFLNGLKEELQAEMKLYDYHDLADMMDRALLLEEKNEALRRRGITGRDRTEWKDKGGGSKFRNPGDFGKDRREIPKVSGVSEKVEGKGVEGVRGRRLNPAELEERSKKGLCFKCGDKWNREHICKFKHMSLRLCEGGSEEEEMEEEKEKVDSETDVVGELKTLQLSLQSKEGFTSNKSFKVWVTIKERQVLTLIDSGATSNFIASKLVEELGLELTETPSYVIEVGNGKKVRNQGVCEDLQFQIQGVEFKQHFFLMELGGSEMVLGMDWLASLGNIEANFGNLCLRWEAEGKKYSIQGDPTMCNRQSSWKAMMKALADAGVGFYIQSMEAELEEVREAEGFNQWQQILGEFAAVFDMPTGLPPIREHDHPIMLKSGAVIPNIRPYRYPYYQKNEIEKIVKEMMQAGIIRHSTSPYSSPVLLVKKKDGGWRFCTDYRALNKVTIPNKFPIPVIDELLDELGGSVIFSKLDLKSGYHQIRMKEEDIAKTAFRTHEGHYEYLVMPFGLTNAPSTFQALMNEVLRPYLRRFVLVFFDDILIYSKSEEEHKLHLREILQVLRRNQLYANKKKCSFAQKEVEYLGHLISDKGVSADPKKIEDMLKWPHPKELKGLRGFLGLTGYYRKFVKNYSKIAWPLTQLLKKDSFLWNDEAQQAFDQLKQAMTTVPVLAMPDFDKEFVIETDASGKGIGAVLMQEGRPVAYMSQTLSDRAQGKSVYERELMAIVIAIQKWRPYLLGRHFQVHTDQKSLKFLTEQRVMGEDQQKWIAKLIGYDFEVKYKPGKENNAADALSRQMTYATITTVQCEVWEGLEDEVQNDEKLKVLVQALVGDPLSHPGYQLKGGRLYHEGRVVIPKNSPRIAWLLHEFHATAVGGHSGYLRTYKKISGLVYWEGMRKQIKEYVQACEVCQQNKYQTLKPGGLLQPLPIPKQIWADISMDFIGGLPKVQGTDTIMVVVDRLTKYAHFLPVSHPYTAKDIASLFIKEIVRLHGFPTSIVSDRDKVFLSNFWSELFKQAGTKLKYSSAYHPQSDGQTEVVNRCVETYLRCLTGRQPKQWPKWLAWAEYWYNTNYHASLKTTPFEALYGREPPMLVKGDVSLSAVEEVNKLTAERNAMLKEMQEQLLRAQDVMRTQANKHRREVVYQIGDMVYLKIQPYKLKKLANRFNQKLSPRYYGPYEVEQKIGEVAYKLKLPADSRVHPVFHASLLKKALAPNVEPQPLPACMNENWQLEPEPEEALDTRKNEQGVVEVLVKWKDLPDFENSWEPVEKLRSEFPGFLLEGKKSFEGGGIDKQQIVYTRKHGKGSVGDHPTRGVTNLVGKLETAWEFSKQLEMLSLFSAFFHFHCSSIVIHKYLHEHCQPPIVHRNFRSANILLNDKLEVLVSDCGLGSLLSSGSASQLLGRHLTANGYSAPEFEYGSYTLQSDVFSFGVVMLELLTGRKSFDSSRPRVEQFLMRWAIPQLHDIDALSKMVDPSLNGEYPKKSLSRFADIISSCIQNEPEFRPAMSEIVQDLLRMM

SEQ ID NO: 157007 - protein, 55 aa, Glycine max
  Coding DNA Sequence Number=SeqID_40229
MGSLWEEDNTRRDDVKNTDSHERRRGQMMDKEGRKITLIKIPGSFGMCLKFRGTP

SEQ ID NO: 157008 - protein, 68 aa, Glycine max
  Coding DNA Sequence Number=SeqID_40230
MEFERGNRMFGALDDAVHFDRFLPNQKKRDLEQYSASPKITKEIADHASHTDGSEIVLETIEAKDVGA

SEQ ID NO: 157009 - protein, 47 aa, Glycine max
  Coding DNA Sequence Number=SeqID_40231
MSYMIGILTLTLKTSIRGNGEEKTIGFLLNDENCSNFQVIKTRHQVY

SEQ ID NO: 157010 - protein, 661 aa, Glycine max
  Coding DNA Sequence Number=SeqID_40232
  Homolog annotation: Hit_ID=Q9FJ51; Match level="QueryCoverage=10%, HitCoverage=16%, E-value=9e-08, Identity=45%"; Hit description =Arabidopsis thaliana genomic DNA, chromosome 5, TAC clone:K15I22
  Pfam annotation: Domain name=DUF688; Domain location=2-660; Score =149.1; E_value=1.2e-41; Accession=PF05097.3; Description=Protein of unknown function (DUF688)
MMNERKLNIDAPLMSVRRSFGTSPSLTEANRKILEKPQTLPNYKSDTTLDQVTEPVAVPFNWEHIPGRSKDYDGSEPQLPTKASITPILPPGKSTNVAKQSLEKEPNVANNFRPPSISNSLSEKIDCNKEHKDEKMKKVEENDDYDDDGDVYSDALETLSPTEPLSMNCSVSDVSGLDNVVADMCGASSTDKQAHDFMMSRFLTAAKAMTIQPPQYASSRKQTVLTEQPREFIKLVPEQKKSFVSRHITDIVPYTGQCQEEEEEEEESDNETNDYANNSAKGCGLFPRLCVRNSLCLLNPVPGTKMGNQFPLYSAYEVGKPDKSSHIRSHRPAPSIKKAWDAINKSKSSSRAASPDKQDVRKKWTSESSRYTYSGELKKLGRLSPFRRSRAASAGVSPFQSKPQPPFPGAKLLGDSKQDDNNHSGKLKFPSRGHSSIQEVLSQGAKRSYSFGSLTVEKTLYIDTASTIKSSCSSSHSLGNTIVVGKDRTFLLDSFRDMKHLEALEENLDSQVLNPVDANSPTLSSMLHLMAKEDKAERLAADQEINLESMSLQLVPSSFDKDAEISKQQIVVVDDSGKVGNEYVLHPLAPPLPKSPSESWLCRALPLVSSKNSFPLSNQGTHSQAKRQGFSRASSYTKWETIVKSSNLNHDHVTCSKAYGI

SEQ ID NO: 157011 - protein, 228 aa, Glycine max
  Coding DNA Sequence Number=SeqID_40233
  Gene Ontology: Mol. function=DNA binding; Biological process =regulation of transcription
  Homolog annotation: Hit_ID=Q1SMM7; Match level="QueryCoverage=99%, HitCoverage=52%, E-value=3e-65, Identity=57%"; Hit description =Homeodomain-related
MGNGGIILASDYNDHSYFHGLMHPCSLSHSHTKAIDLRRQQWYFNNHQPFRRPSYFSNEVVSSTALQTQGRSLSSNQINLMDATSIAPMRPSQFLEEKKWPPLDIMNNHHWKKRLPANITSNAVSQPVVHQFGTTAASLLRPSELNFGNNTRIKEHLSNSDEHRNYSNSFKLEFEPPFRIKSNQEKLQKENQWAPDLRLSLSQRDGNNDGKTDHCRETQEINTKLSLS

SEQ ID NO: 157012 - protein, 141 aa, Glycine max
  Coding DNA Sequence Number=SeqID_40234
  Gene Ontology: Mol. function=transcription regulator activity; Cellular component=nucleus; Biological process=regulation of transcription, DNA-dependent
  Homolog annotation: Hit_ID=Q8W2F3; Match level="QueryCoverage=83%, HitCoverage=24%, E-value=1e-10, Identity=36%"; Hit description =Phytochrome-interacting factor 4
MNNSVPDWNFGSDSCVTTTNQKKPMIGVDQELVELQWQNGQVVMHSQTHRKPFVNSITPRPLRRNFQSTLRTSEPFGNSSNLIQDDETVSWIQYPLEDPLEQEFCSNLLSELAPCEVESYKQIKPFEEGKFTKLDASSTPH

SEQ ID NO: 157013 - protein, 108 aa, Glycine max
  Coding DNA Sequence Number=SeqID_40235
ECHQTKASRLSSHGVSVTTTQGYSKEFARHGMRREERTESLGEATVRDDEVKASEESDEVQALKAELERARVVEEKFKAAIVSSSSEEVKGIITGQRHDLEGQAKGLP

SEQ ID NO: 157014 - protein, 428 aa, Glycine max
  Coding DNA Sequence Number=SeqID_40236
  Homolog annotation: Hit_ID=Q1SM20; Match level="QueryCoverage=33%, HitCoverage=32%, E-value=2e-15, Identity=32%"; Hit description =Nucleic acid-binding, OB-fold
MALCYIIVAFFYSNMARSPDKIKNIDDSKETLKLAVRISDLWFIGMPNKSEQVEMVFINSDVYYLLFSPLCCNFNEIQGDEIHDVCKQDQLKSWKMDLKENCTYVMHNFKVLKNNGQYRVCDHQFKLVFIGVAVVRQCVLNDLPFRKYKFAGFADVVAGQFEPGLLVDVIDVVDEVVFRHVSRKGRRVVFKLKDLRLAGLGIEARPVFKSHGQGSSQLSGSIQLSSKESFFGKAEAKTIAEINTISEEIVCVTVGTITRIVMDNHSWCYIACIQCHKKIDAKMAPFTCACGKYNQEVVLRYRLEVMINHRDENTKFLLWDRECTELIGQSVDTVNRLKNEDGDVDLNASPQALDKLLGYVLAFKIKVQPKFRKFAILKCSTDSSLIDVVMDMLPNAETSSKINVPTFDSNHSTEHEPVNFNHDLHPLI

SEQ ID NO: 157015 - protein, 89 aa, Glycine max
  Coding DNA Sequence Number=SeqID_40237
MTYRGLKMKHHRITRIEHFLKDIMQILFRSARFFRSSSTKVVLWPTPAFFHFLGKENISQPRQKHMQDSPILIGKNASDVGKERLPIEV

SEQ ID NO: 157016 - protein, 93 aa, Glycine max
  Coding DNA Sequence Number=SeqID_40238
  Homolog annotation: Hit_ID=Q53PY3; Match level="QueryCoverage=60%, HitCoverage=50%, E-value=9e-09, Identity=43%"; Hit description =Expressed protein
  Pfam annotation: Domain name=Dabb; Domain location=3-86; Score=10.7; E_value=0.0047; Accession=PF07876.3; Description=Stress responsive AB Barrel Domain
MVSYFVEEFKKKNKVDISENPKEIENYMGKDIESHDMLRQGFTHVFLMTFNGKDEFNAFQTQPNHFEFTGVFSPVIENIVVLDFPYNLVKAPE

SEQ ID NO: 157017 - protein, 43 aa, Glycine max
  Coding DNA Sequence Number=SeqID_40239
MALGTMAARPGELMLHPEVSWLVQKPVLNNTFRLARIKNINGW

SEQ ID NO: 157018 - protein, 314 aa, Glycine max
  Coding DNA Sequence Number=SeqID_40240
  Gene Ontology: Mol. function=binding; Cellular component=integral to membrane; Biological process=mitochondrial transport
  Homolog annotation: Hit_ID=Q2PEQ8; Match level="QueryCoverage=99%, HitCoverage=100%, E-value=1e-138, Identity=79%"; Hit description =Putative mitochondrial dicarboxylate carrier protein
  Pfam annotation: Domain name=Mito_carr; Domain location=121-216; Score=92.6; E_value=1.2e-24; Accession=PF00153.17; Description =Mitochondrial carrier protein
  Pfam annotation: Domain name=Mito_carr; Domain location=221-314; Score=101.3; E_value=2.9e-27; Accession=PF00153.17; Description =Mitochondrial carrier protein
  Pfam annotation: Domain name=Mito_carr; Domain location=5-114; Score =75.5; E_value=1.7e-19; Accession=PF00153.17; Description =Mitochondrial carrier protein
  Pfam module annotation: Pfam domain module=Mito_carr::Mito_carr::Mito_ carr; Domain location=121-216::221-314::5-114
MGVKGFVEGGIASVIAGCSTHPLDLIKVRMQLQGETQQPSNLRPALAFHPSSVHAPPQPAAKEGPIAVGVKLVQQEGVAALFSGVSATVLRQLLYSTTRMGLYEVLKKKWSDPNSAGGTLSLSRKITAGLISGGIGAVVGNPADVAMVRMQADGRLPPIRQRNYKSVLDAIARMTKDEGITSLWRGSSLTVNRAMLVTASQLASYDQFKEMILEKGVMRDGLGTHVTSSFAAGFVAAVTSNPVDVIKTRVMNMKVEPGAAPPYSGALDCALKTVRKEGPMALYKGFIPTISRQGPFTVVLFVTLEQVRKLLKDF

SEQ ID NO: 157019 - protein, 144 aa, Glycine max
  Coding DNA Sequence Number=SeqID_40241
MKANMEAMKEKMTMMMESLMSMRRMMESKQFFPRYDLPPIYTPPNVAHAPDENGLQFCPQPQPLHFAVGRVPPAMVERGNFDHIEERLMAIEGGGDYAFADMAELCLVPDVVIPPKFKVLDFDKYKGTTCPKNHLKMYSRKMGA

SEQ ID NO: 157020 - protein, 106 aa, Glycine max
  Coding DNA Sequence Number=SeqID_40242
MKLCFYIRCSGLARLSFIGKTASDGVDYTSNMLGGVLILVEVVTHAAVASVFVCLSLSIFCLLPSSCAAPLDVLRALLLLGDCLYLVVFDLGLGCFVWVAGWVPLG

SEQ ID NO: 157021 - protein, 81 aa, Glycine max
  Coding DNA Sequence Number=SeqID_40243
MDTRLCVIGDLMNGVQRYTKMKFGGVVPFLIPMTRGGGHNSLFEDSPSECGGGAATVRYGLISKGHSRNKIQAQGRVTRYH

SEQ ID NO: 157022 - protein, 138 aa, Glycine max
  Coding DNA Sequence Number=SeqID_40244
  Gene Ontology: Mol. function=protein binding
MKVVIAICAVYKNNSDHVHIVQTGVVQPLIEMLQEMYSSGKLPLLKLLDSKNGPLQHNAAFALYGLADNEDNASDFIRVGGIQRLQDGEFIVLGFCSYPWMPKLKKHLNICNLKNRGKIDSSLTYIDPYGIAFYCRQL

SEQ ID NO: 157023 - protein, 62 aa, Glycine max
  Coding DNA Sequence Number=SeqID_40245
MAFAGISNDQKMTPFELEHVVNKLDVHRRFFVHGLKLQEAFKSKLFWWSTYMEGSSKISKLQ

SEQ ID NO: 157024 - protein, 106 aa, Glycine max
  Coding DNA Sequence Number=SeqID_40246
MGGPVKEIGPKIEVDVLSLNCNAKKVVKVVPEDSTQNGIEDMDVDGANGVGKGGPVAKIEVVRVETLANVQDAETEVVYVSPEDDGQTSDTSNDGYHFEEFESSQQ

SEQ ID NO: 157025 - protein, 164 aa, Glycine max
  Coding DNA Sequence Number=SeqID_40247
  Homolog annotation: Hit_ID=Q1SKD7; Match level="QueryCoverage=89%, HitCoverage=38%, E-value=1e-12, Identity=26%"; Hit description =Ankyrin
MDFNRHQFWSAKHQQHFETIKGWSFVRERWVQLSNDEFSDFQEEIARRHWAPLVTPMAKFDLEILMEFYANAWPTEEGVEDMRSWVRGQWIPFDANALSLYLGHPLVLAEGQQCEYNQRRRQVSSFDEEAIAQLLCIPGQDFTQTIVGRWVWIMRTSMTTLTQI

SEQ ID NO: 157026 - protein, 72 aa, Glycine max
  Coding DNA Sequence Number=SeqID_40248
MERLLVKNTWSRHQRLLEENTRKNKKTKQKMALGVMAARLGKLLLQPEVTLLAQASWLLHPETIWGPMRARG

SEQ ID NO: 157027 - protein, 191 aa, Glycine max
  Coding DNA Sequence Number=SeqID_40249
  Gene Ontology: Mol. function=DNA binding; Cellular component =mitochondrion; Biological process=DNA integration
  Homolog annotation: Hit_ID=Q1S9T4; Match level="QueryCoverage=99%, HitCoverage=14%, E-value=1e-101, Identity=92%"; Hit description =Integrase, catalytic region
MNALKRIIRYIKGTITHGLHLSPSSADKLTTYTDADWGGCPDTRRSTSGYCVYLGDNLVSWSAKRQPTLSRSSAEAEYRGVANVVSESCWLRNLLLELQCPIAKATLVYCDNVSVVYLSGNPIQHQRTKHIEMDIHFVREKVARGQIRVLHVPSRYQIADIFTKGLPLQLFSDFRDSLNIRPPPVSTTGVY

SEQ ID NO: 157028 - protein, 183 aa, Glycine max
  Coding DNA Sequence Number=SeqID_40250
  Gene Ontology: Mol. function=cysteine-type endopeptidase activity; Cellular component=endoplasmic reticulum; Biological process =proteolysis
  Homolog annotation: Hit_ID=Q1SMM3; Match level="QueryCoverage=52%, HitCoverage=34%, E-value=2e-39, Identity=77%"; Hit description =Peptidase C1A, papain
  Pfam annotation: Domain name=Peptidase_C1; Domain location=71-183; Score=-13.1; E_value=1e-10; Accession=PF00112.13; Description=Papain family cysteine protease
EELHHGLNIYVTQLHRNDITINKLEKFSWEDEEVFQEWLKEQAYSKGSHRRSIAWSRTKKLQKGDDDDDDLPDSVDWRNKGKLSLNVTLSVQQLVDCDPASNDCAGGFYFNAFGYVIDNGGVDTEAHYPYIAQNSTCKANANKVVSIDNLEVVVGREEALLCRVNKQPVNVTIDATGLQFYAG

SEQ ID NO: 157029 - protein, 466 aa, Glycine max
  Coding DNA Sequence Number=SeqID_40251
  Gene Ontology: Mol. function=protein-tyrosine kinase activity; Cellular component=large ribosomal subunit; Biological process =protein amino acid phosphorylation
  Homolog annotation: Hit_ID=Q6QNV0; Match level="QueryCoverage=86%, HitCoverage=62%, E-value=2e-93, Identity=45%"; Hit description =Receptor-like kinase
  Pfam annotation: Domain name=LRR_1; Domain location=108-131; Score =2.6; E_value=95; Accession=PF00560.23; Description=Leucine Rich Repeat
  Pfam annotation: Domain name=LRR_1; Domain location=137-157; Score =8.2; E_value=8.3; Accession=PF00560.23; Description=Leucine Rich Repeat
  Pfam annotation: Domain name=LRR_1; Domain location=159-180; Score =22.2; E_value=0.0018; Accession=PF00560.23; Description=Leucine Rich Repeat
  Pfam annotation: Domain name=LRR_1; Domain location=182-203; Score =11.1; E_value=2.3; Accession=PF00560.23; Description=Leucine Rich Repeat
  Pfam annotation: Domain name=LRR_1; Domain location=205-227; Score =19.0; E_value=0.017; Accession=PF00560.23; Description=Leucine Rich Repeat
  Pfam annotation: Domain name=LRR_1; Domain location=229-252; Score =11.1; E_value=2.4; Accession=PF00560.23; Description=Leucine Rich Repeat
  Pfam annotation: Domain name=LRR_1; Domain location=84-106; Score =13.0; E_value=1; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=108-131::137-157::159 -180::182-203::205-227::229-252::84-106
MKPLFCLFLILVSLFSLVESSCNNNSEEHDLLSKAFKSVSGFNASSSSFQTNNCFQTHIITRIVLPSQNLSGTISWGYLRNMSKLQVIDLSGNALQGHVPCWFWSSSSLLEINLSRNRFGGSILKPTAENTSFSFSSIKTLNLSHNRFTNSIQLSVFRNLKILDLSHNNLVTLPSGFQNLTKLQHLDLSSCNLQTNIKAISSLDSLNHLDLSNNNFTGNFPSDFPPLTTLKFLNISFNNFTSSISVNRLTRFGKSAFVHAGSNFTYDSTKNSTQEEAITHKRKFKTLIAAASSAIVLILLSIWALRIVIQKRKQSAKRKKWAISMPVPQGMTMTMMMKSGPFAFETESGSTWVADLKEPSSAPVVMFEKPLINLSFKDLIVATSHFGKDSLLAEGRCGPVYRAVLPGELHVAIKVLEHARDVDHDDSVATFVDLARLKHPNLLPLSGYCIAVKSIVAAASGYDCAW

SEQ ID NO: 157030 - protein, 446 aa, Glycine max
  Coding DNA Sequence Number=SeqID_40252
  Homolog annotation: Hit_ID=Q2R429; Match level="QueryCoverage=84%, HitCoverage=88%, E-value=2e-54, Identity=36%"; Hit description =Expressed protein
MDSNVCSSVASLNCTAITELEYRGMEGIPVRIVIPSASTCHSHDFQRKTIIQVSSSSTRRVPTHNRYFRFTVPAKLSPSDFQDFQSYARPSHLLPASEVKVYTNTSVENISSSLKEDGSKSLFMVKLVTSNAYGSSISDLNAGILLCLIDENGNSILQRIPVSLMMDHSTESGDMTNIDMLHFQRGSVDEFIFEGPKIARLKALWVSVESGQWRLGSVSLMVINCEGQPSGPEDGVPTYTGFQYDFQIDDVLLGEGVDLSMLELRPSLVTELEGIDPISIFNKGLNDPNLLSSPKISNEESMKEYADLKFSLLFYDAMLMLFGTSVASLLAGENAGIAFLIGGIGGFLYLLLLQRSVDELPASELITNDKERTDALFRGVKGPIASVALALGLAVIASRYSSGGLQVMLTPKDLIVGMLGFLACKVSVVLAAFKPITLGSKLPSDM

SEQ ID NO: 157031 - protein, 213 aa, Glycine max
  Coding DNA Sequence Number=SeqID_40253
  Gene Ontology: Mol. function=nucleotide binding; Cellular component =intracellular; Biological process=small GTPase mediated signal transduction
  Homolog annotation: Hit_ID=Q41253; Match level="QueryCoverage=99%, HitCoverage=100%, E-value=3e-77, Identity=72%"; Hit description=Rac -like GTP-binding protein RAC13
  Pfam annotation: Domain name=Miro; Domain location=8-121; Score=49.6; E_value=1.1e-11; Accession=PF08477.3; Description=Miro-like protein
  Pfam annotation: Domain name=Ras; Domain location=8-196; Score=234.1; E_value=3.1e-67; Accession=PF00071.12; Description=Ras family
  Pfam module annotation: Pfam domain module=Miro::Ras; Domain location= 8-121::8-196
MSTARFIKCVTVGDGAVGKTCMLISYTSNTFPTDYVPTVFDNFSANVTVDGSTVNLGLWDTAGQEDYNRLRPLSYRGADVFLLCYSLISKASYENISKKWIPELRHYAPNVPIVLVGTKLVMHYSLCNNPPVNLQWMQYSSTYIQLNVMTYMPWQKTEEGEELKKMIGAVTYIECSSKTQLNVKTVFDAAIKVALKPPKPKKKPRKKRTCTFL

SEQ ID NO: 157032 - protein, 161 aa, Glycine max
  Coding DNA Sequence Number=SeqID_40254
  Gene Ontology: Mol. function=amino acid transporter activity; Cellular component=membrane; Biological process=amino acid transport
  Homolog annotation: Hit_ID=Q1RZ34; Match level="QueryCoverage=97%, HitCoverage=32%, E-value=6e-60, Identity=72%"; Hit description=Amino acid/polyamine transporter I
QLSSAAYQLLGMADLGFIPRIFGERSKWFNTPWMAILISTVIALGMSFLTFTEIISTVNFLYSLGMLLEFAAFLRLRRKFPALKRPFQVPLGFFGLVIMCFVPSVLLVYVMSVASKIVYVASAFLTSLGIALYYFMNLSKSRKWLEFSRVGDKLGENDYVL

SEQ ID NO: 157033 - protein, 389 aa, Glycine max
  Coding DNA Sequence Number=SeqID_40255
  Gene Ontology: Mol. function=sequence-specific DNA binding; Cellular component=nucleus; Biological process=regulation of transcription, DNA-dependent
  Homolog annotation: Hit_ID=Q6X7J4; Match level="QueryCoverage=99%, HitCoverage=100%, E-value=3e-67, Identity=40%"; Hit description =WUSCHEL-related homeobox 9
  Pfam annotation: Domain name=Homeobox; Domain location=54-115; Score =55.8; E_value=1.4e-13; Accession=PF00046.19; Description=Homeobox domain
MSSSNRHWPSMFKSKPCNNPHNQWHHDINSSIVSTGCQRSPYANSGGDERTPEPKPRWNPKPEQIRILEAIFNSGMVNPPRDEIRKIRVQLQEYGQVGDANVFYWFQNRKSRSKHKLRHFQNTKNQNNAEAQQQHRVDASSSLSQTTPLSSSSSSSDKSSSKELAYNPNGFSFGFSNVNDVAVPNSPTASVNQTYFHPHNHSDNNLLPQEPFSFTMHNNNGQGFVDNNTITTLGFSVPQFSSNMMQSQLQCQQNVGSCTSLLLSEIMSHGTFSKKDQDKALKIMHPQLSNFPLTSTPTTIIAPPISTVLDPSPITQLEGVGEVAAGDRAKCITVFINDVVFEIVMGPFNVRQAFGDEAVLIHSSGNPVPTDEWGITLHPLHHGACYYLV

SEQ ID NO: 157034 - protein, 106 aa, Glycine max
  Coding DNA Sequence Number=SeqID_40256
  Gene Ontology: Mol. function=transcription factor binding; Cellular component=intracellular; Biological process=regulation of transcription, DNA-dependent
  Homolog annotation: Hit_ID=Q40198; Match level="QueryCoverage=93%, HitCoverage=48%, E-value=2e-35, Identity=75%"; Hit description=RAB11H
  Pfam annotation: Domain name=MMR_HSR1; Domain location=14-101; Score=- 12.3; E_value=0.013; Accession=PF01926.13; Description=GTPase of unknown function
  Pfam annotation: Domain name=Miro; Domain location=15-104; Score= -0.3; E_value=0.0058; Accession=PF08477.3; Description=Miro-like protein
  Pfam annotation: Domain name=Ras; Domain location=15-91; Score=2.1; E_ value=2e-09; Accession=PF00071.12; Description=Ras family
  Pfam module annotation: Pfam domain module=MMR_HSR1::Miro::Ras; Domain location=14-101::15-104::15-91
MGAYRADDDYDYLFKVVLIGDSGVGKSNLLSRFTRNEFSLESKSTIGVEFATRSIRVDDKVVKAQIWDTAGQERRNEEVGAAGYFVRNIFSKHKQWKNYEDNVSYG

SEQ ID NO: 157035 - protein, 372 aa, Glycine max
  Coding DNA Sequence Number=SeqID_40257
  Gene Ontology: Mol. function=nucleotidyltransferase activity; Cellular component=cytosol; Biological process=biosynthetic process
  Homolog annotation: Hit_ID=Q1RZ32; Match level="QueryCoverage=99%, HitCoverage=100%, E-value=1e-109, Identity=52%"; Hit description =Glucose-1-phosphate adenylyltransferase, GlgD subunit
  Pfam annotation: Domain name=Hexapep; Domain location=269-286; Score =12.6; E_value=1.4; Accession=PF00132.14; Description=Bacterial transferase hexapeptide (three rep
  Pfam annotation: Domain name=Hexapep; Domain location=298-315; Score =12.8; E_value=1.3; Accession=PF00132.14; Description=Bacterial transferase hexapeptide (three rep
  Pfam annotation: Domain name=Hexapep; Domain location=321-338; Score =1.8; E_value=85; Accession=PF00132.14; Description=Bacterial transferase hexapeptide (three rep
  Pfam annotation: Domain name=NTP_transferase; Domain location=4-269; Score=-58.7; E_value=2.4e-05; Accession=PF00483.13; Description =Nucleotidyl transferase
  Pfam module annotation: Pfam domain module=Hexapep::Hexapep::Hexapep:: NTP_transferase; Domain location=269-286::298-315::321-338::4-269
MDFQVVVLGGGVSKKLIPLVSQELPNALLPLANRPVLSYVLEYLELSNLKDLIVVVEGEEAALHVGAWISGAYADRLHVEVAAVPEDVGTAGAIRAISHHLTAKDILVVSGDLVTDVPLGAVAATHRRHDAVVTAMLCSAPVSGPLESVSSGGKDKTKKPGRYDLIGLDPTKQFLVHIATGAEVEKDLRIQKSMLPAVGQIEIRADLMDAHLYAFKRSVLQEVLDQKSAFHSLKHDVLPYLVRSQLVIGEASRLSGYSFSTLNNIIHPSAELGAKTTVGPHCILGEGSQMGDKCSVKRSVIGRHCRIGANVKVVNSVVMNHVTIGESCSIQGSVICSNVQLQERAVLKDCQVGAGFVVTAGSECKGEVLAKK

SEQ ID NO: 157036 - protein, 247 aa, Glycine max
  Coding DNA Sequence Number=SeqID_40258
  Gene Ontology: Mol. function=catalytic activity; Biological process =metabolic process
  Homolog annotation: Hit_ID=Q1RZ28; Match level="QueryCoverage=95%, HitCoverage=87%, E-value=1e-82, Identity=73%"; Hit description=AMP -dependent synthetase and ligase
MKVLMILRFNHIMLKQFRHQVMLVANAIDVTFSKGDAIAIDMQMTLIALFQKKLQRVSKAKGIFTQPEDVACVGEVGLFPIYMGATDRLLNADNEEVYFKGMPIYKGKVLRRHGDIIKRTAGGRFIGQGRADDTMNLGGIKTSSVEIEHVCDRANKGILETAAISVSPANGGPEQLVIFAVLKKGYNSNAETLKRKFSKAIQSNLNPLFKVSLVKIVPDFPRTASNKLLRRVLRDQMKRELSIQSRL

SEQ ID NO: 157037 - protein, 81 aa, Glycine max
  Coding DNA Sequence Number=SeqID_40259
MAAMVPATTVMVTTVVTVGGGGGNHGYHDGGGNHDSQGSGNDNKDQCSKKIIILKFSSRQIWSLTEAHVQFLEGVIYAISS

SEQ ID NO: 157038 - protein, 128 aa, Glycine max
  Coding DNA Sequence Number=SeqID_40260
GSMEPTFIVVERDCCSLFVEAVIAFADNFQLVDNSRELIDNGDASSIGACRSRIFFINGFLCFLEDEWQRNGERERERRRHFKEKMSLEEAHHHRRPWIRAWRKKEMNEGRGREEHEILCSKRALKSE

SEQ ID NO: 157039 - protein, 544 aa, Glycine max
  Coding DNA Sequence Number=SeqID_40261
  Homolog annotation: Hit_ID=Q5JMX2; Match level="QueryCoverage=98%, HitCoverage=97%, E-value=1e-113, Identity=42%"; Hit description =Putative vascular plant one zinc finger protein
MKKVPKNSCKSASHRLFKDKAKNRVDDLQLMFLDLQFARKESRTVDAAVLEEQVHQMLREWKAELNEPSPASSLQQGGSLGSFSTDICRLLQLCEEEDDASSQLAAPKPEPNDQTLQVGGKVMFQEWNVLWAHISDVPSLLSRWIDLMQQTNNQGLGIHGYSSDRATGGWIWSVTSGEALMVKPFLRVYTCLLLKIGIFLQRAVSAFTNCTFIQYFSTGLGQQQHDFPFVDECKHFTSSVQNVAANNPDGHDLEYHQFDLHQDYDHGFYTGFNGPKCALWDCPRPAQGLDWCQDYCSSFHAALALNEGPPGMAPVLRPGGIGLKDNLLFAALSAKAQGKDVGIPECEGAATAKSPWNAPELFDLSVLEGETIREWLFFDKPRRAFESGNRKQRSLPDYSGRGWHESRKQVMNEFGGLKRSYYMDPQPLNHFEWHLYEYEISKCDACALYRLELKLVDGKKNSKTKAANDSVADLQKQMGRLSAEFPHDNKRAAKGRAKINTKVGIGGGVYSASHRVTPLNGTYEYGLAAPYDYLVDNMGDYYGT

SEQ ID NO: 157040 - protein, 292 aa, Glycine max
  Coding DNA Sequence Number=SeqID_40262
MKLANPEDFWCSAKALECGSFPTPPKQLGDGALSSSSSLRPFVKQVGLTGGTGPPSSVALAVGEVGQPADEVGPVVVVAKVTHNSSSSVLAKRKRDNVVRPSSCKKSKAPISLCALRQVVGLMSSAGRPSTTQDVPPTPLGIEASTVAAITPVTPASSPPPVVVVQKVTPTAVEVIVLATQADSTVALSFTVATPLLSANVETTGAPTVLPPSSSAPMASPSTILAVRALPRRGRSEAVAQHEKGFQKAVRQAGFFAKDLDLGLFDPFKDVKDGVLLDEEDIAAEEEAADKG

SEQ ID NO: 157041 - protein, 118 aa, Glycine max
  Coding DNA Sequence Number=SeqID_40263
MSVKNLVGRLGGDQSGSQCFARMLQPYGINIGLKEHSNRVTPKAHTPKSPSGPLPPDSASDSNIFSGSLRFLQLFLRDCSDRIPKRQRDGEEIETSTCTVFMRFLFLPPRILSQKSQR

SEQ ID NO: 157042 - protein, 52 aa, Glycine max
  Coding DNA Sequence Number=SeqID_40264
MSTTKLWFNGLCQLQILSNCTLTEVHLAIREYIALDWNITFSRTWEENSRAN

SEQ ID NO: 157043 - protein, 141 aa, Glycine max
  Coding DNA Sequence Number=SeqID_40265
MQKHITTSLLCVIHDEVACMQEHDAQNPGRTTPWSILLRACKTQGPSLASPIDSPHYVSNMCHFVRDTYARACQYVSSTCHPQRVSCTEEHNTCTARKTRQTQALHLAYPWYASTRLRRFDKTRGKHVLGPRLDKPMVHPW

SEQ ID NO: 157044 - protein, 115 aa, Glycine max
  Coding DNA Sequence Number=SeqID_40266
MSEDSRLTQDEPIIQSSLLKTRALRAFQRIQHVIENKEFPDPRVVTCRSSRGNQSSCEPTISCFGGKRLILSSLPNDNIRSIVIEKDTVEFLPYVKWNYHSNLVPMPNHIPKDVP

SEQ ID NO: 157045 - protein, 214 aa, Glycine max
  Coding DNA Sequence Number=SeqID_40267
  Homolog annotation: Hit_ID=Q1SKD7; Match level="QueryCoverage=98%, HitCoverage=57%, E-value=1e-15, Identity=25%"; Hit description =Ankyrin
MALTKLSTKRSRRDVMVEGSSAAPKFDSHHFRSAEHQQRFEAIKGWSFHRERHEEIARRHWMSLVTPMAKFDPELVLEFYANAWFTEEGVRDMRSWVKGQWIPFDADALNQFLGEPLVLQEGQQCEFSQRRNRADGFDEEAIAQLLCTPGQDFARTAAGRRVQIMRTSMTTLTQTWMALLLSNVLPSDHNSDLSLPKCQLVYAILTRMSVHVAQ

SEQ ID NO: 157046 - protein, 348 aa, Glycine max
  Coding DNA Sequence Number=SeqID_40268
  Gene Ontology: Mol. function=transporter activity; Cellular component= integral to membrane; Biological process=transport
  Homolog annotation: Hit_ID=Q57PD1; Match level="QueryCoverage=99%, HitCoverage=75%, E-value=1e-138, Identity=70%"; Hit description =Putative membrane transport protein
  Pfam annotation: Domain name=MFS_1; Domain location=10-297; Score= -8.7; E_value=0.00079; Accession=PF07690.6; Description=Major Facilitator Superfamily
  Pfam annotation: Domain name=Sugar_tr; Domain location=1-331; Score= -116.4; E_value=0.0031; Accession=PF00083.14; Description=Sugar (and other) transporter
  Pfam module annotation: Pfam domain module=MFS_1::Sugar_tr; Domain location=10-297::1-331
MGDSIGRKKVLFITIIMMGICTTLIGVLPTYAQIGIFAPVLLVTLRIIQGLGAGAEISGAGTMLAEYAPKGKRGIISSLVAMGTNCGTLSATAIWAIMFFALDREQLLAWGWRVPFLASVVVMIFAIWLRMNLKESPVFEKVNDAQIVQPDTSLGSMVKSKSFWLATGLRFGQAGNSGLIQTFLAGYLVQTLLFDKAIPTDALMISSILGFISIPLLGWLSDKVGRRLPYIILNISAILLAYPMLSIIVDKSYAPGTIMLSIIVIHNFAVLGLLRWKISPWRRCLAREIALPGWLSPKRRAVWWRWVIGLVSACLMPEVRDRDLSAAEDAAEATPKEPVAYGTVSSRR

SEQ ID NO: 157047 - protein, 78 aa, Glycine max
  Coding DNA Sequence Number=SeqID_40269
MSSCIDRTNVSCATKPYILHVILKLRIWIIVMIHQLTPTNMRFNNYPNVLWNGEALDTFLPSRGVLQGDPISSYISVN

SEQ ID NO: 157048 - protein, 65 aa, Glycine max
  Coding DNA Sequence Number=SeqID_40270
  Gene Ontology: Cellular component=anchored to membrane
  Homolog annotation: Hit_ID=O65638; Match level="QueryCoverage=75%, HitCoverage=16%, E-value=3e-10, Identity=57%"; Hit description =Thaumatin-like protein
MNFNPNVLKLHHRQVNCGSSVVECNGSNVILSVTIVEFTLNDANGLDFFNVNLVKGYNLSMIVEP

SEQ ID NO: 157049 - protein, 210 aa, Glycine max
  Coding DNA Sequence Number=SeqID_40271
  Gene Ontology: Mol. function=ligase activity; Biological process =response to auxin stimulus
  Homolog annotation: Hit_ID=Q9ZNS2; Match level="QueryCoverage=65%, HitCoverage=22%, E-value=1e-39, Identity=59%"; Hit description =Putative GH3-like protein
  Subcellular localization annotation: CTP_CleavageSite=40; ConfidenceScore=5.42e-01
MVGSVPCLAFFYLLALWKLTPTNTKIYSFLFATLANAPARSSTINNPSSMEPPVLSFNSNDTTNNGNCTTDFDIITWFEDVSKNAGSVQIQTLCKILKQNYGVEYLKTWLGSYNISEMDACALESLFTSVVPLASHADFEPYIQKIADGDTGPILTQQPITTLSLRLCSSGTTEGRQKFVPFTRHSAQTTLQTFTLAAAYRSRVYPTREG

SEQ ID NO: 157050 - protein, 215 aa, Glycine max
  Coding DNA Sequence Number=SeqID_40272
  Homolog annotation: Hit_ID=Q1S7C5; Match level="QueryCoverage=42%, HitCoverage=10%, E-value=2e-07, Identity=33%"; Hit description =Integrase, catalytic region
MQLENRSVFEYLLQIQSLVDFVGSIGVIISSDKHLDAILKGLTREYESTMSLICHEARLDKFLKWDSLVTVNLTQGASTSNRSINFTQGASTSNNFAYVQPVQVVQNLPSSSSGNSNSQSFHAQAHLTRGNYDNSNDTNNGNRFFNYGRGGGSGYGGCIKDLNNSARRDGRDRGLKNTLVGFSVPIKLSLPDDGELEDTSGGFSTYISSSFPDDR

SEQ ID NO: 157051 - protein, 84 aa, Glycine max
  Coding DNA Sequence Number=SeqID_40273
MGGGVTEMMKNTRVSETLALQSAVTSKVCCKLCHAHTTLSHSRPTVIASAFPLLLPTVMEACLWGFYGDAAEDKGEEVRGGAIY

SEQ ID NO: 157052 - protein, 116 aa, Glycine max
  Coding DNA Sequence Number=SeqID_40274
MRLEQGSHSCIPRAIDSHGAFAILYSRHSKHYIKKPEVFEHVNRFYLDGQLKVFPWTLTWAKKDMAMQYLDVNKITHGLSYCCNVVLDKRNAENKSSVDTSVVLPIFPPNFSFKEK

SEQ ID NO: 157053 - protein, 212 aa, Glycine max
  Coding DNA Sequence Number=SeqID_40275
  Gene Ontology: Mol. function=ligase activity; Cellular component =cytoplasm; Biological process=response to auxin stimulus
  Homolog annotation: Hit_ID=Q9ZNS2; Match level="QueryCoverage=90%, HitCoverage=32%, E-value=4e-74, Identity=69%"; Hit description =Putative GH3-like protein
  Pfam annotation: Domain name=GH3; Domain location=1-208; Score= -170.1; E_value=3e-09; Accession=PF03321.4; Description=GH3 auxin -responsive promoter
FAYGIVQAFCTFEEVWRDLCNDIRDGTLSSRIKLPQMREAVLGTITSNPSLASKLEEACLELEVVDWFGLVPKLWPNAKYLYSIMTGSMQPYLKKLRHYANGVPLISADYGSTESWIGVNVDPCLAPEKVTFAVVPTFSYFEFIPLYYRQKQDFSSVADHDFMEDEPIPLSQVKVGQEYEIALTTFTGNYSFILLLFYKIIPPPVIHIYNYV

SEQ ID NO: 157054 - protein, 154 aa, Glycine max
  Coding DNA Sequence Number=SeqID_40276
FNIARNPSLEPTKPPTLLLEVWIEENPTYTLGTRVLKHLWVLKAQSFLREYCCMRYEESFKFRAILLDLTAIVTIWVRGSEQKVGPSIVCVAFSSFFGNFQFTCVNCNALIAGVAAMFECFDVIARIAITPSCSQLMNTKEMQRKCLTLSHHAD

SEQ ID NO: 157055 - protein, 332 aa, Glycine max
  Coding DNA Sequence Number=SeqID_40277
  Gene Ontology: Mol. function=protein binding; Cellular component =integral to membrane
  Homolog annotation: Hit_ID=Q10HL4; Match level="QueryCoverage=44%, HitCoverage=48%, E-value=5e-67, Identity=78%"; Hit description =Peroxisomal membrane protein, putative, expressed
MISEFILVIVVESLKPPVSNYHKCLILQISLSKCLVPGLREGWTLYEIVRYIPEHNWIAYEQALKANPVLAKMAISGIVYSIGDWIAQCYEGKPLFEFDRTRVLRSGLVGFTLHGSLSHYYYQLCEALFPFQEWWVVPAKVAFDQTVWSAIWNSIYFVVLGLLRFESLTNIYGELKSTFLPLLTQSEQIESTQSREGGVPVNVHCGNGLVADCPFGVIETKKGKGRVETLAFCASDYLWCDSCGTKASLGGLCGAHLGHNTFNVAIQMRNQKLEYLRQHQKQGHPLQAKIPRNKQIENRRKNQSRFMAVAKSTSAMNQRIYQLKVQLSDLRT

SEQ ID NO: 157056 - protein, 112 aa, Glycine max
  Coding DNA Sequence Number=SeqID_40278
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=89%, HitCoverage=12%, E-value=1e-48, Identity=94%"; Hit description =Lipoxygenase-4
MESVGWWGRGRVAIKDPSAPHGVRLLIEDYPYASDGLEIWDAIKSWVEEYVSFYYKSAEELQKDPELQAWWKELVEVGHGDLKDKPWWQKMQTREELVEASAMDCFSSSCCC

SEQ ID NO: 157057 - protein, 239 aa, Glycine max
  Coding DNA Sequence Number=SeqID_40279
  Gene Ontology: Mol. function=enzyme inhibitor activity; Cellular component=cell wall; Biological process=cell wall modification
  Homolog annotation: Hit_ID=Q1STF3; Match level="QueryCoverage=96%, HitCoverage=68%, E-value=8e-53, Identity=52%"; Hit description =Pectinesterase; Pectinesterase inhibitor
  Pfam annotation: Domain name=Pectinesterase; Domain location=95-239; Score=-29.5; E_value=1.9e-19; Accession=PF01095.10; Description =Pectinesterase
MALDTCKELMDLSIGELTRSLDGIDTCLDGFENITSEVGKKMKDLLMTSMHMSSNALAIVSELADTVNNWNVTKSLGWRLLQDSELPSSFKHKPNVTIAEDGREYFTTINEALKQVPEKNRKSFLIYIKKGVHQEYVEATKEMTHMVFIGDGGKKTRKTENKNFIGGINTYRNRHYCEIENKAYLARPWKNYSRTIIIETYIDDLIHAYGYLPWQGLEDPSSINTCFYVEYHNTCLDSN

SEQ ID NO: 157058 - protein, 474 aa, Glycine max
  Coding DNA Sequence Number=SeqID_40280
  Gene Ontology: Mol. function=protein phosphatase type 2C activity; Cellular component=nucleus; Biological process=protein amino acid dephosphorylation
  Homolog annotation: Hit_ID=Q1SAL1; Match level="QueryCoverage=96%, HitCoverage=96%, E-value=0.0, Identity=82%"; Hit description=Protein phosphatase 2C-like
  Pfam annotation: Domain name=PP2C; Domain location=65-361; Score =108.2; E_value=2.5e-29; Accession=PF00481.12; Description=Protein phosphatase 2C
  Subcellular localization annotation: CTP_CleavageSite=81; ConfidenceScore=5.11e-01
MGCCVSTSSQSTCSSRSNGDTIAPTCLEIGFCGQKSARRTSSDHVVSLHQLPSLPNRIFTNGKSRSSCIFTQQGRKGINQDAMIVWEDFMPEDVTFCGVFDGHGPHGHLVACKVREALPLKLLSFLHSSESGQNGSGKACFRGNIKPESGESEKDLSAEDNENSMWREAFMKAYKAMDKELRSHPNLDCFCSGSTAVTIVKQGSNLFMGNIGDSRAIMGSKDSNHSMVAIQLTIDLKPDLPREAERIKRCKGRVFALEDEPEVHRVWLPFDDAPGLAMARAFGDFCLKEYGVISIPEFSHRLLTDKDQFIVLASDGVWDVLSNEEVVGIVSSAPTRSSAARILVDSAALEWKLKYPTSKMDDCAVVCLFLDGKMDSESDCDEPCFSSATIQSNHSENPVESDDGQKPEPSLRRNFTVRSSEENETCGGGVGGVFVDVDDGTSAAEDQNWSGLEGVTRVNSLVQLPRFSEERPNS

SEQ ID NO: 157059 - protein, 238 aa, Glycine max
  Coding DNA Sequence Number=SeqID_40281
  Gene Ontology: Cellular component=chloroplast thylakoid membrane; Biological process=photosynthesis
  Homolog annotation: Hit_ID=Q10LV7; Match level="QueryCoverage=53%, HitCoverage=77%, E-value=3e-43, Identity=72%"; Hit description =Possible Photosystem II reaction center Psb27 protein, putative, expressed
MWTREKVDLNLKNHWLLSHPKTKTQDKTIRPRGKNPTFLFFLLSSHHHNTKTLTFLSLTSLSHIIMASPTLITPKSVKSLTPIKPKPTTTIAATLTPPTTTSTAAATHPRRREFLSIITATTWLVPLSPALASSDEEYMKETEEVINKVRTTIVMDKNDPNVATAVAELRETSNSWVAKYRREKALLGRVSFRDMYSALNAVSGHYISFGPTAPIPAKRRARILEEVDTAEKALLRGR

SEQ ID NO: 157060 - protein, 109 aa, Glycine max
  Coding DNA Sequence Number=SeqID_40282
MACKPSSFLALLLIATILLATTWQAVARRHIIPKHSNKGDKKEPQFLFPPEGLPPFFGFTPQSPNTGGSGLGSGPLGRGYVPGGDDTFVPNPGFEFPNPGSGGGVPVNP

SEQ ID NO: 157061 - protein, 179 aa, Glycine max
  Coding DNA Sequence Number=SeqID_40283
  Gene Ontology: Mol. function=nucleic acid binding; Cellular component= nucleus; Biological process=DNA integration
MTEEYDSFMKNQSWKLVERPKKQRLIGCKWTFKKKPKILGVEKGKDIREAKRILGMDIVRDIIKGTIHFSQGSYVEKVLKKFNMFNAKPISTPIAGHFKLSLSQSPSNEEEYKFKSNILYAHATRSLMYAMVCSITYIAYGASLVSKFMGNLGNEHWMTVKWLFRYLKKTTNIGLKFSK

SEQ ID NO: 157062 - protein, 270 aa, Glycine max
  Coding DNA Sequence Number=SeqID_40284
  Gene Ontology: Mol. function=nucleic acid binding; Cellular component= intracellular; Biological process=DNA integration
  Pfam annotation: Domain name=rve; Domain location=30-196; Score=31.6; E_value=2.7e-06; Accession=PF00665.16; Description=Integrase core domain
MTDGYDNSDVLIVTDQPCSDEWILDSGCTFHMTLNQEWFDTYKKVDIGSVLMDDGSVKVLIEVRHVLELKRNLLSLGMLGEAGCNFKGEGGTIIISKGSNQIMKGIRKNGLYRFDEFNEFHKDKGITRHKTVRLTPQHNGLAERMNRTILERVRCMLSNAKLIKQFWGETAHTTTYIINRSPSVTIQFKTPEELWKDMPPSLKHLRIFGCDAYIHTNKGKLEPRSKKGIFLRYLDGVKGYKVWIIESRRGKAATSRDVVFNEEHMMKGDE

SEQ ID NO: 157063 - protein, 77 aa, Glycine max
  Coding DNA Sequence Number=SeqID_40285
MTYANARMTCSLCWHEEMHDVIKEQARELSVTMHHQKRKTLDEASLLSSESETQHDYRSTSTPYGSHRPGYRTQHLK

SEQ ID NO: 157064 - protein, 151 aa, Glycine max
  Coding DNA Sequence Number=SeqID_40286
MDVEHVDYATDEIYEQPQETIAYDVVADAQGFPGGPHDTLVLTKYEHPKLKLSSHGRRVEKFGRSAPNIEGIVATTRLSPLIACSLDTGEVIITLNDVASLLHLPITDAFYTFDALHVNQVMDWLVELLEVSSQEARDETFQCHGAYVRLS

SEQ ID NO: 157065 - protein, 173 aa, Glycine max
  Coding DNA Sequence Number=SeqID_40287
  Subcellular localization annotation: CTP_CleavageSite=54; ConfidenceScore=5.16e-01
MKGLTAETMTTSTLTTGHSLAARRERRNERRPLDGVRKQNTKTKKRNISRNVVCVQNIKRKHASMNKINNGNVFPFCILFAPPILQWERVSIVDFISQSVIDTTSFFNTVLDPDNYLSKLLKLNSMVNLHHSLEAKDIAENTPESRVMFGDGATHGEEEDGETKKVNQMKRIR

SEQ ID NO: 157066 - protein, 66 aa, Glycine max
  Coding DNA Sequence Number=SeqID_40288
MATPLIFSLGDERIFYLIFLSSSSREVGCDKAIIAPPRDRPIFSGGGRIDEDEDMADPTDYYIGGD

SEQ ID NO: 157067 - protein, 459 aa, Glycine max
  Coding DNA Sequence Number=SeqID_40289
  Gene Ontology: Mol. function=RNA-directed DNA polymerase activity; Cellular component=chromatin; Biological process=RNA-dependent DNA replication
  Homolog annotation: Hit_ID=Q947Y6; Match level="QueryCoverage=95%, HitCoverage=64%, E-value=8e-26, Identity=36%"; Hit description =Putative retroelement
MVNTSIQDITFTVDLHILPLSGANVVLGVQWLKSLGPILIDYNALSMKFFHNNRIVELKGDVESTLHLLTPPQFRRLLRKEGKQEIESQVDAMLQKGLIRLITSPFSYLILLVKKQDRTQTFCMDYHALNVIMIKDHFPIPTIDELLDELGGEGGRGASWFYKLDLLQGCHQIQMHKDDVYKNVFHTHHGHYEFKESNQYPLRYRPFNNGPLCNPLEPCIVSWVSPDSTTNSFEDFTLLLTLEMDTSGISMGAVLSHKGHPIAFFSKPFTILTDHHNLQELMTQGGKALMSFSDALSAMGGPFIGLHYWFTTVSWKYHYTCCHRPFFEGHSPGDATTPSYFSFGSSPIHGHCRKTSRHATDVQFKIGEWVMVKLQPQRQSSVSGLHTGYSKLAKRFYRPFKILDKIGPAAYKLQLPEGARIHPMFHCSMLKPFCQPPSNDNVAPLTLSLHWLLWALKET

SEQ ID NO: 157068 - protein, 90 aa, Glycine max
  Coding DNA Sequence Number=SeqID_40290
METGRGVRKREDPSLLWETLLSLLMAEDMEEELEKTMKMLGFVKSKVILCDCEGEKVTRLAGRRECWKWKGGVHAKMGMVGVAFEKGSMG

SEQ ID NO: 157069 - protein, 231 aa, Glycine max
  Coding DNA Sequence Number=SeqID_40291
MDNVMAIKSMMRSFEIEVLDSKYRDWRGLNSSESLSYESEWWRNLKKSCGVHGEGDWFHKGIKWKVVDGSKTLIWLDKWLDNESLAGIGDKLGIKSIGCQYRRVVRIGLGMGLQMALKLHSKLYSMCTAYKLIHDIKVGSGDVEINGCNLKERQIGVENDNHLCHFCVTWNLWNHMNNCIFRGAVFDINSVMDTALYHAYEHGWKPMTKTSFSPSSNGRVMWVLASLNSCC

SEQ ID NO: 157070 - protein, 121 aa, Glycine max
  Coding DNA Sequence Number=SeqID_40292
MALGKVYDNLSTIHNVLYADDVVRVSVVKVYHSDTEVPFPTSEIRFVRIYKSINQNRLDLLNCTMQWLELIHWENRFMNDWSASLGYGSLYGFLEPQSIHNAKDRHQECQHYIETWVKESQ

SEQ ID NO: 157071 - protein, 307 aa, Glycine max
  Coding DNA Sequence Number=SeqID_40293
  Homolog annotation: Hit_ID=Q2PEP5; Match level="QueryCoverage=45%, HitCoverage=30%, E-value=2e-25, Identity=65%"; Hit description =Putative WD-40 repeat protein
  Pfam annotation: Domain name=BOP1NT; Domain location=86-269; Score= -109.5; E_value=2e-05; Accession=PF08145.2; Description=BOP1NT (NUC169) domain
MGNVTDMEVGSVSSSVTSIAATGSGGGARDPQIQERAINLETNLESERKIQSLMESYLKFERQKQRLMELDLKVEKERLRLTELKLEADKERRRIMEDALLSLFHEMLGRVTQEFAGMLSQTQLLLCSRMNQMNKVKIRLFVMYLESIPESVTSVGLQGLDDDAYAKHPLSSAPEPKRRSIPSKWEAKKVTNTSFTTICQGLITFDKTKEEDSPYLLWGDDSGSTERANHLTYIPAPNHKLPGHEDVVTLISLEASGQWMASGGMEMGPLFSVIFNGSSDGTVCIWEVETGTCLRQWEVDESVSCVA

SEQ ID NO: 157072 - protein, 831 aa, Glycine max
  Coding DNA Sequence Number=SeqID_40294
  Gene Ontology: Mol. function=RNA-directed DNA polymerase activity; Cellular component=chromatin; Biological process=RNA-dependent DNA replication
  Pfam annotation: Domain name=rve; Domain location=705-830; Score =47.6; E_value=4.2e-11; Accession=PF00665.16; Description=Integrase core domain
MANTEKNPKEKCKVVLTRCKRKKGLIGEELVEGVVEDVSDEEGDERDDEVLASKIKSRMEREAKKGAPIAPTKISLIPWFLDIFKKLEITIPFGEVPQHMPMYIKFLKDLLTKKDKYINNESIVVEGNCSAVIQRILPQNFKDPKNMTIMCLIGTMFVGKALIDLGASNNLMPLSMCQRIDNMKIVPTRMNLQLADHCFPRPYGVVEDVLDQKVTFNLFEVMKHPSDSKTYFRVKAIEHEANYVVQQFTMHLPLEKALVNAIECLMNEEEKDLRACLEDLDKLKEIPPGKYTFEEPKKDTLAEKPMGISPSYCTHKIMMKADYRQMRKPQRRLIPTIKEEGGMTVIHNDKNDLIPTKTITDWRMCIDCRKLNSATKKDHFVLPFMDLMLERLAGQAFYCFLDGYLRRMPCRLCNALAIFQRCMLAIFVDLAENNLVLNWEKCHFMVQEGIVFVHKISTRGMKVDKAKIDVIEKLPPLINVKGDFSKIAKPLSNFPNKDVVFKFDEECLLAFCTLKEKLIYAPIIRRNKVFHSIYYASKVLNDAQLNYATIEKELLAIVSALEKFRSYLIGSKFDFEIKDKKGCENIVVDHLSRLVNEEVTLEEKEIHDEFLDEYLLCVSERPWFTDIANFKAINKVSPKRNPEVYCGIATIHLIEDIELLRKCYSSGSFGLISSRMLVSMCNIMISAKEPEAFPRGMRCTCRILLRWRCLITRAFDFVGPLPSSYTNEYILVAVDYVSKWVEAVATQKDDAKTIVKFLKKNIFSHFGVPRVLISNGGSHFCNAQLQKVLGHYNVRHKVAFPYHPQTNGQVEVSNRELKKILNKTVAFSIKD

SEQ ID NO: 157073 - protein, 99 aa, Glycine max
  Coding DNA Sequence Number=SeqID_40295
MMKYLPSPWWSWILERNIGRLHIRSHNTSEVLWHCGTRVIFKRHSRWPFFHHWRLLKDRRSNGHYRFLQDKWMSQRWWKGRGSSFSLPNLLLLLRLFPP

SEQ ID NO: 157074 - protein, 92 aa, Glycine max
  Coding DNA Sequence Number=SeqID_40296
  Subcellular localization annotation: CTP_CleavageSite=57; ConfidenceScore=5.71e-01
MTSRWHHHTLISSGDHPLLGCAPRLTTSRKSKPRRFRDVSVGDFAKIFNRSSSFFVRSSSFFGLQPISKGLKSTCNFITSFKNKEIINGPMP

SEQ ID NO: 157075 - protein, 85 aa, Glycine max
  Coding DNA Sequence Number=SeqID_40297
  Homolog annotation: Hit_ID=Q2PEP5; Match level="QueryCoverage=55%, HitCoverage=6%, E-value=3e-13, Identity=66%"; Hit description =Putative WD-40 repeat protein
MTLHLANMHNLSFFEILPRAQSRRVALSGWLAKPADWLSEKTPSVSWIKDDKHMGLKLRHFKIVTAVEWHQKGDYFSTVMLEDIL

SEQ ID NO: 157076 - protein, 62 aa, Glycine max
  Coding DNA Sequence Number=SeqID_40298
MMNPASRTSSCSSNHGIEPNQATIENDSAESRSSAEKREEFVRKARHSSHPNCTVQFTRLRG

SEQ ID NO: 157077 - protein, 288 aa, Glycine max
  Coding DNA Sequence Number=SeqID_40299
MNLFQEVQPLMAEKDQHLDTSNQALTTIAYPLGLHISKATKAKIVADRVCLCLPIWDATKNNKGFKLYHYVEMPCREMKIEVNLIQDPNVFDTKTLWNQIVWNDTLKSSLFGYDGSDNAKHPDFVQDVDSYAVITRLKNLPIIFHETTHDLTKMDERNSRDHVIQLYNAQKTKRDKFEKDIATAKTDKEKANAKAHIEVATKAMDDIIVNEVSKAAQVDEAIKQQQEPVFKHSETSHEATSKERDAPDAMIAYSINSGPTPINYAPPNVVTINQVQDMIGQAMDTIAK

SEQ ID NO: 157078 - protein, 79 aa, Glycine max
  Coding DNA Sequence Number=SeqID_40300
MLIGDNPTKGIFWLDRGTHKPYLAFLTRAELYHGFVLDLTSMFVVLKGMEYSLLYYDFKDQITSLTRHPPFYIDVIDTK

SEQ ID NO: 157079 - protein, 102 aa, Glycine max
  Coding DNA Sequence Number=SeqID_40301
MAVMDLSLGNPLYRKSSWWVISESHSAIREHSRCGVKYLYVVAHGLLVQISLMFTPLNSPTMVSEPMVRLGDRLKRVRWRQWILSLGIPLAVDHGCSNGAST

SEQ ID NO: 157080 - protein, 367 aa, Glycine max
  Coding DNA Sequence Number=SeqID_40302
  Gene Ontology: Mol. function=polygalacturonase activity; Cellular component=cellulose and pectin-containing cell wall; Biological process=carbohydrate metabolic process
  Homolog annotation: Hit_ID=Q9FJ27; Match level="QueryCoverage=92%, HitCoverage=92%, E-value=3e-95, Identity=47%"; Hit description =Polygalacturonase-like protein
  Pfam annotation: Domain name=Glyco_hydro_28; Domain location=28-354; Score=-12.0; E_value=1.4e-08; Accession=PF00295.8; Description =Glycosyl hydrolases family 28
  Subcellular localization annotation: CTP_CleavageSite=61; ConfidenceScore=5.03e-01
MLFSPFLTLTFFLLFSSSVAAIYSAATCSNIVPLRYRSDRISITDFGGVGDGRTLNTKAFRAAVYRIQHLRRRGGTVLYVPPGVYLTESFNLTSHMTLYLAAGAVIKATQELGNWPLIVPLPSYGRGRELPGGSNVVVRYVTILAPRDSPNTDGIDPDSSSNVCIEDSYISTGDDLVAVKSGWDEYGIAYGRPSYGITIRRVTGSSPFAGIAIGSETSGGVENVLAEHINLFNMGVGIHIKTNSGRGGLIKNITVAHVYVENARQGIKIAGDVGGHPDEKFNPNALPVVKGITIKNVWGVKVNQAGLIHGLRNSPFTDVCLSDINFHGMEGPRSPSWKCSDVFGFAHQVSPWPCSQLSSQEPGSCAI

SEQ ID NO: 157081 - protein, 189 aa, Glycine max
  Coding DNA Sequence Number=SeqID_40303
  Gene Ontology: Mol. function=RNA-directed DNA polymerase activity; Biological process=RNA-dependent DNA replication
MGELSYPVTSTKEVADTINERLQLLRFRHPVVNQLNDQQRVHLKFNMNLHPELLTDVTVTQYMDNGLRSYHMPFLSFGVGCLDRETLIIRVAPNGGVSTIGMLQSISINYELPRKLENITLIQKINITKAKAEHLILGFTNVLPKDEVNFSSIMGASPNEILAKIFNIFASRCWERSDLHDISEDAQKR

SEQ ID NO: 157082 - protein, 276 aa, Glycine max
  Coding DNA Sequence Number=SeqID_40304
  Gene Ontology: Cellular component=nucleus; Biological process =regulation of progression through cell cycle
  Homolog annotation: Hit_ID=Q9ZRX9; Match level="QueryCoverage=95%, HitCoverage=90%, E-value=6e-42, Identity=57%"; Hit description =Cyclin D2.1 protein
  Pfam annotation: Domain name=Cyclin_N; Domain location=51-171; Score =74.4; E_value=3.5e-19; Accession=PF00134.13; Description=Cyclin, N -terminal domain
MEGSIDPATSSLLYESPSLDHKNLNFNNQYLIKDNHHGSEHLLDFSVQSDETVLGLVGREKENLPQDGYLKRLLSGDLDLSVRKEALDWIWKAHAYFDFGPCSLCLSVNYLDRFLSVYELPRGKSWSMQLLAVACLSIAAKMEEIKVPPCVDLQNLSLHLKLKTFKEWNYWPSEIAAAVAISVSREMQAEEIDKTLTCFFIVGKERILKCLELIKDLSLIQDSANLGTNLASFVPQSPIGVLDAACLSSISDELTVGSYTDSSLNTPNSKRRRKSD

SEQ ID NO: 157083 - protein, 221 aa, Glycine max
  Coding DNA Sequence Number=SeqID_40305
MATDVVADGLPLMFNQDGEPYFSFYWQFDPTRFKFFDEDLLTLMEMVNKAIFEQLLASLDAWAILSLPLASDPLVALDDKFIMGDFACRSLVKQVRPTGGIVPPSTIIPPTGEGGQPAIEVGRTAGIVEVSPMFLPLFWLRGSEMMGLGVDSRFGSPFKFAFASTTNATIVALAPPVVPIQEVIPTAEVSATDALADLVIAPTSTTTTAFLSAGVTATCAP

SEQ ID NO: 157084 - protein, 148 aa, Glycine max
  Coding DNA Sequence Number=SeqID_40306
MDSAKVFLQRSLMILKENGQRHQEAPNKVASLEAEVAKWRVAARTVWRVKSLKVANVTVAFTEAVKSNHQLSSKGGENYGGEGQACQGGGGPRGLAEGFRVQPRGGVKDDVLLDEEDIATEEEDAGEEQGTKEKQDLGGVGSKTLVVL

SEQ ID NO: 157085 - protein, 161 aa, Glycine max
  Coding DNA Sequence Number=SeqID_40307
MAFVRRTRGETCKTNDSDAQGRKFVEPPSMDNYCSVLRVATLTSGGHAFGFTGETRRVRHVQCTNNILAYMSLVEWAHTEDVVISIGVSSSKETHDGASDNESSSLERLRVRTVLVEALLTSMGGRNLSLLLCAELPSSPPVTASFEWVRDDVLKYRSSIK

SEQ ID NO: 157086 - protein, 81 aa, Glycine max
  Coding DNA Sequence Number=SeqID_40308
MVFLCDDDNNGGGDVDGGVGLVSIMVSERGNCISGADCSGGSSVVIVVVGGGSGDDDSKNNEIIIQGPLLASTNQHICLRN

SEQ ID NO: 157087 - protein, 89 aa, Glycine max
  Coding DNA Sequence Number=SeqID_40309
MKGSEAGIILEGPDNVILDQALKLNFKASNNQVEYKVLIAGKTTPEQICSPSWPAPKKTGRFKAIIQETLQTPTIDTEEVMAGEEEEPD

SEQ ID NO: 157088 - protein, 349 aa, Glycine max
  Coding DNA Sequence Number=SeqID_40310
  Pfam annotation: Domain name=rve; Domain location=2-146; Score=31.8; E_value=2.3e-06; Accession=PF00665.16; Description=Integrase core domain
MKLDACNRRLSTMSSMMASYSKEVPVDYFTKWIEATPLGEIIANEVEKFTWKHLICRYGLSYTIVTNNDTQFKAWAYEDFLARLGIKHLITFVEHPQTNGQAEAGNRVILKALRTRLNKSKDNNQQNSFSTHIWHKRHDPYQNWETVDKEDAFPGTEEQRKPTSSSNLRSSINESHMLVKPKARQTQGPPLVSLISLKTRQTQGPPLMSFVSPKACQTQGPPLMSLIFPKARQTQGPPLVSLIFPKARQTQGPPLENKSAGTLQTEGLPLVQKSKENKSTRTLQTEGLPRGAKIQGPPLVRTPTIPKACPWSAHSLRTTMTTVKGLSSKSLNKLPSDWSIRPSTRWKSY

SEQ ID NO: 157089 - protein, 600 aa, Glycine max
  Coding DNA Sequence Number=SeqID_40311
  Gene Ontology: Mol. function=RNA-directed DNA polymerase activity; Biological process=RNA-dependent DNA replication
MEYAVGELTASSATERYMSRGTPGPSRLKDGGVAMVFLKPKKSCSQVDFYSSICDYKAQELASTNPENAFFWVEAYVVFTDLSEYFFQVCHVLGYVMGFDDYVIDVDLDISSDLLFEDLIHQSLLAFGKLSTLNLDTPSTSFTMESVHIRHLPLTFLTMTTLANQDISYASVLMAGEVPDKLRTLPNFGSELQLDNQGLDWRPFVYAHDLSGTICCGMRLGRLPGGRIGCHYQAFHIALSCLLLICLDSHNLSRQGEELYLQMRYGDDGSELVECFPANQSKVRDVSGAALVDEDLGYHEVGDYDGVDVDVLDDVEVMLVGLARLPSVGKSTRNEVVDRVFVGGVFVFLDLLLCPFFCPHRDSYANPLGVLRYLVLSNPSLGGSGIGSFIGTSALKASSRIVVRLAVKVGLGATFSLVALLFDLLNLVLEPRHLFHLDVAFDPDMRPNLSMNFWRDSWSACRSLARAAYVIQCDRLVAYYALKCLTRVSKLSMDLGGSPPYQVNAAPLRDIGKTRHRIASSFVYKFAWVRKASRCSSGSVVPSYRSRLSGFQPKVLVTLGASDMSLQLIMSISVHHGCGRRIGAFKWGLVSEARPRANHG

SEQ ID NO: 157090 - protein, 60 aa, Glycine max
  Coding DNA Sequence Number=SeqID_40312
MDVENAGGGGGGSNGKLVIKDRSEGTRKERWRQGSFWSLTSVGKLQSRLLLLSNMKKEKV

SEQ ID NO: 157091 - protein, 231 aa, Glycine max
  Coding DNA Sequence Number=SeqID_40313
  Homolog annotation: Hit_ID=Q9LVC1; Match level="QueryCoverage=59%, HitCoverage=32%, E-value=7e-40, Identity=59%"; Hit description =Similarity to carboxyl-terminal proteinase
MITCLSIVAGTNTHFLSPATVSSVISILLEGDWHGFKSRCKGWWCGACCGWWWSAQDKRQSKVKVVAMGKVVLLFLCMVLVVVPLACTDSIQKLEVQKHLKNLNRPPVRSIKSPDGDVIDCIHVTHQPAFDHPDLKNHKIQMKPNFHPEGHPFGESKVSSNSKPITQLWHQNGRCPEGTIPVRRTKKDDILRTSSVQHFGKKKQSSFPQPKPAKPLPDIISQSGHQVLPLP

SEQ ID NO: 157092 - protein, 537 aa, Glycine max
  Coding DNA Sequence Number=SeqID_40314
  Gene Ontology: Mol. function=6-phosphofructokinase activity; Cellular component=6-phosphofructokinase complex; Biological process=glycolysis
  Homolog annotation: Hit_ID=Q8VYN6; Match level="QueryCoverage=96%, HitCoverage=94%, E-value=0.0, Identity=76%"; Hit description =Putative pyrophosphate-fructose-6-phosphate 1-phosphotransferase
  Pfam annotation: Domain name=PFK; Domain location=176-488; Score= -4.5; E_value=9.6e-13; Accession=PF00365.10; Description =Phosphofructokinase
  Subcellular localization annotation: CTP_CleavageSite=37; ConfidenceScore=5.81e-01
MGSTTHVMTNTNPTLPHLLPSSRSHFNSRLLSLPPTRVANKVGVFAERSNKSRSTSTAAVDFSDPDWKIKFQEDREARFRLPHLTDIFPDAPPIPSTFCLKMRTPIDRDFPGHYSLDEEWHGYINNNDRVLLKTIYYSSPTSAGAECIDPDCTWVEQWVHRAGPREKIYFKPEEVKAAIVTCGGLCPGLNDVIRQIVITLEIYGVKNIVGIPFGYRGFSDEELTEVPMIHLKLSRKVVQNIHLSGGSLLGVSRGGPGVSDIANSLEKRGINMLFVLGGNGTHAGANAIHHECRKRRLKVSVIGVPKTIDNDILLMDKTFGFDTAVEEAQRAINSAYIEAHSAYHGIGVVKLMGRSSGFIAMQASLSSGQVDICLIPEVPFNLHGPQGVLSHLKYLLETKGSAVVCAAEGAGQNLLQKTNATDASGNVVFGDIGVYIQQETKKYFKEIGVHADVKYIDPTYMIRAIRANASDGILCTVLGQNAVHGAFAGYSGITVGLCNTHYAYFPIPEVISHPRLVDPNSRMWHRCLTSTGQPDFI

SEQ ID NO: 157093 - protein, 107 aa, Glycine max
  Coding DNA Sequence Number=SeqID_40315
MADEVDIDMDDTVKNEDCSNYFTTTEVIHNKTTWKEDTFVVLDYERGDKYRQYKKDAKSTIGTRKYDYPFRLKGRQLKIGEGWVLRVLCGSHNHDVAETLVNHPYVG

SEQ ID NO: 157094 - protein, 72 aa, Glycine max
  Coding DNA Sequence Number=SeqID_40316
  Homolog annotation: Hit_ID=Q6ZL19; Match level="QueryCoverage=99%, HitCoverage=21%, E-value=6e-27, Identity=87%"; Hit description =Putative carboxyl-terminal proteinase
MNLAFLKCGFWVALLVKISTALKQVGRSALICMETTTLDSSLIGHDIALGASISPLSKYSSSQYDISILVWK

SEQ ID NO: 157095 - protein, 104 aa, Glycine max
  Coding DNA Sequence Number=SeqID_40317
MASTKIVSFDGDDDNDRHNKPTMSKRRQHVEAQLVDPLEQPMQVDLVEHVDQHMIDHRWVTYGTNAYFVTEEALTLACGVIDDGTVKTSRARGGTRGGSGRGGC

SEQ ID NO: 157096 - protein, 209 aa, Glycine max
  Coding DNA Sequence Number=SeqID_40318
  Gene Ontology: Cellular component=fimbrium; Biological process=cell adhesion
  Homolog annotation: Hit_ID=Q7N8F3; Match level="QueryCoverage=79%, HitCoverage=84%, E-value=2e-32, Identity=45%"; Hit description=MrfX protein
  Pfam annotation: Domain name=Fimbrial; Domain location=49-209; Score =63.8; E_value=5.8e-16; Accession=PF00419.10; Description=Fimbrial protein
MKRKLKKDSLPQRCEWRYYAAMGGLALMLPLLLPKAVAADNWQVEGANGVLQVRGALTESACRLEMTSARQDIWLGETGTARLRQAGDRGLPVAFELRLQDCLRASTSQRDARTGALTWAPNQPAVTVSFGAPADMDNPQLVKAQGVSGLGLRLLDGRGRDVRLGSRGEPLMLTPGQNTLSYTVAPERTAAPLMAGAYRAAVDFRLSYD

SEQ ID NO: 157097 - protein, 132 aa, Glycine max
  Coding DNA Sequence Number=SeqID_40319
MKRSAEFEFDFPAAVNYVSGGVPNDVVFCGKVITRRPEEVETRALLRSETSNGYVAWLWLPSGMMKFPLQMELSDIKMRQERRELPPPPMPMPMPSVAAKGGGAESCWKLVWLLRRRGTLKNALFGCLVPIV

SEQ ID NO: 157098 - protein, 240 aa, Glycine max
  Coding DNA Sequence Number=SeqID_40320
  Gene Ontology: Mol. function=DNA binding; Cellular component=nucleus; Biological process=regulation of transcription
  Homolog annotation: Hit_ID=Q6YXH5; Match level="QueryCoverage=79%, HitCoverage=78%, E-value=7e-49, Identity=50%"; Hit description =Putative ZF-HD homeobox protein
  Pfam annotation: Domain name=ZF-HD_dimer; Domain location=41-100; Score=121.2; E_value=2.9e-33; Accession=PF04770.3; Description=ZF-HD protein dimerisation region
MELQENHEEAELGLPTAVAATSYEEFGMPPNHDEQEPVVEVVPMVYQECLKNHVVSIGGHAIDGCIEFLPGGEEGTLDALKCAACNCHRNLHRKETHDTYSVPFRHHHHPLLPPPVPLAAYYRALPGYLHMTGHQCAMLAHPSLSGRGGPQPPWEDLEDSDPTSGATTHDGSGSSSKKRFRTKFTQHQKDKMLVFAEKLGWRMQKNDESIVQEFCSEIGVQRHLLKVWMHNNKHTLGKKP

SEQ ID NO: 157099 - protein, 92 aa, Glycine max
  Coding DNA Sequence Number=SeqID_40321
MLVLRVPKGANKVRKSTASTPVLMMPKYYLKMVVIIKKGENVNEYHAGFDDAKKIVRLLTYENPEHKREESQDVFRSCKEFTKIVENLKWVA

SEQ ID NO: 157100 - protein, 281 aa, Glycine max
  Coding DNA Sequence Number=SeqID_40322
  Homolog annotation: Hit_ID=Q01091; Match level="QueryCoverage=99%, HitCoverage=100%, E-value=1e-148, Identity=94%"; Hit description =Adhesin precursor
MQRAHFRWMSLLLGLAPGLCSAQIYSYVTQSTGSPSNASYKFVLESWDMDDLSPNPCYQQANCAIGINHRHTSTNTGGTSSVSPSAYVVGSTRYPQITQLATMGELSRFYQSIYPLPIQGSTSHVGESITQECVGLFYNTRSGSAVTGSNARLMPSSVCGIAPPPVGVCGIDEQQLDLNHGVLQDTELAGNTARGSLRVVCSQKMNIVMYIRTGSSGRLDLGNNSGVYSTLRINGVLGNQGYPFTADTSGITLPVTSTLGVTGTVKAGDYSGQSVAILALP

SEQ ID NO: 157101 - protein, 287 aa, Glycine max
  Coding DNA Sequence Number=SeqID_40323
  Gene Ontology: Mol. function=beta-N-acetylhexosaminidase activity; Cellular component=lysosome; Biological process=carbohydrate metabolic process
  Homolog annotation: Hit_ID=Q1SU68; Match level="QueryCoverage=99%, HitCoverage=50%, E-value=1e-155, Identity=88%"; Hit description =Glycoside hydrolase, family 20
  Pfam annotation: Domain name=Glyco_hydro_20; Domain location=1-264; Score=131.4; E_value=2.5e-36; Accession=PF00728.12; Description =Glycosyl hydrolase family 20, catalytic domain
MAGHTGSWALAYPEIVACANMFWWPAEGDILAAEPGTGHLNPLNPKTYQVLKNVIRDMTTLFPEPFYHSGADEIVPGCWKTDPTIQKYLSNGGTLSQVLEKFINNTLPFIVSLNRTVVYWEDVLLSETVHVPSTILPKEHVVLQTWNNGHNNTKRIVSSGYRTIVSSSDFYYLDCGHGDFVGNNSIYDQQNGDNKDNGGSWCGPFKTWQTIYNYDIAYGLSEEEAKLVLGGEVALWTEQADSTVLDGRIWPRTSALAESLWSGNRDEKGMKRYAEATDRLNEWRSRM

SEQ ID NO: 157102 - protein, 102 aa, Glycine max
  Coding DNA Sequence Number=SeqID_40324
  Subcellular localization annotation: CTP_CleavageSite=40; ConfidenceScore=5.35e-01
MVRNAHRSKWPNSLNTVHSGVANCRNLPFGGRATRGSWVRLPRKEGARNHHQRLFEENVEKTGTCGLRTLIVKGSGVVFTHEEGCFPCSYVFLNCDEEIRPK

SEQ ID NO: 157103 - protein, 100 aa, Glycine max
  Coding DNA Sequence Number=SeqID_40325
MEAMMSMKKIIEVNADVVYGVDATPLSGLNLINHPTVDTGDPHFVQVQNKQVFLPYGLPLNYTLPNENVNNSTPILIESQQPQSDHTHVSQLLDMWPQKS

SEQ ID NO: 157104 - protein, 276 aa, Glycine max
  Coding DNA Sequence Number=SeqID_40326
  Gene Ontology: Mol. function=beta-N-acetylhexosaminidase activity; Biological process=carbohydrate metabolic process
  Homolog annotation: Hit_ID=Q1SU68; Match level="QueryCoverage=87%, HitCoverage=42%, E-value=4e-79, Identity=60%"; Hit description =Glycoside hydrolase, family 20
  Pfam annotation: Domain name=Glyco_hydro_20; Domain location=183-276; Score=-141.6; E_value=0.00017; Accession=PF00728.12; Description =Glycosyl hydrolase family 20, catalytic domain
  Pfam annotation: Domain name=Glyco_hydro_20b; Domain location=55-181; Score=42.8; E_value=1.2e-09; Accession=PF02838.6; Description =Glycosyl hydrolase family 20, domain 2
  Pfam module annotation: Pfam domain module=Glyco_hydro_20::Glyco _hydro_20b; Domain location=183-276::55-181
MPRTNTITMTKLEPTLFLLLLFMLSCLITVNNAHSTTIINVWPKPRNLTWAPPYQATLIASTFTIITTTTPHHNKHLSAAIIRYQNLVKSEHHHPLVPPGVNISTNLPPLNSLTLTVLDPGAGLVHDVDESYTLSIPPSSSSATLTAKTTWGAMRGLETFSQLAWGNPTCVAVGVHLWDSPLYAHRGIMLDTSRNYFPVKDLLRTVEAMSMNKLNVFHWHVTDSQSFPLVLPSEPALAEKGAYASHMVYSPEDVKRVVEFGLDHGVRVMPEIDSPG

SEQ ID NO: 157105 - protein, 601 aa, Glycine max
  Coding DNA Sequence Number=SeqID_40327
  Gene Ontology: Mol. function=ATP-dependent helicase activity; Cellular component=nucleus; Biological process=rRNA processing
  Homolog annotation: Hit_ID=Q10PV9; Match level="QueryCoverage=91%, HitCoverage=97%, E-value=1e-176, Identity=60%"; Hit description =DEAD/DEAH box helicase family protein, putative, expressed
  Pfam annotation: Domain name=DEAD; Domain location=137-335; Score =170.5; E_value=4.3e-48; Accession=PF00270.19; Description=DEADDEAH box helicase
  Pfam annotation: Domain name=Helicase_C; Domain location=434-510; Score=87.9; E_value=3e-23; Accession=PF00271.21; Description =Helicase conserved C-terminal domain
  Pfam annotation: Domain name=ResIII; Domain location=133-329; Score= -23.1; E_value=0.004; Accession=PF04851.6; Description=Type III restriction enzyme, res subunit
  Pfam module annotation: Pfam domain module=DEAD::Helicase_C::ResIII; Domain location=137-335::434-510::133-329
MPTLITSRFLLLVGESLHMRRGLATSRSVLLHTSSVQCMSQVEPHHGSVTLSSIGLQTETEPRNRSKTNKVKPLGSPSENLKSKGKPFGINEKKKTFRVVEKQQIESAPFAANSFSELGLPLVLIERLEKEGFTVPTEVQSAAVPTILNNRDVIIQSYTGSGKTLAYLLPILSVVGPLRGEIGEGDSDGGECGKKLGIEAVIVAPSRELGMQIVREFEKVLGMDNKRAVQQLVGGANRTRQEDALKKNKPAIVVGTPGRIAELSASGKLRTHSCRFLVLDEVDELLSFNFREDMHRILEHVGRRSGADQNSDSRKAERQLIMVSATVPFSVVRAARSWGCDPLLVQAKKVAPLGTVSPSEPISLSQSSPSSSPSLAMPSPAAVESLPPALKHYYFVTRVQHKVDVLRRCIHALDAKFVIAFMNHTKQLKDVVFKLEARGMKAMELHGDLGKLARSTTLKKFKNGEVRVLVTNELSARGLDVAECDLVVNLDLPTDSIHYAHRAGRTGRLGRNGTVVTICEESEVFVVKKLQKQLGIPIASCDFAEGKLLVSEEEKTLDGKHQSQKIAPLVNRRKMVGISKEKPKKRIMRVHKKLEGENYGK

SEQ ID NO: 157106 - protein, 488 aa, Glycine max
  Coding DNA Sequence Number=SeqID_40328
  Gene Ontology: Mol. function=nucleic acid binding; Cellular component= endoplasmic reticulum membrane; Biological process=DNA integration
  Homolog annotation: Hit_ID=Q1RWN2; Match level="QueryCoverage=82%, HitCoverage=31%, E-value=1e-143, Identity=61%"; Hit description =Peptidase S8 and S53, subtilisin, kexin, sedolisin; Integrase, catalytic region; Zinc finger, CCHC-type
KGYAQQQGIDYNEVFAPVARWDTIRMVLALAAQKGWNVYQLDVKSAFLHGELTEDVYVEQPLGYVRKGEEEKVYKLKKALYGLKQAPRAWYSKIAAYFVKERFERCDHEHTLFVKTGGGKRILIVSLYVDDLIFTGNDACMFESFKKSMKIEFDMTDLGKMKYFLGVEIQQNSEGIYLSQNKYACELLEKFGLQNCNSVKNPIMPGFKLSKKGEGARIDATAYKQLIGSLMYTTVTRPDLMYVVCLLSRYMASPTELHMQAAKRVLRYLKGTVELGVFYKRGDVKDLVAYTDSDYAGDIDDRRSTSGYVFLLSGGAVSWASKKQPVVTLSTTEAEYVAAAVCACQCVWMRKVLEKIGLSQSKDLTKKEVVRLIHCGTSNQVADIMTKPLKLDVFLKLRVQLGVREHGHTAEELCPTSEAHRTCKRQGDTRDDAQVNDHARSSSDKDSPYIELRAANIKRKEGIALERDSNEGAATAESYAKRGGGGGL

SEQ ID NO: 157107 - protein, 92 aa, Glycine max
  Coding DNA Sequence Number=SeqID_40329
VFNPDFPLYIKHEDLSEIAHGGQCLSISVSQLWILHLTETSMQAGNSDIYGFFKPQSIQSALKGLDDAPQPKSKAPARWIVVKNFNKFTVEV

SEQ ID NO: 157108 - protein, 155 aa, Glycine max
  Coding DNA Sequence Number=SeqID_40330
  Homolog annotation: Hit_ID=Q9FJC0; Match level="QueryCoverage=50%, HitCoverage=16%, E-value=2e-08, Identity=41%"; Hit description=Heat shock transcription factor HSF30-like protein
  Pfam annotation: Domain name=F-box; Domain location=39-86; Score =31.7; E_value=2.5e-06; Accession=PF00646.23; Description=F-box domain
MDGVQEREKKQGSREMVLRKRCRSNGQWLASSKDYLDSDRIRRLPNDIICHIYSFLSTIDAVKTSVFSTRWRSLWTRISTLYLHKDIFGHSKTFFASIVSGVLDRHKVKCIKRLSLSNWSKSKSPSFDLMNTMISTVLFQNHLKEVDLLSNDPYG

SEQ ID NO: 157109 - protein, 90 aa, Glycine max
  Coding DNA Sequence Number=SeqID_40331
MEREIITMIVDTLSVFYYEKMVEYMPSSFVDLVFAGERIEVDLRRGKFDYAALMNRKPRANGENKKEGETHVVTVVPSWPNFSLAQQYQY

SEQ ID NO: 157110 - protein, 614 aa, Glycine max
  Coding DNA Sequence Number=SeqID_40332
  Gene Ontology: Mol. function=ATP-dependent helicase activity; Cellular component=mitochondrion; Biological process=mRNA catabolic process, nonsense-mediated decay
  Homolog annotation: Hit_ID=Q9LUW5; Match level="QueryCoverage=67%, HitCoverage=71%, E-value=1e-165, Identity=66%"; Hit description=DEAD- box ATP-dependent RNA helicase 53
  Pfam annotation: Domain name=DEAD; Domain location=86-252; Score =219.7; E_value=6.6e-63; Accession=PF00270.19; Description=DEADDEAH box helicase
  Pfam annotation: Domain name=Helicase_C; Domain location=321-397; Score=124.0; E_value=4.3e-34; Accession=PF00271.21; Description =Helicase conserved C-terminal domain
  Pfam annotation: Domain name=ResIII; Domain location=92-247; Score= -33.3; E_value=0.029; Accession=PF04851.6; Description=Type III restriction enzyme, res subunit
  Pfam module annotation: Pfam domain module=DEAD::Helicase_C::ResIII; Domain location=86-252::321-397::92-247
MERGPTTRTHLIDSHHRTFVILQLKNKCPTSSCTQPHKEQEVSLGRKPISKKSPTEDCHPGWLKKKANVYVHRNFMKDTCCYILGRAVLEPAMQGRDMIGRARTGTGKTLAFGIPILDRITQFNAKHGQGRNPLALVLAPTRELARQVEKEFNEAAPNLATICLYGGMPIQQQMRQLNYGVDIAVGTPGRIIDLLNRGALNLKDVKFVVLDEADQMLQVGFQEAVEKILEGLSPNRQTLMFSATMPSWIKNITRNYLNNPLTIDLVGDSDQKLADGISLYSIVSDSYTKAGILAPLITEHANGGKCIVFTQTKRDADRLSYVMAKSLRCEALHGDISQTQRERTLAGFRNNNFNVLVATDVASRGLDIPNVDLVIHYDLPNSSEIFVHRSGRTGRAGKKGSAILFFTQDQFRAVQTIERDVGCKFTELPKIDAPSGSAEMFSGMAGGRFGSMRDRQSGGTGFGRSPGFGRSGSYGNSGFGQSSYDGFGSGQAPQFGGNSRPGGNSRPSGFGSSGQSSGFGNFGSGQSGGFGSSGQSGGFGSSGQSGGFGNFGSGQSGSFGNFGSGQSGGFGNFGSGQSGAFGGRKSNQSSTFGNSHGSGFSAFGNDPNNDSYNR

SEQ ID NO: 157111 - protein, 441 aa, Glycine max
  Coding DNA Sequence Number=SeqID_40333
  Gene Ontology: Mol. function=nucleoside-triphosphatase activity; Cellular component=membrane; Biological process=defense response
  Homolog annotation: Hit_ID=Q1SVC8; Match level="QueryCoverage=99%, HitCoverage=46%, E-value=1e-102, Identity=42%"; Hit description=TIR; Disease resistance protein; AAA ATPase
  Pfam annotation: Domain name=NB-ARC; Domain location=88-357; Score =59.6; E_value=1e-14; Accession=PF00931.13; Description=NB-ARC domain
MILECLKERTARLFWPVFYDLEPSHRFGTKLGLMQKLWPNMRRGFRMMRRTRCFKGREALSKAANMVGWHFQHRSQSESEFITKIVTEVSKRINLSLLHVADYPIGVESPVLVTSLLGHGFEEGVSMVGIYGVGGIAFQFEGLCYLANIKESSSNHDLAQLQETLLDEILGEKDIKVGDVNRGIPIIKRRLHRKKVLLILDDVNKLKQLKVLAGGHDWFGSGSKVIITTRDKHLLNTHGVEKSYEVEQWHALKSNKIDPSYADISKPAISYAHGLPLALEVIGSHLFGKSLHVWKSTLDKYEKVLHKEIHEILKVSYDNLEEDEKGIFLDIACFFNSYEICYDKEMLNLHGLQVENDGNGCVRMHDLVQDMGREIVRQGTAAIEVVVLDLSKDKEEQWSGKAFKHMKNLRILIIRNAHFSRGPQNLPNSLRVLHWSGYPSP

SEQ ID NO: 157112 - protein, 171 aa, Glycine max
  Coding DNA Sequence Number=SeqID_40334
METSQASFKANQNSIQNLEIQVGESYSMENCWREQELQPYNQYEEEIISNLENMLMQFIETYEANQHVIQNLEIQVGKLAKEVAKLPFLVTREENFVEVEAREKSLKAFPGYMSFMESLAKKQKCKEDGGDSFGTGDDDVADAGADDDYVADITAAREAWDPRPTQDWGLF

SEQ ID NO: 157113 - protein, 568 aa, Glycine max
  Coding DNA Sequence Number=SeqID_40335
  Gene Ontology: Mol. function=RNA-directed DNA polymerase activity; Cellular component=chromatin; Biological process=RNA-dependent DNA replication
  Homolog annotation: Hit_ID=Q1SAV4; Match level="QueryCoverage=48%, HitCoverage=77%, E-value=3e-83, Identity=56%"; Hit description =Integrase, catalytic region
  Pfam annotation: Domain name=Chromo; Domain location=492-540; Score =23.3; E_value=0.00086; Accession=PF00385.14; Description='chromo' (CHRromatin Organisation MOdifier
MADHDIAKTAFRTHQGHYEYKVMPFGLCNAPLTFQATMNELLKSFLRNFIRGYAALVVSLTSLLQKDNFHWGVDAQNAFDNLKLVMTQAQVLSFPDFSVLFTLEIDVSGLAMGIVLMQHDHPLAFFSKWRQYLLGHFFIILTDHKSLKDLIGKVIQMPEQQVYLSNLLGYNYTIQYKTGKSNVVADALSRIPQYTSGQCLLLSMPNFVFIDALVWLKPDNPFLVSLIEEFHSTPIGGHLGFVKTLNRLQMSFYWSNMHKDVKQFVRQCATCQQFVKFTAFPEAWSPNETLSSLGTFGTICSSRVAQNYTRASPIIQKRMARLRSEWCYNTADHSATDITPFEAMYGKPPPPISTYLKGSSTVEAVDHLLSTRQDLWASLTTRLHKMLLAMKAQADNKHRNVLYMVGDWVYVKLQPYRQTSFSHTSFNKLSKPYYEPFQISETIGAVAYRLALPESSKIHNVFHCSMLKPHHDPIDDVTDPLLPQATDNHPLVEPLSILDTKWDDTTSPPSLLVLVQWSGLAPEETSWEHWEELCATYHLKDKVVLPTVGINGTQQLRPKRKALRPVYL

SEQ ID NO: 157114 - protein, 455 aa, Glycine max
  Coding DNA Sequence Number=SeqID_40336
  Gene Ontology: Mol. function=transcription regulator activity; Cellular component=nucleus; Biological process=regulation of transcription
  Homolog annotation: Hit_ID=Q8W2F3; Match level="QueryCoverage=43%, HitCoverage=42%, E-value=9e-40, Identity=52%"; Hit description =Phytochrome-interacting factor 4
  Pfam annotation: Domain name=HLH; Domain location=252-294; Score =37.9; E_value=3.4e-08; Accession=PF00010.16; Description=Helix-loop -helix DNA-binding domain
  Subcellular localization annotation: CTP_CleavageSite=84; ConfidenceScore=5.10e-01
MKVHISDQEEGKFTKLDASSAPHVTVSSQLPTMKSSSFQDFSGIPIPAPRFHVSDSPQKNNNHLGGSCKVQNFSHFSAPLNVSSASANVHFGDKITGNMSRNEIRECSLMTVGSSYCGSNHIPQDPDASRASSNGVWTTTLSVEPEAVRDDVPKTIPQKEKGKSEMLEPAVTSSSGGSGSSLGKTCSLSTRNQGQKRKGIDVEESEEQSEVKPLSLETQNLNQHLETSHLNAQGRLEGTVLLKCIIYRKGWGILRRRDRINEKMKALQQLIPHSSKTDKASMLEEAIEYLKSLQLQLQLMWMGSGMAPIMFPGIQHYMSQMGMGMARPPFPPPIHNPMQLPRVPLDKSVSASQTPNQTLMCQNPILGAFNYQNQMQNPALSEQYVRYMGYHLMQNASQPMNVFRYGPQGVQHSQTMITPSSNSSGNMSGAANIDEAVSGKMDGDKQTLTCHHVNS

SEQ ID NO: 157115 - protein, 183 aa, Glycine max
  Coding DNA Sequence Number=SeqID_40337
MECRSKFGHREAWYHFLLLPAMVGCVQWVVGEIGFGGGGVGVSGPGSSSSAINKKKHARHLGEGKRGGGGGGGNLASEIAWGRGIGCSVCTSFHSSGVRPEIKQLSKKEGCNGDAFFVRCVMVIEELGDLEDPSHGIIAVKTRDLQLNGVAGRGLGRTDFGLGGESSLLNSLWFLSGCGVPPW

SEQ ID NO: 157116 - protein, 290 aa, Glycine max
  Coding DNA Sequence Number=SeqID_40338
  Gene Ontology: Mol. function=transcription regulator activity; Cellular component=nucleus; Biological process=regulation of transcription, DNA-dependent
  Homolog annotation: Hit_ID=Q8W2F3; Match level="QueryCoverage=69%, HitCoverage=40%, E-value=1e-10, Identity=28%"; Hit description =Phytochrome-interacting factor 4
MNNSVPDWNFGSDSCVTSTNQKKPMMGVDQELVELLWQNGQVVHSQTHRKPVVNSSNLIQDDETVSWIQYPLEDPLEQEFCSNLLSELAPCEVESYKQIKPFEEGKFTKLDASSAPHVTDFSGIPIPAPRFHVSDSPQKNNNHLGGSCKVQNFSHFSAPLNVSSASANVHFGDKITGNMSRNEIRECSLMTVGSSYCGSNHIPQDPDASRASSNGVWTTTLSVEPEAVRDDVPKTIPQKEKGKSEMLEPAVTSSSGGSGSSLGKTCSLSTRNQGQKRKGIDVEESEEQSE

SEQ ID NO: 157117 - protein, 209 aa, Glycine max
  Coding DNA Sequence Number=SeqID_40339
MSPKRSKERKEKPLDQPRRVINTIAEEGLPPLYLKGFIHHGMHFKVAPSSQPFTIKAMCDVDWNSNPNDKRSTSEIPESEILPHDDPLFGFLGEKVGTKGSIWLYTKFGHEGILQKSLKLGYMIMHAHTSYNILLGCPSLNALGVIMSIPHLVMKFLSNTGTITTMHANQRTTKECYMVNLRLCPHARVEAPRVAHYTKAKKKAKEVMN

SEQ ID NO: 157118 - protein, 227 aa, Glycine max
  Coding DNA Sequence Number=SeqID_40340
  Gene Ontology: Mol. function=RNA-directed DNA polymerase activity; Biological process=RNA-dependent DNA replication
MVVSDLMLNGEGKWNETLIEEILDLEDTMVMFSMPLANLQEEDVRIWRHNRNDNKKVLQKWQSVCQKGRNIDRTTSDSDLEEWKPPGPGFVKCNIDVAYFQEQQWWGKGMCIQDDKGWFVRATMNIRHGMPEVHEGEALVLLQTLTWLKNMDYQYVEVESDCKRLTDSLDRNIMDDSEFGMILNKCKRILMSFPNHKVSLIRKQANCIAHSLARASKLYVGPWSMIH

SEQ ID NO: 157119 - protein, 156 aa, Glycine max
  Coding DNA Sequence Number=SeqID_40341
  Gene Ontology: Mol. function=RNA-directed DNA polymerase activity; Cellular component=chromatin; Biological process=RNA-dependent DNA replication
MNSVDKKKMTFLTKFANYYYKVMSFELKNAEDTYQRLMDKVFMGQLGRNLEVCVDDLVVKFDNLATHITDLEEVFRQLKKYNMRLNLEKLHANPLRNTCKLGKMPSHHGDEESLECKRSSKASLQDRLLVKIFSYNCLAGQTNHEPPQENQQLCLG

SEQ ID NO: 157120 - protein, 169 aa, Glycine max
  Coding DNA Sequence Number=SeqID_40342
  Gene Ontology: Mol. function=DNA binding; Cellular component =chromatin; Biological process=DNA integration
  Homolog annotation: Hit_ID=Q1SY60; Match level="QueryCoverage=97%, HitCoverage=64%, E-value=3e-27, Identity=35%"; Hit description =Integrase, catalytic region
MECFLALFLTEIQGLPQGLVSWIALGVGTRFYLLWNSPTTTIIMLALYDKRCSTPLCWYQDGVNMVVGPWFLQWTTKKIKLIQERMKASKSYIDECRKGNHDEDQTRKLTPKFLGPYQILRRVGPVAYELRKYIMDPNVLEPDRVTMGYIMWELEDKMHKQYLNLFPCN

SEQ ID NO: 157121 - protein, 319 aa, Glycine max
  Coding DNA Sequence Number=SeqID_40343
  Gene Ontology: Mol. function=RNA-directed DNA polymerase activity; Biological process=RNA-dependent DNA replication
MHMDDSSNLHGSGAGVILEGPNGISLDQSLRFGFKANCNLVEYEDLLARLRPSKEIRDPQLLKYYCAFERIKEEYEKVQLIHISRTVEENPSGWKNEIVKYLKHKTLPTDKGKAKKLRTQAARRLRYAFRGKNNGHKSVKGLLLLANFEDKLFKLCEEMPPMPKAWEFDTSVGRRTTSYGLPLIVRYLRNGYSHTFPHGSRAKKIPASGNNGLQFIDQKLNEFLGSLGSKHRVTSVEHLQTNKQAETSNKIILGEQRKRLDRVNGRWAEELAKGPSMKRIGRSPKGPVRWKVGGNWEGSFRFRHNLNNEAYKLEELSGK

SEQ ID NO: 157122 - protein, 95 aa, Glycine max
  Coding DNA Sequence Number=SeqID_40344
MTEDPPDNAADPSDCDYDRGGSIVAAAIYDSTIEANRVTIELSGGARSLWNAMDSKSEMRKSYDSTTIIESTSFFANPLDRPRVTPGSHPRSPSS

SEQ ID NO: 157123 - protein, 117 aa, Glycine max
  Coding DNA Sequence Number=SeqID_40345
  Homolog annotation: Hit_ID=Q9SCW4; Match level="QueryCoverage=26%, HitCoverage=10%, E-value=9e-09, Identity=87%"; Hit description=Heat shock factor protein 6
MLSWRTKLEKLLCLKYLGSKSLPKAVVFQTMKDDPDYSSRSDQGVPMNPKRIKVIPEWPTPPTPFIELVRNHVLSWEDAQEMGVEERSPEYEEPRDLRSNPFQGGGNDAILLRKGIG

SEQ ID NO: 157124 - protein, 264 aa, Glycine max
  Coding DNA Sequence Number=SeqID_40346
  Gene Ontology: Mol. function=DNA binding; Cellular component=nucleus; Biological process=regulation of transcription
  Homolog annotation: Hit_ID=Q6YXH5; Match level="QueryCoverage=94%, HitCoverage=96%, E-value=3e-40, Identity=36%"; Hit description =Putative ZF-HD homeobox protein
  Pfam annotation: Domain name=ZF-HD_dimer; Domain location=63-122; Score=108.4; E_value=2.1e-29; Accession=PF04770.3; Description=ZF-HD protein dimerisation region
MEFQKHHEEAELGLPTAVAATSYEEFGMPLNHGEQEPVVEVVPMAVPMAVPVAPPTNIVAQNSGKGKYQECLKNHGVSIGKHIIDGCIEFLPGGEEGTLEALKCVVCSCHRNFHRKETHDTYSVPFHHHHPPLPPPVPFAAYYRAPPGYPHMTGHQRAMLAHPSLSGGGGPQPPLEDLEDSDPTSGATTHDGSGSSSKKRFRTKFTQHQKDKMLVFAEKLGWRMQKNDDNVVQEFCSEIGVQRHVLKPSFQARSSTLKPGRLRC

SEQ ID NO: 157125 - protein, 138 aa, Glycine max
  Coding DNA Sequence Number=SeqID_40347
ARAQLLSTSKIKSNQKFPLLSEDHQVRWHAETNIAISFPCQETQCLLTKATEVSLAIPRQVHQESSGGSNSSPGQACCFKLKPPARLRELGGKLLLYFPIKWRWELRGRGSTLLAIRFHLKLVRRRRKKEKIKAKALP

SEQ ID NO: 157126 - protein, 332 aa, Glycine max
  Coding DNA Sequence Number=SeqID_40348
MSKFVPLAYDHQALPLTRDDIYNVGMIMMQCQLIDQWPSYPSSIHIKCITTVKVMPNRIALRLPPLDLRKKKSKVPPHSTPMPYQGPKDNVSLHPISYDWSRYFRRDVATKTITLKLDTEFDQNDAMLLYFKDMYENSHLASTLDYDKKDNSNHMRMFVFDLHKHSEAAIRRAIVTAWARTLLEIGEQHEDLALKLEEELEEETRQPKLPTDEMKKKAKAKQQQEKLKSEGLFKNLHAYLGPWVDGIEPPLFEVTLHNLHPLLKMPWQPLALLVLLDNLEETMEKGFLVECMETNLFIKNNLESSLKSFNDYALFNMNMLMQQQLPVDKGSS

SEQ ID NO: 157127 - protein, 71 aa, Glycine max
  Coding DNA Sequence Number=SeqID_40349
MTIVDYHNPSGNDTCSNIDTKTKANTSTKEMKTAIAYQQYEAKVESQDTGVQSVGKPKRVITRPSYLNDYI

SEQ ID NO: 157128 - protein, 162 aa, Glycine max
  Coding DNA Sequence Number=SeqID_40350
SLRVNGLTCLWLTKGADNHKVCPRATGPLGHDSRNETFLRSRSVVADIFGKGADDHIGADNHKVCPRATGSLGHDSRNETFLRFRSVDADISGKGADDHIGICVSTGSLASEDADISEKGAEDHIGLCVSIGSLASEDADISGKGADDHIGLYVSTGLLASG

SEQ ID NO: 157129 - protein, 48 aa, Glycine max
  Coding DNA Sequence Number=SeqID_40351
MKCRGEEHLISEDEGEIKQIVGDAKVEEEHLVSKDENELSDVDIGNDE

SEQ ID NO: 157130 - protein, 178 aa, Glycine max
  Coding DNA Sequence Number=SeqID_40352
  Gene Ontology: Mol. function=dipeptidyl-peptidase IV activity; Cellular component=membrane; Biological process=proteolysis
  Homolog annotation: Hit_ID=Q1SQR0; Match level="QueryCoverage=93%, HitCoverage=24%, E-value=3e-48, Identity=50%"; Hit description =Esterase/lipase/thioesterase; Peptidase S9B, dipeptidylpeptidase IV N- terminal
MAWIMTHGLAEYIAQTKYGALHSLYELVLPSTSDWEEMDRKTGYWFRGTGRPPLSFCRSLKSESSITWMDLLCGGTEQQNNEEEYLARVNWMHGNILTAQILNRHHTKIKIVKFDIRTSQRKNILVEENSSWINIHDYFTPLDKGVTKFSGGLSWASEKIGFRHLCPSDSNGKNSKFR

SEQ ID NO: 157131 - protein, 116 aa, Glycine max
  Coding DNA Sequence Number=SeqID_40353
  Subcellular localization annotation: CTP_CleavageSite=84; ConfidenceScore=5.08e-01
MHNFALILNFKNIIYSSHTNNTTTPASLCRIISDQNHLLHPSSTMTKIRPPPNNIVAPPPPRLTNRGMQIATRPTWAFQEVLPKAVPSGGSNLARLGKLSSPGRAGWQAPPSFCYK

SEQ ID NO: 157132 - protein, 89 aa, Glycine max
  Coding DNA Sequence Number=SeqID_40354
MTPKPNTDSGDEEQLSGGPIGASGAKERLPISSKLQTKKGLGDRLRGRMMQSHCLGRKRLMKDFKVAHENAPSFLRLEKECDLQLCKLN

SEQ ID NO: 157133 - protein, 260 aa, Glycine max
  Coding DNA Sequence Number=SeqID_40355
  Gene Ontology: Mol. function=DNA binding; Cellular component=nucleus; Biological process=regulation of transcription
  Homolog annotation: Hit_ID=Q6YXH5; Match level="QueryCoverage=94%, HitCoverage=96%, E-value=1e-41, Identity=37%"; Hit description =Putative ZF-HD homeobox protein
  Pfam annotation: Domain name=ZF-HD_dimer; Domain location=59-118; Score=107.2; E_value=4.7e-29; Accession=PF04770.3; Description=ZF-HD protein dimerisation region
MEFQKHHEEAELGLPTAVAATSYEEFGMPLNHGEQEPVVEVVPMAVPVAPPTNIVAQNSGKGKYQECLKNHGVSIGKHIIDGCIEFLPGGEEGTLEALKCIVCSCHRNFHRKETHDTYSVPFHHHHPPLPPPVPSAAYYRAPPGYPHMTGHQRAMLAHPSLSGGGGPQPPLEDLEDSDPTSGATTHDGSGSSSKKRFRTKFTQHQKDKMLVFAEKLGWRMQKNDDSAVQEFCSEIGVQRHVLKPSFQARSSTLKPGRLRC

SEQ ID NO: 157134 - protein, 470 aa, Glycine max
  Coding DNA Sequence Number=SeqID_40356
  Gene Ontology: Mol. function=RNA-directed DNA polymerase activity; Biological process=RNA-dependent DNA replication
MNGKDEDDFNFLESCWEVVEVDIIRDLNEFHLVQDYCKGLGKYTRKVLSKVVDDRQLAFLGERNNIFDGILVANEVVHEAKVEKEHVSFSRLISRKHVTRWMWCFLQSSSTSILVNGIPMEEFYAKKGLRQEDPLAPFLFLMVVEGLSGLIREGEEKGLFSGVGVSDGALKLKLSIQTHFKSSLAVIHVDQDEARRYAKVLNCNIMTIPFVYLGLPVGADARKVNTWELVIDKMRKKLTPWRRKHLPFGGRICLIESNELGWFQKGIGRVVGERSDGAFGKMRTWCGNEWRWELVWRRLWFQWENSLVQQLREIIERKGPKMNVKDGREWRKSTTRKYVVKEVYQELNEEGNVEDQYLFKKLWKLLIPSKENINYLLFKCPFSYDMWMRYYMWLGETSTLLGECRGHSWQHAGNINGNRAREAWWTSWASIVWTLWNYINDIIFNQAGQDSRVVCRYQDIYRAWSWCIRL

SEQ ID NO: 157135 - protein, 86 aa, Glycine max
  Coding DNA Sequence Number=SeqID_40357
MKHTQVRWRRRRSTELSRCSSATNTMLKLRQNDSQMEDRQLQGMVAKEKKQRLVMMLECDKHDAQMQNRDLQGRRRLEEEEESMKA

SEQ ID NO: 157136 - protein, 45 aa, Glycine max
  Coding DNA Sequence Number=SeqID_40358
MEQHQIKELSPPSFANIDLDKRMSRNRRSLQDILSMRWVSGSRYN

SEQ ID NO: 157137 - protein, 67 aa, Glycine max
  Coding DNA Sequence Number=SeqID_40359
MRLEALIKEKEERERERKNLDLGLAVVDGVVALHLKVEKEIMKKMKVQCFCRNMLIVMCFSHPSHTR

SEQ ID NO: 157138 - protein, 168 aa, Glycine max
  Coding DNA Sequence Number=SeqID_40360
  Homolog annotation: Hit_ID=O82204; Match level="QueryCoverage=23%, HitCoverage=27%, E-value=1e-10, Identity=82%"; Hit description=60S ribosomal protein L28-1
MANTVKFIENFTTCELPLQIEVPSSCAIVADNYYRPDLKKAALARLSAVNRSLRVAKSGVKKRNRQAECIKGLLKEGGQFICCNSTKDEDPRPTSSNGTYIMWYQEHVHLGVEERIPEFQEPMDLRSNPFQGGEGMMQSYPPRALDRRLQEDWARDAREGPSSSMILV

SEQ ID NO: 157139 - protein, 132 aa, Glycine max
  Coding DNA Sequence Number=SeqID_40361
  Homolog annotation: Hit_ID=Q8VYR7; Match level="QueryCoverage=53%, HitCoverage=9%, E-value=5e-13, Identity=64%"; Hit description=Boron transporter 1
MLNVPLIHIIGAFAQSTMIVVLYYFDHSVASQLAQQKKFKLRKTFFLIIMTFFSSTSLYVISLKCSPPRLMQSIEYSLNASHGPKIYPKAHENPRIFSCISGPIFLEFAIQCPWGVGLHHSLPLEKDLTLNP

SEQ ID NO: 157140 - protein, 383 aa, Glycine max
  Coding DNA Sequence Number=SeqID_40362
  Gene Ontology: Mol. function=hydrolase activity, acting on ester bonds; Cellular component=membrane; Biological process=metabolic process
  Homolog annotation: Hit_ID=O81020; Match level="QueryCoverage=86%, HitCoverage=64%, E-value=1e-119, Identity=60%"; Hit description =Putative phospholipase C
  Pfam annotation: Domain name=Phosphoesterase; Domain location=38-380; Score=487.5; E_value=1.6e-143; Accession=PF04185.5; Description =Phosphoesterase family
MPLRRRVPLPLLLLLLLLSPAATSAVAFRKKHKIPGPIKTIVVIVMENRSFDHVLGWLKSSRPDIDGLTGTESNPLSVSSRSSPTVPVSDDALFIDSDPGHSFQAIREQIFGSNDTSAVPPPMNGFAQQAESILPGMSKTVMSGFKPQTLPVYTALANQFGLFDKWFASVPASTQPNRFYVHSATSHGAMSNVRKDLIHGFPQKTIFDSLNENNLSFGIYYQNIPGTLFFKSLRKLKNAVKFHDYALKFKKHAEKGKLPNYVVVEQRYFDVEVFPANDDHPSHDVAAGQMFVKEVYEVLRKSPQWEEMAVLITYDEHGGFYDHVATPVEGVPNPDGIIGPHPYYFGFDRLGVRVPTFIISPWIDKGTGMCSKVFSFFECVLGN

SEQ ID NO: 157141 - protein, 144 aa, Glycine max
  Coding DNA Sequence Number=SeqID_40363
  Gene Ontology: Mol. function=enzyme inhibitor activity
  Homolog annotation: Hit_ID=O49908; Match level="QueryCoverage=89%, HitCoverage=81%, E-value=4e-21, Identity=45%"; Hit description =Invertase inhibitor precursor
  Pfam annotation: Domain name=PMEI; Domain location=11-142; Score =51.4; E_value=3e-12; Accession=PF04043.6; Description=Plant invertasepectin methylesterase inhibitor
MSACHCRVLQPNDLKLIEETCKRTPKPNLCLQLLKGDPRAPSADIAGLALILVDVIQAKANEAEKTIKQLLKQGGNKKALSECAVDYKRILILDIPEATRAVRGDPKFADDAVSDCAVEADICENRFNGKSPLTHVNNGIFCVV

SEQ ID NO: 157142 - protein, 246 aa, Glycine max
  Coding DNA Sequence Number=SeqID_40364
  Gene Ontology: Mol. function=enzyme inhibitor activity
  Homolog annotation: Hit_ID=O49908; Match level="QueryCoverage=59%, HitCoverage=90%, E-value=8e-14, Identity=35%"; Hit description =Invertase inhibitor precursor
  Pfam annotation: Domain name=PMEI; Domain location=31-177; Score =89.3; E_value=1.2e-23; Accession=PF04043.6; Description=Plant invertasepectin methylesterase inhibitor
MLNLKHLSIICSILVVAIISMSACHCRVLQPNDLKLIEETCKRTPNPNLCLQLLKADPRAPSADIAGLALILVDVIKAKATEAEKTIKQLLKQGGNKKALSECADDYDGILMLDVPTATRAVRGDPKFAENTVSDCAVEADSCENGFHGKSPLTHVNNVPKQKLDRSSTTTKNTFSIVKLTSVLHKTDVKNPTPSYFPRALFFACSSSSSSLLLLRDREYNFFRSWFMEVVFAARIRFLLALCHFE

SEQ ID NO: 157143 - protein, 414 aa, Glycine max
  Coding DNA Sequence Number=SeqID_40365
  Gene Ontology: Mol. function=hydrolase activity, hydrolyzing O -glycosyl compounds; Cellular component=apoplast; Biological process =carbohydrate metabolic process
  Homolog annotation: Hit_ID=Q2HTE2; Match level="QueryCoverage=97%, HitCoverage=89%, E-value=1e-157, Identity=58%"; Hit description =Sialidase
  Pfam annotation: Domain name=Glyco_hydro_32C; Domain location=287 -368; Score=61.7; E_value=2.4e-15; Accession=PF08244.2; Description =Glycosyl hydrolases family 32 C termi
  Pfam annotation: Domain name=Glyco_hydro_32N; Domain location=5-251; Score=338.3; E_value=1.3e-98; Accession=PF00251.10; Description =Glycosyl hydrolases family 32 N termi
  Pfam module annotation: Pfam domain module=Glyco_hydro_32C::Glyco _hydro_32N; Domain location=287-368::5-251
MCQSHADPNGPMYYNGVYHLFYQYNPKGTEWGNIVWAHSVSKDLINWNGIEHAIYPSKPFDKFGCWSGSATIVPDKNNTQVQCYAEPEDPNDPLLRRWVKPDRLNPVVVDKDANQTEFRDPTTAWWGKDGHWRMLVGSVRKRRGIAYLYRSKDFMTWVPAKHYPFHGWYGIRIGMCLTTLLDGWGGLSYDYGNFYASKSFFDPSKNRRILWGWANESDKPKDNFWKGWAGIQAIPRTVWLDFTGRQLVQWPVEELNSLRGKEVNIDNQRLEKGDYSEVKGITAAQMLKLRSPFQAWTRQRHMILSGVFKSPNKHIVLLCSDARSSSLKSDLYKPQFAGFVDVDLATDKKIFLRSLIDHSVVESFGAGGKTNILSRVYPELAVMNQAYLFVFNNGTEPIVVENLKAWSMISADIK

SEQ ID NO: 157144 - protein, 106 aa, Glycine max
  Coding DNA Sequence Number=SeqID_40366
MKHGHAADVLRPTLEAYRTRKRVQLRYDAVSVASACHWTRLDTRSARLDAVHQVVDMRDDAQVNNRAHSSSDKDSPDTKSQAANIKRREGRKEKGQKNRLMFEESR

SEQ ID NO: 157145 - protein, 98 aa, Glycine max
  Coding DNA Sequence Number=SeqID_40367
MIQKMFEPSRSGLTRSSSHVASININVGASISEYGVMGMDDQRGSLFGSPIHAGALDIFKEDVYGFGVILLQLVTDTLSQVYTNQNIDIIDIGKMIIT

SEQ ID NO: 157146 - protein, 247 aa, Glycine max
  Coding DNA Sequence Number=SeqID_40368
  Gene Ontology: Mol. function=nucleic acid binding; Cellular component= chromatin; Biological process=chromatin assembly or disassembly
  Homolog annotation: Hit_ID=Q1SJG7; Match level="QueryCoverage=72%, HitCoverage=24%, E-value=4e-58, Identity=60%"; Hit description =Helicase, C-terminal; Homeodomain-like
MSISLSRGQEKKKQSGSSKFNVKIRKDGLQKPLKVEPIVKEEGEMSDDEEVHEQFKEVLSKIRNYLQLLGLMIDQIVLEHEEEPYKQDRMTTQLWKSVSTFSHLSGERLCQIYSKLKVEQNVAGVGPSHSNGSVSDPFSRNRNPNHSYPFPRHMEKQRGNKNMTTYQMPEQINITDMSEPWKRRRAESNVHFQGQLPAQRTIVISLDMGFASLNKVADANEYLAFGLQDECKLAHFLPLFPIDSSYP

SEQ ID NO: 157147 - protein, 105 aa, Glycine max
  Coding DNA Sequence Number=SeqID_40369
MYYTKGDVTTHYAGWWKQSILYHHRDFAKNILGERAVYAMMLVFPPEFCPLKTILFGNPSQDTVEPLMEALEEDYKDGNEINESRQFIGGVLDLEKTINRLDTLT

SEQ ID NO: 157148 - protein, 494 aa, Glycine max
  Coding DNA Sequence Number=SeqID_40370
  Homolog annotation: Hit_ID=Q6L3I4; Match level="QueryCoverage=99%, HitCoverage=89%, E-value=1e-124, Identity=48%"; Hit description =Kelch repeat-containing F-box family protein, putative
  Pfam annotation: Domain name=F-box; Domain location=189-236; Score =17.0; E_value=0.068; Accession=PF00646.23; Description=F-box domain
  Pfam annotation: Domain name=Kelch_1; Domain location=276-318; Score =7.2; E_value=0.58; Accession=PF01344.15; Description=Kelch motif
  Pfam annotation: Domain name=Kelch_1; Domain location=320-366; Score =31.0; E_value=4.2e-06; Accession=PF01344.15; Description=Kelch motif
  Pfam annotation: Domain name=Kelch_2; Domain location=267-318; Score =9.4; E_value=2.2; Accession=PF07646.5; Description=Kelch motif
  Pfam annotation: Domain name=Kelch_2; Domain location=320-363; Score =8.7; E_value=2.7; Accession=PF07646.5; Description=Kelch motif
  Pfam module annotation: Pfam domain module=F-box::Kelch_1::Kelch _1::Kelch_2::Kelch_2; Domain location=189-236::276-318::320-366::267 -318::320-363
MLDGRSCVVPRMFSGTCQAENDWSYMKCLLELDIKNGKRPMEIDDVEEDEPHQPRKCTKKLDSCHRVEMARISFQRQSIEAKDSVVPPMDQETIEPLSVCQGVVEEDGALTDQLLDEKEQEVDGYLMDFGDHQSDKQQQAQTGDSSDFGAQLSDEDQLQHDDENLLNSSEQQSEGQQQHHGGDSSDSSSLLPRMNRDSSIACLSRCSRSDYGSLASLNRSFWNIIRSGELYQWRRLNGIMEHWIYFSCALLEWEAYDPIRQRWMHLPRMASNECFMCSDKESLAVGTELLVFGRELRSHVTYRYSLLTNSWTSGTRMNAPRCLFGSASLGEIAILAGGCDSEGHILDSAELYNSETQTWETLPWGIGGCDSKLLTCGEEYNLQTRTWTEIPSMSPGRSSRGPEMPATAEAPPLVAVVNDELYAADYADMEVKKYDKERKVWLTIGRLPERAVSMNGWGLAFRACGDKLIVIGGPRTHGEGFIELNSWVPSEGPP

SEQ ID NO: 157149 - protein, 100 aa, Glycine max
  Coding DNA Sequence Number=SeqID_40371
MLLVSTIRAALPHSFISFGGKNTRFLHSYPQQGQRQLEGVEAMPSKVILMMPKNQELSKVSSKDSRIKFQVSSFKFQVSRIKNQVSRIKNNQDQDSRFKN

SEQ ID NO: 157150 - protein, 153 aa, Glycine max
  Coding DNA Sequence Number=SeqID_40372
MAFLGETSSQMIVNSTLAFIFPNGSIIYNETGVYFQTFTPIPIRVPNASGFEMLKSRMHNILQLTDKQYLDEIYYRRPFVDAATMTLTHDVLLYYNGRWNMSRQHDFVGYSFTGKNPKIFYIPSGYTIDELKDLIKQVASQGIPPYGIHESQM

SEQ ID NO: 157151 - protein, 38 aa, Glycine max
  Coding DNA Sequence Number=SeqID_40373
MVTWPQFAAQCRFLLSGDGPRPMVHSEIMGHATLPPFP

SEQ ID NO: 157152 - protein, 163 aa, Glycine max
  Coding DNA Sequence Number=SeqID_40374
  Homolog annotation: Hit_ID=Q10AB4; Match level="QueryCoverage=99%, HitCoverage=31%, E-value=1e-10, Identity=26%"; Hit description =Expressed protein
MVAEAWIVKMGNQVSANLKHALLLEPSARRKHNPKRQDNSTSSKEVIGILSFEVANVMSKTVHLHRSLSEPEIVKLRNEISNSQGVQNLVSSEEGYLLELARAEKLEELNRVANVVSRLGKKCSLPALQGFEHVYGDIVSGVIDVKELGFLVKHMEGMVRKMD

SEQ ID NO: 157153 - protein, 125 aa, Glycine max
  Coding DNA Sequence Number=SeqID_40375
EDFQQTHLQKDIGRFIDDRSRQTHTLLKNIDLGVGVGIQLRGQSVRDAFIVRVCGLSSFVPHRLVCKTCVVLVPHRLFSGGSGSNGIRRGEGEDREVRWQRFQLLEDADRGLSISEEAVLAFIRG

SEQ ID NO: 157154 - protein, 182 aa, Glycine max
  Coding DNA Sequence Number=SeqID_40376
MAPTRHPLDPDKSNRALGFPALITGLCQSFGVPVTPSKVIRPPITRAFIEKCCTQRQVQGDVPQAADTPPPHQDGPAGLFDTEQYLRHLVRQQAANHRAHVQTHDCLYQMSLSLQSQGFTPFPCPTPDQFRAEVAWPGDWPEAQAAEAPAGAPAEAPDEADEAREDEEMTDLLDFLGGSGAA

SEQ ID NO: 157155 - protein, 99 aa, Glycine max
  Coding DNA Sequence Number=SeqID_40377
MASKKRKAPSTPTQARYDRSRFTSQKAWERYTDIVGPRKLLPKRNMIFYDTEFDEFKEELDRRHWDEELIYFNDSSIDIAIVKEFYANLYDPEDKSPKQ

SEQ ID NO: 157156 - protein, 53 aa, Glycine max
  Coding DNA Sequence Number=SeqID_40378
MDSAHLIVENKGSSTDKSFNLSKDLNYLVLAYFDEENLKEIASTVHKGQGQGQ

SEQ ID NO: 157157 - protein, 95 aa, Glycine max
  Coding DNA Sequence Number=SeqID_40379
  Gene Ontology: Mol. function=heat shock protein binding
  Pfam annotation: Domain name=DnaJ; Domain location=17-91; Score=17.3; E_value=9.3e-05; Accession=PF00226.21; Description=DnaJ domain
NRKVTKDPTSYNVNIRGIKSADTATDIKKAYHKATLRHHADKLLARSEVGDEGQLWKEISQEVYKDADKLFKMIGEAYTALSDPAQGYTYDFSTS

SEQ ID NO: 157158 - protein, 77 aa, Glycine max
  Coding DNA Sequence Number=SeqID_40380
  Subcellular localization annotation: CTP_CleavageSite=41; ConfidenceScore=5.41e-01
MWDRHRLKGAFKPSVFTPKAYTSKSPSGPLPPDSGESDKASASRPRAKREISALSTAGVFSQAQCKIGAKPKPTYLR

SEQ ID NO: 157159 - protein, 63 aa, Glycine max
  Coding DNA Sequence Number=SeqID_40381
MKRAKQQNKQVKLLSINKPEATQSGTEKEESRAVIADNNVVAITSNLRQSVLRQKEKGETIGF

SEQ ID NO: 157160 - protein, 165 aa, Glycine max
  Coding DNA Sequence Number=SeqID_40382
  Subcellular localization annotation: CTP_CleavageSite=81; ConfidenceScore=5.05e-01
MTKTRNDPPPAQRTNDAAAALVIAFAGEVTHLSLSLISPSLSSLPSKKKHQFFRTPTRITKRVTEKMGVCGSRPKVNEDLSAKKKNNHHRRRRRRILRRRVSSRKIEANNVSHCNSALQASNRASDAAWFDSTSALDSECDDEFYSVYDGMSVFPPSPPKFGVSE

SEQ ID NO: 157161 - protein, 125 aa, Glycine max
  Coding DNA Sequence Number=SeqID_40383
  Homolog annotation: Hit_ID=Q9AY32; Match level="QueryCoverage=47%, HitCoverage=90%, E-value=2e-25, Identity=96%"; Hit description=RRNA intron-encoded homing endonuclease
LDLGWVDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 157162 - protein, 599 aa, Glycine max
  Coding DNA Sequence Number=SeqID_40384
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q3K942; Match level="QueryCoverage=96%, HitCoverage=47%, E-value=3e-75, Identity=31%"; Hit description=Multi- sensor Hybrid Histidine Kinase precursor
  Pfam annotation: Domain name=SBP_bac_3; Domain location=305-522; Score=36.6; E_value=1.7e-10; Accession=PF00497.10; Description =Bacterial extracellular solute-binding proteins, family 3
MLRLVTLLLLLLSPLLAAQPQPEIFQLFSREKLAPMHIELSGDEWRWLRIKHELRIAVWTPELPPYLIFQEAAGSGNSVEGIYADYLQLLARNLGVQAVMVRYPSQTAAQAAVKSGAADALFSSPGRELHDAAAFRATDSFLINRPVVIAAEKQASQPVPYDAPLRLAMREGSLTDAQIKQRFPQASIVRYPSSQAALEAVASGEADYALGSLQAATFLIERSYVNQLALAAILPEDALYGSRLVVKADNQPLLKALNAAIAAIPGEQHRLISRQWTQRPDVWRLQDPLSLTPREQQWLQQHAQVKVGFNPFSAPLALLDEQGEFQGISADLLHLIQLRTGLFFTPVPAYSWRDGVQQLEQHQVAMLAAVAQDGGHQEAVRFTRPYLKVPLVLLVPDQPDAPQALYPGMKLSIVKGNPARQALLDRFPTLQLSEVDNASLALQLLQEGKVAGLIDNQLSVNTLLARYAQQPLKIVSRLALPPVELSFAVSRDQPELLSIIDKALADIQPSEISLIASRWQGTPQTTRTTWQLYRAQFYAISLLTALLLIACLAWVYYRGKEVKHRRRAEADLQAELRFRDALLNGLPTPVYVLDRNWNV

SEQ ID NO: 157163 - protein, 128 aa, Glycine max
  Coding DNA Sequence Number=SeqID_40385
DGWITQLIFKGQILITILQALETLVQVLDPDDEVGDEVDELVEEDGKGASIGCKNLPIGGSRKNAKRSCTHHATATSSSSTMIFTSFLNNTHGSGFLTLGGFGLGHRYDNMGFGIWRLSWATRRPDEQ

SEQ ID NO: 157164 - protein, 118 aa, Glycine max
  Coding DNA Sequence Number=SeqID_40386
  Subcellular localization annotation: CTP_CleavageSite=16; ConfidenceScore=5.08e-01
MEAQTACFPLGFLSLPCSNVGNPVLVFLLTTKSSGKCASLMRDTTIVKDDDDKLFFLFYVPTSFVLGEEVGGGKHACRKKCRTEPFDPLIAQSCSAPSANPEHSKASLIMIAKSFPNK

SEQ ID NO: 157165 - protein, 92 aa, Glycine max
  Coding DNA Sequence Number=SeqID_40387
MGVGDVISCRRLLLGALVSLGVIWFMFLAISVNRQTKRTVLVPMNVISKHLKLVSMQRHALHSNSGLFIVSKRRVPNGPDPIHNRQCASEEK

SEQ ID NO: 157166 - protein, 252 aa, Glycine max
  Coding DNA Sequence Number=SeqID_40388
  Gene Ontology: Mol. function=methyltransferase activity
  Homolog annotation: Hit_ID=Q10D93; Match level="QueryCoverage=52%, HitCoverage=42%, E-value=4e-50, Identity=73%"; Hit description =Expressed protein
  Pfam annotation: Domain name=Cons_hypoth95; Domain location=112-252; Score=57.2; E_value=5.4e-14; Accession=PF03602.5; Description =Conserved hypothetical protein 95
  Subcellular localization annotation: CTP_CleavageSite=31; ConfidenceScore=5.64e-01
MAVLLPPTFSPLLLNTKTDFGSPPFPLLTLSSSSPTSSPLFVSYTKSGNGLASEDKKILLEKYGYDIDADEYFSQSSSKSKRRKEQPRRRGGKQVQDPPEDPKPPRVTHKLLQVLGGTARRVKLLSPKGMDVRPMMEVVKGAAFDILQAAGGCPAALRPGRWLDLYSGTGSVGIEALSRGCSQVHFVEMDPWVVSDVLRPNLEETGFLDASVIHTVRVEKFFERAEQFVGMCIFSLLIPFNAYLRSILVNWD

SEQ ID NO: 157167 - protein, 142 aa, Glycine max
  Coding DNA Sequence Number=SeqID_40389
MNHSRLIIQIQSSGIVHWSLLILKTLTGHRHYHKIKLNQIYYLKETENFHKILHNRSSSNFPWASIYETTTTLLCGKANCITLTPLTVGDWHERFGVLVEVVVKQAKPEMTATLMASKKNKRWMEQPLESVWVCLFESLVHD

SEQ ID NO: 157168 - protein, 646 aa, Glycine max
  Coding DNA Sequence Number=SeqID_40390
  Gene Ontology: Mol. function=protein-tyrosine kinase activity; Cellular component=integral to membrane; Biological process=protein amino acid phosphorylation
  Homolog annotation: Hit_ID=Q1S510; Match level="QueryCoverage=90%, HitCoverage=97%, E-value=0.0, Identity=68%"; Hit description=Protein kinase
  Pfam annotation: Domain name=LRRNT_2; Domain location=50-93; Score =26.4; E_value=0.0001; Accession=PF08263.3; Description=Leucine rich repeat N-terminal domain
  Pfam annotation: Domain name=LRR_1; Domain location=124-146; Score =8.1; E_value=8.7; Accession=PF00560.23; Description=Leucine Rich Repeat
  Pfam annotation: Domain name=LRR_1; Domain location=149-171; Score =14.6; E_value=0.37; Accession=PF00560.23; Description=Leucine Rich Repeat
  Pfam annotation: Domain name=LRR_1; Domain location=173-195; Score =16.9; E_value=0.071; Accession=PF00560.23; Description=Leucine Rich Repeat
  Pfam annotation: Domain name=LRR_1; Domain location=197-219; Score =8.6; E_value=7.1; Accession=PF00560.23; Description=Leucine Rich Repeat
  Pfam annotation: Domain name=LRR_1; Domain location=99-121; Score =1.3; E_value=1.6e+02; Accession=PF00560.23; Description=Leucine Rich Repeat
  Pfam annotation: Domain name=Pkinase; Domain location=329-600; Score =11.6; E_value=3e-09; Accession=PF00069.15; Description=Protein kinase domain
  Pfam annotation: Domain name=Pkinase_Tyr; Domain location=341-600; Score=-16.5; E_value=1.9e-11; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=50-93::124 -146::149-171::173-195::197-219::99-121::329-600::341-600
  Subcellular localization annotation: CTP_CleavageSite=26; ConfidenceScore=5.24e-01
NGTTFPTTGLDPYPSNPTIKTKPFTPQQPRFPLHGSQQHLFLLVPSADLVEGDVRCLKGIKETLSDPLNRLSDWRFDNTTIGFICKFAGVSCWNDRENRVLSLTLRDFKLSGKIPEALKHCGKNIQKLDLASNSFSLEIPREICSWMPFLVSLDLSSNQLSGFIPPTIEKCSYLNELVLSNNQLSGSIPFEFGSLGRLRKFSVANNRLSGTISEFFNRFDREGFEGNSGLCGGPLGGKCGGMSKKNLAIIIAAGVFGAAASLLLAFGLWWWYHLSGKKKKGHGVGSGVGGGGGDWALRLRGYKLVQVSLFQKPIVKLKLGDLMAATSNFSGENVLFATRTGTTYKADLPDGSTLAVKRLSACRIGEKQFGMEMNRLGQVRHPNLAPLLGYCIVEEEKLLVYKHMSNGTLYSLLHKNGGGALDWLMRFRIALGVARGLAWLHHGCHPPIIQQNICSSVILVDEEFDARLMDFGLARLMASDSNGSFVNGDLGELGYIAPEYPSTLVASLKGDVYGFGILLLELVTGRKPLDVSNGEEEFKGSLVDWVNMHSSSGRIKDCIDKAISGRGHDEEILQFLKTAMNCVVSRPKDRWSMYQVYHSIKSISKEQSFFEHDDEFPLIFGKPENESSQNRANVYGLSMSMGDPNQ

SEQ ID NO: 157169 - protein, 305 aa, Glycine max
  Coding DNA Sequence Number=SeqID_40391
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=3e-43, Identity=33%"; Hit description= UPI00006A17C9 related cluster
LHVFTFKGLHVLAFKGLHVLAFRGLRTLTFRGLHIVTFRGLHVLAFRGLHVLAFRGLHVLAFRGLHVLTFRGRHVLGLRGLHVLTFRGLHALAFRGLHVLTFGGLHVLSLRGLHVLTFRGLHDLGFKGLHVLTFIGLHALAFRGLHVLAFRGLDVLTFRGLHVLAFRGLHVLTFRGLHVVPFKGLHVLTFKDYTSTPFRGLCTLNVKGLHVLAFRGLHVLAFKGPHVLPFRGLHALPFRGLHALPFRGLHILSFRGLHILTFRGLHALTFRGPHVLAFIRIHALMRIMKLANYRLKAQVEKDEGP

SEQ ID NO: 157170 - protein, 213 aa, Glycine max
  Coding DNA Sequence Number=SeqID_40392
  Gene Ontology: Mol. function=acetylglucosaminyltransferase activity; Cellular component=membrane
  Homolog annotation: Hit_ID=Q9FLD7; Match level="QueryCoverage=70%, HitCoverage=34%, E-value=6e-44, Identity=62%"; Hit description =Glycosylation enzyme-like protein
MKIQVPEIFPPSRCPMQSHPMKNQMPHHQICLVPRTDSKQGKAVFCLVSENQCYYLVHVYNYLAQWVIGGAEIDEPVPIPELPKQDRGGVERVGDHGGSPVRDEVRLLDNPHIPEPLEQRVALHEPHQIGALLRRGLEVEVDHVAIVGVVESEEDAGDGGAVALGAGDEVGEARRGREGGDGEGAELGFDEDGVGGGGDGAVEWENGGALRGG

SEQ ID NO: 157171 - protein, 268 aa, Glycine max
  Coding DNA Sequence Number=SeqID_40393
MMFATLRDKLKNYKGEVMPKPLKRLDWEVEKFGNWVATWRGDGDFKVTSINGIDMWSAIEFDDIQPPKYKKGPGRPKKLRKKEPDENPNRSRLIRDQVPYKCSRSRAIGHNTRRCPLPPLIVPEEQNEEPSGAAEGGVTRGTKKGGTQGATQGRNEGTPVRGQTQQLNVVLGRFEGAPARVQTQNKKKEITQIKCSKTNNKGKCVHQSIRKVVGPQQHQQTKPTNRHTMGHFGHNTTANEKVQKLVPKHKAPTTSKKLKDCQLTKVMT

SEQ ID NO: 157172 - protein, 541 aa, Glycine max
  Coding DNA Sequence Number=SeqID_40394
  Gene Ontology: Mol. function=nucleoside-triphosphatase activity; Cellular component=membrane; Biological process=response to abscisic acid stimulus
  Homolog annotation: Hit_ID=Q1S520; Match level="QueryCoverage=88%, HitCoverage=96%, E-value=1e-166, Identity=60%"; Hit description=AAA ATPase
  Pfam annotation: Domain name=AAA; Domain location=229-432; Score =63.7; E_value=5.9e-16; Accession=PF00004.19; Description=ATPase family associated with various cellular activities (AAA)
  Subcellular localization annotation: CTP_CleavageSite=24; ConfidenceScore=5.38e-01
AGSLMASTMFIYTMFMRFFPSPLQARVRRYTNKFTSFVYPYIRIRFHEFTGERLMKSEAYNAIQTYLSEHSSQRASKLKAEAIKVKDTRTPLMLSMDDNEEIIEEFQGVKVWWGSYKTTSKTQSFPWNSSSDEKRYYKLTFHKHYRSLITDSYLKHVLEEAKAIEMKNRQLKLYTNSKTRWSHVVFEHPATFETLAMKPKEKECIINDLVKFKSGKTYYAKIGKAWKRGYLLYGPPGTGKSTMVAAMANFMNYDVYDLELTAVKDNSDLRKLLINTSSKSIMVIEDIDCSLDLTGQRKKRKEKVEGREGKDSRKRGDEDDDDDDRGSKVTLSGLLNVIDGIWSACGGERIMVFTTNFVEKLDPALIRRGRMDKHIELSYCCYEAFKVLAQNYLGLESHQLFPKIEKLLEETKMTPADVAENLMPKSLDEEVDTCLHNLIQALERSKVDLEKKKAETERKQSNVQKTSENHGEGMEENGVSVEFEPAILGSNSPSYFQDTCDVRIEDEITAKRHDFVAEVGCVNDECRLFLIQRIHLDLVVA

SEQ ID NO: 157173 - protein, 128 aa, Glycine max
  Coding DNA Sequence Number=SeqID_40395
  Gene Ontology: Mol. function=RNA-directed DNA polymerase activity; Biological process=RNA-dependent DNA replication
MDGGYSTKINRTRAPYKCQPTCLECLRHVRQTQAWRRKKKSHGSRSRKMIREVNYTTWLANVVMATTRSRCILWIKKRRHSSLTQPTSATKSCLLASRTQKQHIRGSWIRSSRSRSDEMWKYTWTTWL

SEQ ID NO: 157174 - protein, 419 aa, Glycine max
  Coding DNA Sequence Number=SeqID_40396
  Homolog annotation: Hit_ID=UPI00004BF617; Match level="QueryCoverage =38%, HitCoverage=25%, E-value=9e-18, Identity=32%"; Hit description =bromodomain containing 9 isoform 1
  Pfam annotation: Domain name=Bromodomain; Domain location=162-249; Score=100.0; E_value=6.9e-27; Accession=PF00439.15; Description =Bromodomain
MVQIARRKKGRPSKADLARRSGESPAAASQSDPRRSLRRRSVRYNIIDYDGDYLDDDEEDERRRKKKKLKLMAKLNQDGEEEEEEEREEEEEIEPTSPSRTRPEPVEEYGDDEKEENENEQEEENEEDEDAVVKGRKVESKGLHSVSVSAPVILQSGTPLPDRRTLELILDKLQKKDTYGVFADPVDPEELPDYHDVIEHPMDFATVRKKLGNGSYTTLEQFEIDVFLICSNAMQYNAPETIYHKQARSIQELGQKKFEKLRIGFERSQIELKSEQKAGSNYLVKKQPKKPLAHASQEPVGSDFSSGATLATIADVQPTSHLMQGGRCERSGNIDGILEANAFWIDANQEKAEDVLSGMSVMRSCYYLSPITFAPIIPIHSVKGGYLCQKLGYSIFDCGSILFQGKGLLSKWGREVLCA

SEQ ID NO: 157175 - protein, 110 aa, Glycine max
  Coding DNA Sequence Number=SeqID_40397
  Gene Ontology: Mol. function=nucleoside-triphosphatase activity; Cellular component=membrane; Biological process=response to abscisic acid stimulus
  Homolog annotation: Hit_ID=Q1S4Z7; Match level="QueryCoverage=67%, HitCoverage=18%, E-value=5e-26, Identity=64%"; Hit description=AAA ATPase
MAASHLQRITIFTTNFVGKLDPALIRRGRMDKHIEMSYCGYEAFKLLGKINMTPADVAENLMPKSFVEDSETCLKNLVKSLEEAKKKVKEQEVNANGKSGEGLKENGTVH

SEQ ID NO: 157176 - protein, 447 aa, Glycine max
  Coding DNA Sequence Number=SeqID_40398
VGLHAEYSYASSLARFGASLGPIAWKIASHRIQQALPAGCKFGRGWVGEYEPLPTPILKVNNCAQKETSLVMKFPSSTELPNSNQNCKNVKSSIEHPLNGQMLEGKHPSMPDFKGKLFFGSAGVRLSAPVNILNQEQNAQSRKSGKSEKKGLKQVELNSLTSSNQNNNGLVAKFTSNAPAVESKPREMVPRNMFKQPDTNGIVSGELPNGKVTNTSLNIQVTGSSPESTSHQSSRAAPAVVHGQEQGLSDPVQLMRMFAERAQKQHTSSNHLLVDTPPVTLSGPSGQRNELGNASAAAAHAWMSVGAGGFKQGPNNSSSPKNQISADSLYNSTRELHQHISRIRGEFPSGGMPFQPFQAVAPQPIHTGAVSQFPNRPMVFPQLASADQSRFQMQSPWRGLSPHSQSRQKQETLPPDLNIDFESPGSPVKQSSGVLVDSQQPDLALQL

SEQ ID NO: 157177 - protein, 88 aa, Glycine max
  Coding DNA Sequence Number=SeqID_40399
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q9LSI6; Match level="QueryCoverage=73%, HitCoverage=19%, E-value=1e-14, Identity=58%"; Hit description =Prolyl 4-hydroxylase alpha subunit-like protein
  Subcellular localization annotation: CTP_CleavageSite=55; ConfidenceScore=5.30e-01
MGQSKKQGHPLSLFFRVDAVSECSRRHGSVLRLNRGGSSVKFDPTRVTQLSWSPRAFLYKGFLSDEECDHLITLPIKVLKTGILAATQ

SEQ ID NO: 157178 - protein, 311 aa, Glycine max
  Coding DNA Sequence Number=SeqID_40400
  Gene Ontology: Mol. function=nucleoside-triphosphatase activity; Cellular component=membrane; Biological process=cell division
  Homolog annotation: Hit_ID=Q1S520; Match level="QueryCoverage=65%, HitCoverage=47%, E-value=8e-64, Identity=59%"; Hit description=AAA ATPase
  Pfam annotation: Domain name=AAA; Domain location=77-247; Score=36.0; E_value=1.3e-07; Accession=PF00004.19; Description=ATPase family associated with various cellular activities (AAA)
MNDNQEIIDEFQGVKAGLLEFRTGHSSCTPTIPSKHPLKFETLAMDPKKKEEILNDLVKFKTGGEYYAEVGKAWKRGYLLYDPPGTGKSSMIAAMANFMNYDMYHLELTAVKKNTELRKLKKKENEDEEQPENPIMNAEEEEKASKVTLSGLLNFTDGSWSVCGGERIVIFTTNLVEKLDPALIRRGRMDKHIEMSYCGYEAFKVLTKNYLRKQEEDQRRGSKEKDQGGRESVAEENEKEQLAKAGEAKANEKSGEGFSKQQIDWMVIMLFVIGLCCGQAYTCTARNFHGYVILKRASVAALNLQDPIDLQ

SEQ ID NO: 157179 - protein, 171 aa, Glycine max
  Coding DNA Sequence Number=SeqID_40401
  Homolog annotation: Hit_ID=Q1STK9; Match level="QueryCoverage=61%, HitCoverage=74%, E-value=1e-08, Identity=42%"; Hit description =Gonadotropin, beta chain; Peptidase aspartic, active site
MSISIYHRWCYANLPLLTLYASVIVFRRRIFTILIDFGSSQNILEQKIGELLALSVVAINPFSVIVVNGESIQFAGYGSNVPIVMTHKVFHIPCYILLIHGANLVFRLSPCILSHYYLWNMRCHTLFQAGTWILHLFPSEMTTLSLNIPPFLPNHKDYLRNKHKITASIFN

SEQ ID NO: 157180 - protein, 83 aa, Glycine max
  Coding DNA Sequence Number=SeqID_40402
  Homolog annotation: Hit_ID=Q338D2; Match level="QueryCoverage=41%, HitCoverage=11%, E-value=8e-10, Identity=91%"; Hit description =Prolyl 4-hydroxylase, putative, expressed
MLQSKSRSQTVFKTVIKAKDKLEKSMVADNESGKSIMSEVRTSSGMFLNKAQHIEKYGWGCSYFLFFWIVLLLEHMALVIFPV

SEQ ID NO: 157181 - protein, 128 aa, Glycine max
  Coding DNA Sequence Number=SeqID_40403
MNTLSTAVVLSAFIFSVELAKRGCALSEYYMASRKRKVPASVSQARYDISKFTSQDAWDRYADNVLGRKILPEMNVKLYITEFDEFRRKIERRNWHKELTNFSEGSIDVAIVKEFYANLYDPEDKSRG

SEQ ID NO: 157182 - protein, 74 aa, Glycine max
  Coding DNA Sequence Number=SeqID_40404
MELSLGEEADRGNGGACEVGVGVDAFRYGSGCGHECGKGKIVEMVHTFLDKILASLKHSSNQAPKKNLHYVWNF

SEQ ID NO: 157183 - protein, 120 aa, Glycine max
  Coding DNA Sequence Number=SeqID_40405
MHIPFPYKVHVDRKGLGRHRSHLRPHSHRREKERKPQEANTNFPYFHGKDNVKAYFDWEIRIEQQLKRKSTSKSDDPHSYPKKDQGQGILGVALSKPKDDKGKTIEKQPLRLVCKRRLAL

SEQ ID NO: 157184 - protein, 566 aa, Glycine max
  Coding DNA Sequence Number=SeqID_40406
  Gene Ontology: Mol. function=hydrolase activity, hydrolyzing O -glycosyl compounds; Cellular component=periplasmic space; Biological process=metabolic process
  Homolog annotation: Hit_ID=P0AGC3; Match level="QueryCoverage=96%, HitCoverage=84%, E-value=0.0, Identity=62%"; Hit description=Soluble lytic murein transglycosylase precursor
  Pfam annotation: Domain name=SLT; Domain location=492-564; Score=8.5; E_value=0.00057; Accession=PF01464.10; Description=Transglycosylase SLT domain
MKGVRHKLERSNEESGVEKWRNWMIGICLVSTAGSVWADSLDQQRQRYAQIKQAWDNKQMDQVEQLMPTLQDYPLYPYLQYRLLAQDLDQETGLAVKNFIQQYPTLPPARSLQTRFVNVLAHRQDWPGVLSFSPDEPKPVQARCNWYYAKWATGQQQAAFDGAKAIWLRGTALPNDCDKLFSVWRASGQLSPITILERIRLAMKAGNDSLVNYLAKMLPADYQTTASALIALQQNPQTVTTFASTLGPTDFTRMATSYAFARVARQDMDNARMMIPQLVQAQKMSPAEEQDLKETVVWRMMGADLTSEQARWRDAVVMNSESTALIERRVRLALSENDRRGLNTWIARLPVEAKEKDEWQYWQADLLMAQGRKEEAEEILRKLMQQRGFYPMVAAQRLGVEYPLQVDQAPAADNSVVQGPEMARVRELMYWGLDNLARSEWANLISSKTHTQQQMLARYANEQDWWDLSVQATITAKMWDSLKERFPLAWRNLYQQYTSDKGITPSYAMAISRQESAWNPKARSPVGASGLMQVMPGTASHTVKMYNIPGYVNSSQLLDPQTNIQI

SEQ ID NO: 157185 - protein, 75 aa, Glycine max
  Coding DNA Sequence Number=SeqID_40407
MASTFGFTLQDWQRCAQQDAQQIPALLAAHLDALDNQDNAWLYLASPAQLLAQLNRCWRRISAIRPPCRCLACRL

SEQ ID NO: 157186 - protein, 470 aa, Glycine max
  Coding DNA Sequence Number=SeqID_40408
  Gene Ontology: Mol. function=oxidoreductase activity, acting on CH-OH group of donors; Biological process=electron transport
  Homolog annotation: Hit_ID=UPI00005F90C2; Match level="QueryCoverage =99%, HitCoverage=99%, E-value=1e-172, Identity=68%"; Hit description= COG5383: Uncharacterized protein conserved in bacteria
  Pfam annotation: Domain name=DUF1338; Domain location=348-459; Score =216.3; E_value=6.8e-62; Accession=PF07063.3; Description=Protein of unknown function (DUF1338)
MRMTAQQFVSPNEIRARFSHAMSDMYQKEVPLYGDLLELVAETNRQVLREDAALAHQLQITGEIERLAMERHGAIRVGTADELATLRRLFRVMGMAPVGYYDLSVAGVPVHSTAFRAVHEDALQISPFRVFTSLLRLELIEDPALRALAERLLARRRIFTDRALELIALQEAQGGLNEVQAQEFVEQALETFRWHNQATVSAEEYRQLHDQHRLIADVVAFKGPHINHLTPRTLDIDRVQQAMPGRGITPKAVIEGPPRRRRAILLRQTSFKALEERVDFVEHDGRAVAGHHTARFGEIEQRGVALTTKGRELYDRLLQATNDALQAPPSEKNAERYYQLLEENFRAFPDDYATLREQQLAWFRYFPTECGLAAKESLDKHSTLEQLIEKEHVRFQPLVYEDFLPVSAAGIFQSNLGDSRHAQYNAASSRAAFEQALGSEVIDELALYQQTQQRSLEACAQALGLATLTS

SEQ ID NO: 157187 - protein, 423 aa, Glycine max
  Coding DNA Sequence Number=SeqID_40409
  Gene Ontology: Mol. function=tetraacyldisaccharide 4'-kinase activity; Biological process=lipid A biosynthetic process
  Homolog annotation: Hit_ID=UPI00005F758A; Match level="QueryCoverage =69%, HitCoverage=90%, E-value=1e-114, Identity=69%"; Hit description= COG1663: Tetraacyldisaccharide-1-P 4''''-kinase
  Pfam annotation: Domain name=ABC_tran; Domain location=1-99; Score =25.1; E_value=1e-09; Accession=PF00005.17; Description=ABC transporter
  Pfam annotation: Domain name=LpxK; Domain location=119-422; Score =454.5; E_value=1.4e-133; Accession=PF02606.5; Description =Tetraacyldisaccharide-1-P 4'-kinase
  Pfam module annotation: Pfam domain module=ABC_tran::LpxK; Domain location=1-99::119-422
MAYAMDFINKMENGLDTVIGENGVMLSGGQRQRIAIARALLRDCPILILDEATSALDTESERAIQAALDELQKDRTSLVIAHRLSTIEKADEILVVEDGRIVERGEHAELLERQGAYAQLHRMHWLIRLSYRCGLRKSWRAPVPVVVVGNLTAGGNGKTPMVIWLVEHLQQRGYRVGVVSRGYGGKSAVYPLVLNQNTSTREAGDEPVLIYQRTGAPVAIAPKRAEAVQALLQQQPLDAIVTDDGLQHYALQRDFELVVIDGVRRFGNGWWLPAGPMRERAARLGSVNARVANGGVAQAGEIAMRLQARDAVNLLSGERRPVAELPHVVAMAGIGHPPRFFATLEKLNVEVVQEVAFADHQEYQQAQLAALVAADQTLLMTEKDAVKCRAFAQPNWWYLPVDAVLPSAQAEQLLQDIESLLTK

SEQ ID NO: 157188 - protein, 118 aa, Glycine max
  Coding DNA Sequence Number=SeqID_40410
MVYKNSHSIRYLLSLDEILLSLSSGGKDEDSLHRLSQHALLRLSEARLTSALSKGGKMRGVTTNVYLWKMSEKTEGNRSKRKFQVRELYLRLRKVDKSGALAPTYPPSKRKSDLRSSF

SEQ ID NO: 157189 - protein, 58 aa, Glycine max
  Coding DNA Sequence Number=SeqID_40411
MALKAAGSEGTRENMTFRRSGRSPRRRGEKVSGFHHGAAGDLVVQQRGGGGRCLLEGD

SEQ ID NO: 157190 - protein, 286 aa, Glycine max
  Coding DNA Sequence Number=SeqID_40412
  Homolog annotation: Hit_ID=Q6DAI7; Match level="QueryCoverage=99%, HitCoverage=44%, E-value=6e-73, Identity=52%"; Hit description =Putative signaling membrane protein
MRQQHGKIAVEVARQQRRRIAHHEGRQQIDQRIHQLLHRHAAVRLAQGLEIGQPHHHHDAVRAFVFQLSGQLVIEEQAIIEPGFGVLRGEGADQRIDPAALFPRFRQIGQQAIERAADVGRPLTHVALHDVFTLAVQNAPRAAFQTIFAVGLLTQPAQAEQQNHHHHDDRQRDGGGGLQRAHVAGEGVAVGDVQRAARMLQQGTRDLTITVQRIPVLFFLRRQLIVEQLAGTGLYADRHDAERAHDDRQPFFLLLRRLAQHGLIESGDQRIQAALLAILGNVKEAV

SEQ ID NO: 157191 - protein, 39 aa, Glycine max
  Coding DNA Sequence Number=SeqID_40413
MTTLCKSRRKVSKGNNCQFCEIKTFPKGLPKVDSLQSKP

SEQ ID NO: 157192 - protein, 93 aa, Glycine max
  Coding DNA Sequence Number=SeqID_40414
DKDGVDNTVYEKYSISKEKWAQFCQTHRDPSWEDVRKKVQAIQKQNTAPHVLCRGGYDYLEQKLMAEKTKKKLEEAAQSGSTEGVINPPSPIR

SEQ ID NO: 157193 - protein, 45 aa, Glycine max
  Coding DNA Sequence Number=SeqID_40415
MEESLTEKVTRQLMASFNQMQSHLQSQMQSQGLALPLEPEELLKH

SEQ ID NO: 157194 - protein, 383 aa, Glycine max
  Coding DNA Sequence Number=SeqID_40416
  Gene Ontology: Mol. function=oxidoreductase activity, acting on the CH-CH group of donors; Biological process=electron transport
  Homolog annotation: Hit_ID=Q4KBL4; Match level="QueryCoverage=98%, HitCoverage=91%, E-value=1e-121, Identity=58%"; Hit description=Acyl- CoA dehydrogenase family protein
  Pfam annotation: Domain name=Acyl-CoA_dh_2; Domain location=236-378; Score=-9.0; E_value=0.0015; Accession=PF08028.2; Description=Acyl -CoA dehydrogenase, C-terminal doma
  Pfam annotation: Domain name=Acyl-CoA_dh_M; Domain location=120-170; Score=16.6; E_value=0.0008; Accession=PF02770.9; Description=Acyl -CoA dehydrogenase, middle domain
  Pfam module annotation: Pfam domain module=Acyl-CoA_dh_2::Acyl-CoA_dh_ M; Domain location=236-378::120-170
MSILSTGTDYDTLAAHFRPLFARIAAGAAERERTRILPYESLQWLKEAGFGTVRIPQQKGGWGASLPQLFQLLIELAEADSNLPQALRAHFAFVEDRLNQPDNAERDAWFRRFVDGELVGSGWTEIGNVRLGDVITRVTPAANGWTLNGEKFYSTGALFADWIDVYARRDDNQGDVIALVNTHQPGVTREDDWDGFGQRLTGSGTTRFEHAHVETQHVYDFATRFRYQTAYYQHVLLATLAGIARAVARDGAAAVAARNRVYSHGNGAASRQDAQVLQVVGEITSLAFAVEATVIRATHSLQSAYEAHVSADEAAIAAINNLAEAEAGQAQVIASELVPRAGTELFNALGASDTRVSKALDRHWRNARTVSSHNPVIYKARDI

SEQ ID NO: 157195 - protein, 38 aa, Glycine max
  Coding DNA Sequence Number=SeqID_40417
MSHLARCADAVLSGGCALSPHGPLSATAPFSTSRISLI

SEQ ID NO: 157196 - protein, 171 aa, Glycine max
  Coding DNA Sequence Number=SeqID_40418
MVWKLLGARLFSSYASSLLLTPLLFRCKISLVHGQEPIFGHLCYMKPSPFLGNESFHSYPFLKFNDKVVEQQHQDSQKASSANGDGDGNAKVKRNNLKGKRAVVVEMSLSYSLDEGSEVKMLGGLHAIGTSLHESQRIDNQLLNDNNNGLKRKGAPNQRNHMVLCSAIPAH

SEQ ID NO: 157197 - protein, 74 aa, Glycine max
  Coding DNA Sequence Number=SeqID_40419
MERHGKRQGDLRLTEGIISVRARGVVGLLVLHLRQCAAKLPTQSLRLRPMIFEGALIHGMHVSHGSEMAECVPF

SEQ ID NO: 157198 - protein, 139 aa, Glycine max
  Coding DNA Sequence Number=SeqID_40420
  Gene Ontology: Mol. function=protein binding; Cellular component =nucleus
  Homolog annotation: Hit_ID=Q8RXD8; Match level="QueryCoverage=96%, HitCoverage=38%, E-value=9e-17, Identity=38%"; Hit description=WD repeat protein-like
  Pfam annotation: Domain name=WD40; Domain location=60-98; Score=18.6; E_value=0.022; Accession=PF00400.22; Description=WD domain, G-beta repeat
MNSRLLKITFHEKHGTDRICCTHHPSSVICSSKYNLEFTGGLRSQSIRNHYCISSLGGNFLEPHLFLNPIGRVFSLCMSPINDSFMSGSLDHNVRIWDLWGILRLRGRPAIAYDQQGLVFAVAMEGGAIKLFDSRSYDK

SEQ ID NO: 157199 - protein, 59 aa, Glycine max
  Coding DNA Sequence Number=SeqID_40421
  Subcellular localization annotation: CTP_CleavageSite=33; ConfidenceScore=5.21e-01
MGDQVNLIFTQSSLLPRLTSMAILALSARLALSASSLSRIIFLPLSMRYPSSPCIMLNA

SEQ ID NO: 157200 - protein, 109 aa, Glycine max
  Coding DNA Sequence Number=SeqID_40422
  Subcellular localization annotation: CTP_CleavageSite=48; ConfidenceScore=5.77e-01
MAGHRAKAPTTPSSSLFTAISPLFLLCTRVVNASSSKLGWCHGVGSPLATKFKPGVRLRRIWVVGFGGEERMAVEVQFEVAPLVWMEWKGNLEIFKISGRETMAIISLS

SEQ ID NO: 157201 - protein, 338 aa, Glycine max
  Coding DNA Sequence Number=SeqID_40423
  Gene Ontology: Mol. function=sucrose transporter activity; Cellular component=integral to plasma membrane; Biological process=sucrose transport
  Homolog annotation: Hit_ID=Q84RQ3; Match level="QueryCoverage=98%, HitCoverage=65%, E-value=1e-126, Identity=67%"; Hit description =Sucrose transporter 4 protein
MIGKDQRRTRVANAYYSLFMAIGNILGYATGSYSGWYKVFAFTLTPACNISCANLKSAFFLDIIFIAVTTYISIVAAKEVPLSSSGAHPVEEAAAGESGTAGEAFLWELFGTFRYFSTPVWTILTVTALTWIGWFPFLLFDTDWMGREIYGGEPNEGPNYDTGVRMGALGLLLNSVVLGVTSVLLERLCRKRGPGFLWGISNILMAVCFISMLVVTYVANNIGYVGKDLPPTGIVIASLIIFTILGFPLAITYSVPYALISTHIQSLGLGQGLSMGVLNLAIVFPQMVVSLGSGPWDQLFGGGNSPAFGVAAVAALASGLIAVLFIPRPGGQKPRSPV

SEQ ID NO: 157202 - protein, 90 aa, Glycine max
  Coding DNA Sequence Number=SeqID_40424
MTPSSCTKHEPIAELGDEFDANLSLQNNVIKRNANNVPMRRIPSGEIIDGEENCVNRVTLLQCTTSGGTEASLSPPGLARCPEESVRMRL

SEQ ID NO: 157203 - protein, 108 aa, Glycine max
  Coding DNA Sequence Number=SeqID_40425
MEIGGLGKVSQHYGYECWIGDNERLLLLSRRVFRVICVETSFMMMNQVDSSSFDNDKKSKEWFQEGVNKFKIKFNFKFHKKKSRRFKNQEKIDFKIQEKMNSRFKRRN

SEQ ID NO: 157204 - protein, 1218 aa, Glycine max
  Coding DNA Sequence Number=SeqID_40426
  Gene Ontology: Mol. function=nucleic acid binding; Cellular component= beta-galactosidase complex; Biological process=DNA integration
  Homolog annotation: Hit_ID=Q1S0A6; Match level="QueryCoverage=98%, HitCoverage=98%, E-value=0.0, Identity=62%"; Hit description=Zinc finger, CCHC-type; Peptidase aspartic, catalytic; Polynucleotidyl transferase, Ribonuclease H fold
  Pfam annotation: Domain name=zf-CCHC; Domain location=264-281; Score =7.9; E_value=0.048; Accession=PF00098.13; Description=Zinc knuckle
  Pfam module annotation: Pfam domain module=RVT_2::Retrotrans_gag::zf -CCHC; Domain location=724-979::83-197::264-281
MAENKKPHTDGTKKTPSPYDLNSNDNPGNLITQVHLRGENYEEWARAMKISLRARRKWGFIDGTYEQPDDGSPEMEDWWTVQSMLVSWIFNVIEPTQRSTVTYAENAKDLWEDIRDRFSVVNGPRIQQLKAKLADCKQQGMIMVSYYGKLKTLWDELANYEQIPRCSCGGCKCDIASKLEKRREEEQVHQFLMGLDDASYGTVRSNILVADPLPSLNRVYAILVQEERVRTISRTKEERGAVMGLAVQAGHKSKWRREIKDKSMVCSICRKAGHDDKNCFQVVGYPDWWGDRPRSEGGSSGKNQQRNWTSAGRGRGGMARANTTHVEKSELPGLSNEQWQTLVEMLNNRKTDEIEKMTGKHPDNLWIIDTGASNHMTGYLKNLCQQRTIRGCPVGLPDGEKDRTLKTLIGAGERKDGLYLYHGVRNSKAYHTNTKYDLDILHKRMGHPSFKVVKLIPNVTSSGYLINLTPSPILDGKTPYELVHRTPPSYDHLRVFGSLCYAHNQDRKGDKFDSRSRKCIFVGYPYGQRGWKLYDLEREVFFVSRDVKFVETEFPFEESINNPSPTSLVPLINPCMDEECMVENGHDNDTNADVRGGASEASNEPQSFAPPLEKQNCIDVVQCSSEGPETRSNFPPTSPLGKGHRIKRPSVKLSDYVTNTMIKLSPSTCSSASSHDSGARYPIAHYVNCDRFSHQHRQFLAAVSAGRESMHFSEAVQDERWREAMASEIEALQNNGTWTITTLPPKKKALGCKWIYKIKYHSDGTIERFKARLVILGNHQVEGLDYTQTFAPVAKMVTVHTVLAVAAAKAWELHQMDVHNAFLHGDLQEDVYMKLPLGFMTEHKGMVCKLRKSLYGLRQAPRCWFAKLSTALKNYGFRQSCSDYSLFTLRTTTVHLVVLVYMDDLIVSGNDSEAILRFKLYLHICFHMKDLGRLKYFLGVEVARSPKGIYLCQRKYATDIILETGLLGAKPMSIPLEENHRLALAEGPLFSDPGHYRRLFGRLIYLCFTRPELSYCVHTLSQFMQQPREEHWHAALRVVRYLKGNPDQGILLRSDNDLKLYGWCDSDWAGCPLTRRSLTGWYISLGHSPISWKTKKQHTISRSSTEAEYHSMANTICELTWLKAILSSLGVLHPQPIQLYCDNQAALHIAKNPVFHERTKHIEVDCHFVRDEVLKNTIQPFYVPSRTQLADIFTKALGTKQFLFLLSKLGIQNLHVPP

SEQ ID NO: 157205 - protein, 1266 aa, Glycine max
  Coding DNA Sequence Number=SeqID_40427
  Gene Ontology: Mol. function=RNA-directed DNA polymerase activity; Cellular component=chromatin; Biological process=chromatin assembly or disassembly
  Pfam annotation: Domain name=Chromo; Domain location=1174-1225; Score= 16.9; E_value=0.01; Accession=PF00385.14; Description='chromo' (CHRromatin Organisation MOdifier
  Pfam annotation: Domain name=RVP_2; Domain location=332-440; Score= -51.6; E_value=0.01; Accession=PF08284.2; Description=Retroviral aspartyl protease
  Pfam annotation: Domain name=rve; Domain location=912-1068; Score =107.8; E_value=3.1e-29; Accession=PF00665.16; Description=Integrase core domain
  Pfam module annotation: Pfam domain module=Chromo::RVP_2::RVT _1::Retrotrans_gag::rve; Domain location=1174-1225::332-440::502 -679::85-175::912-1068
MAESTRSKSFDRLKEAIVKLASSHLHVSKKLDDLINRVTALESNPHSPSSSSTNPPHHNPTPSPHRLKLDVPRFDVSDPSGWRLTVASFYMDGPALAWFPWMACNHQLPTWTGFLQAIEARFALSPYEDPIGQLFKLVQKGTVREYLAQFESLANRITGLSPSSLLSCFISGLEPDIRREEEKLQDSRRSFRSRSSFTPSPSTPPPLSMVSPPSPLPLLPSPPKPLPLPVRRLSPEELASRRERGLCFYCDEKYNRDHRCASRFFLLVADEDPDDDPLNPNISPSISPNPPRPDITNNPSPTHLQPDPPLAQISLHALSDHTAPKTLRMTGRISQQIVVILIDDSSTHNFVQARLVKSLGLNPQPTPTLRVLVGNGNEVVCSQICLAVTIQLQGHSFTVDLHVLPLCGADIVMGVQWLKSLGPILTDYNDLTMKFFHQGHLIELKGTTNMHLLAVSPPQLRRTLQTQSASEFFHIRVCSPTSPSPTTYPEILTILDQFAPLFQPPTTLPPSRPTNHSIHLLPNSPPFNTRSYSTSPFSPPVLLVKKRDGSWRFCVDYRALNALTVKDRFPIPTIDELLDELGGAPFRTHHGHYEFLVMSFGLCNAPASFQATTNQTLGPYLRKFVIVFFDDILIYSQTFSDHLEHLRKILQVLADHSFVLKLSKCSFATQQVEYLGHLVSEKGVEPVPAKVTAVQQWPVPRSTRALRRFLGLSGFYRRFIKGYASLAAPLTALLAKDQFHWSEEADRAFSQLKLALCQALVLGLPHFNSPFVIKTDASGIEIATIIVAVKKWRQYLLGHHFMILTDHQSLKELMAQAVQTPDQQIYLAGLMGFDYTIQYRAGKANLAADALSRLPPPNPGRIWLPPKFPLIPTILAEFHSTPTGGHMGVMKTLARIKPDNRRPPGLLFPLPISARPWEDLSLDFIVALPLHHGNSVILVIVDRFSKGLHLGSLPQHHTAAGVAKLFMEIFGKFHGMPKSLVSDRDPLFLSHFWQELFKLSGTKLCMSSAYHPQSDGQTEAMNRVVEQYLRAFVHQKPSSWGCFLMWAEWSYNTLTLSATSMSPYEITFGKKPPCFPQYLEGASKVEAVDEWLTQHDIMITSLVKKLSEAQQHMKEIADRQRRDVSYKEGDQVLVKLRPRRQTSISGGAHSKLAKRFYGPFSVIKKIGKDNQPCITPLVILDTKWETSSMGRQLMVLVQWASLLPEDSSWESWDTLKHDYNLEDKVVLEACRDVMNKESSEAGVKEYGTGSKRKNQRPRYLKDYVAK

SEQ ID NO: 157206 - protein, 64 aa, Glycine max
  Coding DNA Sequence Number=SeqID_40428
  Gene Ontology: Mol. function=nucleic acid binding
  Homolog annotation: Hit_ID=Q1SIQ0; Match level="QueryCoverage=97%, HitCoverage=20%, E-value=4e-09, Identity=60%"; Hit description=Zinc finger, CCHC-type
MGLAGIPFAESVSCLLGSLDIPKRWHEGSVDPSASNIGSHEGWRLGTDLCCQHSQLGQSLLEGH

SEQ ID NO: 157207 - protein, 316 aa, Glycine max
  Coding DNA Sequence Number=SeqID_40429
  Gene Ontology: Mol. function=protein serine/threonine kinase activity; Cellular component=anchored to membrane; Biological process=protein amino acid phosphorylation
  Homolog annotation: Hit_ID=Q1S6A8; Match level="QueryCoverage=76%, HitCoverage=80%, E-value=4e-97, Identity=70%"; Hit description =Thaumatin, pathogenesis-related
  Pfam annotation: Domain name=Thaumatin; Domain location=31-248; Score= 272.7; E_value=7.2e-79; Accession=PF00314.8; Description=Thaumatin family
MDQLTLAFPFLLTLHLLVSGVVATTSFTLVNKCDYTVWPGILSNAGIATLPTTGFVLQTGESKTVTAPTSWGGRFWGRTLCTQDSAGKFSCLSGDCGSGKLECAGNAATPPATLAEFTLDGAGGLDFFDVSLVDGYNVPMLVAPQGGSGDNCTSTGCVGDLNGACPSELRVTSVDGKQSVACKSACEAFGSPQYCCSGAYGSPTTCKPSPYSQIFKNACPRAYSYAYDDKTSTFTCASAAAYTITFCPSPSSNPSQKSWQGQNPKSDSSGSASASASGSPQLNNGTMVVPMGRNLKPLRALLVSPSLFGSCATSTN

SEQ ID NO: 157208 - protein, 168 aa, Glycine max
  Coding DNA Sequence Number=SeqID_40430
  Gene Ontology: Mol. function=nucleic acid binding; Biological process= DNA integration
  Homolog annotation: Hit_ID=Q1RWP6; Match level="QueryCoverage=62%, HitCoverage=8%, E-value=5e-24, Identity=58%"; Hit description=Zinc finger, CCHC-type; Polynucleotidyl transferase, Ribonuclease H fold
MYMKECFTCFTKGSRSMTDYLHGIKSLTDELAITNDPLDDADLVIHTLNGLSAEYKEVSTALHTHEKPIDFEELHDLLLTLRVISRGMTTTMIPHLLPLLMQYTRGLLYTGNDTLFESTGLYGELRVILGSDAWVSCCWDKSKDPLCLREIFSVQEKKTHISCNVCVF

SEQ ID NO: 157209 - protein, 794 aa, Glycine max
  Coding DNA Sequence Number=SeqID_40431
  Gene Ontology: Mol. function=DNA binding; Cellular component=nucleus; Biological process=transcription
  Homolog annotation: Hit_ID=Q53J12; Match level="QueryCoverage=78%, HitCoverage=41%, E-value=3e-11, Identity=22%"; Hit description=BAH domain-containing protein, putative
NEAGNDNDPASGLIGSEKSLLKSSDNLPVHSSDNVLQLSASVECIDIKVGSENHVAGVPSSAQEVAPAHEGLPICTTGETTSAGTCNFPIPNQSSFEGQSDVVQLSDLAKVEKQEQNINDPPEKLGAPEICSVSSNKPESEPVSMVACEAKAPESVKNPALEQNVEHNEDDVCRNLTNSASMRTPASDRSGEDDGASVSDSNLGKTEVLDVSVFGTEYVTASKEGKGHEEDTSIGSDSSKPGIDFRSSNIIDKRGSDNELDCGIVDALEFARKIAQEVNREVSCSSEKVSEHRIRQPCSPDSVRKEDELTPVPPKEVSSRQSHATEACSMEGHVSILDNNEAEPECRPYVVSLEVTEKAQDSGGNSEKRLCGFDLNEVGADDMDVSVNTMSTPIPVVSASRPAPTPGLTGAPLQFEGTLGWKGSAATSAFRPASPRKNCDNDRNLSVDMNFDTSKQRQDWLDFDLNVAEGEEGNVKPTAESSGRPSGQSSFEFSPKKSSRLEFDLNSTGDDGDTQPSDQRMEGQLFLGRNGCWSPSPASSSSSMQPSVRNIDLNDRPCLQTDLVDQGPIKSAHLINAFGSKSSNAPVISLLGAKVEVGKKECVPQRLSLQNGKATEPAIELTMSRAGSVLGMTPTVPFNHSSVFGYNGVASASVTPAMSFSSAMYGSGGTIPYMVDSRGAPVVPQVGGSSSTVLSSYSQPPIFMNMAGTQLGLNGFGPSRPNFDLNSSFMIEGGNRDTLAARQFFFPVQGRAVEEQVRSMPQPSSSGVSGKRKEPDSGLEPYPFIYKNPQPPWK

SEQ ID NO: 157210 - protein, 67 aa, Glycine max
  Coding DNA Sequence Number=SeqID_40432
MAASKLFSASLLVSMVTLLVLSSDKCLALQCGVSYETITVVNEFPHDPQAFTQVFSSPKFERLIKRT

SEQ ID NO: 157211 - protein, 70 aa, Glycine max
  Coding DNA Sequence Number=SeqID_40433
MDSMWKGLPRTSLSDMKELKLGARVRTSEAATTTEDRGPAMTRIATEGFQSRTTTVSSSASAQHGVTTHK

SEQ ID NO: 157212 - protein, 96 aa, Glycine max
  Coding DNA Sequence Number=SeqID_40434
MWVSEASLDKFDEGGLNIQMKWYVDMDSGYFSGEVELNGLRSIAIAPFIYLALLGSFIFHLVRVWTMDYKVHCVSCHGLFIVPVSCPVTFSSYINI

SEQ ID NO: 157213 - protein, 121 aa, Glycine max
  Coding DNA Sequence Number=SeqID_40435
MVIVNVQVLKRHSLSKRPVALESGRKRVRERGFMEISSWVSWRVLKPIYAFVSGRRFSRGYLLIVSAAVILVLVATLTWDVSRKATCAFLRDHTDSQEDVADELVAELADPINGVSNPDQV

SEQ ID NO: 157214 - protein, 73 aa, Glycine max
  Coding DNA Sequence Number=SeqID_40436
MTMARLHKWEGNSRVTAVFMSTTKIHKYSVLEGLLITLKAHYTFKTVDSQSLSYTLKPTKAYLCVPLINLPDL

SEQ ID NO: 157215 - protein, 163 aa, Glycine max
  Coding DNA Sequence Number=SeqID_40437
  Homolog annotation: Hit_ID=Q6Z7R3; Match level="QueryCoverage=90%, HitCoverage=8%, E-value=8e-12, Identity=31%"; Hit description =Putative serine-threonine rich antigen
MTLEDFFTLSEMKDGLTAPSRVQELVSVMQKEKDSEVKNAADVTRQWAAVASTIAATENKDCLDLFIQLDGLCFINRWLKDAQDFGVDANDSFVEESITAMLRAVEKLHIDSEKSMSSGIRITVSNLLGHHSARVQDRARTLFDSWKGVGNGDTESHDVELAK

SEQ ID NO: 157216 - protein, 89 aa, Glycine max
  Coding DNA Sequence Number=SeqID_40438
MRKARCLVLTSKKFDGKVVLDLDVRTFFDALNGLLYHGNDTLFESTGLYGEISTEETNFLLLGKDFAHLILPTPYNDRRLVHRTILQWS

SEQ ID NO: 157217 - protein, 109 aa, Glycine max
  Coding DNA Sequence Number=SeqID_40439
MRLYINSNKEEIGKVDLSEGLWVVRERVEDGDRVVGNPALKRAAPVRQKDDDGDNEINGKECGRGHAWEGSEREMSSKHYYCKLHKLESYVTVLLLAMERARGERERLL

SEQ ID NO: 157218 - protein, 699 aa, Glycine max
  Coding DNA Sequence Number=SeqID_40440
  Gene Ontology: Mol. function=unfolded protein binding; Cellular component=phagocytic vesicle; Biological process=protein folding
  Homolog annotation: Hit_ID=P27323; Match level="QueryCoverage=99%, HitCoverage=100%, E-value=0.0, Identity=81%"; Hit description=Heat shock protein 81-1
  Pfam annotation: Domain name=HATPase_c; Domain location=27-181; Score= 68.0; E_value=2.9e-17; Accession=PF02518.16; Description=Histidine kinase-, DNA gyrase B-, and HSP90-like ATPase
  Pfam annotation: Domain name=HSP90; Domain location=184-699; Score =1294.1; E_value=0; Accession=PF00183.9; Description=Hsp90 protein
  Pfam module annotation: Pfam domain module=HATPase_c::HSP90; Domain location=27-181::184-699
MADAETFAFQAEINQLLSLIINTFYSNKEIFLRELISNASDALDKIRFESLTDKSKLDAQPELFIRLVPDKDNKTLSIIDSGIGMTKADLVNNLGTIARSGTKEFMEALQAGADVSMIGQFGVGFYSAYLVAEKVIVTTKHNDDEQYIWESQAGGSFTVTRDTDGEQLGRGTKITLFLKEDQLEYLEERRIKDLVKKHSEFISYPIYLWTEKTTEKEISDDEDDEPKKEEEGDIEDVDEEKEKDSKKKKKIKEVSHEWQLINKQKPIWLRKPEEITKDEYASFYKSLTNDWEEHLAVKHFSVEGQLEFKAILFVPKRAPFDLFDTRKKMNNIKLYVRRVFIMDNCEELIPEYLGFVKGVVDSDDLPLNISREMLQQNKILKVIRKNLVKKCIEMFNEIAENKEDYNKFYDAFSKNLKLGIHEDSQNRSKLADLLRYHSTKSGDEMTSLKDYVTRMKEGQKDIYYITGESKKAVENSPFLERLKKKGYEVLFMVDAIDEYAVGQLKEYDGKKLVSATKEGLKLDDETEEEKKKKEEKKKSFDELCKVIKDILGDKVEKVVVSDRIVDSPCCLVTGEYGWSANMERIMKAQALRDSSMSGYMSSKKTMEINPDNGIMEELRKRAEADKNDKSVKDLVLLLFETALLTSGFSLDDPNTFASRIHRMLKLGLSIDEDDNGGDDVDMPPLEEDGAEESKMEEVD

SEQ ID NO: 157219 - protein, 154 aa, Glycine max
  Coding DNA Sequence Number=SeqID_40441
  Gene Ontology: Mol. function=glutaminyl-peptide cyclotransferase activity
  Homolog annotation: Hit_ID=O81226; Match level="QueryCoverage=94%, HitCoverage=51%, E-value=1e-55, Identity=70%"; Hit description =Glutamine cyclotransferase precursor
  Pfam annotation: Domain name=Glu_cyclase_2; Domain location=1-134; Score=-0.1; E_value=5.3e-11; Accession=PF05096.3; Description =Glutamine cyclotransferase
MKDGWGLATDGKVLFGSDGSSTLYQIDPQTFKALSKQVVHYKGHQVHNLNELEYINGEVWANVFMTDCIVRISPSDGNVLGWILLQNLRKELIKAGNNDIDVLNGIAWDGEQKRIFVTGKLWPKLYEIKVSPVNKPIEEGIIEQLCLRNPFKFP

SEQ ID NO: 157220 - protein, 291 aa, Glycine max
  Coding DNA Sequence Number=SeqID_40442
  Subcellular localization annotation: CTP_CleavageSite=37; ConfidenceScore=5.33e-01
MEAVLTPHATAQKQPFAPNKNIRMKTPKKNGRGNFICANNRSENFDTYAGLLNPPSRAMSFSYSHPLSASSLFTHHCAQQPPLLPLPHVVSPTYGSGQGLVVVVNKNKNRSRDMSLTPKKSKPTKREEAKKRSVTQSDNRWGPDPKDLPKVVLGMGNNHHDVVSGAVFNLAPPPSSLPLPKFSLRSKLGCNAETAAGGVDDGATNNLRRLLRLREGVGIGEGKEGAGPRGRVDGEVISSELGEGVEGEEGKEGQEAGEEGGGGGGGSEGGGYGGGGGAVVEDFEEAGVAEP

SEQ ID NO: 157221 - protein, 54 aa, Glycine max
  Coding DNA Sequence Number=SeqID_40443
MVESFIENERSRLNSFPLQGIWFDRDWKKIEAFVGSKSVIQGSQQSHGKKRGIH

SEQ ID NO: 157222 - protein, 153 aa, Glycine max
  Coding DNA Sequence Number=SeqID_40444
MQQGDYTSAPSPYYQFPHLQNPNPNPDPHPNNPYASAPPFTPNYAPSDYTPYPSSYPQNPDPIPPTAPSFPPSSSNPNLPPPFNPPFDSNPPYQQPQPQQPYFPPYDHHQTPPNYAPPNTNSTPSVYNSAPYSYTGVSSVPPIPTYEPAYDAP

SEQ ID NO: 157223 - protein, 323 aa, Glycine max
  Coding DNA Sequence Number=SeqID_40445
  Gene Ontology: Mol. function=RNA-directed DNA polymerase activity; Cellular component=chromatin; Biological process=chromatin assembly or disassembly
MADSRSKSTLERLEEAIAQLASSQLNVTERIEELLLRVANLEHASKPSTSPSSSSPNPAPNTTYNPPKMKLDVPKFDGTDPSGWVFKITQFFAYHSTPEPERLTIASFAMEGPALAWFQWMTRNHQLPTWAAFLQAIEMCFAHGGSIIQLKALPYPNPIHPDISALLIDFATLFQKPNTLPPTRPTNHTILLEPHSTPVNVCPYRYPYFQKHEIETQVAQMLQSGIIHPSTSPFSSPVLLALKFDYNLEDEVILEALRDFRISNIEEETKEQTKEQEAYVEQQRGAEKEKDKGQRGKFTNPRTLETSSFHDHSSKAYAIRPLG

SEQ ID NO: 157224 - protein, 324 aa, Glycine max
  Coding DNA Sequence Number=SeqID_40446
  Gene Ontology: Mol. function=zinc ion binding; Biological process =lipid metabolic process
  Homolog annotation: Hit_ID=Q5YLY5; Match level="QueryCoverage=98%, HitCoverage=49%, E-value=1e-78, Identity=68%"; Hit description=Zinc finger protein-like
  Pfam annotation: Domain name=FYVE; Domain location=174-240; Score =119.5; E_value=9.4e-33; Accession=PF01363.12; Description=FYVE zinc finger
MQRIDSSTFAFWSKSPVDIEPRRIRLQSNSYTTNTLLDIVTAATIQAKMINAFRKIGGRYWLCIFNVTMGQDFVLKLLSQFELPYEQEVKNRKIQMAQAVSRLPVVVVQCHHGHLSYSGALWPIMNITGAMQFKEMGGSRWPAEAVKPNEQPTERKKGFGDWMNLIKPANEEKDHWVPDEAVSKCTACGTDFGAFVRRHHCRNCGDIFCDKCTYGRIALTADENAQPVRVCDRCMAEVSQRLTSAKESSSKPALQSHEDLARKLQEELERNRKTSGSKSDGSARRMKEVACPICTVHLQVQVPSSGSETIECGVCQHPFLVSAH

SEQ ID NO: 157225 - protein, 794 aa, Glycine max
  Coding DNA Sequence Number=SeqID_40447
  Gene Ontology: Mol. function=RNA-directed DNA polymerase activity; Cellular component=chromatin; Biological process=chromatin assembly or disassembly
MDPFGGEDDKRGLAPVERGTTEMASAMNSETRGVCGMNPTNLTLASRTKFDQDLISDFELDISASHLVNHSSTAATFESPMRQRGIEGGFLPKVISYGAKVLFDYVIHHLSLAICLRVVGSAHLERGAIEFEQFLPKFADEEEIAIRDEASGHAAKMNSFGKAVHHDQHCCVALGRRKAYDEGAEEAWAPTMVDLSLLAHEAGGNEQVDILFHRGPDEMFTNMCQGLSNTYVAPCRSVVEFIEDRGYGLEIPRGRLVFGGEGPRMKGSLGPTREGVCRCIGLFGTILDGIIVAEKSSQESLLLQSFKQNGLLKKAIGWFFWDRTTPIPTLEASVSTQNGMEKSGKLRTEAWHRACLRSGDRGIALYESPVESGQPEEAAKSPSGGGNRPILNSFEFCRHKCHALARHDMAENLLIALHKVELGEPAGTAELVEELADIDRGRVRFKKDCVVGCNVGEQGRDVWVNGGWGNGCKEELYVEEGTSGIGLDQSSKLWRRDCLQVLSRITFELNDRTTMDELHGVALNLDGGVRAHMVAFELVIDPNKDTQGWGGFSGQVQVPEEPRLHKIVCAPTVNEDDNGMLFFICNEKIEARGTSVPMGVLLVAVEAETMLLPVSHFGGCQLLQGGGVDQQVFPHGGEPIPRPVPGFKLMQVIANRAPLCEFEEDSCWVLVWGVGEARLNGLQKRHPRRELVVAGHPLEPRKSGAFHSEGGDGKALWFQRRVIGKKLGGFEHPPRGEEDGEAEGLDACSRLATCRRSSSILSATFSWLEASFAMASSRRSKVDLERESSIREEE

SEQ ID NO: 157226 - protein, 69 aa, Glycine max
  Coding DNA Sequence Number=SeqID_40448
MDKRGISTEESRPLTPPGVGPSGVRPPQGHGDGDCSMAAQRNLIKGTTIVHAILLSSQGAHVDGQGDPH

SEQ ID NO: 157227 - protein, 100 aa, Glycine max
  Coding DNA Sequence Number=SeqID_40449
  Homolog annotation: Hit_ID=Q9LW42; Match level="QueryCoverage=95%, HitCoverage=7%, E-value=6e-21, Identity=39%"; Hit description =Helicase-like protein
MLMDLTKNHMLGKVIAYEIDQIISAEIPSQQDDPELYSLVKKHMVHGPCGSLNPGSLCMKKGKCSRFYPKMFQPHTLLDADGFPVYRRRNNGGLLKAFFF

SEQ ID NO: 157228 - protein, 173 aa, Glycine max
  Coding DNA Sequence Number=SeqID_40450
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=75%, HitCoverage=15%, E-value=2e-33, Identity=51%"; Hit description =Kinesin heavy chain, putative; 55116-47986
MVWLLKLMCTVTPASGSSEETHNTLKFVHWSKHVEIKASQNKELQQLKRGMVENPNMATSSQEDMITLKLQLEVGQSKLKSRLQEEEQAKTTLMGRIQRLTKLILVSTKNAMSSSIVERPNHRRMHSFGEDGVGFSEGYTSNWGYNTQKEREEADAIPIIHVLELSDFSKKLK

SEQ ID NO: 157229 - protein, 137 aa, Glycine max
  Coding DNA Sequence Number=SeqID_40451
MDPNEGNKIGGMNSEQKGQNTKNYISYGKTIISKLTKLAKRGKKKITSEPVVEDASDQTTESISENASNSQKHTIHVIDDSSNPSNHHVEAAAKYFSPPSSPHRGTYQYDVEEGLGEDFLKATYYFDDYNTQGCSIM

SEQ ID NO: 157230 - protein, 118 aa, Glycine max
  Coding DNA Sequence Number=SeqID_40452
MPKIPILITNRRCTCIVQEDTMKLGGYSSLKKKRYKNIIFVCDIASNNNIKPISTTFKTIQSFIQKSNNDNNERVATQCTKNKYDKANNKGLGATNKKNHKRRTNTREGRRRSTNGVK

SEQ ID NO: 157231 - protein, 209 aa, Glycine max
  Coding DNA Sequence Number=SeqID_40453
MHCELPHANKLKLGLVKNKFPKPWKEKRINPDEQRVGLEGIARDMEEVVCILLGSSWMRKFSLYIRGEVINEGQVIGYLDQFGTGLPIKVICLSIILVPFIHDVVYMSLVYLPCWLFIQQFQLFGVISFGKGKHDKLLTESSRKIDAIRNRLTVLDMKLDSKPSYVETFAIGLASGATLKGIGAIAPHIIASLFQIWNSVSTATKSSPQ

SEQ ID NO: 157232 - protein, 48 aa, Glycine max
  Coding DNA Sequence Number=SeqID_40454
MLKKGAQLRDGETPNVVPSHANVMTRSPDKIKSIDGSKETLKTQCEDQ

SEQ ID NO: 157233 - protein, 65 aa, Glycine max
  Coding DNA Sequence Number=SeqID_40455
MKSMIECTGYMIGIIPGEMKSFDNSARYRVPSFVLCSQTIQRSWYLSDQLLPPMAPITKKGFTCS

SEQ ID NO: 157234 - protein, 184 aa, Glycine max
  Coding DNA Sequence Number=SeqID_40456
  Gene Ontology: Mol. function=sequence-specific DNA binding; Cellular component=nucleus; Biological process=regulation of transcription, DNA-dependent
  Homolog annotation: Hit_ID=Q93WY4; Match level="QueryCoverage=98%, HitCoverage=74%, E-value=7e-28, Identity=43%"; Hit description =Probable WRKY transcription factor 12
  Pfam annotation: Domain name=WRKY; Domain location=163-184; Score= -6.8; E_value=0.0049; Accession=PF03106.6; Description=WRKY DNA -binding domain
MEGERGVSPNFELQVSFTNTPQAIHEMGFVQFEENQVLSFLAPSAQSQSCQLSQSLNAGSSGSNTAVAATTTFTVTATTSGSGATIGFSHNDLVSRTSWNNNEQVRTLDPKAVNDENCTGNTSDGGNNTWWRSAGSEKNKMKVRRKLREPRFCFQTRSDVDVLDDGYKWRKYGQKVVKNSLHPR

SEQ ID NO: 157235 - protein, 105 aa, Glycine max
  Coding DNA Sequence Number=SeqID_40457
  Gene Ontology: Mol. function=transferase activity; Cellular component= mitochondrial inner membrane; Biological process=protein kinase C activation
  Homolog annotation: Hit_ID=Q9FFN1; Match level="QueryCoverage=88%, HitCoverage=10%, E-value=4e-26, Identity=58%"; Hit description =Selenium-binding protein-like
MSKQFSLFNSMRTVYQIEPTSKHYASFISVLGYWGLLQEALETINNMPFQPSALVWRALLDGCRLHKNALIGKWAAQNILSLEPKDPSTFILVSNLYSASRMGPL

SEQ ID NO: 157236 - protein, 135 aa, Glycine max
  Coding DNA Sequence Number=SeqID_40458
  Subcellular localization annotation: CTP_CleavageSite=36; ConfidenceScore=5.54e-01
MVTTSRDYITKGNKAVTSSQTRKRTITSSNNISLTYLSKVGGRSCLSLSTVGLPQLTNDEINPTDGTIPTLDRKPCESLAGKVEVVRRNEEAVEQNQAGVRFKEKPRGTEVSARKGKRCFNQQVLTLGLEATTKV

SEQ ID NO: 157237 - protein, 73 aa, Glycine max
  Coding DNA Sequence Number=SeqID_40459
METHSTMLDTTTIKSCCRMHKRTQVTYARVKQAHIVITFVLGPTCLQIKWDEVEVSTRVMPIICTSADYKYIM

SEQ ID NO: 157238 - protein, 227 aa, Glycine max
  Coding DNA Sequence Number=SeqID_40460
  Gene Ontology: Mol. function=long-chain-fatty-acid-CoA ligase activity; Cellular component=integral to membrane; Biological process=metabolic process
  Homolog annotation: Hit_ID=Q96537; Match level="QueryCoverage=97%, HitCoverage=33%, E-value=7e-96, Identity=73%"; Hit description=Acyl CoA synthetase
MTRTIGVPMTTIEARLESVPEMGYDALSNVPRGEICLRGNTLFFGYHKREDLTKEVMVDGWFHTGDIGEWQSNRAMKIIDRKKNLFKLSQGEYIAVENIENKYLQCPLIASIWVYGNNFESFLVAVVVPERKAIEDWAKEHNLTDDFKSLCNNLKARKHILDELNNTGQKHQLRGFELLKAIHLEPNPFDIEKDLITPTFKLKRPQLLKYYKDHIDQLYKEAKGEMV

SEQ ID NO: 157239 - protein, 136 aa, Glycine max
  Coding DNA Sequence Number=SeqID_40461
  Gene Ontology: Mol. function=catalytic activity; Biological process =trehalose biosynthetic process
  Homolog annotation: Hit_ID=O65664; Match level="QueryCoverage=74%, HitCoverage=47%, E-value=4e-35, Identity=61%"; Hit description =Puative protein
  Pfam annotation: Domain name=Trehalose_PPase; Domain location=1-135; Score=-19.2; E_value=7.8e-06; Accession=PF02358.7; Description =Trehalose-phosphatase
MMLSRVVIIENNGRSVCSESKVEQVYNFVRLTELYYVGSHGMDIKGPTTTSKYNKDSKAEPILCQPASDFLPLIDEVYQQLVEKTKSTPGALVENNKFYLSVHFCCVDEKVLEIRPTIKWDKGKALEFLLESLGEF

SEQ ID NO: 157240 - protein, 116 aa, Glycine max
  Coding DNA Sequence Number=SeqID_40462
MKTTELIENLKVHEQKLQQDKGLKKDKSPVLKECPILEKSQDNKRQFKSNDKKGLMSTWKDLDLSNKDKEKEAKICLMVGTTSEESELEQKDEVDLDDPESLKQAYHELFSNSSIL

SEQ ID NO: 157241 - protein, 423 aa, Glycine max
  Coding DNA Sequence Number=SeqID_40463
MASRKRKVPASASQACYDRSRFTSQEAWDRYSDIVIGRKILPERNVMIYHTEFDEFKAELERRNWHKELTNFVDESIDVAIVKEFYTNLYDPEDKSPKQMRVRSHLIKFDEDALNTFLKTHVIIEEGGNLPAYSRFSRLRPDPQELAARLCIPGRGFELNVDGLPLKILRKNLTTLAQTWSVLSFSNLTPTSHTYDITLDRASLNPAINLAYVKKSCWNLDGLSVTFQGPQKTKGKRSEAPPSSALPTLAPFTSTAALFAPASSTPLPVPSPISTRPSFFNFDTLFAMLQSLHKGQIIIMQFLHSSGLQPIMSIDEFISQVAWPGVQPSPSGGGEASAAQEPVPEEDEHIPPESFVYETDPASAQEEVASPEPLPQSSPATVLDDIPEPSAPALVPDQSISQDPLSALVLDLNEHAEDHLLDD

SEQ ID NO: 157242 - protein, 91 aa, Glycine max
  Coding DNA Sequence Number=SeqID_40464
  Gene Ontology: Mol. function=protein domain specific binding; Cellular component=nucleus; Biological process=intracellular signaling cascade
  Homolog annotation: Hit_ID=Q96299; Match level="QueryCoverage=73%, HitCoverage=25%, E-value=2e-26, Identity=82%"; Hit description=14-3 -3-like protein GF14 mu
MSTSWKGDYYCYLAEYKSGNEKKEAVDQSMKAYESATIAAEADLPPTHPIRLGLALNFSVFYYEILNSPESGCSQTTKDPSKKKGKDNITM

SEQ ID NO: 157243 - protein, 73 aa, Glycine max
  Coding DNA Sequence Number=SeqID_40465
  Homolog annotation: Hit_ID=Q1SAV4; Match level="QueryCoverage=97%, HitCoverage=18%, E-value=6e-08, Identity=45%"; Hit description =Integrase, catalytic region
MAYHLQLPDSSKINLVFHVSMLKLHQGPPPSTSEDPMLSLLTENLPFIEPLTILDWQWDTLSSPPSKKVLVQC

SEQ ID NO: 157244 - protein, 78 aa, Glycine max
  Coding DNA Sequence Number=SeqID_40466
DSHQKILPRRIGMLYAFGTTLTARLSFQGRVLIVTRPKGVTDSKEHRGNQLTSRLTHDPSQGTTRIRIGIANSVIAVG

SEQ ID NO: 157245 - protein, 111 aa, Glycine max
  Coding DNA Sequence Number=SeqID_40467
  Gene Ontology: Mol. function=metal ion binding; Biological process =metal ion transport
  Homolog annotation: Hit_ID=Q1SWG9; Match level="QueryCoverage=99%, HitCoverage=100%, E-value=2e-25, Identity=49%"; Hit description =Heavy metal transport/detoxification protein
  Pfam annotation: Domain name=HMA; Domain location=4-71; Score=36.0; E_ value=1.3e-07; Accession=PF00403.16; Description=Heavy-metal -associated domain
MKKVVLKVELHDDRVKQKAMTTASALSGVKSISVDLKDSQMILSGDTDPVSVVSKLRKCCHTEIVSVEPAKEEKETKKVEPAKLSLPLHQAYPLIYYVTSYKENPSDCVIC

SEQ ID NO: 157246 - protein, 113 aa, Glycine max
  Coding DNA Sequence Number=SeqID_40468
MHIPPILFVKNQCIPWLVKYLWLLSDELLGSDIPTDEERAESINRRISNLIVAEIFTIPCAHTCVSLLPHLITEALRYNLFHQSLREALWHVSSVREWEDEVMATNAELKHVR

SEQ ID NO: 157247 - protein, 53 aa, Glycine max
  Coding DNA Sequence Number=SeqID_40469
MLLLSHRAPPSSHGSLSEPDWLSEAHPLSEEACPLSENKTLENVEPESSTLST

SEQ ID NO: 157248 - protein, 207 aa, Glycine max
  Coding DNA Sequence Number=SeqID_40470
  Homolog annotation: Hit_ID=Q1SWG8; Match level="QueryCoverage=32%, HitCoverage=61%, E-value=1e-18, Identity=64%"; Hit description=Heavy metal transport/detoxification protein
  Pfam annotation: Domain name=HMA; Domain location=128-195; Score =32.9; E_value=1.1e-06; Accession=PF00403.16; Description=Heavy-metal- associated domain
MAAEWRRKRERRCHFKEKMSLEEAHHHRRPWIRAWRKKEMNEGRGREEHEILCSKRALKSEKSIMRFMKILGPSFATLAQSSWTLLLMALVTAHLGHVHPDVGQLRILLSTIGRIELYTILVPLGHKVVLKVDLHGDRIKQKAMKTASGLSGVESVYVDIKDMKMIVLGDIDPVSAVSKLRKCCHTELVSVGPAKEDKEKEKDKPAK

SEQ ID NO: 157249 - protein, 84 aa, Glycine max
  Coding DNA Sequence Number=SeqID_40471
MGSRSCDCRIAVPVSHQVLALFLNSAILWHRLMGKKVLAVSNDVHIKDFYLQLGNVSYPNFVRGPLLDNMQLLFGPCEVLGTHH

SEQ ID NO: 157250 - protein, 114 aa, Glycine max
  Coding DNA Sequence Number=SeqID_40472
  Subcellular localization annotation: CTP_CleavageSite=40; ConfidenceScore=5.70e-01
MSKATLLASTPQSPTLTPSLSVAALPLSCSWTPPPSATPTASSAFERLCIWDFKYVRFFGSTQGSTEVHNVKWFMATEATRSMRVTRRPRDSGMAEGMGKRENVVVSWLGFVSV

SEQ ID NO: 157251 - protein, 87 aa, Glycine max
  Coding DNA Sequence Number=SeqID_40473
MEMEASSLGCRRMQWRWERESEWHWSFCLHDRHLGYRKIRDIPRFGFLYHSNKERENFDTKSETLLFLNQVVVELDSFKLSATLLPL

SEQ ID NO: 157252 - protein, 244 aa, Glycine max
  Coding DNA Sequence Number=SeqID_40474
  Gene Ontology: Mol. function=zinc ion binding; Cellular component =integral to membrane
  Homolog annotation: Hit_ID=Q10Q37; Match level="QueryCoverage=55%, HitCoverage=53%, E-value=1e-58, Identity=76%"; Hit description=RING zinc finger protein, putative, expressed
  Pfam annotation: Domain name=zf-C3HC4; Domain location=45-99; Score =6.5; E_value=0.033; Accession=PF00097.15; Description=Zinc finger, C3HC4 type (RING finger)
MWNFASSLIAGSVGLKNDSPKPTHSASEFSDDETSMVSREERLECPICWESFNIVENVPYVLWCGHTLCKNCILGLQWAVVNFPTLPIRLPLFISCPWCNLLSLRLVYQGNLKFPHKNYFLLWMVESMNGDRVKSHSTVCGDHQPVWPIIDSLTNGSQVSHDSLQGGQVCHPESSSSNHYHGDTTLVELGWVGGGISVFGIIYFEDHQGRGVNKSYFPGHMCKHCTLYLILVIFSWLATGKGIV

SEQ ID NO: 157253 - protein, 54 aa, Glycine max
  Coding DNA Sequence Number=SeqID_40475
MMTKGKVKKEQSSNLESASRLASSEPHLSDDGGHRHDRRSLDSETCRRGNRRIK

SEQ ID NO: 157254 - protein, 190 aa, Glycine max
  Coding DNA Sequence Number=SeqID_40476
MSITSSTTTRRDYIQILVFYHEQWAPHYPDFAHFSYDRAIYEGSTSPPTINFLACEQKWIFDLHFTPPLDQQSCGRPLLTSRMHVGTLELTQGLLGTPDPLRLPHIAAIHLPSCGFHMTVLRRLDPPLQWTVVTLDVGVGDKYVVQPWYQFLANGDFNHGDELSFYYRPHNKIWEIVIRRKRNWGDNNSD

SEQ ID NO: 157255 - protein, 110 aa, Glycine max
  Coding DNA Sequence Number=SeqID_40477
  Gene Ontology: Mol. function=nucleic acid binding
MDKWCLQFQTKFREDPAVNEGWEVLLLRVLQAQLKKLKVVMFESFLVHFILNTLPTEYGPFKISYKDKWSINELIAMCFQEEERLVMEMGESTLLTTACGKNKATKSQAN

SEQ ID NO: 157256 - protein, 97 aa, Glycine max
  Coding DNA Sequence Number=SeqID_40478
MDIDYAIRKDESSAITDESSPAAVALYERCEQSNRLNVMFIKTKIPTRIRNSIDQHEKVQDLLKAIDDQFITSYKALASTLIMKFSSLRLTSVKRVC

SEQ ID NO: 157257 - protein, 152 aa, Glycine max
  Coding DNA Sequence Number=SeqID_40479
MPPEPKVGPSAARVNTKESCVDPSGNDPDTVDSDKCGLHIEENPPRLDFNSKRDVYLGAYLNGAHWQMVVIFPKENLVVWFCSLHNRPDNYLKGIINSASKGLDNTPQPKSKVGARWIVVKYFNDARSLEPERLKTFRIQWAKYYLKVRNET

SEQ ID NO: 157258 - protein, 65 aa, Glycine max
  Coding DNA Sequence Number=SeqID_40480
MVSVFIDSKEGPKVAKTCTYNNPVMGEHEVKIYYWCSWRTVEVGTRKVGTLLSGKKWDCEVGQDL

SEQ ID NO: 157259 - protein, 386 aa, Glycine max
  Coding DNA Sequence Number=SeqID_40481
  Gene Ontology: Mol. function=RNA binding
  Homolog annotation: Hit_ID=Q1RWD7; Match level="QueryCoverage=98%, HitCoverage=77%, E-value=7e-78, Identity=46%"; Hit description =Cyclin-like F-box; Agenet
  Pfam annotation: Domain name=F-box; Domain location=30-77; Score =35.6; E_value=1.7e-07; Accession=PF00646.23; Description=F-box domain
MAFWKEQLRADHQWINHSWVPPIKDHNNRDRISELPDSILLHILNFMNTESAVQTCVLSKRWKDLCKRLISLAYCPDPYLLKKRGVGRFMKFATWVLSRRDDAYSLLNLTLHLCWTEPELLDKVTKYALLHDVRQLTMELYSGFRPDLESLPLIFCCHSLTSLKLCINGMNYPLIILPKSLHLPALKSLHLQGFNFTATGNDSAEPFSNCYVLNTLVLRFCSLHNDARVLCISNSTLSILTILEGQTYQIVLSTPNLSSFTIRGSSSLQLFSTCNLSFLGEVNIDVSWDGHWAEKSSIISSNIVRWLVVLAYVKKLSFSRYAFQIILHDFSNPISMRPEPPSFVRLESLKVIKLLSANVSDEKVNTVVEYLLRDSPMARVEILGEY

SEQ ID NO: 157260 - protein, 107 aa, Glycine max
  Coding DNA Sequence Number=SeqID_40482
MELGSEVGQESSQWEQENEYFSQEQIDSLPDVIDEEVTSIITMEDVIYGENFYSLAGWGDILDETDEYVHVQKKRGDYATKIPCDLVTSNIFRDSFLRQDMAILKGS

SEQ ID NO: 157261 - protein, 205 aa, Glycine max
  Coding DNA Sequence Number=SeqID_40483
  Homolog annotation: Hit_ID=Q67YQ9; Match level="QueryCoverage=80%, HitCoverage=46%, E-value=2e-57, Identity=66%"; Hit description=MRNA, complete cds, clone: RAFL24-13-K22
MVSEGAPTEAFDPSPSLAIGEYDLLIVGPGILGRLVAHNWRQEYPGCKVFGQTATTNHHQELTEIGINPSLKWTKASSFKFPYVICCAPPYQSPDYLGDLRLAASCWNGEGALLFTSSSAPYDCNDNGLCHEDNPVVPMGRSPRTDVLLKAEKIVLEFGGSVLRLSGLYISSSEFSLLGFQLFIHLGGYFYYHICQFMSIVCFQP

SEQ ID NO: 157262 - protein, 102 aa, Glycine max
  Coding DNA Sequence Number=SeqID_40484
  Homolog annotation: Hit_ID=Q9LTD8; Match level="QueryCoverage=92%, HitCoverage=18%, E-value=1e-14, Identity=41%"; Hit description =Arabidopsis thaliana genomic DNA, chromosome 5, BAC clone:F6N7
MKEDEFLCCQLGFWVFLIICLVLVSLAGIASGLALGLLSFSQVDLEVLIKAGRPKDTKHAERIQPFVKNGHFVLCTLLLGKSLAMEMSSHLLENLYKRTSTK

SEQ ID NO: 157263 - protein, 427 aa, Glycine max
  Coding DNA Sequence Number=SeqID_40485
  Gene Ontology: Mol. function=transcriptional repressor activity; Biological process=regulation of nitrogen utilization
  Homolog annotation: Hit_ID=Q10LH0; Match level="QueryCoverage=78%, HitCoverage=82%, E-value=1e-128, Identity=67%"; Hit description =Isoflavone reductase, putative, expressed
  Pfam annotation: Domain name=3Beta_HSD; Domain location=82-307; Score= -135.3; E_value=0.0054; Accession=PF01073.9; Description=3-beta hydroxysteroid dehydrogenaseisomerase family
  Pfam annotation: Domain name=Epimerase; Domain location=81-298; Score= -15.3; E_value=3.4e-05; Accession=PF01370.11; Description=NAD dependent epimerasedehydratase family
  Pfam annotation: Domain name=NAD_binding_4; Domain location=83-285; Score=-86.0; E_value=0.0046; Accession=PF07993.2; Description=Male sterility protein
  Pfam annotation: Domain name=NmrA; Domain location=81-325; Score= -16.3; E_value=3.5e-07; Accession=PF05368.3; Description=NmrA-like family
  Pfam annotation: Domain name=adh_short; Domain location=79-216; Score= -57.7; E_value=0.035; Accession=PF00106.15; Description=short chain dehydrogenase
  Pfam module annotation: Pfam domain module=3Beta_HSD::Epimerase::NAD _binding_4::NmrA::adh_short; Domain location=82-307::81-298::83 -285::81-325::79-216
  Subcellular localization annotation: CTP_CleavageSite=72; ConfidenceScore=5.22e-01
MSLCYTSNFISLNHKKSLSLTFSSESSPHFINLFPVKPKKPHHPIKFTAERFKLFASLTPSPPVETTPSSYRCKSPKDVNVLVVGSTGYIGKFVVRELVKRGFDVTAIARERSGIKGSVDKDQTLNQLRGANVCFSDVTNLDAFEESLNSLGKSFDVVVSCLASRNGGVKDSWKIDYEATRNSLVAGRKRGASHFVLLSAICVQKPLLEFQRAKLKFEAELMKLAEEDDGFTYSIVRPTAFFKSLGGQVELVKDGKPYVMFGDGKLCACKPMSESDLASFIVNCVLSEDKINQVLPIGGPGKALTPLEQGEMLFRLLGKEPKFLKVPIEIMDFAIGVLDFLVKVFPSLEDAAEFGKIGRYYAAESMLLLDPETGEYSAEKTPSYGNDTLEEFFARVLREGMAGQELARVIVMFTSSGTVERNSNLWK

SEQ ID NO: 157264 - protein, 148 aa, Glycine max
  Coding DNA Sequence Number=SeqID_40486
  Homolog annotation: Hit_ID=Q6YT98; Match level="QueryCoverage=77%, HitCoverage=55%, E-value=6e-18, Identity=36%"; Hit description =Integral membrane protein-like
  Pfam annotation: Domain name=DUF588; Domain location=7-130; Score =51.1; E_value=3.7e-12; Accession=PF04535.3; Description=Domain of unknown function (DUF588)
MAPLTASQVQGKYPCWQRTEQFFFSFCGIFLRYFVAAFSVSGLYALVSALASISVIQKPGFKLKFLLHFIFWDALILGITASATGAAGSVAYIGLKGNSHVGWIKVCNIYDKFCRHLAGSIAVALFGSIVTVLLIWLSAFTIHSRVPK

SEQ ID NO: 157265 - protein, 246 aa, Glycine max
  Coding DNA Sequence Number=SeqID_40487
MGNCLLGGISDPELVIKVTTSNGGIMEFYAPITVSFITSEFPGHGIFPSHDLFCKPLSQFDELVAGQSYYLLPLNNKPEHPSASGHIGGDNSAIRQGHVRSHSVPTTPYPPPYRMSLDYQHHQGMKFLNKTSIEPFSCRTSTSKSSIITSSSSSKSSKITSSSKSSRFWKVKLVITPQQLMEILSQEARTKELIESVRIVAKCGVAAGGILPASAAPSILSDQWSLSSSGRSACDSSKVDALVVDI

SEQ ID NO: 157266 - protein, 118 aa, Glycine max
  Coding DNA Sequence Number=SeqID_40488
  Gene Ontology: Cellular component=integral to membrane
  Homolog annotation: Hit_ID=Q9LTD8; Match level="QueryCoverage=91%, HitCoverage=21%, E-value=1e-21, Identity=42%"; Hit description =Arabidopsis thaliana genomic DNA, chromosome 5, BAC clone:F6N7
MSSYFEERAPCCGTHFWILLSMCSAFVLFAAITSGLSLGLLSFSQVDLEVLVKAGQPKIQKNAAKIMSIVKNEHLLLCTLLIAKSMALEGVSVFLEKMFPEWLSVLIAATILGLTAEV

SEQ ID NO: 157267 - protein, 159 aa, Glycine max
  Coding DNA Sequence Number=SeqID_40489
  Subcellular localization annotation: CTP_CleavageSite=43; ConfidenceScore=5.14e-01
MEGSEADRTALLVHPANFKNGKNALQLFYEPSSVDTRGRNVPRASTEEPSSVNCGRRFFRGTTRKNFFRQSQRRRFFRGLPRKKSRTSSSLHFSNSGHAIGVGLIAFSVEMMNKAKGKCKEVAEKGSAGKRKGAFDDDKIGGVQKRNKRGVLQLFLTTN

SEQ ID NO: 157268 - protein, 430 aa, Glycine max
  Coding DNA Sequence Number=SeqID_40490
  Homolog annotation: Hit_ID=Q10SE0; Match level="QueryCoverage=58%, HitCoverage=50%, E-value=2e-66, Identity=51%"; Hit description=CBS domain-containing protein, putative, expressed
  Pfam annotation: Domain name=CBS; Domain location=59-170; Score=15.5; E_value=0.0026; Accession=PF00571.18; Description=CBS domain
LLDWLFGKGHTALLGRAELKTLVHLHAIEAGKGGELSLHETRIIAGALDLTQKTAKDAMTPISETFSLDINSKLDMHTMGLIMSIGHSRIPVYSGKQTNIVGIILVKNLIFCHHEDEMPIKFMTIRRVPRVGEDWPLYDILNQFKKGQSHMAVVLKCGGNIRTAATGHCPSFEPGDHFRISTDASNWHSQETEYYSATLKSVMHREGDSDLLQRRSEQPDASSSFENLESLSTEVEEVIGIITLEDVMEELLQYQNQTRTCKKSVIRVLQKGFKYSSTTEKFRCISIFIHQLSFFFAAEVQHMVIIVIIRMNIMDCQSVCFLRIVNPYELYRLSIRMNHMTYQSIVNSYELYGLSISIIHTDCQFPNAQKPQHYKEKSTHGDDDGDNDSDGKNRRRNHQQVKTNKGLKEGDRDARRESENRSSVGGGRWV

SEQ ID NO: 157269 - protein, 591 aa, Glycine max
  Coding DNA Sequence Number=SeqID_40491
  Gene Ontology: Mol. function=DNA primase activity; Biological process= DNA replication
  Homolog annotation: Hit_ID=Q9FLY1; Match level="QueryCoverage=97%, HitCoverage=98%, E-value=4e-64, Identity=43%"; Hit description =Arabidopsis thaliana genomic DNA, chromosome 5, P1 clone:MXC20
  Subcellular localization annotation: CTP_CleavageSite=50; ConfidenceScore=5.69e-01
MSSSTTSSSSSNNNMSDVDRLFASFKCGLTPPKSATRERKRSKRRLEQVSSNHETPSESPGPRSPEEELRTPLSRIRKTNIESSIEKLKSAVTRAQSIGCGKQFSPIVFYGSPCGIPPKKPTRMLWRMLREICPNVSQQNILSIRKEVWMTFPRQDEAMKFAKGQEDVHVFSYQDHFNGQRRYNNMNPKFRHHYEVIQAGLPCHLYFDLEFNKKVNTGKNGEEMVDLLISVVLEAFHEKYAIQGDHDWVVELDSSNEGISVDLFKIRRQLSLALFVDQNIGTTEMEIVCPVLFTPKCLGPSILIDGGGFNPKTLCQGDNERHQCYQIVAIVALPHYSIVGFRDNAIMMASRSGLRENRNRVRLTRRGTSLHRDFCVTLVSNKRKPGHVQIADSGQGEEDIFMASLICNMDVDCKTYLVCKTDLDCVKTLHFDTEENSNVSNSTQIPPEFTLGTSTSDVSTTYFMGKSPFPFLDKFILSVASVGNIPVIYVVDLRMAVYYQKCHDPDCRGYRSPSRQIPVHVFSNPSDVIGSFGLLDDEQPVDDKLRHQLDDNKEQNLLQFKDTVEDNSNDSWWLEAIRVVEDMENKQTKTE

SEQ ID NO: 157270 - protein, 57 aa, Glycine max
  Coding DNA Sequence Number=SeqID_40492
MVFFPPTKLVTRKAFVLEHDCAEDEVIDEDEEWWQAVESTASQVELTCSSQQELCAI

SEQ ID NO: 157271 - protein, 91 aa, Glycine max
  Coding DNA Sequence Number=SeqID_40493
MKVLPPEALKYVFNKNKYKRYMKVERSSRRRCLWKINVQNGVPTLADPWYQYLADNDLMSGDEVVFYYAFKKHGWDILYRKQLIWDDDESD

SEQ ID NO: 157272 - protein, 326 aa, Glycine max
  Coding DNA Sequence Number=SeqID_40494
  Homolog annotation: Hit_ID=Q2R2Z9; Match level="QueryCoverage=77%, HitCoverage=45%, E-value=2e-52, Identity=42%"; Hit description =Expressed protein
MEQVIVGINSMEMISEMDLSGPSEIDFGIEEIDEEDTEDLDDSDEDEDEDENEDYDSEWVAVFSDDEQDDDETLADWAKLESMQSSHPMYFAKKLAEIASDDPVDWMEQPPACVAIQGVIRPAFVEEHSTIQKHLSANQSSDTDKSRSIESKGENIGVINGHVLNSGSSGDNAAQQVENNENSVIPSCETSFYKLEMIKIQVFSAQGQPTALELEDYMNAQPDIIAHSASKIISRLKADGEKTLEALKSLCWRCKGIQVEEAQLICLDSLGFDVRVCSGTQIQTLRFTFKKRATSEYSAERQLNDILFPRIHPKQQKMKQTHQNEC

SEQ ID NO: 157273 - protein, 119 aa, Glycine max
  Coding DNA Sequence Number=SeqID_40495
MMIFGDQEQFFVLGNCRRKSHVKRIPGLEVMHQGGYENTNLTIQFKGDPRRSFPKKKHFCSMSSCLFLVKLLQFKECLAKPDGIKTNRSQLVDSKKLCVIEGLGLGGADGRRRNRQTNV

SEQ ID NO: 157274 - protein, 82 aa, Glycine max
  Coding DNA Sequence Number=SeqID_40496
MGACLESMVRSKINTGTPFTRRDKLVKNRIRASSEHLGSAQDPVKKNEKPSYHPFEEVSVSSSENSEDATLTTAETSRTIIE

SEQ ID NO: 157275 - protein, 245 aa, Glycine max
  Coding DNA Sequence Number=SeqID_40497
  Homolog annotation: Hit_ID=Q6ZFC1; Match level="QueryCoverage=88%, HitCoverage=84%, E-value=9e-37, Identity=40%"; Hit description =Pentatricopeptide (PPR) repeat-containing protein-like protein
  Pfam annotation: Domain name=PPR; Domain location=124-158; Score=5.0; E_value=1.9; Accession=PF01535.11; Description=PPR repeat
  Pfam annotation: Domain name=PPR; Domain location=160-194; Score =22.3; E_value=0.0018; Accession=PF01535.11; Description=PPR repeat
  Pfam module annotation: Pfam domain module=PPR::PPR; Domain location =124-158::160-194
MLALTDSPLLIAKTFEATKIPTSTRGTVVCAAKGPRPRYPRVWKTHKKIGTISKAAKLVKSIKELSNVKEEVYGALDSYVAWELEFPLITVKKALKTLEFEQDWKRVIQITKWMLSKGQGKTMGSYFTLLNALVEDDRLDEAEELWTKLLMQYMESLPRRFFDKMISIYHKRGMHEKMFEIFADMEELCLRPNIVVVSMIGDAFKERGMLDKYLKLHAKYPPPQWEYRYIRGKRVKVKVEVQSSQ

SEQ ID NO: 157276 - protein, 91 aa, Glycine max
  Coding DNA Sequence Number=SeqID_40498
MEPERISDINNNYRSEETSDMIDDQQLGQEADVISMELEQISDDSYDSIEPILDLLLIIVGIIISMPISNKLLGDKSEDTRNRTRTKRTCF

SEQ ID NO: 157277 - protein, 161 aa, Glycine max
  Coding DNA Sequence Number=SeqID_40499
MEASKLSSSDQNVRCHHCAGPLSKDMETSHWTVSPLIRDSFSMIGSAVGGVASAFYGFNLVMPIVQRRIKGPMWLHFLIGFMVFPHIEYSGDSKPFHCYTDINLSAIQAPPVIVFSSACAGLAGGAVPAAAQLVSSSYHAAYSSPTSPPPSKDENIQRSRK

SEQ ID NO: 157278 - protein, 137 aa, Glycine max
  Coding DNA Sequence Number=SeqID_40500
MTFLMVLVSYVKKLNIPSGVVGACRLDLAYEHFKEKPHLFQFVPNEKQVKAANKLLKTISEHGEKKKVDGVPVFSAQNLDIAIATTDGIKWYTPYFFDKNMLDNILEEAVDQHFHTLIQTRHMHRRRDVVDDNLAAE

SEQ ID NO: 157279 - protein, 325 aa, Glycine max
  Coding DNA Sequence Number=SeqID_40501
GWTTELEVQELLDEMGHPSIPLSVISKAAELQFQYTVDKVFLGNRPLKLKISTCGIFTPVLSSVAPHPNRFLCHPQSMTLLSLLERSLSSRRWPSNELGCYMGYPTNLDNLYWLTKCTRDHGKNRKQGSLNILSSSETGCLELQSTFKVGCLELSEASLLRATESSSSLENSKVEDDRKNAECIDSSKCSLDGNTEAIKQSSPRLSLPFGNWFHHLWPKQCRKKVGSSRKGVNKEEMKPAPFLPKITMVGLSTEEAGQMSKANLKKTMDDLTRELEKTELDIMTDGGSKECKVEDRDPLFVANVGDYYSSLGKPGSGRWIRGGSN

SEQ ID NO: 157280 - protein, 348 aa, Glycine max
  Coding DNA Sequence Number=SeqID_40502
  Gene Ontology: Mol. function=structural constituent of ribosome; Cellular component=ribonucleoprotein complex; Biological process =translation
  Homolog annotation: Hit_ID=Q6ZJ04; Match level="QueryCoverage=55%, HitCoverage=92%, E-value=8e-84, Identity=80%"; Hit description =Putative 60S ribosomal protein L10A
  Pfam annotation: Domain name=Ribosomal_L1; Domain location=163-348; Score=153.0; E_value=8e-43; Accession=PF00687.11; Description =Ribosomal protein L1pL10e family
  Subcellular localization annotation: CTP_CleavageSite=36; ConfidenceScore=5.51e-01
CLAQFSIATTTTSSLSMEGNNLPHNMPTWSSRKLVTSQSPASFSLEPNEKQKLKNNTQECKSPNTNDKAKDPEEGHSENIGKVDGVEEITGRERLKRLREEVTMDKVNIPENWGQEPKLKDWMDYTMFDAFFPHTLIVTARDALIANAREAKSPSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGKFPTLVTHQESLESKVNETKAMVKFQLKKVLCMGVAVGNVSMEEKQIFQNVQLSVNFLVSLLKKNWQNV

SEQ ID NO: 157281 - protein, 117 aa, Glycine max
  Coding DNA Sequence Number=SeqID_40503
MARTKGKEPLEGLGGPMARARTKKTKEALHQVLTMLYKFRPKLQVEKLQIVKLCWPEKKEATPNRKFWRDATLLQDENIVVFELIPSRRPTMPSKIILMMPKNQESNKFQKSRSGLK

SEQ ID NO: 157282 - protein, 90 aa, Glycine max
  Coding DNA Sequence Number=SeqID_40504
MLIDVENALACACCVCSWGALCNDLPGSLALAFGHVHTSYGVYVMRVECTDLVGWPRRGGGLSPGREQFWAPRLITYGKGAITCTTGWSR

SEQ ID NO: 157283 - protein, 126 aa, Glycine max
  Coding DNA Sequence Number=SeqID_40505
  Gene Ontology: Mol. function=nucleic acid binding; Biological process= RNA-dependent DNA replication
MQEMPLYTKFMKDILTKKGKYIDNESIMVGDNCSVVIQRKLPKKFKDLENKNWKSEDRLYQDDAPARRPINHKTIRGSGRCPGQSPSLYFPSGFCHHGHRKRCKDSSYPRQTLHVDYQLRGRYGEW

SEQ ID NO: 157284 - protein, 192 aa, Glycine max
  Coding DNA Sequence Number=SeqID_40506
MGTRGCINYNTVLSIRQLGYPMRGVPLEEGLTPFIAQGFNSTNVGVLRRVCKAWEMVQKKDEELWGSSNGPIGGYHKWLKAYAQGLGWLPNLRATKEVEVEAPEEGEEVQALRMKLEQAQAVKEKFKSAVARIRKENAELRDINIATTKALVQKTKRARKKEHGRNKFRGEERDQSRVDGMILKDELKDLPK

SEQ ID NO: 157285 - protein, 103 aa, Glycine max
  Coding DNA Sequence Number=SeqID_40507
IRVEQQLKRKYTSKSYGPHFYPKKDQGQGILGVAPSKPKDNKGKTLEKQPPKARAKTFIVAKMRILLHLPLVKVKNQKGKNLVKKSTPKKKGQPLMVKEECKG

SEQ ID NO: 157286 - protein, 67 aa, Glycine max
  Coding DNA Sequence Number=SeqID_40508
MEFKVQAFMGGRESMGNKIYLSGPLMVSSSNMDQMLKDHDRKIQEFSRRARIDKSRARGEKVRALRK

SEQ ID NO: 157287 - protein, 188 aa, Glycine max
  Coding DNA Sequence Number=SeqID_40509
MTVMIKVFVLQKEVKLFGRNKINFLRTSSRETKVRQATKGVLRELNKSERLCICRRHPVVAKTLQELLAEGNIDNNGNNDDVNNNDNKNTSGDFNDVTATTIVVVLVATTGAGGCSNVGGGSGGGGVVVVVPLVLVIVVVAVMEVVAKILVVAVMEVVTVSYGDGDNEEGGIGSDDDDNSGDIMVLMM

SEQ ID NO: 157288 - protein, 467 aa, Glycine max
  Coding DNA Sequence Number=SeqID_40510
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=94%, HitCoverage=66%, E-value=1e-132, Identity=52%"; Hit description =Receptor protein kinase like protein
  Pfam annotation: Domain name=Lectin_legB; Domain location=27-264; Score=329.4; E_value=6.3e-96; Accession=PF00139.10; Description =Legume lectin domain
  Pfam annotation: Domain name=Pkinase_Tyr; Domain location=354-467; Score=-162.3; E_value=0.016; Accession=PF07714.7; Description =Protein tyrosine kinase
  Pfam module annotation: Pfam domain module=Lectin_legB::Pkinase_Tyr; Domain location=27-264::354-467
  Subcellular localization annotation: CTP_CleavageSite=59; ConfidenceScore=5.06e-01
MSTSTFLISLLVFITNLTLLLLLTSVSCTEFIYNTNFNSTNTLLHGNATIESSILTLTNSSTFSVGRAFYPFKIPTKPSNSSTPLPFSASFIFSIAPFKDLLPGHGFVFILTPSAGTTGVNSAQHLGLFNYTNNGDPNNHVFGVEFDVFDNQEFNDINDNHVGVDINSLSSFASHDAGFWGGSDNDEFEDLKLNDGENYQVWIEYLDSRVNVTMAPAGQKRPQRPLISEIVDLSEVLLDEMFVGFCGATGQLVESHKILAWSFSNSNFSIGDALVTTNLPSFVLSKESILRSTGFIVGIIVGVLFVLSAAVVIFVFFLRRKRSKRKDEEIEDWELEYWPHRVSYEDIYSATKGFSDQHVIGFGGNGKVYKGLLQGVQVAVKRIPCDSEHGMREFLSEISSLGRLKHRNVVPMRDKRIFDDDENTIFGWEKRIKVLKDVAHGVLYLHEGWEVKVLHRDIKSSNVLLDK

SEQ ID NO: 157289 - protein, 141 aa, Glycine max
  Coding DNA Sequence Number=SeqID_40511
  Gene Ontology: Mol. function=oxygen transporter activity; Biological process=oxygen transport
  Homolog annotation: Hit_ID=UPI00005F7BAD; Match level="QueryCoverage =99%, HitCoverage=58%, E-value=9e-54, Identity=73%"; Hit description =COG1496: Uncharacterized conserved protein
  Pfam annotation: Domain name=DUF152; Domain location=1-141; Score =99.5; E_value=1e-26; Accession=PF02578.6; Description=Uncharacterised ACR, YfiH family COG1496
MTADCLPVLFCSQHGDEVAAAHAGWRGLCHGVLEQTVAAFSAAPSQISAWLGPAIGPQQFEVGPEVRAAFIAEDAEAAAAFTPHGDKFLANIYLLARQRLLRAGVQAIYGGDRCTVNEKSHFFSYRRDGITGRMASLIWLI

SEQ ID NO: 157290 - protein, 316 aa, Glycine max
  Coding DNA Sequence Number=SeqID_40512
  Gene Ontology: Mol. function=protein binding; Cellular component =integral to membrane; Biological process=protein amino acid phosphorylation
  Homolog annotation: Hit_ID=Q9SRL2; Match level="QueryCoverage=95%, HitCoverage=85%, E-value=2e-45, Identity=34%"; Hit description =Putative disease resistance protein
  Pfam annotation: Domain name=LRRNT_2; Domain location=3-43; Score =49.5; E_value=1.2e-11; Accession=PF08263.3; Description=Leucine rich repeat N-terminal domain
  Pfam annotation: Domain name=LRR_1; Domain location=121-143; Score =14.3; E_value=0.44; Accession=PF00560.23; Description=Leucine Rich Repeat
  Pfam annotation: Domain name=LRR_1; Domain location=145-167; Score =0.6; E_value=2.2e+02; Accession=PF00560.23; Description=Leucine Rich Repeat
  Pfam annotation: Domain name=LRR_1; Domain location=169-194; Score =8.6; E_value=7.1; Accession=PF00560.23; Description=Leucine Rich Repeat
  Pfam annotation: Domain name=LRR_1; Domain location=196-218; Score =14.9; E_value=0.29; Accession=PF00560.23; Description=Leucine Rich Repeat
  Pfam annotation: Domain name=LRR_1; Domain location=220-242; Score =1.4; E_value=1.6e+02; Accession=PF00560.23; Description=Leucine Rich Repeat
  Pfam annotation: Domain name=LRR_1; Domain location=244-267; Score =13.2; E_value=0.92; Accession=PF00560.23; Description=Leucine Rich Repeat
  Pfam annotation: Domain name=LRR_1; Domain location=269-291; Score =15.0; E_value=0.28; Accession=PF00560.23; Description=Leucine Rich Repeat
  Pfam annotation: Domain name=LRR_1; Domain location=94-119; Score =10.8; E_value=2.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=3-43::121 -143::145-167::169-194::196-218::220-242::244-267::269-291::94-119
VCIPSERETLLKFKNNLIDPSNRLWSWNHNNTNCCHWYGVLCHNVTSHLLQLHLHTSPSAFYHDYDYQYLFDEEAYRRWSFGGEISPCLADLKHLNYLDLSGNRFLGEGMSIPSFLGTMSSLTHLDLSYTGFYGKIPPQIGNLSNLVYLDLSSDVANGTVPSQIGNLSKLRYLDLSANYLLGGGMSIPSFLGTMTSLTHLNLSHTGFMGKIPPQIGNLSNLVYLDLSSVSANGTVPSQIGNLSKLRYLDLSYNDFEGMAIPSFLCAMTSLTHLDLSHTGFMGKIPSQIGNLSNLVYLDLGNYFSEPLFAENVEWVS

SEQ ID NO: 157291 - protein, 760 aa, Glycine max
  Coding DNA Sequence Number=SeqID_40513
  Gene Ontology: Mol. function=phosphoinositide binding; Biological process=cell communication
  Homolog annotation: Hit_ID=Q1S2J1; Match level="QueryCoverage=95%, HitCoverage=99%, E-value=0.0, Identity=76%"; Hit description=Phox -like
  Pfam annotation: Domain name=PX; Domain location=108-214; Score=32.0; E_value=2.1e-06; Accession=PF00787.14; Description=PX domain
RQRILGCDDDDEEDAETKSSEAQARRDFAAASRHGLEPCASKMGDLNHFHSFLRVLPSSAGIYGGESQKVPHTPALMECGDLYHFCSFLRVLPSPASIYGGECWKGISMVFIVSFVYHLVQQPSMESSGQFYRVQVGVQSPEGITKVHGVLRRFNDFLKLFADEFPRKNIPPAPPKGLLRLKSRALLEEEWITKLLSDIDISRCAAVASFLELEAAARSSFQDASQQNSETDPDSNNTVYSVQSPLQSSLSLFAGSSSVASDYGSDTAYEPSDLGTPRIGRDDNSEVGTDDLTLDEDMTNPIEKLVKYGISNIDEGLFMGQTILEQLEGLPRHKANARHVNYAAEKVKNNGNVYDSSLLANNTMELFSEPGHAKVVAHVRKLSSESVGSDGSSIRGSDMSNFGIPNSSGDGSHDLPGSALVSRETDIMGHTKLKSTGDTQLVLPLDQRNKLNRILSTMQRRLGTAKTDMEDLIVRLNQEIAAKDFLATKVKDLEVELETTKQKNKENLQQAILIERERFTQMQWNMEELRRQSLEMEIKLKSELDLTKESIVQQNDVLLENLDATKEQLEILSKQYGELEAKSKADVKVLVKEVKSLRNSQTKLKKELSESIKEHSETEAEVARRILLEKCRVLFNQLQECNVSLPYEYEGRTIVNSSSSTDAFNQLTTSDDQMDILLAEVENLEKDYGSAACNVDKTNDIKDGVICDDEVRKIIADLFIDNVRLRKQTNRVTRHALKLDMTASDDSPSVETVTSIEKYM

SEQ ID NO: 157292 - protein, 91 aa, Glycine max
  Coding DNA Sequence Number=SeqID_40514
  Subcellular localization annotation: CTP_CleavageSite=62; ConfidenceScore=5.22e-01
MALAPPEGGLLCPPPKLRRKSPKPIPGNSSPHLHRHVYFTESLSETVPRSLRLSCGRPGLVTATPFVRRHPFSRSYGAILPSSLERVVSRL

SEQ ID NO: 157293 - protein, 51 aa, Glycine max
  Coding DNA Sequence Number=SeqID_40515
MTKMIHFENIKGRLWQRQKKGLDNYLFGSMMRGEVTDEGKKTLSSVIENNW

SEQ ID NO: 157294 - protein, 168 aa, Glycine max
  Coding DNA Sequence Number=SeqID_40516
  Gene Ontology: Mol. function=structural constituent of ribosome; Cellular component=intracellular; Biological process=translation
  Homolog annotation: Hit_ID=Q1S1G5; Match level="QueryCoverage=84%, HitCoverage=100%, E-value=5e-71, Identity=87%"; Hit description =Ribosomal protein S19e
  Pfam annotation: Domain name=Ribosomal_S19e; Domain location=30-167; Score=321.3; E_value=1.7e-93; Accession=PF01090.9; Description =Ribosomal protein S19e
MEFRYNSKLGEGKGNGCKEWGREAAMATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAVARHILQQLQNMSIIELDTKGGRKITSSGRRDLDQVAGRIVVAP

SEQ ID NO: 157295 - protein, 32 aa, Glycine max
  Coding DNA Sequence Number=SeqID_40517
MCCVLDKDIPFWTLHVSVHYVLWRYEDVIKGE

SEQ ID NO: 157296 - protein, 119 aa, Glycine max
  Coding DNA Sequence Number=SeqID_40518
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q1S2J7; Match level="QueryCoverage=67%, HitCoverage=35%, E-value=9e-09, Identity=49%"; Hit description=H+ -transporting two-sector ATPase, B/B subunit
MGRVRLKSKSAAFSNSSAREGLAKTSGAIPPRRDSIWGFEIGSFSFKVGALGSEIWRMGSFGVGERELVQTGTRGFVEAIIILRGLDGREEEDLRARLSKFFATQIDEVVWQWLPNGIW

SEQ ID NO: 157297 - protein, 164 aa, Glycine max
  Coding DNA Sequence Number=SeqID_40519
  Homolog annotation: Hit_ID=O49260; Match level="QueryCoverage=38%, HitCoverage=16%, E-value=8e-23, Identity=76%"; Hit description=G5bf protein
EATEYSVITVGSSHCGKYHIRQEQDPINVFRYGAQAVQHSQTMIAPGNNGPTSGTANIDDADSGKAAKQALELMGKWEMIDVCDALELLSLVFESEEWFFHRLKVGRPIPIPNLGLQITQLGHVKDLAKAFIHVLGNEKANKEVFNISREKYVMFNGLARACAK

SEQ ID NO: 157298 - protein, 227 aa, Glycine max
  Coding DNA Sequence Number=SeqID_40520
  Homolog annotation: Hit_ID=Q9MQV2; Match level="QueryCoverage=29%, HitCoverage=11%, E-value=1e-11, Identity=44%"; Hit description=DNA -binding protein
MGALAVQYLKGDGGWCGEGGVGTVVGQFVKLLFEAMGEQNKGCGGGGGGGEAVPVAAFQKLCPRICKLLNSPVSEPYWSCIEVVSNLRKPYPNLSMSDTGATPILFLFSRIRASQMIILYKKCDKRKIPGILSFMKKENLTASHLTYRILIATRGETRDLIGMEQLLEDMKSHGLQPDAHFVTDLISNVNDIVKDAWVWFCVLLIYSPAYNVKNRSYKKKFLCKRAF

SEQ ID NO: 157299 - protein, 109 aa, Glycine max
  Coding DNA Sequence Number=SeqID_40521
  Gene Ontology: Mol. function=protein serine/threonine kinase activity; Cellular component=protein complex; Biological process =protein amino acid phosphorylation
  Homolog annotation: Hit_ID=Q75PK5; Match level="QueryCoverage=61%, HitCoverage=10%, E-value=5e-31, Identity=91%"; Hit description =Mitogen-activated kinase kinase kinase alpha
MLSFKGSPYWMAPEVVMNTNGYSLPVDIWSLGCTILEMATSKPPWNQYEGVAAIFKIGNNRDMPEIPEICLGSWVLELSSEQPQNLLPQIATHTPHCFSLPHTPPYCCQ

SEQ ID NO: 157300 - protein, 49 aa, Glycine max
  Coding DNA Sequence Number=SeqID_40522
MVQNGSVGLGIEQNGVLVQRCRPCEGHVMVQGKWELMLFTEPRTTTGTR

SEQ ID NO: 157301 - protein, 329 aa, Glycine max
  Coding DNA Sequence Number=SeqID_40523
MNDIQVWNNAAFDGNEEDSFLPMKTSWSSSECTKENLSPPAPDNLSFKKSTTATKKNPKGFGFGSDDNKNIDDEIEEIELEIKRLTTRLDALRLEKAKRGKRVVMGRVVPAKFMEPRPSAVVSRKPEETPKTKVRVSSSSNNNNNAWRRGMSLGPNEIAAATPATTLQSRRKSCFWKIPEIGEESRAKTTVGRVKKKEGNSVIQVQGKRLFEKEKVKSVCESGKKGLLKQGRMVASRYNSDVRKRSLPEGGTEIRVKKRWEIPKNGEEEAEAVAVMLPKIKMVKCLNESPRDSGAAKRVAELGGRRSYFNTDEKDVCQILNFAEEEEGQ

SEQ ID NO: 157302 - protein, 388 aa, Glycine max
  Coding DNA Sequence Number=SeqID_40524
  Gene Ontology: Mol. function=sulfotransferase activity; Cellular component=integral to membrane; Biological process=estrogen metabolic process
  Homolog annotation: Hit_ID=Q1S1F5; Match level="QueryCoverage=80%, HitCoverage=96%, E-value=1e-111, Identity=59%"; Hit description =Sulfotransferase
  Pfam annotation: Domain name=Sulfotransfer_1; Domain location=139 -381; Score=273.8; E_value=3.4e-79; Accession=PF00685.17; Description= Sulfotransferase domain
STKSTYAEAQSYNEDMKLTLNPTPTMAARLAMKCTLGHHEFPNPCSRNQKRSLAQWRTTTLDVNGEEESMRGYTEKKRARQEEVIEDDKISQQSTELILSLPREKGWRTPYVYLFQGFWCQPHEIQAIITFQKHFQAKDSDVLVATVPKSGTTWLKALTFATVSRHNFSSFNKNHPLLNFNPHDLVPFFEYTVYDKHDKVPDLSNMHEPRLFGTHVPFASLSKSIKESNCKVIYICRNPFDTFISSWFFANKIKPGSLPTLALDEAFEMYCKGVVGFGPFWTHMLGYWKESIEKPNKVLFLMYEDLKGDINFHLKRVAEFLGCPFTLEEENRGVIENIIKLCSFQKMKELEGEIGDWVNYLSPSMAQKLTKVMEDKLGGSGLTFRMNS

SEQ ID NO: 157303 - protein, 652 aa, Glycine max
  Coding DNA Sequence Number=SeqID_40525
  Gene Ontology: Mol. function=phospholipid binding; Cellular component= coated pit; Biological process=endocytosis
  Homolog annotation: Hit_ID=Q8LF20; Match level="QueryCoverage=94%, HitCoverage=95%, E-value=0.0, Identity=68%"; Hit description =Putative clathrin assembly protein At2g25430
  Pfam annotation: Domain name=ANTH; Domain location=29-366; Score =326.1; E_value=6e-95; Accession=PF07651.6; Description=ANTH domain
  Pfam annotation: Domain name=ENTH; Domain location=29-159; Score=0.4; E_value=2.4e-05; Accession=PF01417.11; Description=ENTH domain
  Pfam module annotation: Pfam domain module=ANTH::ENTH; Domain location=29-366::29-159
MAPTTIRKAIGVVKDQTSIGIAKVSSNMAPEMEVAIVKATSHDDDPASEKYIREILNLMSHSRGYVHACVTAVSKRLGKTRDWIVALKALMLVHRLMNEGPPLFQEEILFATRRGTRLLNMSDFRDEAHSSSWDHSAFVRTYAMYLDQRLDLMLFDRKSTAASYGGGAGSVGGGGSDDRFGGRDNFQSPPYEYGGGGEFRGEGGYGNGMRKTRSYGDMSESVGRGEEKRVVSVTPLRDMTPERVFGKMGHLQKLLDRFLACRPTGLAKNSRMVLIALYPVVKESFQLYADICEVLAVLLDKFFDMDYADCVKAFDAYSSAAKQIDELVAFYNWCKDTGVARSSEYPEVQRITNKLLETLEEFVRDRAKRPKSPERKEEVPPVEKVEEEPAPDMNEIKALPPPENYIPPPPPEPEPKPQPQVTEDLVNLRDDAVTADDQGNKLALALFAGAPANNVNGSWEAFPSNGQPEVTSAWQTPAAEPGKADWELALVETASNLSKQKATLGGGFDPLLLTGMYDQGMVRQHVSTTQLSGGSASSVALPGPGKTTTPVLALPAPDGSVQPVNQDPFAASLSVPPPSYVQMADMEKKQHLLVQEQQVWHQYARDGMQGQSSLAKLNGAGYYAGGPMPMMPYGMPPVNGMGPPTGYYHTPY

SEQ ID NO: 157304 - protein, 226 aa, Glycine max
  Coding DNA Sequence Number=SeqID_40526
  Gene Ontology: Mol. function=protein dimerization activity; Cellular component=nucleus; Biological process=regulation of transcription
  Homolog annotation: Hit_ID=Q1S2K0; Match level="QueryCoverage=99%, HitCoverage=100%, E-value=3e-67, Identity=62%"; Hit description =AUX/IAA protein
  Pfam annotation: Domain name=AUX_IAA; Domain location=5-226; Score= -6.4; E_value=5.5e-09; Accession=PF02309.7; Description=AUXIAA family
MEVDLVLALPTQNSVEEFKLNKSKQIVSLQLWRASCGSESEKRVKHNKRSFEESFGHFLKPLPLLVWSGQPNEEDDRSEKVQRNIHIPNKNGDEENHLVGWPPVKSWRRKELHQQHPARGRIRNDRIQANENQSRGPNSLYVKVNMEGVAIGRKINLRLFNSYQTLTSSLISMFAKYQKFEEVGESYTLTFQNEQGEWLQVGHVPWQSFIGTVRRLVILRNGSETI

SEQ ID NO: 157305 - protein, 124 aa, Glycine max
  Coding DNA Sequence Number=SeqID_40527
  Homolog annotation: Hit_ID=Q1T5Y9; Match level="QueryCoverage=36%, HitCoverage=11%, E-value=4e-16, Identity=84%"; Hit description =Histone deacetylase superfamily
MENKNSRHLLEEIRSKLLENLSKLQHAPSVQFQERPPDSDLGEFMRLLIVIIGTMMAMFLVSTQPMDYTSQYPNQNQSQTSASSPDFVSTSVNRINPRCPVIRAANIHTTTVGVAYAAGLTIGI

SEQ ID NO: 157306 - protein, 309 aa, Glycine max
  Coding DNA Sequence Number=SeqID_40528
  Gene Ontology: Cellular component=mitochondrion
  Homolog annotation: Hit_ID=Q2QM21; Match level="QueryCoverage=76%, HitCoverage=34%, E-value=5e-65, Identity=50%"; Hit description =Expressed protein
MSERASGESACTVLVALIAHWLHTNHGMPTRAQFERLITQGSSEWRRLCNSDDYSKLFPDKHFDLETVIEANLRPLVVLPQKSYTGFFSPEKFQCLKGAMSFDEIWNEIKSKVGDKESRVYIVSWNDHFFVLKVEADAYYIIDSLGERLYEGCQQAFILKFDDSSVMYGKIDKAKEVPISGASREKICRGKECCKEFIKRFLAAIPLWQLEKEEKEEKKWSVSSPYLHRQLQIDFHYSSSSSSSASADSLWSLLESGRYAGPEKNCISTSNWCKECFLLVDLEQLLPPENANSQEIQFLAAVPLFADNF

SEQ ID NO: 157307 - protein, 131 aa, Glycine max
  Coding DNA Sequence Number=SeqID_40529
  Homolog annotation: Hit_ID=Q9LRN2; Match level="QueryCoverage=55%, HitCoverage=15%, E-value=5e-23, Identity=71%"; Hit description =Arabidopsis thaliana genomic DNA, chromosome 3, P1 clone:MUJ8
MPRPGPKPYDCVKRAWHSEIHQPIRGTLIQEIFRVVNEIHGSSTKKNKEYQEKLPVVVLRAEEIIYSKANSEAEYMDLTTLLERTNDAIDTIIRRDEHTETGEYLRPCIEELEGTLKEKYRKSTFLAWFSD

SEQ ID NO: 157308 - protein, 293 aa, Glycine max
  Coding DNA Sequence Number=SeqID_40530
MPPMKCWVTRLSGKPNKQQHAVKLTQLKLELGLFGARLGAANDRIAFEITGIATKKETTPLPLVPFSKRRYTHSHTTCSRRFLSSKSPSLAWEARDLCGFHLLLKDHSLDVCDIAFHVLYGEGNAGESKAKMTAVGKAEMSVAVAELVVRKEKKTQFTSHHDFQRRLPIKLKVNGLCIEATLLVSMRLLKLRDSNGDSAGPFGKNWVQSEKKRGIIKEVKYLASLGKKNKGKFDESEQTSPHDSDRSPVFDSDDSYDSTTSSGSSSNSGGIPNARSTLSNGSESFTTSETAKT

SEQ ID NO: 157309 - protein, 35 aa, Glycine max
  Coding DNA Sequence Number=SeqID_40531
MADPSRGYDRVIEVLLWVANAKGKNQWSNVALAFQ

SEQ ID NO: 157310 - protein, 816 aa, Glycine max
  Coding DNA Sequence Number=SeqID_40532
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q1SD49; Match level="QueryCoverage=99%, HitCoverage=100%, E-value=0.0, Identity=64%"; Hit description =Protein kinase; Curculin-like (Mannose-binding) lectin; Apple- like
  Pfam annotation: Domain name=B_lectin; Domain location=81-181; Score =83.5; E_value=6.3e-22; Accession=PF01453.15; Description=D-mannose binding lectin
  Pfam annotation: Domain name=PAN_2; Domain location=324-387; Score= -8.2; E_value=0.0095; Accession=PF08276.2; Description=PAN-like domain
  Pfam annotation: Domain name=Pkinase; Domain location=491-761; Score =178.2; E_value=2e-50; Accession=PF00069.15; Description=Protein kinase domain
  Pfam annotation: Domain name=Pkinase_Tyr; Domain location=492-761; Score=94.0; E_value=4.7e-25; Accession=PF07714.7; Description =Protein tyrosine kinase
  Pfam module annotation: Pfam domain module=B_lectin::PAN _2::Pkinase::Pkinase_Tyr; Domain location=81-181::324-387::491 -761::492-761
MEIHWPFFHITGTLFLLCKVCLAGIQYSGSVSPGIINGSQMNWIDRDGKFLVSKEGQFAFAFVATANDSTKFLLAIVHVATERVIWTANRAVPVANSDNFVFDEKGNAFLEKDGTLVWSTNTSNKGVSSMELLDTGNLVLLGSDNSTVIWQSFNHPTDTLLPTQEFTEGMKLISDPSTNNLTHFLEIKSGNVVLTAGFRTLQPYWTMQKDNRKVINKDGDAVASANISGNSWRFYGKSKSLLWQFIFSTDQGTNATWIAVLGSDGFITFSNLNGGESNAASQRIPQDSCATPEPCDAYTICTGNQRCSCPSVIPSCKPGFDSPCGGDSEKSIQLVKADDGLDYFALQFLQPFSITDLAGCQSSCRGNCSCLALFFHISSGDCFLLNSVGSFQKPDSDSGYVSYIKVSTVGGAGTGSGGSGGGNKHTIVVVVIVIITLLVICGLVFGGVRYHRRKQRLPESPRDGSEEDNFLENLTGMPIRYSYKDLETATNNFSVKLGQGGFGSVYKGALPDGTQLAVKKLEGIGQGKKEFRAEVSIIGSIHHLHLVRLRGFCADGTHRLLAYEYLSNGSLDKWIFKKNKGEFLLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPRESSEKSHFPTYAFKMMEEGKLRDIFDSELEIDENDDRFQCAIKVALWCIQEDMSMRPSMTRVVQMLEGICIVPKPPTSSSLGSRLYATMFKSSSEEGATSSAPSDCNSDAYLSAVRLSGPR

SEQ ID NO: 157311 - protein, 71 aa, Glycine max
  Coding DNA Sequence Number=SeqID_40533
MEEFLNCETEGLMRLVCGCGREKKREATVEKVNKDNWAKYSSFDHESICLSLTQGSWSRETHLRDLSSSLF

SEQ ID NO: 157312 - protein, 311 aa, Glycine max
  Coding DNA Sequence Number=SeqID_40534
  Homolog annotation: Hit_ID=Q47522; Match level="QueryCoverage=17%, HitCoverage=67%, E-value=7e-22, Identity=89%"; Hit description=LacZ protein
  Pfam annotation: Domain name=SGL; Domain location=3-171; Score= -103.9; E_value=0.01; Accession=PF08450.2; Description=SMP -30GluconolaconaseLRE-like region
MVKVRTYYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSNGQGLPDGLTVAADGSVWVALWGGGAVHGYAPDGTQIARIDLPVPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 157313 - protein, 89 aa, Glycine max
  Coding DNA Sequence Number=SeqID_40535
MTCDHSLVLVRCLAPIIRQFMKFQDMPKNQKNIDAQSHPGPLGPSGIFLQKAVASGGSNPARLGELGGNHLPYFAINRGGSEEERGSAP

SEQ ID NO: 157314 - protein, 57 aa, Glycine max
  Coding DNA Sequence Number=SeqID_40536
  Homolog annotation: Hit_ID=Q9LRX4; Match level="QueryCoverage=77%, HitCoverage=2%, E-value=4e-10, Identity=71%"; Hit description =Arabidopsis thaliana genomic DNA, chromosome 3, TAC clone:K7P8
MGSARQLFQRLQGPMEEDTLKSHFDKIIKIGQKQRYHRNQLKLEFSDASSFTDVTLR

SEQ ID NO: 157315 - protein, 531 aa, Glycine max
  Coding DNA Sequence Number=SeqID_40537
  Homolog annotation: Hit_ID=Q69Q42; Match level="QueryCoverage=34%, HitCoverage=45%, E-value=2e-49, Identity=55%"; Hit description =Putative BRI1-KD interacting protein 118
  Pfam annotation: Domain name=TPX2; Domain location=276-332; Score =108.0; E_value=2.8e-29; Accession=PF06886.2; Description=Targeting protein for Xklp2 (TPX2)
MTPPDWYAVFTYHSHLSFFKWLSLMMDPSNLLPADGLEEVHQNGVHDELSNSGKDDIASNVDPGVTKIIETAATNGNFENFIQYDSTATDYSSKEGSNDNIDVNNVTISKEEEAKIIDRTGQLKVGKGPAKNKNAKPPSPRGSHVSSVKKNKDGKDEEVASAVSNGTFALDSHPRQPIKNRSLSDKQARLSKHPGKSNAATSEESMEKSRPRLLKKEPLDNLQGETESSSYPFFFLFVTESGTVYLWFILNPLVSPTAEDAKPRRVGALPKYGFSFKCDERAERRKEFYTKLEEKIHAKEVEESNLQAKTKETQEAEIKMLRKSLGFKATPMPSFYQEPPPPRVELKKLFAFIDLHVETLDVMPTTRAKSPKLGRKKSSTNSEPEGNLSNNARQGRLSLDEKVSQTNPTKGISPVHQKKPQRKSLPPQLTSEKTRSSNSASVRTSSKAVNGGKNSLSSVTTEVTTLSNPREEEKVEIAAATEENNVLLNETSKALPLNIEPDETESPVNGDLVIQEKPQLNMAQEPIAAEH

SEQ ID NO: 157316 - protein, 373 aa, Glycine max
  Coding DNA Sequence Number=SeqID_40538
  Gene Ontology: Mol. function=phospholipase D activity; Cellular component=membrane; Biological process=phosphatidylcholine metabolic process
  Homolog annotation: Hit_ID=Q1RZP8; Match level="QueryCoverage=88%, HitCoverage=57%, E-value=6e-87, Identity=62%"; Hit description=C2
REEEISFPTQELFALSMLMPARVDLDEARVGRTKLLNDQSSNPTWNETFHIYCAHLISYVIFTVKQKDPIDATLIGRAYVPVEQVLRALVDRWFQILDENLRWFCAMDLLVKWKTLDPMKPRTRITLGELPKMKAEEGVKVLMLVWDDRTSVLDFKKNGLMAAHDQETADYFKNKKVNCVLCPRNPDDGKSIVQGGIDLCDGRYDIQEHPLFSTLDTVHKDDFHQPNFSGASIKKGSVAWDVLLNFQQRWEKQVGNQLLFSSSKLDEYFVPRSTVATTNENETWNVQLFRSIDGGAASGFPQDPEDAAELGLVSGKDNITDRSIHDAYINAIRRAKNFIYTENHFVTDLCSDFHKCISVDMFHLGSVRFSLAW

SEQ ID NO: 157317 - protein, 64 aa, Glycine max
  Coding DNA Sequence Number=SeqID_40539
RSWSSMRALEYGDRYPLFCVGSVKRLGKIVLVTARNHWAGDVKLFMVLLLYLQEKNVIAEGRAC

SEQ ID NO: 157318 - protein, 192 aa, Glycine max
  Coding DNA Sequence Number=SeqID_40540
  Gene Ontology: Mol. function=transcription factor activity; Cellular component=nucleus; Biological process=regulation of transcription, DNA-dependent
  Homolog annotation: Hit_ID=Q1RZP2; Match level="QueryCoverage=98%, HitCoverage=94%, E-value=4e-63, Identity=66%"; Hit description =Pathogenesis-related transcriptional factor and ERF
  Pfam annotation: Domain name=AP2; Domain location=4-68; Score=130.0; E_value=6.4e-36; Accession=PF00847.10; Description=AP2 domain
MVQAKKFRGVRQRQWGSWVSEIRHPLLKRRVWLGTFETAEAAARAYDQAAILMNGQNAKTNFPTSKNQAEADHDNNNTFLSPKALSELLSTKLRKYCKDPAPSLTCLRLDADNSHIGVWQKGAGPHSGSNWVMRVELGKKQIITEGESTGSPQSTNIGAVENNEVEVEVEVEEEEEEDRVALQMIEELLNWN

SEQ ID NO: 157319 - protein, 1204 aa, Glycine max
  Coding DNA Sequence Number=SeqID_40541
  Gene Ontology: Mol. function=RNA-directed RNA polymerase activity; Cellular component=nuclear RNA-directed RNA polymerase complex; Biological process=electron transport
  Homolog annotation: Hit_ID=Q1RZP1; Match level="QueryCoverage=99%, HitCoverage=99%, E-value=0.0, Identity=82%"; Hit description=RNA -binding region RNP-1 (RNA recognition motif); RNA dependent RNA polymerase
  Pfam annotation: Domain name=RdRP; Domain location=576-961; Score =641.3; E_value=7.9e-190; Accession=PF05183.3; Description=RNA dependent RNA polymerase
MDLEGSEKGSVVTQISIGGFGSEVKASDLLNYLEDKIGLVYRCRLKTSWTPPESYPEFKIIDTAKIRRTEDYKKVEPHAFVHFASPESVTAALNASGCCDLFLKNQPLKVSCGPKNPYFLNQRRRTTTPFKMSDVLVEIGTLVSPGEFFVSWRGPDKGVKFLVDPFDGMCRFCFSRDTAFSFKGIDKKAVIKCDFQVGFLVRDINEIRRYNDTSYLVVLLHLASSPWVWYRTADDDIEESVPFDLLDDDDPWIRTTDFTPSGAIGRCNFYRISIPPRHGAKLMKAMLYLKGQRVQIQELPLKQTLRTQNEPDFGMPMSDAFFYVHFQKDIAFDIMFLVNAIVHKGIFNQHRLSDRFFELLRNQPKELNVAALKHLCSYKRPVFDATKRLKIVQEWLLRNPKLYQISKQLDDIVEVRRLVVTPSKAYCIPPEVELSNRVLRKFREVSDCFLRVTFMDEGMQTINVNALNYYVAPIVKEITSNSFSQKTKIYKRVKTILEEGFYFCGRKYSFLAFSSNQLRDRSAWFFAEDKIRCDDIRNWMGKFNQRNVAKCAARMGQCFSSTYATVEVAANEVNSMLPDVERNNYIFSDGIGVITHDLAREVAEKLKLDNVPSAYQIRYAGFKGVVASWPAKGDGVRLSLRPSMNKFQSTHNILEICAWTRFQPGFLNRQIITLLSALGVPDEIFWQMQEAMLLKLNQMLVDADIAFDVLTKSCAEHGNAAAIMLSCGFSPLTEPHLRGMLTSTRAAQLWGLREKSRIFVSSGRWLMGVLDELGVLEQGQCFVQVSTPSLENCFSKHGSRFSETKNLHVVKGFVVIAKNPCLHPGDVRVLEAVDAPDLHHLNDCLVFPQKGDRPHTNEASGSDLDGDLYFVTWDENLIPPSKRSWIPMEYAPQESKLLTRQVMTRDIIEFFVRNMVNEHLGAICNAHVVHADSSDYGALDEKCIHLAELAATAVDFPKTGKLVTMPPHLKPKLYPDFMGKERHQSYRSNKILGRLYRHIKDAYDEDIEAPYLNFVTGDIPYDKDLEVPGSADFIADAWEQKCSYDGQLSGLIGQYKVKREEEVVTGQIWSMPKYNSRKQGELKERLKHSYSALKKEFRYTFEKLNSDVGELSEEEKNLLYEQKASAWYQVTYHPEWVKKSLDLQDKSSENQEADSLGSTVMLSFPWIAVDYLARTKIRQRHQRSGNFDSTKPVDYLAKYLSERL

SEQ ID NO: 157320 - protein, 88 aa, Glycine max
  Coding DNA Sequence Number=SeqID_40542
MGLTMSQAIISTLRTCHAFPPFNVTFPTLTLDIKLKVAFVGPILLNDAITCRDLDVVRNLIKRQCSMLTDLSPTQVKTLWKLPQGGKD

SEQ ID NO: 157321 - protein, 523 aa, Glycine max
  Coding DNA Sequence Number=SeqID_40543
  Gene Ontology: Mol. function=ATP-dependent helicase activity; Cellular component=nucleus; Biological process=mRNA processing
  Homolog annotation: Hit_ID=Q1RYY7; Match level="QueryCoverage=94%, HitCoverage=94%, E-value=1e-179, Identity=69%"; Hit description =Helicase, C-terminal
  Pfam annotation: Domain name=DEAD; Domain location=70-238; Score =102.4; E_value=1.3e-27; Accession=PF00270.19; Description=DEADDEAH box helicase
  Pfam annotation: Domain name=Helicase_C; Domain location=400-476; Score=122.3; E_value=1.4e-33; Accession=PF00271.21; Description =Helicase conserved C-terminal domain
  Pfam module annotation: Pfam domain module=DEAD::Helicase_C; Domain location=70-238::400-476
MGETKDEAYEEELLDYEEEDDKAPDSAGAKVNGEATKKGYVGIHSSGFRDFLLKPELLRAIVDSGFEHPSEGKLSIYLNLLFNLQLLLLAVVAVCDDFEDFRFVMQIDPVPGQVSALVLCHTRELAYQICHEFERFSTYLPDLKVAVFYGGVNIKVHKDLLKNECPHIVVGTPGRILALTRDKDLSLKNVRHFILDECDKMLESLDMRKDVQDIFKMTPHDKQVMMFSATLSKEIRPVCKKFMQDLVGWSVRWAGGWRDWARKKLWMGCLSIGPVCGWRECQVSWHLLGVTKKKFLQGDKTDGQELSFKGSASIIHFVVDSISLRKDPNMIYCEICSFQPMEIYVDDEAKLTLHGLVQHYIKLKEEEKNRKLNDLLDALDFNQVVIFVKSVSRAAELDKLLVECNFPSICIHSGMSQEERLKRYKGFKEGHTRILVATDLVGRGIDIERVNIVINYDMPDSADTYLHRVGRAGRFGTKGLAITFVSCSTDVDVLNNVQSRFEVDIKQLPEQIDTSTYRHIIEF

SEQ ID NO: 157322 - protein, 87 aa, Glycine max
  Coding DNA Sequence Number=SeqID_40544
  Homolog annotation: Hit_ID=Q9ATG0; Match level="QueryCoverage=65%, HitCoverage=44%, E-value=4e-21, Identity=70%"; Hit description =Putative chaperon P13.9
  Pfam annotation: Domain name=DnaJ_CXXCXGXG; Domain location=21-78; Score=-40.2; E_value=0.093; Accession=PF00684.9; Description=DnaJ central domain (4 repeats)
MCFKALLLPNIALSLQRFYRKEVDLTLNGGAVLCSQCKGSGVNSVDIFNGQFKAGDTCWLCGGRKEMLCGNCNGTGFVGGFLSTYDQ

SEQ ID NO: 157323 - protein, 126 aa, Glycine max
  Coding DNA Sequence Number=SeqID_40545
  Homolog annotation: Hit_ID=Q1RYZ1; Match level="QueryCoverage=92%, HitCoverage=47%, E-value=8e-50, Identity=82%"; Hit description=SPX, N-terminal
  Pfam annotation: Domain name=SPX; Domain location=1-126; Score=41.0; E_value=4e-09; Accession=PF03105.10; Description=SPX domain
MKFWKILKSQIEQTLPEWRDQFLSYKDLKKQLKVMCPKDALTPPCLDADELNHFLGLLELEIDKFNGFFVDKEEEYIIKWKELQDRVARAIDSNAELMSLGREIVDFHGEMVLLENYTALNYTGMF

SEQ ID NO: 157324 - protein, 100 aa, Glycine max
  Coding DNA Sequence Number=SeqID_40546
MKNDGKPSRNRPGKHLESVTEVPRLEFSSWKQFFSLILSVSQIPGRGKEGGGCCPARPGELGCFHQKASPSVGTPWKLQVGLVAIFTPLFTQYTPLCPFC

SEQ ID NO: 157325 - protein, 176 aa, Glycine max
  Coding DNA Sequence Number=SeqID_40547
MVIAMLNVAMPIVVTISSGDGGGRNISGLDGDGGCDDVGDDCGGNDGGDIVGSEGGGDNDSDDGDDDIDGGSGSGASGDINIDGDGSHASGDDDVGDGEGGTDNGGSDNDDDDGGSNCIWWWSSRLRHVDGDCGDNDGDNIIGNDDGGDNDGSNIIGSDDGGDNGNDDIDGGSVSC

SEQ ID NO: 157326 - protein, 59 aa, Glycine max
  Coding DNA Sequence Number=SeqID_40548
MEKWESEIEYSWQEMATEIVAGGREKTSNNANELDPRRTKTRCYGYVVQDTDGLSSSSN

SEQ ID NO: 157327 - protein, 67 aa, Glycine max
  Coding DNA Sequence Number=SeqID_40549
MNGNGSNNLAGTEEEGMHKMKKDEERRKGEIVGEFLVIWLKRMDCSLCLGRWVCIVRLRCEKKELQE

SEQ ID NO: 157328 - protein, 434 aa, Glycine max
  Coding DNA Sequence Number=SeqID_40550
  Gene Ontology: Mol. function=binding; Cellular component =mitochondrial inner membrane; Biological process=transport
  Homolog annotation: Hit_ID=Q1RYX7; Match level="QueryCoverage=99%, HitCoverage=100%, E-value=1e-143, Identity=62%"; Hit description =Adenine nucleotide translocator 1
  Pfam annotation: Domain name=Mito_carr; Domain location=108-195; Score=76.7; E_value=7.1e-20; Accession=PF00153.17; Description =Mitochondrial carrier protein
  Pfam annotation: Domain name=Mito_carr; Domain location=245-333; Score=119.8; E_value=7.6e-33; Accession=PF00153.17; Description =Mitochondrial carrier protein
  Pfam annotation: Domain name=Mito_carr; Domain location=339-431; Score=119.4; E_value=1e-32; Accession=PF00153.17; Description =Mitochondrial carrier protein
  Pfam module annotation: Pfam domain module=Mito_carr::Mito_carr::Mito_ carr; Domain location=108-195::245-333::339-431
MGRRGIQLFDEKIDVFFSVSNLGFESKDGYHQFGGLFASVGQMGMGVGVQPNDPSDSRDNGGMKLPLNELFLKHVQPQGKEEVVEEGAKGKKNRKGGGVSLKLKIRNPSLRRLFSGAVAGAVSRTAVAPLETIRTLLMVGSSGHSTTEVFNNIMKTDGWKGLFRGNFVNVIRVAPSKAIEPGWNCGFKQVLLESLVDLEMIEHRCNMITLVILFYSQHLQAAMLFAFDTVNKNLSPKPGEQSKIPIPASLIAGACAGISSTICTYPLELVKTRLTVQSDIYHGLLHAFVKIIREEGPAQLYRGLAASLIGVVPYAATNYYAYDTLRKAYQKIFKEEKVGNIETLLIGSVAGAFSSSATFPLEVARKQMQLGALSGRQVYKNVFHALACIFEQEGIHGLYRGLAPSCMKLVPAAGISFMCYEALKRILLENDEED

SEQ ID NO: 157329 - protein, 84 aa, Glycine max
  Coding DNA Sequence Number=SeqID_40551
  Gene Ontology: Mol. function=structural constituent of ribosome; Cellular component=ribonucleoprotein complex; Biological process =translation
  Homolog annotation: Hit_ID=O80361; Match level="QueryCoverage=81%, HitCoverage=24%, E-value=2e-12, Identity=56%"; Hit description=50S ribosomal protein L4, chloroplast precursor
MGQGELHRRDELLRLWLLGELRHKVLHHDGTGGSAGNSGGDGEALLLAVDLDGPVAGLRAEDDTSAGAEGSAVGITSKGLMEAK

SEQ ID NO: 157330 - protein, 394 aa, Glycine max
  Coding DNA Sequence Number=SeqID_40552
  Homolog annotation: Hit_ID=Q1ZY19; Match level="QueryCoverage=85%, HitCoverage=69%, E-value=2e-35, Identity=29%"; Hit description =Fgenesh protein 60
  Pfam annotation: Domain name=DUF247; Domain location=21-390; Score =253.1; E_value=5.8e-73; Accession=PF03140.6; Description=Plant protein of unknown function
MRNQDDVVNSIRAMLEKAEAPVTDECCIYRVPFDIRKLNEDAYTPKVVSIGPFHHKGNPRLQNMEKHKLIYCNAFLKRSNTGLETWIRYIQDVEPRFRSCYSDALEFTKEELLKIILVDSGFIFELFWLTYYEENSGNNGSILLKPWLTTNVRLDLLLLENQLPFFVLDHLFGLSMQSYTSTSGRGGKKNIPPFIAFTFDYFSFYNRSELNFHGVMIKHFTDLLRTFHLQHPQQNRIEKTVVHLPSAAELSEAGVRFKANTTSKCCLLDLKFSGGVLEIPQLKVQDWTELIFRNMVALEQCHYPYHSFVTDYVAVLDFLVNTSRDVDVLVRKGVLVNWLGDSDSVADILFCLASNTTIEYMPPLSPKGQRMARGPKKGFMARSVGVVSPIRSLI

SEQ ID NO: 157331 - protein, 105 aa, Glycine max
  Coding DNA Sequence Number=SeqID_40553
MGLNFLNAMHFLGQVTIPILMIKDSTTSLNFPYFYVLGHAATGENVEDPFIAVEEIDKEVDTQFAKDIEDQVDIMLFLKPKLPQMLDKVVLRKILPNETPIGKRH

SEQ ID NO: 157332 - protein, 145 aa, Glycine max
  Coding DNA Sequence Number=SeqID_40554
  Gene Ontology: Mol. function=transcription regulator activity; Cellular component=intracellular; Biological process=regulation of transcription
  Homolog annotation: Hit_ID=Q6YXC5; Match level="QueryCoverage=29%, HitCoverage=11%, E-value=5e-15, Identity=69%"; Hit description =Putative zinc finger protein ID1
  Subcellular localization annotation: CTP_CleavageSite=58; ConfidenceScore=5.25e-01
MTSIKPIIHQNPSTTSPIYIKPSTIKRSVLRSSQIYLSRSERGVEQRPERCGDGNGRKAMYLPAEKPSETTMQRHVTWFSCPFVGCERNKLHRRFRPLKSVICMKNHFKRRHCPKMYTCERNSAGVRSDNLVMPWTVEGSSLEGV

SEQ ID NO: 157333 - protein, 72 aa, Glycine max
  Coding DNA Sequence Number=SeqID_40555
MAVVGSDVEALWHFGLTMTLMVDHNPHELTTVVVNLPCVEAKLHDDDKGDDKKLKGQSKNEFKMFKIESRTL

SEQ ID NO: 157334 - protein, 135 aa, Glycine max
  Coding DNA Sequence Number=SeqID_40556
MSENNPFSGSAHEDPMQYLRKFIKLINTARQNHPLVDAIRIIKDICSNPYNNLRQPRNLPSQLESNPKREDVKFVMTRSKRIQGDIKEKEDFPPKTVNGILAEKDQVLEKVEDPTIGNALPKKEGDKKKEILTSP

SEQ ID NO: 157335 - protein, 72 aa, Glycine max
  Coding DNA Sequence Number=SeqID_40557
GLIGACVLSATLARLARISEFRLSARLFAQWMDSSGALSGISPCLANMNNSSFFHILPRAQPKECCAQQMAR

SEQ ID NO: 157336 - protein, 121 aa, Glycine max
  Coding DNA Sequence Number=SeqID_40558
MTHWQRRCDSTSLTNSELACCLMTLKRHDASSRGVMVISPTGRWKVEGGGPLVLTYVSLALSTGVVIKPRELGKLLKIEEEGEKVVEEGKELGTRVGRRGKRAKRLGEEGKEMYERGREKG

SEQ ID NO: 157337 - protein, 160 aa, Glycine max
  Coding DNA Sequence Number=SeqID_40559
  Homolog annotation: Hit_ID=Q1SGV5; Match level="QueryCoverage=32%, HitCoverage=10%, E-value=6e-10, Identity=58%"; Hit description=Beta -ketoacyl synthase; Immunoglobulin/major histocompatibility complex
MEGWNCMQCLEMNRDGFVLGEGAGVLLLEELEHAKKRGANIYAEFLGGSFTFDAYHVTQPHPNDGKISYIGYGFLGGFVATSMDLDFVVLRLSCWWLIWIFNGGFGDGVRVRSGACTKDGCVECVGGAWSSRDLVMGKMATCDATTMVVADLIYEKVMDT

SEQ ID NO: 157338 - protein, 96 aa, Glycine max
  Coding DNA Sequence Number=SeqID_40560
  Gene Ontology: Mol. function=3-oxoacyl-[acyl-carrier-protein] synthase activity; Biological process=fatty acid biosynthetic process
  Homolog annotation: Hit_ID=Q5ECI5; Match level="QueryCoverage=88%, HitCoverage=17%, E-value=1e-17, Identity=55%"; Hit description =Plastid 3-keto-acyl-ACP synthase II-B
  Pfam annotation: Domain name=Ketoacyl-synt_C; Domain location=3-48; Score=-21.1; E_value=0.00044; Accession=PF02801.12; Description=Beta- ketoacyl synthase, C-terminal do
MNVNFNKLRVNSTKSMIGHLLGAAGGVEAVATIQAIKTGWVHPNINLENPDEGVDTNVLVGSKKETLDIKAAMSNSFGFGGQNSSIIFAPFKCNRF

SEQ ID NO: 157339 - protein, 121 aa, Glycine max
  Coding DNA Sequence Number=SeqID_40561
  Subcellular localization annotation: CTP_CleavageSite=31; ConfidenceScore=5.39e-01
MHPPSSFAIMPKPHPPQCNRASTFPISNPITCSSPSPMIVFDFFINDPSFESRNDVQEHIHRIQGHIYLCKGLKLMNGLSTVTLTDSRGDDKSVCLASRLNWDNDDETVLLDAEDGGKGEA

SEQ ID NO: 157340 - protein, 399 aa, Glycine max
  Coding DNA Sequence Number=SeqID_40562
MKVMRTSLKNEKHRRKSMILIFEDVHTLILKKISNSETCNSSLSRKSSPPNFPLAISHSILVQITPYKAQNFIFFHFLSFEPIEISKNLFKWRNHRRSERALRVGVNDIPGHRKRQFLPPFPLDHCFHERNNVYEINEGTLMSKFYGIKMVIDQSLFYDLTKLPNEGVPFEGTMIDDWKFDFSVHDARRLVCTNQADMIGRLLVGSLAFESRILHYLIVRILLPRSSNLAQVFEEDLIVLWAFHKGLQIDWAHLVRYRMHKALRLNAPLPYPHLVTLFLQHFNIPLDSKPYVPIKRSFLIGALVIASFGYQKEHDGSWVKKGTRHVGEEGHDGEDSSLLSKIMDRFDCLQTFVGERFDTLELQVDMHFNKMEPRITKVEEDVSYIRSSFDLPPPPPPSS

SEQ ID NO: 157341 - protein, 268 aa, Glycine max
  Coding DNA Sequence Number=SeqID_40563
  Gene Ontology: Mol. function=hydrolase activity; Cellular component =mitochondrion; Biological process=fatty acid metabolic process
  Homolog annotation: Hit_ID=Q84VJ1; Match level="QueryCoverage=91%, HitCoverage=73%, E-value=4e-87, Identity=64%"; Hit description =Biostress-resistance-related protein
  Pfam annotation: Domain name=Abhydrolase_2; Domain location=21-260; Score=71.1; E_value=3.7e-18; Accession=PF02230.7; Description =PhospholipaseCarboxylesterase
  Pfam annotation: Domain name=Peptidase_S9; Domain location=72-263; Score=-80.2; E_value=0.052; Accession=PF00326.11; Description=Prolyl oligopeptidase family
  Pfam module annotation: Pfam domain module=Abhydrolase_2::Peptidase _S9; Domain location=21-260::72-263
  Subcellular localization annotation: CTP_CleavageSite=30; ConfidenceScore=5.01e-01
MSYSGSSMSSGSGSSRRTFEFGRTHVVRPKGKHQATIVWLHGLGDNGSSWSQLLETLPLPNVRISILCNFFSSYCTADVSPHAKQSNLIEASLPGFDAGEISEEAPSDLEGLDASAAHVANLLSTEPPNIKLGIGGFSMGAATALYSATCHVLGHYGNGNIYPINLSAIVSLSGWLPCSRTLKNQIERSRDGIRRAASLPLFLCHGRGDDVVAYEHGERSAVTLSSSGFQNLIFRSYNGLGHYTVPEETDEVCRWLTANLGLEGFRLN

SEQ ID NO: 157342 - protein, 36 aa, Glycine max
  Coding DNA Sequence Number=SeqID_40564
MCLNIRVLAKTDAVKTPSTSVLAKTDVDQQQRGWCK

SEQ ID NO: 157343 - protein, 522 aa, Glycine max
  Coding DNA Sequence Number=SeqID_40565
  Pfam annotation: Domain name=Arm; Domain location=312-350; Score=8.4; E_value=1.1; Accession=PF00514.13; Description=Armadillobeta-catenin -like repeat
  Pfam annotation: Domain name=Arm; Domain location=352-393; Score =16.8; E_value=0.079; Accession=PF00514.13; Description=Armadillobeta- catenin-like repeat
  Pfam annotation: Domain name=Arm; Domain location=394-435; Score=2.9; E_value=5.3; Accession=PF00514.13; Description=Armadillobeta-catenin -like repeat
  Pfam annotation: Domain name=Arm; Domain location=475-516; Score =15.3; E_value=0.15; Accession=PF00514.13; Description=Armadillobeta -catenin-like repeat
  Pfam annotation: Domain name=HEAT; Domain location=317-352; Score =14.8; E_value=0.3; Accession=PF02985.12; Description=HEAT repeat
  Pfam annotation: Domain name=HEAT; Domain location=360-395; Score =1.9; E_value=25; Accession=PF02985.12; Description=HEAT repeat
  Pfam module annotation: Pfam domain module=Arm::Arm::Arm::Arm::HEAT::H EAT; Domain location=312-350::352-393::394-435::475-516::317-352::360- 395
EALAGFLQRKASAEARSEHLVEAIAAVFLGVLALFIGQGLLVGGVCQGVYHLMLHQSVSEGEEVSVKDTLMQEDILLTEGFPLGVSGAHHHVEELPQGIEAGGAGRHLFHAVHDIEPDDIAEVGARGMHLLLGAGVHQNPGLGPGHPWSLRQEQVETAGPGHRPEALMESKAWSHMAMVLHTNVKGEICGAEGFGLGCEVVAVFVGIGDSDAVALLMLGWKVLNHNWGENQSLVAHSDMILVLILPEARVITTYSMSSQPISLIPFPANEKGQIYRLNVPEHPRFTFKLFKYFPSKDHKFGVVESCKPKNMSVSSVSRVVDTITECLSLVQSDSIEVQEKALQTLASITKVSPQNRTMLAQTDNAIPTLASLTNSSSPVIQTLSLLTLFNLSLNPDLKQSLADMETIHYLNSLITSTSSLDSSKLASSLICSLAMHDKNKAKFGVAGTVQLLVKAIEGSHDAHHLLSSLAELVHFHGNCTLAVRAGAVPVLLRVAKGTDNEDLAGTSLAVLSLLARFDEGLN

SEQ ID NO: 157344 - protein, 100 aa, Glycine max
  Coding DNA Sequence Number=SeqID_40566
MMFTKTKISARICGSVDQHEKVRDLFKAIDEQFITSDKANKHIDHEVLLSLTYQCERRKACNGDGRECNATTAYGKNKATKSQANQKGNGKIPPQADIKK

SEQ ID NO: 157345 - protein, 89 aa, Glycine max
  Coding DNA Sequence Number=SeqID_40567
  Gene Ontology: Mol. function=RNA-directed DNA polymerase activity; Cellular component=mitochondrion; Biological process=DNA integration
MDVKTTFLNGNLEEVNVKQPEGFSSSSGAHLVCKLKKSIYGLKQAFRQWCLKFHGIISSFGFDENPMDQYIYHRMIFYLQPMTGVCYMR

SEQ ID NO: 157346 - protein, 652 aa, Glycine max
  Coding DNA Sequence Number=SeqID_40568
  Gene Ontology: Mol. function=isomerase activity; Biological process =protein folding
  Homolog annotation: Hit_ID=Q1S411; Match level="QueryCoverage=67%, HitCoverage=49%, E-value=2e-80, Identity=68%"; Hit description =Peptidyl-prolyl cis-trans isomerase, cyclophilin type
  Pfam annotation: Domain name=Pro_isomerase; Domain location=48-223; Score=214.8; E_value=2e-61; Accession=PF00160.11; Description =Cyclophilin type peptidyl-prolyl cis-
MEAARLGSFTSHAFIYKLAYEPSFIISNESFPWLSTRAKTMTKKKNPLVFMDVSIDGDPVERMVFELFYDVAPKTAENFRALCTGEKGISPNTGKSLHYKGSFFHQIIKGSIVQLSGLPALFHLHVSCDNGTAGESIYGSKFPDESPKLKHDATGLLSMAIADRDTLGSHFIITLKADHHLDRKHVVFGKLVQGPNVLKKIEEVGDEEGHPTVTVKIINCGEYSEDGKKVNKSKMGKNKKSSKDRRKRRKYYSSKSGSSSDSDTESSETDSDSESDMSSSSYISSSSDDRRRKRKRSKKDKYRREKRRDKRRDKKRRKKDKRSKRKSKRESGSDSDSESNSDSSSEGEGIGAQHKGLKLKDHSQKNAETRSALVAEKDLPPAHHEKEEVGMLENEEKFSKENGEQRSNGIGGADYGSDRSEERQPDVMDDHSGKTRSTFFFSHTSVISYAYHFFQIWRSARLSKSPSVTPKRRLSKSPSVTPKRRLSKSPSVRSPPPSQRSLSRSPARSISRSPSRSISRSPVRGRNGRSVSRSPVRGRNGRSVSRSPVRVRNGRSVSRSSVRVRNGRSVSRSPVRVRNGRSVSRSPVRGRNWRSVSRSPVRGRNGRSVSRSPARTRSLRSVSKSPVRSHSRSHRSRSSPRAPSGKIISKSP

SEQ ID NO: 157347 - protein, 1275 aa, Glycine max
  Coding DNA Sequence Number=SeqID_40569
  Gene Ontology: Mol. function=RNA-directed DNA polymerase activity; Cellular component=chromatin; Biological process=chromatin assembly or disassembly
  Pfam annotation: Domain name=rve; Domain location=967-1123; Score =109.0; E_value=1.4e-29; Accession=PF00665.16; Description=Integrase core domain
  Pfam module annotation: Pfam domain module=RVT_1::Retrotrans _gag::rve; Domain location=482-651::102-192::967-1123
MAKATRSKTNVDRWEDAFVKLSASITSKFDELLNRMNQLETSHTNPQVTPAFASPSVAATTNFAYRLKLEVPHFDGSNPEGWIFKIMQFFEYHVTPDHDRLTITSFYMEGPALAWFQWMYRSGQLSSWSAFLYAIHARFSSSAYEDPTGVLCKLTQRSTVSAHLSEFEAFANKVIGLPAPFMLSYFVSGLSLAIRWEVQVMQPHSLAQAVSLARLHEEKLLDSRRPRVQSSPTMTSISPPSRLKPPPRINPSESSLLPSLTKACSSTIPFKRLTPTELALRREQGLCFNYDEKYSRGHKCTSSLFLFVTEEDEYAQEIDPEPLSPTLPPSSQEPSPAQISLHALSDYTTLTMKFIYDGKLIKLMGDRDTSIDQISPSQLHRLVDTGNTSTYFHIQMEPHTTTLLPLAHPIPTIQKILTKYSSLFQPLLTLPPSRPIDHTITLFPNSAPINVRPYRYPYYQKKEIENQVASMLSQGRIQHSSSPFSSPVLLVKKHDETWRFCVDYRALNAITVHDHFLIPTVDELLDELGGTVWFSKLDLMQGYHQILMKEFDTSKTAFRTHHGHYEFRVMPFGLCNAPSSFQAMMNRLFQPYLRKYIIVFFDDILIYSQNLEEHLNHLETTFQVLMDGKFTLKFTKCSFAQKHIDYLGHIVSGNGVQPIPEKVQAIQRWPQPRTTRALRGFLGLVGFYCRFIRGYTAMVASLLQLLTKADFMWSPEAEHAFQTLKDAVTMAPVLALPDFAKPFTVETDASGSDMGAVLSQEGHPIAFFSKQFCPKLLRSSMYVRELAAITAAVKKWRQYLLGHHFVILTDHRSLKKLMNQAIQTPEQHRFLARLLGFNYVIQYRAGKSNDLCKELQTHNEFVTLKEKICTDTIAYLDHSLTPHFILDQGRIWLPSDCSFIKTLLAEFHQSPTGGHMGFRKTLNRVTENFIWNTMVVDTRKFVASCLDCQLVKYEPAKPRGLLCPLSVSSQPWEDLSMDFIVRLPAYRGNTCIFVVVDRFSKGLHLDILPPHHTSQGVAQLFIEIVGKIHGMPRSITSDRDQFFISKFWQALFSLSGTKLRMSSAYHPQMNGQTEVANRVIEQYLRVFIHRRPSTWGHFLLWVEWSYNTSTHSATGLTPFEVTFGCKPLSFPQYLTGTSKVDAVDELLSQREAVFALLRQKQQKAQNRMRAIIDGHRRDHEFQSTVSGTAQSKLSKCFYGPFRISVRMGPVTYKLALPEHSRIHPVFHCSILKPFIRPRDTVQVMDLPPVAVDNQPVPIPLAILAHKTILSDTGPK

SEQ ID NO: 157348 - protein, 122 aa, Glycine max
  Coding DNA Sequence Number=SeqID_40570
MEQVADEKGEREKRKEGRGKVYEKKREMKAVANAGCYYISYLFSIFSSQWLLLNDGDVRWSSVGAYGLVGIGSEVCSRTKTVSPVAPARQVLTGQPASSTSETYMHLLHALQTPSSRLDPAT

SEQ ID NO: 157349 - protein, 478 aa, Glycine max
  Coding DNA Sequence Number=SeqID_40571
  Subcellular localization annotation: CTP_CleavageSite=71; ConfidenceScore=5.11e-01
MRKRERILDATTPDIRMGSNLALFGQTRGTDPTSQPSTLQDSRKMRQKRTYGSSSKSGGISRGGRRYGFVRFRRVTDERRLERQLGNIMVNGLKLYVNIPKYGRPMTTKAEYRKETKMQGDENKHETEAAQKRQPQPRIPLVSYAMMVATNTRNSGQIWTQQNVLYRPDESQSTVQLEIPKGEKNWCRDAWVGRLKNLAMFDRLEDEISWDVGANVSSKYQGDEMVLLLGLTDIRAEQLAQEDDRNGSSLFHSLEKWNSGMRTRHRLVWVQCWGIPLIAWNMAQIQKMVATIGDMVEVDDDAKESWRLDRARVLIRIPWRPTIQYTVNVHVSGEVYEVYIVEENGNSAVKCNCRFKGGLGSSEEIDSDDSDMGTLLSKLDGAPEIEVVPTRGNKLLTIGPNETARPLGNDHGQRPHCHIQQEPRAENLYGNEDEHAERSTVAAEVSSRVDVSCRAQNEHGARQRVDSNSTMFSPKRNR

SEQ ID NO: 157350 - protein, 466 aa, Glycine max
  Coding DNA Sequence Number=SeqID_40572
  Gene Ontology: Mol. function=protein transporter activity; Cellular component=cytoplasm; Biological process=intracellular protein transport
  Homolog annotation: Hit_ID=Q2QP84; Match level="QueryCoverage=67%, HitCoverage=36%, E-value=1e-102, Identity=61%"; Hit description =Vesicle tethering family protein, putative, expressed
MDLVSGYKGVFGLVFGNENSSNEDSYVERLLDRISNGKLAEDRRNAITELQAIVSESQAAQLAFGAMGFPVLLSVLREEHDDVEMVRGALETLVSALTPINHAKGSSNEVQPALMNTDLLSREAESISLLLSLLHITIKPSSLESTLAKFLFRLQEAILTIPRGITRLMDMLMDREVIRNEALLLLTHLTCEAEEIQKIVVFEGAFEKIFSIIKEEGGSDGGVVVQDCLELLNNLLRKNASNQVLLRETIGLDSLISILKLRGSGYTFTQQKVGSDADPGKDLNKQTNKRTLIQKKLLDYLLMLSVESQWAPVAVRCAKLLEAVLKLRLRILFVCIFSYSNISSWYQSGTIPFCTSVSVYRRRHCTYLQQYPDLGRLFQRIPTPEVSKSKTLTRATSPHIILKRVHPMHPSLVTGTSMRHLGFGHRPLPTLFQPSDRHFGVVWIVDLYTSILLPIFVSSGFVLRVY

SEQ ID NO: 157351 - protein, 276 aa, Glycine max
  Coding DNA Sequence Number=SeqID_40573
DVGNFPFGPDLRALMARQNMVVGNHQQVSYRRVWERTRQEKKNTTEVESRAIDLDVGDCGVPAQKTREDEVLESNVPLSLEHIRLLSSNIQVDTQTKFIRKWKRIARENTERGNRESLKQGGKRIVEMIWSDSAMETEGGKRAKEARATIRSLSDLCNGNQEEVSRGARLWLKKAEECKDVVAHSWILGDDVMHHLTRVGSNLNSWGKAAFDLFMTSIPQDTDLVAQLVGGRIINDLRNVLNGDFTKEEAFEALNQMHPLKAPSLDGTPAVFYHKF

SEQ ID NO: 157352 - protein, 561 aa, Glycine max
  Coding DNA Sequence Number=SeqID_40574
  Gene Ontology: Mol. function=protein transporter activity; Cellular component=cytoplasm; Biological process=intracellular protein transport
  Homolog annotation: Hit_ID=Q2QP84; Match level="QueryCoverage=93%, HitCoverage=56%, E-value=1e-160, Identity=54%"; Hit description =Vesicle tethering family protein, putative, expressed
  Pfam annotation: Domain name=AIP3; Domain location=121-558; Score= -216.5; E_value=0.074; Accession=PF03915.4; Description=Actin interacting protein 3
  Pfam annotation: Domain name=Uso1_p115_C; Domain location=435-557; Score=147.3; E_value=4e-41; Accession=PF04871.4; Description=Uso1 p115 like vesicle tethering protein, C terminal region
  Pfam annotation: Domain name=Uso1_p115_head; Domain location=6-331; Score=-33.9; E_value=6e-08; Accession=PF04869.5; Description=Uso1 p115 like vesicle tethering protein, head region
  Pfam module annotation: Pfam domain module=AIP3::Uso1_p115_C::Uso1 _p115_head; Domain location=121-558::435-557::6-331
MKMCFSYAAKLNALLGIEEPQVEPALNSILRIILRTSSMQEFIAADFVFKSFCEKNADGQSMLASTLIPQPYSMNYAPLEEDVNMSFGSMLLHGLTLGENDGDLEVCGRAASVLSHVLKDNLHCKDRAPVPSLGAPEPLMHRMVKYLALASSMKSKDGKSRSSENSYIQEYILKLLVTWLADCPAAVHCFLDARPHLTYLLELVSNLSETVCVRDLAAVVLGECVIYNKSSDSAKDAFAIVDMMSQKIGLSSYFLMFDEMQKSFAFANIESSLNLKSFTRSSAASMEDIADSDNNDLSEQKNMDHPILSSILDSYFVNLVKGLEADIREQIVEAFSHPKVQVAVVPAELEQKMGESDGEYIRRLKAFLEKQCSEIQDLLSRNASLAEDLARTGGGSNSQSEQRVSGSSDKVQINALSRDLQETSKRLEMLKAEKAEVESEARKNRTLAEKMEADLRSLSGAYNSLEQSNIEQEKQVKALKSGAPSTFLDLEAIKAEAREEAQKESEGELNDLLVCLGQEQSKVDRLSARLLELGEDVDKLLEGVGDDVGNVEDDEDDEGTE

SEQ ID NO: 157353 - protein, 595 aa, Glycine max
  Coding DNA Sequence Number=SeqID_40575
  Gene Ontology: Mol. function=RNA-directed DNA polymerase activity; Cellular component=chromatin; Biological process=chromatin assembly or disassembly
  Pfam annotation: Domain name=RVP_2; Domain location=272-395; Score= -36.3; E_value=0.00068; Accession=PF08284.2; Description=Retroviral aspartyl protease
MQNGTCEAYRVSREHDQGVRRLRYPSVSCLASVRLEANQQQPQSPPSSSAGHTPQTQTAFHRMKLDVPRFDGSDPTGWTFKITQFFEFHATPDHERLTIASFYMEGPALAWFQWMHRNAQLSSWSAFLHALHSRFATSTYEDPTGLLCKLQQRSSDSRVTGFVRLELLHLRIESNDSQRSTSLTIDIAGLGNILCTITGRKTSRCPPAAAVSSTSLHRISYHTFIIKQLYTNLATNTVMEDEDTMIEAESLRDYTPTQELLPELPPAQLSLHALSGHLAPETLRLKGFINDQPINILIDGGSTHNFLHNRVVLSLGLKSNEIAPLRVTMGNGEEIHCNQLCTTVQVHIQQHSFTIDFHVLPLCGVDVVLGVQWLKTLGPVLTDYGALTMKFITGGKLIELHGDREKGIEQVSPSQLRRFVYTNPTMTFFHIRVETATTHNSSPNHPLSAINRLISKYASLFQPPTTLPPSRSTYHTINLLPNSTPVNVRPYRYPYFQKKEIEEQVATMLAKRFIQPSSSSFSSPVLLVRKKDGSWRFCVDYRALNAITVCDRFPIPTVDELLDELGGARWFSKLDLMQGYHQILMNTSDICKIAF

SEQ ID NO: 157354 - protein, 227 aa, Glycine max
  Coding DNA Sequence Number=SeqID_40576
  Gene Ontology: Mol. function=nucleotide binding; Cellular component =nucleus; Biological process=small GTPase mediated signal transduction
  Homolog annotation: Hit_ID=P41916; Match level="QueryCoverage=92%, HitCoverage=99%, E-value=1e-107, Identity=86%"; Hit description=GTP -binding nuclear protein Ran-1
  Pfam annotation: Domain name=MMR_HSR1; Domain location=29-134; Score=- 11.6; E_value=0.012; Accession=PF01926.13; Description=GTPase of unknown function
  Pfam annotation: Domain name=Miro; Domain location=30-134; Score =55.1; E_value=2.4e-13; Accession=PF08477.3; Description=Miro-like protein
  Pfam annotation: Domain name=Ras; Domain location=30-179; Score =185.9; E_value=9.7e-53; Accession=PF00071.12; Description=Ras family
  Pfam module annotation: Pfam domain module=MMR_HSR1::Miro::Ras; Domain location=29-134::30-134::30-179
PIYNRKSKVQVEEVREALPNQQTVDYPSFKLVIVGDGGTGKTTFVKRHLTGEFEKKYEPTIGVEVHPLDFFTNCGKIRFYCWDTAGQENIHGQCAIIMFDVTARLTYKNVPTWHRDLCRVCENIPIVLCGNKVDVKNRQVKAKQVTFHRKKNLQYYEISAKSNYNFEKPFLYLARKLAGDTNLHFVESPALAPPEVQIDLAAQQQHEAELLAAASQPLPDDDDDQFE

SEQ ID NO: 157355 - protein, 414 aa, Glycine max
  Coding DNA Sequence Number=SeqID_40577
  Homolog annotation: Hit_ID=Q1ZY19; Match level="QueryCoverage=92%, HitCoverage=80%, E-value=1e-62, Identity=34%"; Hit description =Fgenesh protein 60
  Pfam annotation: Domain name=DUF247; Domain location=17-401; Score =382.3; E_value=7.4e-112; Accession=PF03140.6; Description=Plant protein of unknown function
MTNHDDIKAILEGAEAPVTDKCCIYRVPFHIRKFNDDAYTPKVVSIGPFHHKSHPRLQNMERHKLLYCKAFLERTQTSLDSWIRYIEEVEPDFRRCYSDTLEFSKKELVDIILVDSGFIIELFCRIISGTWSRDDRFLATPLLFTNIVQDLCLLENQLPFFVLEGLFNLSFASTSSGISFLELTLFYFDNYNRSNLVFNNNTNIRHFTDLIRTFHLQHPLNRRPSRTDTYVKHFPSATELLEAGVSFKVNIHSKCLLDLRFSEGVLQIPQLEVEDSTEILLRNMIALELCHYPYESYITDYAKVLDLLINTSRDVDVLVRKNVLVNWQEDNASVANLFNGLLKNVIRGNDNSHYLTICQDLNAFCKNPWNNSKSTLRQDYCKSPWQTAATIAGIVLLILSIIQTVCSVLQVIQQ

SEQ ID NO: 157356 - protein, 150 aa, Glycine max
  Coding DNA Sequence Number=SeqID_40578
  Gene Ontology: Mol. function=heat shock protein binding; Cellular component=integral to membrane
  Homolog annotation: Hit_ID=Q1T1K6; Match level="QueryCoverage=74%, HitCoverage=87%, E-value=9e-22, Identity=52%"; Hit description=Heat shock protein DnaJ, N-terminal
  Pfam annotation: Domain name=DnaJ; Domain location=11-77; Score=22.1; E_value=3.2e-05; Accession=PF00226.21; Description=DnaJ domain
MLLDKNDIQETHYEVLHVKEHANYEEIRASYRSVVLSLHPDKLLKTSKTSSSNQTTREISQSTEGVGDSVKDVLAADIAEDLSLRKDVLAADVAEDLSLQDMMIEDDGEALELVGSGISVLNADTLPGSVILPCGSCSLKARLLINMDAN

SEQ ID NO: 157357 - protein, 280 aa, Glycine max
  Coding DNA Sequence Number=SeqID_40579
  Gene Ontology: Mol. function=nucleotide binding; Cellular component =nucleus; Biological process=small GTPase mediated signal transduction
  Homolog annotation: Hit_ID=P41916; Match level="QueryCoverage=78%, HitCoverage=99%, E-value=1e-116, Identity=90%"; Hit description=GTP -binding nuclear protein Ran-1
  Pfam annotation: Domain name=Arf; Domain location=51-230; Score= -91.3; E_value=0.01; Accession=PF00025.11; Description=ADP -ribosylation factor family
  Pfam annotation: Domain name=MMR_HSR1; Domain location=73-187; Score=- 8.8; E_value=0.0063; Accession=PF01926.13; Description=GTPase of unknown function
  Pfam annotation: Domain name=Miro; Domain location=74-187; Score =53.4; E_value=7.4e-13; Accession=PF08477.3; Description=Miro-like protein
  Pfam annotation: Domain name=Ras; Domain location=74-232; Score =229.1; E_value=9.6e-66; Accession=PF00071.12; Description=Ras family
  Pfam module annotation: Pfam domain module=Arf::MMR_HSR1::Miro::Ras; Domain location=51-230::73-187::74-187::74-232
MTEVWQFWIWAGGATQQSGSCKERCRKDFGSGHRGVVQWCWRTGIGWRGILVKRSLRGVKALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQQHEAELLAAASQPLPDDDDESFE

SEQ ID NO: 157358 - protein, 67 aa, Glycine max
  Coding DNA Sequence Number=SeqID_40580
MESGRDEDLLKKEMVVVCGSKMPNMCDVKERRRKGHIASCKVLVMGLLPECGKQEEPIIFKDDVDSP

SEQ ID NO: 157359 - protein, 520 aa, Glycine max
  Coding DNA Sequence Number=SeqID_40581
  Gene Ontology: Mol. function=1-deoxy-D-xylulose-5-phosphate synthase activity; Cellular component=type II protein secretion system complex; Biological process=terpenoid biosynthetic process
  Homolog annotation: Hit_ID=Q1S421; Match level="QueryCoverage=99%, HitCoverage=73%, E-value=0.0, Identity=83%"; Hit description =Deoxyxylulose-5-phosphate synthase
  Pfam annotation: Domain name=Transket_pyr; Domain location=197-363; Score=145.7; E_value=1.3e-40; Accession=PF02779.14; Description =Transketolase, pyrimidine binding dom
  Pfam annotation: Domain name=Transketolase_C; Domain location=377 -500; Score=148.1; E_value=2.4e-41; Accession=PF02780.10; Description= Transketolase, C-terminal domain
  Pfam module annotation: Pfam domain module=Transket_pyr::Transketolase _C; Domain location=197-363::377-500
MAVARDIKGRRERVIAVISNWTTMAGQAYEAMSNAGYLDSNMVVILNDSRHSLLPKIEEGPKTFVNALSSTLSKLQSSKSFRRFREAAKGVTKRIGRGMHELAAKVDEYARGMMGPLGSTLFEELGLYYIGPVDGHNIEDLICVLQEVASLDSMGPVLVHVITDENQGDENSQKSDISDGQQDEGSVKSDSLDNPVRPQTYGNCFVETLVVEAEKDKDIVVVHAGLTMEPSLELFQEKFPDRFFDVGMAEQHAVTFASGLACGGLKPFCVIASSFLQRAYDQVVHDVDQQRIPVRFVITSAGLVGSDGPLQCGAFDINFMSCLPNMIVMAPSDEVELMHMVATATRINSQPICFRYPRGALVGRGYTISDGIPIKIGRGRVLVEGKDVAFLGYGSMVQNCLKAHSLLAKLGIEVTVADARFCKPLDIKLLRQLCKHHSFLVTVEEGSIGGFGSQVAQFIAVNGLLDGRIQWRPIVLPDRYIEHASPNEQLDQAGLSGHHIAATALSLLGRTREALLFMCS

SEQ ID NO: 157360 - protein, 694 aa, Glycine max
  Coding DNA Sequence Number=SeqID_40582
  Gene Ontology: Mol. function=inorganic anion exchanger activity; Cellular component=integral to membrane; Biological process=anion transport
  Homolog annotation: Hit_ID=Q1S420; Match level="QueryCoverage=98%, HitCoverage=99%, E-value=0.0, Identity=78%"; Hit description=HCO3 -transporter
  Pfam annotation: Domain name=HCO3_cotransp; Domain location=2-569; Score=-73.8; E_value=9.6e-14; Accession=PF00955.11; Description=HCO3- transporter family
MGAPFKGIIQDFKGRAQCYKQDWICALCSGVSILAPTFYIFFASALPVIAFGEQLNRDTDGTLSTVETLASTAICGVIHSILGGQPLLILGVAEPTVIMYTYLYSFCQKTPELGGKLFLPWAGWVCVWTGVFLILLAIFNACTIITRFTRIAGELFGMLITVLFFQEAIKGLIGEFNMPKNENPSSVEFQFQWLYTNGLLAIIFCFGLLVTALKSRRARTWRYGTGWLRGFIADYGVPMMVVLWTALSYTVPGKVPDGVPRRLISPLPWDAASLYHWTVVKVRVLGFNIVITSSDHFSLGKSKYLSNSYCKLQDMGKVPVVYIFGAIIPALMIAGLYFFDHSVASQMAQQKEFNLQKPSAYHYDVLLLGIMTLICGILGLPPSNGVLPQSPMHTKSLAVLRRRMIRKKVVKSAKECIKQRRTNSELYGKMQEVIVEMDTDPTVKELENLKEAVMQSDSKDGAKEKFDPEKHIDEYLPVRVNEQRMTNLLQSLLVAVSILAMSVIKRIPTSVLWGYFAYMAIDSLPGNQFWERILLLFVTSSRRYKILEGSHASFVETVPFKTIAAFTALQLVYFALCFGVTWIPIGGILFPVPFFLLIIIREHLLPKMFKPNHLQELDASGYEEIIGAPHGSLRDKEPDTDTDGSSEDFYDAEILDEMTTNRGELKLRTVSSFNDRNHSFSEDRHTQVYPGNAV

SEQ ID NO: 157361 - protein, 53 aa, Glycine max
  Coding DNA Sequence Number=SeqID_40583
MVFESVKRSEGFIVEGREIIFIPPPMSIAFRPPSVKHQIEIHWAIKRKYIWIL

SEQ ID NO: 157362 - protein, 102 aa, Glycine max
  Coding DNA Sequence Number=SeqID_40584
  Gene Ontology: Mol. function=DNA binding; Biological process=DNA integration
  Homolog annotation: Hit_ID=Q1SKC8; Match level="QueryCoverage=69%, HitCoverage=19%, E-value=5e-09, Identity=54%"; Hit description =Integrase, catalytic region
MTRSYKNRTSSQVNKCCFSIPDSGPFVIKEVRPHEVVELVDPTAGTPKKRRIVNGQHLKIYKGGQLERYQLTKPHISLSENKQSREEKQKFRNELAKHDPTR

SEQ ID NO: 157363 - protein, 292 aa, Glycine max
  Coding DNA Sequence Number=SeqID_40585
  Subcellular localization annotation: CTP_CleavageSite=99; ConfidenceScore=5.43e-01
MGPKSAAAKSAMMSSPTSASIVSLTSEGLSPPSVEGWTPGQATYWMKAFGLAVTGSSPGGASGVAALARARQGPGKVMDKSMWFQQFFFMKAKLITGLSDSKVKAIYVICHEIKLPRSFYNTFRGAPLVFKMNPPPVRWIFFSVNKDDGASKKSLMVSPSNDNMPPHLAIVWSIILWVIDVGVEFFDQSNVYLLFWEPSEYPVPLPLLELSVKFIKHACGELYVPFHGRNPSWIPLLEWALIVVSVRPYEKMKIRLVSFSMSYALSEFILLHEHATARLARLAIFFCCNELT

SEQ ID NO: 157364 - protein, 100 aa, Glycine max
  Coding DNA Sequence Number=SeqID_40586
MAHKLGVIDNGGSREVALAHNGLVSKFGRVVAQLWLIVAQVADLRERSRLVRVVALAHDGSSSVRDEDSRKVERMRDEKWQCLNGSTTAQKEEKRVTPIG

SEQ ID NO: 157365 - protein, 93 aa, Glycine max
  Coding DNA Sequence Number=SeqID_40587
MSWKKSGNGISFVLDQLMKKRKNEHECFKTTKKCRMLFESTMKIEGIEDVRLGKIAFLIGHYENFNMKEGETVDEMFRRFQTILNDGLGKVAL

SEQ ID NO: 157366 - protein, 1423 aa, Glycine max
  Coding DNA Sequence Number=SeqID_40588
  Gene Ontology: Mol. function=nucleoside-triphosphatase activity; Cellular component=integral to membrane; Biological process=transport
  Homolog annotation: Hit_ID=Q76CU2; Match level="QueryCoverage=97%, HitCoverage=96%, E-value=0.0, Identity=53%"; Hit description =Pleiotropic drug resistance protein 1
  Pfam annotation: Domain name=ABC2_membrane; Domain location=1147 -1365; Score=172.0; E_value=1.5e-48; Accession=PF01061.14; Description=ABC-2 type transporter
  Pfam annotation: Domain name=ABC2_membrane; Domain location=538-751; Score=199.7; E_value=7e-57; Accession=PF01061.14; Description=ABC-2 type transporter
  Pfam annotation: Domain name=ABC_tran; Domain location=234-436; Score= 10.5; E_value=2e-08; Accession=PF00005.17; Description=ABC transporter
  Pfam annotation: Domain name=ABC_tran; Domain location=926-1129; Score=78.3; E_value=2.4e-20; Accession=PF00005.17; Description=ABC transporter
  Pfam annotation: Domain name=PDR_assoc; Domain location=756-820; Score=133.9; E_value=4.5e-37; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1147 -1365::538-751::234-436::926-1129::756-820
MESGELRVASARIGSSSVWRSSGGVDVFSGSSRRDDDEQELKWAAIEKLPTYLRMTRGILTEAEGQPTEIDINKLCPLQRKNLVERLVKIAEQDNEKFLFKLRDRIDSVGLEIPAIEVRFEHLNVEAEAHVGSRALPTIFNFCINLLEGFLNSLHLIPSRKKPFTVLDDVSGIIKPKRMSLLLGPPSSGKTTLLLALAGRLGKDLKVRAYEICFCFNNFTDELESESFKAYDSFNSIADELQFSGRVSYNGHGMEEFVPQRTSAYISQTDLHIGEMTVRETLAFSARCQGIGTRNEMLAELSRREKAANIKPDPDLDIYMKAAALEGQETNVVTDYIMKILGLEICADTMVGDDMIRGISGGQKKRVTTGEMLVGPARALLMDEISTGLDSSTTFQMVNSLRQSIHILNGTAVISLLQPAPETYELFDDIILLSDGQIVYQGPRENVLEFFEYMGFKCPERKGVADFLQEVTSRKDQEQYWANKDEPYSFVTVKEFAEAFQSFHVGRKLGDELATPFDMSKGHPAVLTKNKYGVCKKELLKACVSREFLLMKRNSFVYIFKMWQLILTGFITMTLFLRTEMHRDTETDGGIYMGALFFVLIVIMFNGYSELSMSIMKLPVFYKQRDLLFFPCWAYSLPTWILKIPITLVEVGIWVVMTYYVIGFDPSIERFIKQYFLLVCINQMASGLFRFMGAVGRNIIVANTVGSFALLAVMVMGGFILSRVDVKKWWLWGYWFSPMMYGQNALAVNEFLGKSWSHVPPNSTEPLGVKVLKSRGIFPEAYWYWIGVGASIGYMLLFNFLFPLALHYLDPFGKPQALISEEALAERNAGRNEHIIELSSRIKGSSDRGNESRRNMSSRTLSARVGSIGASEHNKKRGMVLPFTPLSITFDEIRYSVEMPQEMKSQGILEDRLELLKGVNGVFRPGVLTALMGVSGAGKTTLMDVLSGRKTAGYVQGQITISGYPKKQETFARIAGYCEQTDIHSPHVTVYESLVYSAWLRLPPEVDSVTRQFFIGCALVPHKNCARAHAHMFIEEVMELVELTSLREALVGLPGVNGLSTEQRKRLTIAVELVANPSIIFMDEPTSGLDARAAAIVMRTVRNTVDTGRTVVCTIHQPSIDIFDAFDERGGEEIYVGPLGQCCSQLINYFEGINGVPKIKKGYNPATWMLEVTSEAQEAALGLNFAEIYKNSDLYRQRKQDLFNAMGSMYAAVLFIGIQNATSVQPVVAIERTVFYRERAAGMYSALPYAFGQVAIEIPYIFIQTLVYGVIVYAMIGFDWTFSKFFWYLFFMFFTFLYFTFYGMMAVGLTPDHNVATIVSFGFYMIWNLFSGFVIPRTRMPVWWRWYFWICPVSWTLYGLVTSQFGDIKERIDTGETVEEFVRSYFGYRDDFVGVAAAVLVGFTLLFGFTFAFSIKAFNFQKR

SEQ ID NO: 157367 - protein, 91 aa, Glycine max
  Coding DNA Sequence Number=SeqID_40589
RTYSTVNSQSSDPDSELSVINNQIIAIEVFFADNVLRALYVCEERTITTISTVWFVLHVPREAQVVAVQLWLSVMQLPNKKVHTRAPTRHN

SEQ ID NO: 157368 - protein, 45 aa, Glycine max
  Coding DNA Sequence Number=SeqID_40590
MGWFVKQGKTRAAHRVVVEEAGTLFTGLQTVGGIVCGVSHTPFCI

SEQ ID NO: 157369 - protein, 245 aa, Glycine max
  Coding DNA Sequence Number=SeqID_40591
  Gene Ontology: Mol. function=DNA binding
  Homolog annotation: Hit_ID=Q1SP03; Match level="QueryCoverage=93%, HitCoverage=40%, E-value=2e-26, Identity=33%"; Hit description=IMP dehydrogenase/GMP reductase
MRTNQSGKRFYQVKIKGLDVTSLKELGRLMGPLQMQAFRKAYGKILDLTIAEIFTEAVVSLTQYYDQPLRCFMFGDFQLVPTVEEFEEILGCALGGRKPYLFSRFLPSLSKITVVVRDSASELDRVKQTQNDVVGLPRKYLEGKARDMANQEEWVPFMDVLALLIFGVVLFPNVDGLVDLGAIDAFLAYHHSKESPVVAILANLFDTFDQRCEKSSARIICCLPALCVWLVSHLFQQDIRHPCPL

SEQ ID NO: 157370 - protein, 144 aa, Glycine max
  Coding DNA Sequence Number=SeqID_40592
  Homolog annotation: Hit_ID=Q1RXS1; Match level="QueryCoverage=44%, HitCoverage=16%, E-value=7e-07, Identity=39%"; Hit description=Zinc finger, CCHC-type; Peptidase aspartic, catalytic
  Pfam annotation: Domain name=zf-CCHC; Domain location=88-105; Score =14.3; E_value=0.0043; Accession=PF00098.13; Description=Zinc knuckle
MSHHSSSVNGEGTSHKDPLSKILEDLSSLKLWKEKLERKEKGKERSFPKKDQGEGILGVAPSKPKDDKGKTTEKQLPKASMQEKTSSIKYFKCLGRGHITSQCPTKKTMIMKGQDIYSSQDEATTSPSSSESEEAKGEESNEEI

SEQ ID NO: 157371 - protein, 217 aa, Glycine max
  Coding DNA Sequence Number=SeqID_40593
MAHEVEDDSHQKSGEMTSEVASEIADRIDSLEERYNPRCSPDAITYAIPGTRTASATYVSIKGSCVDPSEQDPDTSKSDKYGLYVDNNPPHLVALRRVYEGLTTVHNVPLGNDRVKVSVEEVRDADACILVPTQKDKLRAKGPAKPVDRPKPDDDPLYQMTLMILELFLKPMQVSLDSTVFGVYNDNVLLYIKHEDLSEIAHSDQCLNISIIQIWIL

SEQ ID NO: 157372 - protein, 304 aa, Glycine max
  Coding DNA Sequence Number=SeqID_40594
  Homolog annotation: Hit_ID=Q9M112; Match level="QueryCoverage=21%, HitCoverage=8%, E-value=1e-18, Identity=73%"; Hit description =Putative GTP pyrophosphokinase
MGTSSLLVSDLYCTLYHMMPHDLKHAISYLPPKELKLVYNAFMELDWESIAPGLLHDIVEDTNVTFERIKEEFGATVRHIVEGETKVLIILESSSKRITSNLKSSITLWKDRLSYHQPSPYAENSENTTYHEPSSYAWNSSNTAYYQPSTYARSSKNTCHQHKRQPTYIVDNFSSLDKVHESKIDDLNKEAIPKAKDVVRIDLVGGYAMQKVTLERSYFRESAIEYTDDEDVSWKVQRVAAKCLVALIVSRPKILSKLYDEACPKLIDRFKERGKNVKWEASNTSISSLGSYFNDLLQTLPLAV

SEQ ID NO: 157373 - protein, 95 aa, Glycine max
  Coding DNA Sequence Number=SeqID_40595
  Gene Ontology: Mol. function=transition metal ion binding
VSKKPLYPGCKKSLTLLSVVLSLVNVKARYEWSNKSFTSLLQYQKIHACPNDCILYIHEFEEMHKCPKCRVSWYKVNDDDECSNDESIKKDPPMK

SEQ ID NO: 157374 - protein, 53 aa, Glycine max
  Coding DNA Sequence Number=SeqID_40596
MVLQEIEKGEKNEGSMESILALPVNKAIKHKATMGMYNSLQRSVSWSIGLSRS

SEQ ID NO: 157375 - protein, 140 aa, Glycine max
  Coding DNA Sequence Number=SeqID_40597
MGKVEEVQEKVKADMEAMATMMEAMMSMKKIMEANAVAVAATSAVTKVNLMPPSDLNQMNHPTSDMVGKDLGSTDDPMMCKFKTSTSSHHMACHPTIHHPLWRTLPIRMSITPLLYSLRANNPKLIMHPWVRHIKCPTTI

SEQ ID NO: 157376 - protein, 41 aa, Glycine max
  Coding DNA Sequence Number=SeqID_40598
MVRQCKERPRSEISKRLPVHTGGQFTKDASSTSNSYSRKGI

SEQ ID NO: 157377 - protein, 178 aa, Glycine max
  Coding DNA Sequence Number=SeqID_40599
MEAMKDQMTTMMKAMMSVRKMMEVNAAAVTATSAAIEVDLTHPSGINQVNRPVLDMVDQGGEALGSMGGPHFVQSSHAHVPQPMGETHEVPRDHTLAEFEPHVGYAIKGQAFGGVPLPNALGGPQYRPQPQLQPLHFTMGRLPPAMVEREKFDHIEERIRTIEGGGDYPFVNMAKLCL

SEQ ID NO: 157378 - protein, 63 aa, Glycine max
  Coding DNA Sequence Number=SeqID_40600
MTAMNLGLRYPLYRKSSWRWVQATCPADGAAVQVPQVAKACDDMSVIERDDVILRLSRHHLTE

SEQ ID NO: 157379 - protein, 941 aa, Glycine max
  Coding DNA Sequence Number=SeqID_40601
  Gene Ontology: Mol. function=DNA binding; Cellular component=nucleus; Biological process=multicellular organismal development
  Homolog annotation: Hit_ID=Q1SFF6; Match level="QueryCoverage=99%, HitCoverage=100%, E-value=0.0, Identity=72%"; Hit description =Lissencephaly type-1-like homology motif; Single-stranded DNA -binding protein, SSDP; WD40-like
  Pfam annotation: Domain name=LisH; Domain location=10-36; Score=34.9; E_value=2.9e-07; Accession=PF08513.1; Description=LisH
  Pfam annotation: Domain name=SSDP; Domain location=72-338; Score =194.2; E_value=3e-55; Accession=PF04503.4; Description=Single -stranded DNA binding protein, SSDP
  Pfam annotation: Domain name=WD40; Domain location=622-660; Score =27.7; E_value=4.2e-05; Accession=PF00400.22; Description=WD domain, G-beta repeat
  Pfam annotation: Domain name=WD40; Domain location=664-702; Score =50.8; E_value=4.7e-12; Accession=PF00400.22; Description=WD domain, G-beta repeat
  Pfam annotation: Domain name=WD40; Domain location=742-781; Score =35.3; E_value=2.1e-07; Accession=PF00400.22; Description=WD domain, G-beta repeat
  Pfam annotation: Domain name=WD40; Domain location=824-861; Score =39.4; E_value=1.3e-08; Accession=PF00400.22; Description=WD domain, G-beta repeat
  Pfam annotation: Domain name=WD40; Domain location=903-941; Score =30.7; E_value=5.1e-06; Accession=PF00400.22; Description=WD domain, G-beta repeat
  Pfam module annotation: Pfam domain module=LisH::SSDP::WD40::WD40::WD4 0::WD40::WD40; Domain location=10-36::72-338::622-660::664-702::742 -781::824-861::903-941
MSQTNWEADKMLDVYIHDYLVKRDLKASAQAFQAEGKVSSDPVAIDAPGGFLFEWWSVFWDIFIARTNEKHSEVAASYIETQLIKAREQQQQQNQQQPQPQQSQHQQQQQQQHMQMQQLLLQRAQQQQQQQQQQQQQQQQQQQQQQQQQQQQQQQQPQSQQQQSQPQQQQSRDRAHLLNGSANGLVGNPGTANALATKMYEERLKLPLQRDPLDDAAMKQRFGENMGQLLDPNHASILKSAAAPGQPSGQVLHGAAGGMSPQVQARTQQLPGSTLDIKGEISPVLNPRAAGPEGSLMGMPGSNQGSNNLTLKGWPLTGLEQLRSGLLQQQKPFMQAPQPFHQLQMLTPQHQQQLMLAQQNLASPSASEESRRLRMLLNNRNIGLNKDSLSNPVGDVVSNVGSPLQGGGPPFPRGDTDMLMKLKLAQLQQQQQQSSTNAQQQQLQQHVLSNQQSQTSNHSMHQQDKVGGGGGSVTVDGSMSNSFRGNDQVSKNQIVRKRKQPGSSSGPANSSGTANTTGPSPSSAPSTPSTHTPGDVISMPALPHSGSSSKPLMMFSTDGTGTLTSPSNQLWDDKDLELQADVDRFVEDGSLDENVESFLSHDDTDPRDTVGRCMDVSKGFTFSDVNSVRASTSKVACCHFSSDGKLLASGGHDKRVVLWYTDSLKQKATLEEHSSLITDVRFSPSMPRLATSSFDKTVRVWDVDNETVLYILTGLICVSVVEVPRCGFTVLYYYCYVAHMPGYSLRTFTGHSTSVMSLDFHPNKDDLICSCDGDGEIRYWSINNGSCARVSKGGTTQMRFQPRLGRYLAAAAENIVSIFDVETQACRYSLKGHTKPVDCVCWDPSGELLASVSEDSVRVWTLGSGSEGECVHELSCNGNKFHASVFHPTYPSLLSLELWNMSENKTMTLSAHDGLITSLAVSTVNGLVASASHDKFLKLWK

SEQ ID NO: 157380 - protein, 50 aa, Glycine max
  Coding DNA Sequence Number=SeqID_40602
MACTGSVGSLDLSGVLLFHASRIYLEVPKQHLMMQVNSYGMSILDGVRFS

SEQ ID NO: 157381 - protein, 74 aa, Glycine max
  Coding DNA Sequence Number=SeqID_40603
MDKIKYNPEMQNGAVDGWEVISEKIPRMVQRDNLFDMFVMTTVKKKPDLRRIQGELGNMLGMQLQEKTLEGRAT

SEQ ID NO: 157382 - protein, 65 aa, Glycine max
  Coding DNA Sequence Number=SeqID_40604
MATSLARPLCMRHVAVTLLSLATPVSIATCNGALAMQGGVAAFQLYGSSFSAMAVWEKAQLRLVI

SEQ ID NO: 157383 - protein, 316 aa, Glycine max
  Coding DNA Sequence Number=SeqID_40605
  Gene Ontology: Mol. function=oxidoreductase activity; Cellular component=cytoplasm; Biological process=flavonoid biosynthetic process
  Homolog annotation: Hit_ID=Q1SFF5; Match level="QueryCoverage=91%, HitCoverage=98%, E-value=1e-103, Identity=64%"; Hit description=2OG -Fe(II) oxygenase
  Pfam annotation: Domain name=2OG-FeII_Oxy; Domain location=166-267; Score=84.8; E_value=2.6e-22; Accession=PF03171.10; Description=2OG -Fe(II) oxygenase superfamily
MESESEIMMIPCFDFGKALEEGSEEWKEMSKKVREACESHGCFLLVCDHEIIPKGVHEQFFSNMEALFDLPEETKMKHISPKPYSSYNGKSPVIPLSETFGIDDVPLSASAEAFTYLMWPQGNPSFCETLKIMSLKMLELSSLVLKMIVGGYGIQQHYVDVEKMKSSSNSRLIKYKVPENNNDSKTALLPHTDKNALTILCQNEVQGLQVLSKTGNWIELKIPQNGFVVIVGDILKAWSNGRLHAATHRVVMNGNKERYSFGLFAMPMEEMDIEVPLELVDEKIHPLRYHPFKYGEYTSYFVSNLKENALEVFAGL

SEQ ID NO: 157384 - protein, 324 aa, Glycine max
  Coding DNA Sequence Number=SeqID_40606
  Gene Ontology: Mol. function=oxidoreductase activity; Cellular component=integral to membrane; Biological process=flavonoid biosynthetic process
  Homolog annotation: Hit_ID=Q1SFF5; Match level="QueryCoverage=87%, HitCoverage=97%, E-value=5e-95, Identity=59%"; Hit description=2OG -Fe(II) oxygenase
  Pfam annotation: Domain name=2OG-FeII_Oxy; Domain location=175-276; Score=83.7; E_value=5.8e-22; Accession=PF03171.10; Description=2OG -Fe(II) oxygenase superfamily
QSAAGERGNMESESEVTMIPCFDFCKALEEGSEEWKEMSKKVREACESHGYFLLMCDEIIPESVREEMFDGMKELFDLPEETKQQHICQKPYRGYIGKNSIIPLCESFGVDDAPFSATAEALSNLMWPQGNPHFCETLKTMSLKMLELSFIVMKMIVEGYDLPQHYILDVKNMKSSSYSRLIKYKVPESNNDLETALPPHTDNSAITILCQHKVQGLQVLSKIGKWIELEIPQDGFVVIVGDILKAWSNGRLHAVTHRVALSGGNERYSFGLFAMPKEEMDIEVPPELVDDQIHPLRYRPFNYGEYFNYFVSNPREALEVFACL

SEQ ID NO: 157385 - protein, 953 aa, Glycine max
  Coding DNA Sequence Number=SeqID_40607
  Gene Ontology: Mol. function=RNA-directed DNA polymerase activity; Cellular component=chromatin; Biological process=chromatin assembly or disassembly
  Pfam annotation: Domain name=Chromo; Domain location=903-953; Score =30.4; E_value=6.5e-06; Accession=PF00385.14; Description='chromo' (CHRromatin Organisation MOdifier
  Pfam module annotation: Pfam domain module=Chromo::RVT_1::Retrotrans _gag; Domain location=903-953::327-519::60-151
MINPSEDDGASCDRFTHYAGYTRLSRIEFPRFNGDNVKEWLYQCETYFLMDETPPEVKTKLAIMHLEGKALKWHHASRKILWSQHLPSWEEYVQFLTERFGNACDDPMVKLMNLREKGTISEYHEQFDAIMTRLYLPVNYSLSCFLGGLKTEGAATQFEEAQIFVNALIGVPNFKTMRVTWRYNKKPLHILIDNGSTHNFWDVHVAARIRCKIEDLKLLVVTVADGTKVQISSVVRNFTWVIQHTTFTSDVMLIPLGCCDIVLGIEWLITLWEITWNFTELNMEFMVQGRRHVIRGMEGGVLQALTTHATKVDIPTTIEQILCQYADVFVTPTQLPPSRGEHDHIIPLLQSAEQVNKRPYRDLNKNTIKGRFPIPLVEDLMDEFHESTIFSKIDLRAGHHQVKMHTADIYKTTFRTHNGHFEYLVMPFGLTNAPATFQNLMNTIFQEFLRKFVLVFFYDILIYSQSLDEHLQHLHKVEYLGHVISTEEVSTNPAKIVAVQNWPMPATLKQLRGFLGLAVAKIAFQQLKESLTSAPALAMPNFTQIFVIEVDASGQGIGVVLMQQHHPIAFISRMLNQQQQALSTYEKELLAVVFAVQKWRHYLLSRPFVIRTDHRSLKYMLEHILTTTFQQKWLVKLMKFKFSIEYKQGKENVAVDALSSTWVSDASLATIIAALKENNSSHKHYTWLNGQLRRKGRLVVGKDLQLRQELLHWFHNSAPGGHSGRTTTCKRIQGFNLPQEILAGINGILGCMCVDSPQQWPKWLPLAKWWYSTTFHSAIQTTPYEVVYGQPPPIHLPYLPGESKVADKHRSDRQFSIGDLVYVKLQAYKQVPIAARANKKLAPKYFGPYPVISRIGVVAYELKLLDHTKIHNVFHVSQLKKHIGQFIHSLTLPDFIPEATGPKEPAAILDRMTAKRRGQAVTKVLIQWKHQLPYDATWEFYYDLKRRFPQFDS

SEQ ID NO: 157386 - protein, 353 aa, Glycine max
  Coding DNA Sequence Number=SeqID_40608
  Gene Ontology: Mol. function=binding; Cellular component=lysosome; Biological process=transport
  Homolog annotation: Hit_ID=Q2QX93; Match level="QueryCoverage=98%, HitCoverage=47%, E-value=1e-134, Identity=65%"; Hit description=WD repeat domain 48, putative, expressed
  Pfam annotation: Domain name=WD40; Domain location=21-59; Score=18.9; E_value=0.019; Accession=PF00400.22; Description=WD domain, G-beta repeat
  Pfam annotation: Domain name=WD40; Domain location=63-98; Score=2.8; E_value=17; Accession=PF00400.22; Description=WD domain, G-beta repeat
  Pfam module annotation: Pfam domain module=WD40::WD40; Domain location=21-59::63-98
MGFCISGSSDSMIRLWDLGQQRCVHSYAVHTDSIWALASTSTFSHVYSGGRDSSLYLTDLQTRESVLLSTGENPILQLALHDDSIWVASTDSSVHRWPAEGRNPQKIFHRGNLSFSRARVSLEGSTLVPVYKQPTLTIPGIPSIVQHEVLNNRRHVLTKDTSGSVKLWEITKGVVVKDFGKVSFEEKKEELFEMVSNIPAWFTVDTRLGCLSVHLDTPQCFSGEMYSADLNIVGKPEDDKVNLAQETLKGLLANWLIKRKQRMGTPAPPYDNAELLSGSVTHSRTELDGSSETEIMVYPPFEFSDVSPPSIITEGTHGGPWRKKMSDLDGTEDEKDFPWWCLDSVLNNRLPSF

SEQ ID NO: 157387 - protein, 273 aa, Glycine max
  Coding DNA Sequence Number=SeqID_40609
  Gene Ontology: Mol. function=protein serine/threonine kinase activity; Cellular component=lysosome; Biological process=protein amino acid phosphorylation
  Homolog annotation: Hit_ID=Q2QX93; Match level="QueryCoverage=99%, HitCoverage=35%, E-value=1e-86, Identity=59%"; Hit description=WD repeat domain 48, putative, expressed
  Pfam annotation: Domain name=WD40; Domain location=116-155; Score =36.8; E_value=7.4e-08; Accession=PF00400.22; Description=WD domain, G-beta repeat
  Pfam annotation: Domain name=WD40; Domain location=209-247; Score =23.8; E_value=0.0006; Accession=PF00400.22; Description=WD domain, G- beta repeat
  Pfam annotation: Domain name=WD40; Domain location=25-68; Score=12.8; E_value=1.2; Accession=PF00400.22; Description=WD domain, G-beta repeat
  Pfam annotation: Domain name=WD40; Domain location=74-111; Score =28.8; E_value=1.9e-05; Accession=PF00400.22; Description=WD domain, G-beta repeat
  Pfam module annotation: Pfam domain module=WD40::WD40::WD40::WD40; Domain location=116-155::209-247::25-68::74-111
MHRVGSVGNTNNSTRPRKEKRLTYVLNDSDDKRHCAGINCLSVLKSTTFDGSGYLFTGSRDGKLNRWALADDMPSCSATFESHVDWVNDVVLVGDNVLVSCSSDTTLKTWNALSTGTCTRTLRQHSDYVTCLAVAEKNSNVVASGGLGGEIFIWDIEAALASATKCNDPMDDDDNSNDINVSGNSLPMTSLHTISSSNSMSMHTTQSQGYNPIIAKGHKESVYALAMNEGGTLLVSGGTEKVLRIWDPRSGSKTLKLKGHTDNIRALLLDSTG

SEQ ID NO: 157388 - protein, 194 aa, Glycine max
  Coding DNA Sequence Number=SeqID_40610
MVCHAENTIEVDECRTLIDALSGNLDELNQQKMNVVKQLYILQERINKEGADSAAQKLVSLLTSLKDLKKQENYFQSNRDTKHSELQDDISELERKITNDCDTENLPDELYHSFSELIEKVNLMKKFQEAFSSTDGRIKLVHSMEGIVKGNQQKLERVHVGLQDEEKICNDLKYRYAAATGEQKRCYSLLKAFQ

SEQ ID NO: 157389 - protein, 342 aa, Glycine max
  Coding DNA Sequence Number=SeqID_40611
  Gene Ontology: Mol. function=protein serine/threonine kinase activity; Cellular component=membrane; Biological process=protein amino acid phosphorylation
  Homolog annotation: Hit_ID=Q1PCG0; Match level="QueryCoverage=85%, HitCoverage=77%, E-value=1e-142, Identity=91%"; Hit description =Mitogen-activated protein kinase
  Pfam annotation: Domain name=Pkinase; Domain location=27-281; Score =145.4; E_value=1.5e-40; Accession=PF00069.15; Description=Protein kinase domain
  Pfam annotation: Domain name=Pkinase_Tyr; Domain location=22-275; Score=144.7; E_value=2.5e-40; Accession=PF07714.7; Description =Protein tyrosine kinase
  Pfam module annotation: Pfam domain module=Pkinase::Pkinase_Tyr; Domain location=27-281::22-275
MVPRLCQAHLTKNFTFLHVIYIHKDSEVCLVVVGEAPCSYGEVYHADWNGTEVAVKKFLDQDFSGAALSEFKREVRIMRRLRHPNIVLFMGAVTRPPNLSIISEYLPRGSLYRILHRPNCQIDEKRRIKMALDVARGMNCLHTSTPTIVHRDLKSPNLLVDKNWNVKPKAENETQVCDFGLSRLKHNTFLSSKSTAGTPEWMAPEVLRNEPSNEKCDVYSFGVILWELATLRLPWSGMNPMQVVGAVGFQNRRLDIPKEVDPIVARIIWECWQHFQFMTFFWPPSPFQGSKFAALVCATHSGSKASTASGYPILSRSVSSTYAAGDFCKFHPLKCLASSVNN

SEQ ID NO: 157390 - protein, 59 aa, Glycine max
  Coding DNA Sequence Number=SeqID_40612
MVKKELLPQRMHSKIQDARSNCNHSSRRCIVEVVHFFKREQHIDDEFYKELRKILKSKY

SEQ ID NO: 157391 - protein, 90 aa, Glycine max
  Coding DNA Sequence Number=SeqID_40613
MSEYTVSKARKNFFRESAQKNLLLQLKLTTAEEPSSVHSCGRTSSRNLLPCIFAEEVLPQECTEEGSSVVNVTISEEPSSAVENNNCRRR

SEQ ID NO: 157392 - protein, 361 aa, Glycine max
  Coding DNA Sequence Number=SeqID_40614
  Gene Ontology: Mol. function=protein serine/threonine kinase activity; Cellular component=membrane; Biological process=protein amino acid phosphorylation
  Homolog annotation: Hit_ID=Q76BL0; Match level="QueryCoverage=94%, HitCoverage=35%, E-value=1e-107, Identity=59%"; Hit description =Enhanced disease resistance 1
MSERVKKEKQTGEKRERMKNIFKKLHIGSSHDPHRSNEASPSVPSPSCVADQSQSSAATPASPSSASASASTVVVTPGGGGGGASPVMNRQDFFSSEEEFQVQLALAISASNSEFREDPEKDQIHAATLLSLGGHRIDSARNKDDVAEALSRQYWEYNVLDYEEKVVDGFYDVYGPYNDSVMQGKMPSRTDLEANPGGSELVIVNRTIDPSLEELIQIAQCIALDCPVSSLVQRLAELVTSHMGGPVKDASIMLARWTETRAELKTSLHTIVLPLGSLNIGLSRHRALLFKVLADNINMPCRLVKGSHYTGVEDDAVNIIKLEDEREFLVDLMAAPGTLIPADILSTKDSAFKPYNPKIWP

SEQ ID NO: 157393 - protein, 304 aa, Glycine max
  Coding DNA Sequence Number=SeqID_40615
  Pfam annotation: Domain name=Zim; Domain location=279-304; Score=8.3; E_value=0.065; Accession=PF06200.4; Description=ZIM motif
  Subcellular localization annotation: CTP_CleavageSite=43; ConfidenceScore=5.13e-01
MAQPHNGNTNSTANQQLVLHDFLGMKPAADSPQTADVRFPEPSASASSAGGRGPFSATSDIASEKQIGNHLEGVPFYGPRSDFSGTEISNRLVGNKRSNSDSTFMGSSRDALQMVPDSFQNSHLMKVLRSAAEGERSQRPNDDEVLLGMQSMKPSSSQIFQPPTSTKIDANKWERSILMNVGPSMQHPLRGAQLAPFVHQMASSKIRDSNAGPSFISQSAADEGSRTGIKGPGILSSINAAATATEKTIPSAVMLGGSRPKPGTNIIESSTPPSSQHGLTSACRQMTIFYGGQAHVFDDVHPHK

SEQ ID NO: 157394 - protein, 106 aa, Glycine max
  Coding DNA Sequence Number=SeqID_40616
MDVNTMLMSNDRFSCVGPIELLCTVGRTLDEILNLLERTMTPTHDAILYYNGRWNMPHQNNFVGYTFTGKIPQKFDITKGCAIDELKDLMKQVAPKGIPPHRIHES

SEQ ID NO: 157395 - protein, 80 aa, Glycine max
  Coding DNA Sequence Number=SeqID_40617
  Homolog annotation: Hit_ID=Q1SHW6; Match level="QueryCoverage=60%, HitCoverage=7%, E-value=2e-16, Identity=87%"; Hit description=AAA ATPase; DEAD/DEAH box helicase, N-terminal
MEEKKDGEDSTFNKGEAEVTMAHAKRLVQSGVLPPDIGIITPYAAQVVLGFVENGAANVAVVIKEHEAVNYQLESNELER

SEQ ID NO: 157396 - protein, 287 aa, Glycine max
  Coding DNA Sequence Number=SeqID_40618
  Gene Ontology: Mol. function=protein binding; Cellular component =cytoskeleton; Biological process=regulation of transcription, DNA -dependent
  Homolog annotation: Hit_ID=Q5NBI2; Match level="QueryCoverage=71%, HitCoverage=43%, E-value=6e-65, Identity=61%"; Hit description =Putative actin-related protein 6
  Pfam annotation: Domain name=Actin; Domain location=3-217; Score= -88.8; E_value=1.3e-09; Accession=PF00022.9; Description=Actin
KSGKENLFRCTYVLPDGVTYTKGFVKYPDQAQRYLALREGGLHSSSPVQAQEDVNFTEIAEHPENRKRVDLTKNEFDLTNERFLVPEMIFRPADLVGCSLICKMLRKRFAGMNQAGLAECIVRAVNACHPHLRPVLYESIILTGGSTLFPQFAERLEKELRPLVPDDYRVKITTQEDPILGVWRGGSLLASSPDFEAMCVTKSEYEELVDEIHKDVTFFYLFHFPIPTSSSQANATLERRSEDHGLLVQEVCKWRILIEPTVRHCTVQRMFCPHLSNGFLHGTKAYW

SEQ ID NO: 157397 - protein, 33 aa, Glycine max
  Coding DNA Sequence Number=SeqID_40619
MASQYEVPAATALHLCKFQSHGLEASVLLEQIS

SEQ ID NO: 157398 - protein, 222 aa, Glycine max
  Coding DNA Sequence Number=SeqID_40620
  Gene Ontology: Mol. function=nucleic acid binding; Biological process= DNA integration
  Homolog annotation: Hit_ID=Q1S7C5; Match level="QueryCoverage=99%, HitCoverage=27%, E-value=2e-11, Identity=50%"; Hit description =Integrase, catalytic region
MLEDKSMCEFLLRIKAISDSLASVGSPISLQEHTDALLEGLPQDYHSVISVIESKFQPLPIEEVELWSLMEVLTETAVVVVVAAVVAMEEDALQIFNVNYQLNLSFTLHDPSNQGNVQTKSFGQNQYFQGNSNNSGQNNYGQNNGFRSSNSWNQGTNQNASMLNNQSQQPPSAMIANSNFQLGPDQIYIGNGHGLPINSTGSSTFTSPISPKVSLSLNQLLH

SEQ ID NO: 157399 - protein, 615 aa, Glycine max
  Coding DNA Sequence Number=SeqID_40621
  Gene Ontology: Mol. function=triacylglycerol lipase activity; Biological process=lipid metabolic process
  Homolog annotation: Hit_ID=Q1S9M3; Match level="QueryCoverage=99%, HitCoverage=99%, E-value=0.0, Identity=58%"; Hit description=Lipase, active site
  Pfam annotation: Domain name=Lipase_3; Domain location=49-204; Score =69.4; E_value=1.1e-17; Accession=PF01764.16; Description=Lipase (class 3)
MAVGSLGDNIGLKEEFITNVCGLAFQANMSPENLYHFHEIEIFSEIYHVFSFSGSWNPHEWLVNNKPFGETKIDHALFPSLRSIGNDEAALVNEGFAKRFDLILKTSSIKSEVNKAMVDGKQVVFTGHSSGAAIAILATFWALEEYLNPTKPQNLKHPFCVTFGSPLIGNHIFSHSSRRENWSHYFIHFVLRYDIVPRILLAPFSSVGQTFSSILQILDPNFETSTQDPTRNCVISQFYSTVMTNAATVTSHAAGILMGSTNMLLETVTNFVDLSPYRPFGTYVFCNGNGQLIVVKNSDAVLQLLFHTAQLSNFAELEEVANNSILQHLNYVAELQESLGMQNVVYLEQLEQLPLSADGSNSDVATALDGLGLSPRARLCLRAAANLATRKLDNEDKIKQKKVFIEQKMKDLKKYREMWEHQNVGFYDGFREHKKKEDFKANVTRLELASVWDEIMEKLRSYQLPDEFEGNKEWVDLGSRFRQLMEPLDIANYYRHARHYEDGSSSYMLRGRPKRYRYTQKWLEHAERRPQEPSSTSCFWAEVEDLRYKTSYSNSSSFEDVKERVEQLEAQLQAWSEKGELANDVFLEGSTLVKWWKTLPLQHKQQSCIRNLINE

SEQ ID NO: 157400 - protein, 242 aa, Glycine max
  Coding DNA Sequence Number=SeqID_40622
  Gene Ontology: Mol. function=phosphotransferase activity, alcohol group as acceptor
  Homolog annotation: Hit_ID=Q69R94; Match level="QueryCoverage=83%, HitCoverage=12%, E-value=3e-19, Identity=33%"; Hit description =Putative symplekin
  Pfam annotation: Domain name=HEAT; Domain location=125-161; Score =19.1; E_value=0.016; Accession=PF02985.12; Description=HEAT repeat
MVGKTMSMAATSREKLASLVNAAKLAIDIPSKLESLRQLRHELPPEDPVLLTEFLPSLFLFHSDRFGPVRKFLTEIDSGSYPSLTLPLPLQCLGPVCKFVTEDTFFPLVSKLFLVMLGEIGLKNTEFLSNIVPVLIDLLDDDTPAVVRQVLLCGTDLFRATLEKIVVQGLYSSDLDGALESAWAWMLKFKDKVYSIAFQHGSGGAKLLALKFVEAVIRLYTPDPNGSSEPTSHQGITLRLVG

SEQ ID NO: 157401 - protein, 340 aa, Glycine max
  Coding DNA Sequence Number=SeqID_40623
  Gene Ontology: Mol. function=protein phosphatase type 2A regulator activity; Cellular component=protein phosphatase type 2A complex; Biological process=signal transduction
  Homolog annotation: Hit_ID=Q93YV6; Match level="QueryCoverage=99%, HitCoverage=67%, E-value=1e-159, Identity=77%"; Hit description =Serine/threonine protein phosphatase 2A 57 kDa regulatory subunit B' iota isoform
  Pfam annotation: Domain name=B56; Domain location=1-325; Score=713.8; E_value=1.2e-211; Accession=PF01603.10; Description=Protein phosphatase 2A regulatory B subunit (B56 family)
SNRGGENDDDEPAFDPAWPHLQLVYELLLKFITSNCLDAKVAKKYIDHSFILRLLELFDSEDPRERDCLKTILHRVYGKFMVHRPYIRKSINNLFYNFVFETERHNGIAELLEIFGSIISGFALPLKEEHKIFLWRVLIPLHKPKSIGVYFQQLSYCVTQFIEKEPKLASIVIRGMLKYWPITNSQKEVMFLGELEEILETINMVEFQRVMVPLFWRIGCCINSLHFQVAERALFLWNNDHIVNLIAHNRQVILPIIFPALEKNSQGHWSQSVLNLTYNVRKMFVEMDEKLFLASHSQFKEEEVMLNMAAEKRKEAWKQLEHAASLQPAIGNTPVLVSPI

SEQ ID NO: 157402 - protein, 44 aa, Glycine max
  Coding DNA Sequence Number=SeqID_40624
MSQKQAHHHRKSWIRALRNLRASVGNFVLARKVEAAKKPKKNLK

SEQ ID NO: 157403 - protein, 343 aa, Glycine max
  Coding DNA Sequence Number=SeqID_40625
  Gene Ontology: Mol. function=DNA binding; Cellular component =endoplasmic reticulum membrane; Biological process=DNA integration
MTRCMLKGKGLPNCYWGEVVTTTTYVLNRCPTKRLQSITPEEAWTGDKPTVNHLRIFGSLSYRHIPDERRKKLDDKSEALILVGYHPTGAYKLYSPLKQQVVISRDVVVSRDAVVDEIAAWKWENDYKIHNSYILEDSPRAKDVNPASSMQPSIRSSISDVGEMVQFAFMVVTELVHWKQALNIREWKAAMKEELDAIEKNRTQELVDLPHNKHPIDLDVKTAFLNGPLEEEVYILQPPGFEIKGKEHKAPRAWNRVIGNFLGKQGFVKCTVEFGVYVKETQHKNLLFVCLYVDDLIITGDEDEEIEQFKEKMKSEFDMIDLGILHYFLGFEFMHTQKGIFLH

SEQ ID NO: 157404 - protein, 120 aa, Glycine max
  Coding DNA Sequence Number=SeqID_40626
MLEEQAAPHYCWGTQQTVKWRNCPSAIILPEEGSSGKVPEIIFPESFWKNLLPEDQFVSSGNTHRQFPEERHPECFRKKLLPEEFRCLPEEASSGRSFFRKLVFFYNAYVMTILPLCKFL

SEQ ID NO: 157405 - protein, 385 aa, Glycine max
  Coding DNA Sequence Number=SeqID_40627
  Gene Ontology: Mol. function=metal ion binding; Cellular component =integral to membrane; Biological process=ubiquitin cycle
  Homolog annotation: Hit_ID=Q9C965; Match level="QueryCoverage=79%, HitCoverage=75%, E-value=1e-92, Identity=53%"; Hit description =Putative RING zinc finger protein; 53384-54880
  Pfam annotation: Domain name=zf-C3HC4; Domain location=310-350; Score= 40.4; E_value=6e-09; Accession=PF00097.15; Description=Zinc finger, C3HC4 type (RING finger)
  Subcellular localization annotation: CTP_CleavageSite=45; ConfidenceScore=5.47e-01
MARPTHHVIDITGSSRPSTSSSSTPHDRLANDVDFGALNSRTRRRGDTTRSRQHRSPLNSGLWICVELVITVSQIVASVVVLSLSKHEHPHAPLIAWIVGYASGCVATLPLLYWRYYHNRGVREQESSQASPRSNDPSGTLLSDSTTNGGEDAPASSRTRSNQESWLMNARLKLLVEYFKIAVDCFFAIWFVVGNVWIFGGHSSADQAPNLYRLCVVFLTFSCIGYAMPFILCATICCCLPCIISILGVREDMAQTRGASSESINALPTYKFKMKRNKSKGESNSAVGEGGVVAAGTEKERMISGEDAACCICLAKYENNDELRELPCSHLFHKDCVDKWLKINALCPLCKSEVSENVRGSVSGVDANQHEGESRVENGLTNTSS

SEQ ID NO: 157406 - protein, 141 aa, Glycine max
  Coding DNA Sequence Number=SeqID_40628
MGTNQTGKRFYQVKIKGLDVTSLKELGLRAVEGFGDYPFEDMADLCLVPDVVIPPKFMVPDFDKYKGTICSKNHLKMYYRKMGAHSRDEKLLMHFFQDSLAGAAVIWYTNLEASHIRTWKDLITAFLRQYQYNSDMAPNLT

SEQ ID NO: 157407 - protein, 181 aa, Glycine max
  Coding DNA Sequence Number=SeqID_40629
  Gene Ontology: Mol. function=nucleic acid binding; Biological process= DNA integration
  Homolog annotation: Hit_ID=Q1T010; Match level="QueryCoverage=90%, HitCoverage=12%, E-value=6e-37, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDAILGFQELDEIELHRENKRLDCKARVLLHQCVFANVFQKISQAATSKQAWDILQQVYGNTGRTKKVKLQSLRRQYELLSMIEQETIIDYFNRIQVVTNSMRACDEAMADSKIVEKVLRTLTPNFDHIVVVIEESKDIENMNVEELQNSLEAHEQTVLERKNNNKVAEQALQARTNHKSR

SEQ ID NO: 157408 - protein, 51 aa, Glycine max
  Coding DNA Sequence Number=SeqID_40630
MAFTAAITTRLQQCSQQQQQCCFLFMGPCLCTSSGNEFLYTTTYNWMLNCK

SEQ ID NO: 157409 - protein, 60 aa, Glycine max
  Coding DNA Sequence Number=SeqID_40631
  Gene Ontology: Mol. function=heat shock protein binding; Cellular component=cellular_component; Biological process=protein folding
  Homolog annotation: Hit_ID=Q6EIX9; Match level="QueryCoverage=96%, HitCoverage=19%, E-value=4e-15, Identity=57%"; Hit description =Potyviral capsid protein interacting protein 1
LSIPVSDIVSPGYEMSVANEGMPITKEPGHRGDLRIKFDVKFPTRLTHEQRAGLKRALGS

SEQ ID NO: 157410 - protein, 1123 aa, Glycine max
  Coding DNA Sequence Number=SeqID_40632
  Gene Ontology: Mol. function=translation elongation factor activity; Biological process=transcription
  Homolog annotation: Hit_ID=Q6H8E1; Match level="QueryCoverage=76%, HitCoverage=74%, E-value=1e-122, Identity=35%"; Hit description=PHD finger protein-like
  Pfam annotation: Domain name=SPOC; Domain location=740-843; Score =54.1; E_value=4.5e-13; Accession=PF07744.3; Description=SPOC domain
  Pfam annotation: Domain name=TFIIS_M; Domain location=366-481; Score =128.5; E_value=1.9e-35; Accession=PF07500.4; Description =Transcription factor S-II (TFIIS), ce
  Pfam module annotation: Pfam domain module=SPOC::TFIIS_M; Domain location=740-843::366-481
MSNNLVSEPIPSMQMAQLEPLMNKVDSSGRQVEMGLLGPVSSDVIVSQSQGTSNEHVGLLRAVPGEASNPGMHQILSANKHSMLMDILPNSSGPQQQPTTPKRKAPMELLSSSSFNKRVAQMGSRPWLQQVPNVSNKGSLQMQSPSHASRTQHLAASSKRKTQLDNTPSKSGTPRSMSSKSQNTQMKQSSKVQTESSDSVRSKMRESLASALALVCQQGKLQLPNNNTPNDAANSQGKLENSSQCAGSAPASIDASLEQRKDISQSVNSSFADADSVGNVVGEHMQSTAYEDFPEKYKDYEAGPTNTSNNESILSSMHVLNRDKQDFQSSYFLTTDAVSFSDGFFMKDDLLQGNGLSWVLSDMVDVGNQRESQINIEQRSEPEESGGGCRVEVPLPKLLASRIEAELFKLFGGVNKKYKEKGRSLLFNLKDHNNPELRERVMFGKIPPEQLCSMTAEELASKELSQWRIAKAEELAQMVVLPDSDVDFRRLVKKTHKGEFQVEVEHEDNVPVEEVSGGTTSVAQSQTIKKDVEDASPSKPDVNTDGEKGNLQKDDTFSITISSNDGADPMQGLMTDDALKDPDFLPPIVSLDEFMESLHSEPPFENLPVESGKVTPTSDKDDSGVGSKSKSADLTPNEQADVNADNKSEKFQSTRVNSDAEKEKKINAESGAISSDAGYCGSQADMKSTDGHTKERSTDDVKSASSDAELRGNQFHLEERYGNNNRYSKDAVLTKGECLWEGMLQPNISSTHSVVSIFKSGEKTAAEDWPGFLEIKGRVRCDAFEKFLQDLRQSRSRAIMVSHFVSKESDDQSTLSEVADSYVLDERVGFAEPAPGVELYFCPPHNKTVEMLCNIIPKEQIEEVNSIDNGLIGIIVWRKTNLTSSISPTTESHHKHSSKRQYFSRRQQDINMNANSTLKAVPSMGVKMTENDDDDVPPGFGPPVAQVEDDLSEFSFCSNPSHLGQKPMGSSNVVPLHPVNPAPPCPAEQMRELVHKYGQNKPNVPSINWQDKFGGTIQPWNDDDDDIPEWQPQNSQNQFPPQQTMHNFHLRPHILNQSFPGSQQQPIMTPQYLQPPMNVTHGQRNFDPQGVPSPQGSNLQPRGGPPYAQGTTWPQHASSSTGY

SEQ ID NO: 157411 - protein, 89 aa, Glycine max
  Coding DNA Sequence Number=SeqID_40633
  Gene Ontology: Mol. function=RNA-directed DNA polymerase activity; Cellular component=chromatin; Biological process=chromatin assembly or disassembly
  Homolog annotation: Hit_ID=Q94I07; Match level="QueryCoverage=71%, HitCoverage=36%, E-value=2e-16, Identity=68%"; Hit description =Putative retroelement
MVCLGPLCQIEIPKFLSHFWKTLWAKLGTKLLFSTTCHPQTGGQTEVVNRSLMEACLWGFYGGWIFELQWGPLMVIFHHGDAAEDKGKE

SEQ ID NO: 157412 - protein, 78 aa, Glycine max
  Coding DNA Sequence Number=SeqID_40634
MSSKIYPEVHENPRAFFNNSSLILLEPLAHGSSDWSLPREDCINLGDALLPPLSFVRSIHFNSLFFIIFSMYLLHCVV

SEQ ID NO: 157413 - protein, 175 aa, Glycine max
  Coding DNA Sequence Number=SeqID_40635
  Gene Ontology: Mol. function=heat shock protein binding; Cellular component=cellular_component; Biological process=protein folding
  Homolog annotation: Hit_ID=Q9SIL3; Match level="QueryCoverage=64%, HitCoverage=32%, E-value=3e-29, Identity=64%"; Hit description =Putative heat shock protein
  Pfam annotation: Domain name=DnaJ; Domain location=4-61; Score=96.2; E_value=9.8e-26; Accession=PF00226.21; Description=DnaJ domain
MGLDYYNVLKVNRNASEDDLKKAYRKLAMKWHPDKNPTNKKEAEATFKQISEAYEARNLFPSLELRQYDCARHIGDFILMVLSDPQKRVVYDQYGEEGLKDRPPPETQRIYLQNSLEVALLDLDHQGQEGPRGSHLMEGQQHLVDSVQLTIIFERIVQEQDGGTCQRSHHQWRPN

SEQ ID NO: 157414 - protein, 178 aa, Glycine max
  Coding DNA Sequence Number=SeqID_40636
MASKKRRSIGARPTAQYDTRRFHSLDSWNHYTDNILGRSILPKRKVEIYHTEFDDFKTELERHNLHKRLTNLADGTIDVALVKEFYANLYNSEDPSPKQARVRGHLVKIDADSLNTFLETPVVLEEGETLPTYSRYCRLPIDHREIETALCIPGRGFILNAEGHSRRILRKDLTTLAQ

SEQ ID NO: 157415 - protein, 98 aa, Glycine max
  Coding DNA Sequence Number=SeqID_40637
MKNFHRIAYGSVSEAPRLRFSSRKRFFQANSKEREVPKGLNILKQLPPPLFIEKKGGFRKFYGSITEAAEAPKTIFQKRGGACRPVASSLSNPTSKMF

SEQ ID NO: 157416 - protein, 130 aa, Glycine max
  Coding DNA Sequence Number=SeqID_40638
MAPRKLLVKRSRKDTTGEGSSTAPHVDMDFDRHWFQSCEYSQGRSQASGFDEEAITQLLCIPGQDFAQTAAGRRVSVHMAQLISNAIYQFAGIAPMRHPVDPEKSNRALGFPALITSLCQFYGMPVASSK

SEQ ID NO: 157417 - protein, 89 aa, Glycine max
  Coding DNA Sequence Number=SeqID_40639
MRSAKKAEPFFFFTPPPIYSKIGEELATQLAQASKVASSRSNSLLEEGSGRPNFRRSYENSRIAKNTSFRFPSHHGIFTDRVSLLPFDF

SEQ ID NO: 157418 - protein, 75 aa, Glycine max
  Coding DNA Sequence Number=SeqID_40640
DADEAPLDVSICLHAFGIVGCGSLVVSSLANVRVLTIGSCVAYLPNGIRVASQTHSIQASLLGTLEDFKVPHVNH

SEQ ID NO: 157419 - protein, 71 aa, Glycine max
  Coding DNA Sequence Number=SeqID_40641
  Subcellular localization annotation: CTP_CleavageSite=50; ConfidenceScore=5.20e-01
AHLGGEAPSSMAYSLVDGASSHLFSFVFHCISMGGGYANSARQSIRWAPVSMANSARQSIRGAPDLMVKDR

SEQ ID NO: 157420 - protein, 85 aa, Glycine max
  Coding DNA Sequence Number=SeqID_40642
MNTLPRSSFSFRRQGSSGRIWQDQIQFVEPKANGSASIATSLGKNKSIKEENVSHLEETIMGRRLHDNSKRATRSSSSSKIHNKL

SEQ ID NO: 157421 - protein, 345 aa, Glycine max
  Coding DNA Sequence Number=SeqID_40643
  Gene Ontology: Mol. function=DNA binding; Cellular component=nucleus; Biological process=regulation of transcription
  Homolog annotation: Hit_ID=Q1S505; Match level="QueryCoverage=99%, HitCoverage=100%, E-value=1e-110, Identity=58%"; Hit description =Homeodomain-related
  Pfam annotation: Domain name=Myb_DNA-bind_2; Domain location=13-69; Score=-8.7; E_value=0.09; Accession=PF08914.1; Description=Rap1 Myb domain
  Pfam annotation: Domain name=Myb_DNA-binding; Domain location=14-61; Score=52.1; E_value=1.9e-12; Accession=PF00249.21; Description=Myb -like DNA-binding domain
  Pfam annotation: Domain name=Myb_DNA-binding; Domain location=67-112; Score=39.8; E_value=9.5e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=13-69::14-61::67-112
MGRPPCCDKSNVKRGLWTPEEDAKILAYVANHGTGNWTLVPKKAGLNRCGKSCRLRWTNYLRPDLKHDGFTPQEEDLIINLHGAIGSRWSLIAKRLPGRTDNDVKNYWNTKLRKKLMKMGIDPVTHKPVSQVLSDLGSISGLPNTTNQMAFINKDLMMSNMPPTKTEPSDSNKSMVEHTQEGQVHSWEHHIPYQVIINSENVQPQVLSEAASSTSSSSSSNLTQLGSPQSYSCQTPQAQISPPCSSFDWSEFLHSDSFNWSLNPPSGLMQSEAELSDNTKSNGHDMQGAASEGSGSGSGAVACGASMEYQINKQCEAHSFVDGILDRDSEIRAAFPQLLDASFDY

SEQ ID NO: 157422 - protein, 361 aa, Glycine max
  Coding DNA Sequence Number=SeqID_40644
  Homolog annotation: Hit_ID=Q9SLT5; Match level="QueryCoverage=86%, HitCoverage=62%, E-value=7e-88, Identity=52%"; Hit description=CW14 protein
  Pfam annotation: Domain name=DUF1336; Domain location=177-361; Score =200.5; E_value=3.9e-57; Accession=PF07059.3; Description=Protein of unknown function (DUF1336)
MSLNEYEIGSRPNDSSPKGVDSVFVDHQQQKQRVHPYNYFRSNSSLKVAKNQGKPKDSTLKSDGSRVELDSVSTGEVSTGQADEIGEYRKLSLDHCGILPNTCLPCLTSNALAVEKRRPMSPDTPSSRRKSLSKLSFKWREGSSDMTLLSPKAFKQKHLAGSSIPFCPIEKQTPGSWSQIEPSSFRVRGKNYFRDKKKDFAPGSAAFYPLGADLFLSSRKIDHIARFIQIPSINVPGDVPSILIVNIQIPLYPATIFQSENDGEGMNVVLYFKLSEKYSKDLPDQFRESISKLINDEVERVKGFPLDTIAPFRERLKILGRVANLENLSLSTTEKKLMNAYNEKPVLSRPQHEFFLVYCVF

SEQ ID NO: 157423 - protein, 92 aa, Glycine max
  Coding DNA Sequence Number=SeqID_40645
MRLPGKESLLMKSPITINEILDVSISFLNDHLEQTLGSTKIKEIHSKCINLAQGKVYGESGFWLKACRMARHDTCQGLVWFKDKKGCPTLFP

SEQ ID NO: 157424 - protein, 67 aa, Glycine max
  Coding DNA Sequence Number=SeqID_40646
MVMDMADTFGEDFGIHFNQWSSNIRAGFNHIFFYFIITPDCWNGEGVALMQKFPQNHQCQDCSSSAL

SEQ ID NO: 157425 - protein, 146 aa, Glycine max
  Coding DNA Sequence Number=SeqID_40647
MISEVVIIKNGEIVEAKLHDESRLIQRCFDDNKDDDKGDDKKLKGQSKNEFKMFKIESRTLQDSRGKLKNTSRFKRKVEFNNQESSFKNQDQYSRLKIQESREDLIKISMKRFFQKLSSTWIFLKTCLPKSFYSLVIDYEIVVIDY

SEQ ID NO: 157426 - protein, 148 aa, Glycine max
  Coding DNA Sequence Number=SeqID_40648
MPPTRHPLDPDKSNRALGFPTLITGLYQSFRVPVTPSKVIRPPITRAFIEKYCTPRQTQGDAPQAADASPPPHQADPAGSLGMERYLQHLVRQQGANHQGQNSLGLRSHGPEAQAGEAPAEAPGDAKEARKDEEMTDLLGFLGGSRAT

SEQ ID NO: 157427 - protein, 148 aa, Glycine max
  Coding DNA Sequence Number=SeqID_40649
  Gene Ontology: Mol. function=transition metal ion binding
MQSRIETRLNDLIEISRDGKAFYEEASDRIESSELSDLFMGIAGVKGELVEEISRIVSRSGGRPAERGTLVGAMHQYYGKMLAAFGETQYQYLKELEKSEERLVQTFNEVLNDPELSQDVKREVARMIPKVSECHSVMLNRLQSMHRH

SEQ ID NO: 157428 - protein, 384 aa, Glycine max
  Coding DNA Sequence Number=SeqID_40650
MLEQVLAIVAWRVDGAAEAAGQLLLAACCASHSAHHRLAVNSSRWSDLCMNDVDGYRYASSTNLKGCERYGYGSSIGVKGFKRYGYMLDAEVIVPWRLRSCEQRIQLKIFSESRGLVCGSLGGRAARLLERSVVNRIGGRHQERRWSQHRDARRLAAASLSARPERISSLLIKSSAQASRLPWGSLSETGPWEFSCPELSAPVDNFSFHINIIFIPAHGTFLECTEVTVRLLVEWAHSCARNVMNDFKRDASNTNKPAVAEPDAGKQKQQQQEQERQDKESKERNANEGGAHKSNKLRDRSTDAETLMVRVAYQLRCPSETTLLPCKRCRRPSPGGYLCANCLCDDLAVLIENTGAASRWLSSVKIAIQDEGTVLRYARKAASK

SEQ ID NO: 157429 - protein, 111 aa, Glycine max
  Coding DNA Sequence Number=SeqID_40651
AARSGNAAATAAQEAADAAAAKAKTARTKIRTFDQKIKSPPILAYKSITCPQIFYGGLPIFVANFVLVPSHFTEANDAKRIWAYPALKLVGAGFCSSRLRMQAHVNGFAID

SEQ ID NO: 157430 - protein, 197 aa, Glycine max
  Coding DNA Sequence Number=SeqID_40652
MQVRNYTAREYAEAMRAWPRFWTSVRPLTANAQQASATLERDLSKFRALYPALRPATITYAVGVLRTGGTTLGDKVLIGAEMALGDERVDVSELPEKMRERLRIFYDSRPGANNAQNNLHEYVHTQQRETTGSLAQYAVREGVAEYVAERLSGRRPALPLYSYGPAHEADIRTRFIAEMDGGNLDNWLYNSARNPFG

SEQ ID NO: 157431 - protein, 81 aa, Glycine max
  Coding DNA Sequence Number=SeqID_40653
MQAGAAWIDVALLHECDLAFNVGLGAYRVIVAQKRPMSSVTTWGGAASAAQGSSRAAMRQRGSASVAPGKGSQMGCDDGSE

SEQ ID NO: 157432 - protein, 118 aa, Glycine max
  Coding DNA Sequence Number=SeqID_40654
MRSFNGDFPPWRCSGRQRRRGEGRRHPLGNMPWKKELHHKECALDKKLEEDVLMEENKERRGEHEIEGIKEGEKWNFEVYLIRLSFIKVTTSVTHASIYRLSSFLEKLELSYTHPSNN

SEQ ID NO: 157433 - protein, 69 aa, Glycine max
  Coding DNA Sequence Number=SeqID_40655
AIMKHSSKLESGGHMNENAIHGAPKKALGNNIHGAPKKGGWQDQTVYREAGCFGHFLFVQVGWDIASRE

SEQ ID NO: 157434 - protein, 58 aa, Glycine max
  Coding DNA Sequence Number=SeqID_40656
MWVQAIGLFSQATYAPEFGLPRPFNQRLLVLHVGGERSELSRIGCWTNGLSYLKKKGG

SEQ ID NO: 157435 - protein, 114 aa, Glycine max
  Coding DNA Sequence Number=SeqID_40657
  Homolog annotation: Hit_ID=Q8TGM5; Match level="QueryCoverage=31%, HitCoverage=53%, E-value=6e-07, Identity=75%"; Hit description =Uncharacterized protein ART3
MGPELTRLARDWSRAWLIHPFYHGEVGHEPRFQPTTRRVLAGGRRALGLMASGATCVQRLDGSRDSAIHTKYRISLRSSSMQEPRYPLPRVIVCKCCVVTTPAGHRLRAPGSRT

SEQ ID NO: 157436 - protein, 133 aa, Glycine max
  Coding DNA Sequence Number=SeqID_40658
REIERRNWYKELTNFFGGSIDVALVKEFYANLYDLEDKSPKQTPVVIEERESLPSYSRFCRLRPDLQELAARLCIPGRGFELNADGLPLKILRKNLTTLAQTWSVLSFSNLAPTSHTSDITLDRAKLIYGLVM

SEQ ID NO: 157437 - protein, 59 aa, Glycine max
  Coding DNA Sequence Number=SeqID_40659
MAQSSEKKDPKELELLELEGEERDSKVRESDVTPWALHKAVIRAGKPSLEESCCAMREI

SEQ ID NO: 157438 - protein, 90 aa, Glycine max
  Coding DNA Sequence Number=SeqID_40660
MRGNSSARNLAPLDLEIEATCWRNNAERRRKALQERTVQPSAEGTHSSESSSAFPVDLRESEVGASEAHIMVDEPPQRVTLKYYSSSTVP

SEQ ID NO: 157439 - protein, 105 aa, Glycine max
  Coding DNA Sequence Number=SeqID_40661
MTQMVTWRYLRLDWWEKGFTQKKGINFKETFSPVSTKDSFRIIIALPAHFNLELHQMNLSQPTLRREGDAGLTGASSKGGRRAESPPTFIQGKRRKNWKGVVYEL

SEQ ID NO: 157440 - protein, 120 aa, Glycine max
  Coding DNA Sequence Number=SeqID_40662
LGGTRRYPSGYPYKHSFAIRQTQSPVTCEDTQAVFIQTISVNPDPGSQVAGGYRMVIRTFRQPGANEPADTQRLTSSSAPFVIQGQRVRWQAKIPYGRLHLSSTKANEFDGIRMMLVVRF

SEQ ID NO: 157441 - protein, 134 aa, Glycine max
  Coding DNA Sequence Number=SeqID_40663
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-20, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=70; ConfidenceScore=5.60e-01
MWSPLKARTCSPLKARACSPLKARTCSHLKARRCSPFKVSICSPLKVRTCSPQKARACSPLKVRACSPLKARTRSPLKARACSPLKARTCSPLKVRTCSPLKARACSPLKARMCSPLKARACNPLKARTCSSLK

SEQ ID NO: 157442 - protein, 251 aa, Glycine max
  Coding DNA Sequence Number=SeqID_40664
  Gene Ontology: Mol. function=nucleic acid binding; Cellular component= nucleus; Biological process=DNA integration
MGVKHFEVVKRKSHANKKWSLDEIRRSIYGLKQAFRQWYLKFDEIVASMGFKENKVDQCIYLKVSGSKFIFLVLYLEDLLLASNDLGMLYKTKHMLTTSFDMKDLDIDHVIDLGYFKRLTLIKSERFNMQNCKRGNVPVVKGDKFDKDQCPKIEIEQETKEYMLVYRRVDNLEVVGGCDAILPRKGPVTGAMSKRLQEDWARVDKEGLRVLMNLRLSSSFSRKLLKELLKEVFSKKLLKEVFLRKLLKEAT

SEQ ID NO: 157443 - protein, 171 aa, Glycine max
  Coding DNA Sequence Number=SeqID_40665
MRNKREPTKEEVMILHEIRRPNSLKTVPSGVANCRNLPFGGRATRGSQCIIQGRKGRGVATNVYSRKTSEKPEREKERCLLPRGFLRKISKRTPITKFSPLFILYGKVTEALWKCFGFDFHLFLSSLSPMLSEICLPKVFGNFTEALRKPQKSRKPFFNNVEELAAQLLPP

SEQ ID NO: 157444 - protein, 257 aa, Glycine max
  Coding DNA Sequence Number=SeqID_40666
  Subcellular localization annotation: CTP_CleavageSite=52; ConfidenceScore=5.64e-01
MEKSSKKRKGSFSSTTTVGQRRHGASGDSPAPPNPSLSSPCPLTLFSSNDQRQRHYSSFSNRVILDPKFLDFDFFEGETFDCYQGTLVDDWKSIYSSHDTRKTVCVENDDMTGRLLAGSFTFECCIMHYILCQVLLPRSANLAQAFEEDLILLWALQIGRQIDWAHLVRYRMHKALWANAPLPYPHLVTLILRHFNIPLVNEPFVKVKRSFAIGAIVVASFGYRKDLIGQWVCKQDLPPNASNERTPSPPPRVPPLH

SEQ ID NO: 157445 - protein, 105 aa, Glycine max
  Coding DNA Sequence Number=SeqID_40667
  Homolog annotation: Hit_ID=Q1SJY5; Match level="QueryCoverage=33%, HitCoverage=3%, E-value=2e-08, Identity=83%"; Hit description =Integrase, catalytic region
MELIVIRNKARLVAKGYNQEGIDYEETYAPGARLEAIRMHYDEDMTKSKGKDPLEGLGGPMTRARARKAKEALQQVLSILFEYKPKFQGEKFKVVSCIMAQMEED

SEQ ID NO: 157446 - protein, 53 aa, Glycine max
  Coding DNA Sequence Number=SeqID_40668
MVVGILNKTYQGNPCGIYPNLSSFTGSGIIQNSVTYIKRSAPSKDHINKYSSS

SEQ ID NO: 157447 - protein, 87 aa, Glycine max
  Coding DNA Sequence Number=SeqID_40669
MAARGGHRWSWVMEKKVLGFGWASAEEESQKIMFFMLKNLVSLSGSPLFALSATIRSKRNSRCAKRNNSCSVQFPLGLELQLVRFSH

SEQ ID NO: 157448 - protein, 239 aa, Glycine max
  Coding DNA Sequence Number=SeqID_40670
MTLTIPELFLRPYQVRWDATVFRVFNPDFPLYIKHEDLSEIAHGDQCLSISVLQLWILHLTKTCMRVGNSNIYGFLEPQSIQRSGQSQFESESYIKSWMQSSQRDVYLGAYLNGFHYRGHWQMVVILPKEHLVVWFCSLHNRPDNYLKGIINSALKGLDNAPQPKSKASARWTAIKCNRQKGSTECGYYVMHWMSTIILGTFRNNWEAYFNDPRPLEPERLKALRIQWAQFYLRVRDQA

SEQ ID NO: 157449 - protein, 301 aa, Glycine max
  Coding DNA Sequence Number=SeqID_40671
  Gene Ontology: Mol. function=ribonuclease activity; Cellular component=cytoplasm; Biological process=RNA processing
  Homolog annotation: Hit_ID=UPI0000669458; Match level="QueryCoverage =94%, HitCoverage=55%, E-value=1e-82, Identity=52%"; Hit description =Ribonuclease G
KGKKLAPNLNAAFVNIGYDKDAFLHYQDLGPQYLTYRKFLKDTISKKQSSSSLKNFEIQPEIDKNGTVDKVIAKDDIVLLQITKEPISTKGPRISTQVSLTGRFLVLIPFDNKVSISKKIKSFEEKERLRTLIESIKPEGFGVIIRTVAEGKKVADLHNDMNQLIQKWESTFKNIQKNKVPSKVLSEEDKASAILRDNFNQDFVSIICDDEQMVEEMKNYVEVIAPERKNIVQFYDSHIPLLEYYNVEKQLKQSFGKHVNIPSSKGAYLVIEHTEALHVVDVNSGNNITTGNAANKEHALN

SEQ ID NO: 157450 - protein, 60 aa, Glycine max
  Coding DNA Sequence Number=SeqID_40672
HFAKRKPRAKRIFGHALSQKSLVLSAQPLHLRLIWSAMLAKAELSPFQFNLNWAKRWPTR

SEQ ID NO: 157451 - protein, 144 aa, Glycine max
  Coding DNA Sequence Number=SeqID_40673
MGMRGFINYNLVFAIRQLGYPMRGAPLEEGLTPFIARGFNNSNTGMLQRVHKAWERVQKKDKELRGSSNGPIDGYRRRLKAHAQELGRAQTAKEKYKSAAVRIRKENTELRDVNIATIRALEQETKRARKEEHGWNKFRGALWG

SEQ ID NO: 157452 - protein, 44 aa, Glycine max
  Coding DNA Sequence Number=SeqID_40674
MALVMGPLLRRIASLLSGSNTQTHYGESSEALIYPLLHAAIRLA

SEQ ID NO: 157453 - protein, 83 aa, Glycine max
  Coding DNA Sequence Number=SeqID_40675
  Homolog annotation: Hit_ID=Q1WIR9; Match level="QueryCoverage=90%, HitCoverage=28%, E-value=4e-07, Identity=32%"; Hit description=PIF -like orf1
MCFLKAALVTAVTEIMLKVCIEEVKVNVGNKPHNHFTKLGWANIAEKFNKLIGKDTGLAWDGEKKTIAASDEWWEANIQILDL

SEQ ID NO: 157454 - protein, 65 aa, Glycine max
  Coding DNA Sequence Number=SeqID_40676
MAPFASHKMLFVFLWEHDQRVSGVGRRAGEATVELRPMVFYLTEFDIGVILNTECATWALVYCTV

SEQ ID NO: 157455 - protein, 321 aa, Glycine max
  Coding DNA Sequence Number=SeqID_40677
  Subcellular localization annotation: CTP_CleavageSite=18; ConfidenceScore=5.13e-01
MDKISPALVAFMVHQYLKDNHFAQTSSTFLNEASSLFTDSSTNQLSKTMLGLVQILDEYMCLKKQKEMLHQQRVMVMQEKYRLQMFVQGLQNVINTFQKPLSLNFLGMSTNSAVVPQWRLCNETPSGVSSIASIGSAMQNTFGNFSTPMINASDKKRKDTETVNGPAVGKQPRGRPPGRKNQVQGQNTLPQSSNVVNNQVVSWQSSSSTLPPSGICAPSGSQVQGSNFAKGSFNHPLFCVPNHSQILETPPRTQSSHCDTYVSPTNFLVASCNREASSSYCTMISTDRVMFDPVKQMAYKESSHCSSPIKADTGKASKKDD

SEQ ID NO: 157456 - protein, 147 aa, Glycine max
  Coding DNA Sequence Number=SeqID_40678
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=97%, HitCoverage=13%, E-value=1e-38, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAKYLLCCWDHQQVQGKCADVDLIGFTDSDWKKDPDEKKNTAGYVFMYCRAPISWSSRKQDIVALSTCEAEYVAGALGACQAVWLKSLLEELQLRENKPMKIMMDNQSAINLAKHPVAHCRTKHIETCFHFLRDQVNKGKVDVEFCR

SEQ ID NO: 157457 - protein, 282 aa, Glycine max
  Coding DNA Sequence Number=SeqID_40679
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=5e-34, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=38; ConfidenceScore=5.74e-01
KTTRPHHQSTIRTRLQRTSRPHLQRTTRPRLQRATRPRLQRTSCPHLQRTTCTRLQRATRRRLQRTTHPDLQRTTHLAIRGLHVLTFRGLHVLSFRELHGLAFRGLHVLTLRGLHVPTFRGLHILNFRGLHIHDFRGLHVLTFSGLHALTFKGLHILTFRGLHVLTFRGLHVPTFRGLHVLNFKGFDALSFSRIHALSLRVLHILTFRGLHALAFRGLHILAITGSRTITFRGMHALAFRRLHLLVFRGLLALAFRGLHLLPIRGSHTLTLRGQHILAIRES

SEQ ID NO: 157458 - protein, 212 aa, Glycine max
  Coding DNA Sequence Number=SeqID_40680
  Homolog annotation: Hit_ID=Q86AI8; Match level="QueryCoverage=31%, HitCoverage=15%, E-value=4e-07, Identity=41%"; Hit description =Similar to Homo sapiens (Human). Mucin 2
VNSRGGGGVSIARYRPSQCYLWCLALRPSGGAVLLDESSISRGPDALAGGPLGVFVGAIPANNRWGRLALQSLGRMLLSSNVIYICVRVVMLVRMVRTCLFAVVRVKSCPGMHSSCVIASLSGCACTVGRPPISGGGPGTVWMWSTLKMRTHSPLKVRACSPLKARMCSPLEVRACSPLMARRCSPLKVRACSPLLARRCSPLKVRACSPTK

SEQ ID NO: 157459 - protein, 505 aa, Glycine max
  Coding DNA Sequence Number=SeqID_40681
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=99%, HitCoverage=28%, E-value=0.0, Identity=64%"; Hit description =Putative glucan synthase component
MSLRHRQSPASVTSSAPGRGEEPFNIIPVHNLLADHPSLRFPEVRAAAAALRAVGDLRRPPFGQWRPNMDLLDWLALFFGFQRDNVRNQREHLVLHLANAQMRLTPPPDNIDTLDAGVLRRFRKKLLKNYTSWCSYLGKKSNIWISDRRGGAGDDLRRELLYVSLYLLIWGEAANLRFMPECICYIFHNMANELNRILEDFIDENTGQPVMPSVSGENAFLNLVVKPIYETIKREVDSSRNGTAPHSAWRNYDDINEYFWSRRCFEKLKWPLDIGSNFFVTAGGGGKHVGKTGFVEQRSFWNLFRSFDRLWVMLILFLQAAIIVAWEGKTYPWQALEDRTVQVRVLTIFFTWSGLRFLQSLLDVGMQYRLVSRETIGLGMRMVMKCVVAAGWIVVFGVFYARIWTQRNQDRRWSPAANNRVWNFLVVVFVFIIPELLAVALFVIPWIRNFIENTNWRIFYMLSWWFQSRSFVGRGLREGLVDNVLYSHSGLWCWPQNFVSVTFCR

SEQ ID NO: 157460 - protein, 55 aa, Glycine max
  Coding DNA Sequence Number=SeqID_40682
VLAKILAAILRREIHYVIAYAQPTFIHQRQIPDGVLANKLMEEAKRIELGSLMSE

SEQ ID NO: 157461 - protein, 185 aa, Glycine max
  Coding DNA Sequence Number=SeqID_40683
  Homolog annotation: Hit_ID=Q6CQE3; Match level="QueryCoverage=31%, HitCoverage=73%, E-value=9e-12, Identity=47%"; Hit description =Kluyveromyces lactis strain NRRL Y-1140 chromosome D of strain NRRL Y- 1140 of Kluyveromyces lactis
MKFQRLPGPVGQGYRLVEYISVARVRPRTSKGITDLLRSRSLTELTRQIAPPTKNGHAPPPIESRKSSQSVNPYYVWTCTEARPGPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 157462 - protein, 80 aa, Glycine max
  Coding DNA Sequence Number=SeqID_40684
MLIERVRVRIDIIIQGLTILAPVDSPNTDGIDPDAICELNLCSNIRRLMFKKEFDTSYVGFHSGSELLSRQNLCNAYLDF

SEQ ID NO: 157463 - protein, 63 aa, Glycine max
  Coding DNA Sequence Number=SeqID_40685
MWKRIRRVELVLWIRCWLRNDELLKLKRRFGNGGTSQGGRGCAGVSEKRGIYRPGRIVIDYKY

SEQ ID NO: 157464 - protein, 113 aa, Glycine max
  Coding DNA Sequence Number=SeqID_40686
MGLNQDHAFKKRFPTSTVQSFEFGMTGPLDESNSCFLTRVDPWVLVPIAFRGLHALSFRGLHALAFRGLHALTFRGLHTLAFKGMHALASEGCTPRLQRAARPRLQRASHPRL

SEQ ID NO: 157465 - protein, 187 aa, Glycine max
  Coding DNA Sequence Number=SeqID_40687
EGDILTTCVFAVFHLVLLFVVKEVSRLWKAKSSAGSSLGNRSDSKVLGSTGLSCCAITRDSDNTSSPRVRYLVLTVLYYLCDPVHLSAVNSYMPSSFPDLVFVDERIEVGLRKGKFDCLALTNKKPRANEEKEKEEGTHVVAAIPTWPNFPPVQQCHYSADISPSHYPPPNHPQRPSLSQPQSLPAT

SEQ ID NO: 157466 - protein, 52 aa, Glycine max
  Coding DNA Sequence Number=SeqID_40688
MYVHLCCPMSQRTGEELVDTTPSPRPKVRASTGPVIDKSSSYVWLKTLKRCY

SEQ ID NO: 157467 - protein, 86 aa, Glycine max
  Coding DNA Sequence Number=SeqID_40689
  Pfam annotation: Domain name=zf-CCHC; Domain location=34-51; Score =20.4; E_value=0.00043; Accession=PF00098.13; Description=Zinc knuckle
MEFLELKQGNMTVVEYAAKFELGHISSSCIDKGTTCFNYRQKGHIQRDCPYPKKEHNGGGQNDQTIRRPWEESLPLVVLKLQNPKV

SEQ ID NO: 157468 - protein, 83 aa, Glycine max
  Coding DNA Sequence Number=SeqID_40690
MSGFTRNSPQISASPHQLDLAPYASEPYNAQWNAPGLLRDKHTLRSSHILGEMEVDEPWLGLWLPLNYQVVFVIGSAVDRLCG

SEQ ID NO: 157469 - protein, 93 aa, Glycine max
  Coding DNA Sequence Number=SeqID_40691
MGFPALSTSLCQFYGVPVAPIKVIKPPINRVYIKKYCGPQAGTGRDTTAAWGWPASGNRRTAATSRAPQLIYKGWSVAYNPWATKSNAKGLML

SEQ ID NO: 157470 - protein, 142 aa, Glycine max
  Coding DNA Sequence Number=SeqID_40692
  Subcellular localization annotation: CTP_CleavageSite=51; ConfidenceScore=5.44e-01
MTEPSKKRKGVATSSAVTGTQSHGTSKVQTSQIPSSISSPTLFSIEEHRIRYNSLFSSHSIIDPKFVDLAFFDDEVSDCFQAFQNSSLIQFISMKLPFYPELVKDFYSNLEIQEDSLISEVYGIKMIIDQSLFFDLTQLSSD

SEQ ID NO: 157471 - protein, 164 aa, Glycine max
  Coding DNA Sequence Number=SeqID_40693
  Homolog annotation: Hit_ID=Q1STZ2; Match level="QueryCoverage=42%, HitCoverage=14%, E-value=1e-07, Identity=41%"; Hit description=IMP dehydrogenase/GMP reductase
MGSVLIPTVNKPTEGPCRLLKNVRWGILLPLDVVSKKGTNSPDPRIPRLHLCHMHSIMHSSIPPMRYRSFDLHQLLSHFSKHGNKSNRQEVLPSQGQKPRYHQHQGIRAVDGTPPNASLPQDLRKDLRVDHSRGVHRSHCITYSILRPAFEVLHIRGLPISTNH

SEQ ID NO: 157472 - protein, 68 aa, Glycine max
  Coding DNA Sequence Number=SeqID_40694
MFMTPKLCISAILGKNTRFREEKLSRSASVTLPQAILWKFFIVLHRSLPFFVRSSSFFSLQPFSFLPL

SEQ ID NO: 157473 - protein, 120 aa, Glycine max
  Coding DNA Sequence Number=SeqID_40695
MASRKRKSIVTRPTSQYDTRRFSSLDAWTRYIDNVLGRNILPERKVEMYHTKLDDFKAELERHNFYKCLTNLADGSIDLALIDADSLNTFLETPVVLAEGETLPAYSRYYRLPTDFREIE

SEQ ID NO: 157474 - protein, 78 aa, Glycine max
  Coding DNA Sequence Number=SeqID_40696
MAYACIGPSSTWRISWLKWPGKKSSLLLWGKVTLLQPRMMQSYPPRALDRRLQEDWAKDAREGPRVLMSLRVDFGPMG

SEQ ID NO: 157475 - protein, 395 aa, Glycine max
  Coding DNA Sequence Number=SeqID_40697
  Subcellular localization annotation: CTP_CleavageSite=32; ConfidenceScore=5.07e-01
MLEVGMDTISTSICSTPKSQGDKSTMQNSGVTLRAKSQHFATMHDDNACLVSMPYFGVIEEIWELKHMTTLSRSPPFPKSAPSPSTLKPVMMERPVIHVDSATGKADGLHRRKLRMHLGIVARDKVDVTFVNWKEVSTAQKDLIWEDIQFKSDLTSKWALAQGKEEDDDTVYEKYSISKEKWNQFCQSRRDPSWEDSLEEQLAQGNFVAHGHQDSLQWIPLKSGQHRAALSPIDDKMTDIIGQPKHSSRVRAAGVGATINQYLALASASFHTSMSINPEELHRLTKNITEQLIKKIRDELEQSINQKDKQGPNGPIKPINRVEPDDNPLYHITLASCNFFSSLCTCRRIQLCLGVYNDDVPLSIKHEDLSEIAHNGQCLNIFVIQCILATGRYMS

SEQ ID NO: 157476 - protein, 56 aa, Glycine max
  Coding DNA Sequence Number=SeqID_40698
MVLFVGEKMKNKKVEAAGVSLSEAYAPSELHPLSEALSSLSGLGESGRESENHARA

SEQ ID NO: 157477 - protein, 123 aa, Glycine max
  Coding DNA Sequence Number=SeqID_40699
  Homolog annotation: Hit_ID=Q10MT0; Match level="QueryCoverage=43%, HitCoverage=49%, E-value=2e-07, Identity=36%"; Hit description=ECA1 protein, putative, expressed
  Pfam annotation: Domain name=DUF1278; Domain location=1-110; Score =109.1; E_value=1.3e-29; Accession=PF06915.2; Description=Protein of unknown function (DUF1278)
  Subcellular localization annotation: CTP_CleavageSite=23; ConfidenceScore=5.57e-01
MASTHKVFAVTILLLAVNMASPSSSSSSSNTSLVARLKLDGESSNCWDSLFELQACTGEAIRIVGHDCWPDMIASLGFTTEEGDVLQGYCDSEKEQLHSPPSPTSPTTVVHDFDDATTKVLLP

SEQ ID NO: 157478 - protein, 67 aa, Glycine max
  Coding DNA Sequence Number=SeqID_40700
  Homolog annotation: Hit_ID=Q1T0J7; Match level="QueryCoverage=52%, HitCoverage=14%, E-value=2e-08, Identity=69%"; Hit description=CAMP response element binding (CREB) protein
MLLCFFSLLACLNLECFFNPHFGPNVPKTGDAERKKERYKQLMEKVLPIAQKQKPPCILRRARSLQW

SEQ ID NO: 157479 - protein, 250 aa, Glycine max
  Coding DNA Sequence Number=SeqID_40701
  Homolog annotation: Hit_ID=Q1T0J6; Match level="QueryCoverage=76%, HitCoverage=84%, E-value=1e-53, Identity=59%"; Hit description =Cupredoxin
MHFPILFLFLLPSLFKLSHSTTILVDGSSEWKSPTVSIGDSIIFKHKQHYNLYIFKNEKAFKLCNITQATLLSNPFTWHPSRPGFFYFTFHNGSLKACQDSQKLAIEVASSAMAPEHSPVATPAPSSGGEVPSSPSFPWPFRPGQEASSPGPAPQAQAQAGSPVTIPLVPDKGGGMPFINSNPAVPLPTGEVDSATIRPLPITSGHQEQTICNHNFSGNIKIFGGSITTSTTFIYNIMQHGEIVVAVTIL

SEQ ID NO: 157480 - protein, 91 aa, Glycine max
  Coding DNA Sequence Number=SeqID_40702
  Subcellular localization annotation: CTP_CleavageSite=50; ConfidenceScore=5.86e-01
MLKARPSLSFLQKFPASSPSSPMFSSCSSITNFSLLQASNSSSFPHKISSQSYFWSLGTYLYIKGPSILVSKLVEKIGRVSLELNVRKVVL

SEQ ID NO: 157481 - protein, 213 aa, Glycine max
  Coding DNA Sequence Number=SeqID_40703
  Subcellular localization annotation: CTP_CleavageSite=37; ConfidenceScore=5.51e-01
ARKTKLRAADVPSSFALTTGIPASSTSAPSPALADPSAQSSQTSDAKLQSLFEGQILIMQSLQELAQQKPIMSVEQFIEKVARSGARPSFMGDNESFTAQAPQPHELEPKNDHSSKAVIPGAVDFLKRRLEMRSNEAAHPEPVPVSADALFLGVDPSLSQYAADSSTPVLEIPEGQTIPVLTLDTSPPVIPVLHLADEEDVQTQDTQDQSQEL

SEQ ID NO: 157482 - protein, 265 aa, Glycine max
  Coding DNA Sequence Number=SeqID_40704
  Gene Ontology: Mol. function=siderophore-iron transporter activity; Cellular component=outer membrane; Biological process=siderophore transport
  Homolog annotation: Hit_ID=Q6D8N7; Match level="QueryCoverage=78%, HitCoverage=28%, E-value=1e-79, Identity=68%"; Hit description=TonB -dependent receptor for Fe(III)-coprogen, Fe(III)-ferrioxamine B and Fe(III)-rhodotrulic acid
  Pfam annotation: Domain name=Plug; Domain location=79-182; Score =49.1; E_value=1.5e-11; Accession=PF07715.5; Description=TonB -dependent Receptor Plug Domain
MSFIHHHPGMGNVSLSQTPSLLAVCIAVALTPAAAFAASTAEDTVIVDGGFDQTQDPSASQERDYSVKTTTTGTKLLLVPRDIPQSVSVISQQRMADQNLQSIGQVLTNTTGVTAQVQDSDRTVFYSRGFFVSNYAYDDLPTSISEVWNFGDTAADTAIYDRIEVVRGATGLMSGTGNPAAYVNMVRKHADSNEFKGNVSASYGSWDKQRYVLDLQAPLVESGKLRGRMIAGYQDNDSFVDNYHYRKKFLYGVMDADVTDSTTLS

SEQ ID NO: 157483 - protein, 157 aa, Glycine max
  Coding DNA Sequence Number=SeqID_40705
MGLAKPPDRPNHDVDDPLYLMTLTITQLFLKSLQVMWDVIVFGVFNENFPLYIKHEDLSEIAHGGQCLSNSVIQLWILAHWQMVVILPKENVFIWFCSLHNRSDNYLKGIINKSVLFFNTFALALVGNINILIVQYESMFALNNSLKGLDDTPRGIL

SEQ ID NO: 157484 - protein, 86 aa, Glycine max
  Coding DNA Sequence Number=SeqID_40706
MSFSRDLHSGNRLPEDGLRDRGSLIVKKSEHKGRVVLVWFRTFKGLLQDSETLKRVAWGLDVGTMVWPNHYKSEFAIFLPLNSSIQ

SEQ ID NO: 157485 - protein, 96 aa, Glycine max
  Coding DNA Sequence Number=SeqID_40707
AGDHDLSFPDFHKLPNDGCQAPHKDQRKVACHQAKVPGRFHSSQLTRVAGDHDLSFPDFHKLPNDGCQAPHKDQRKVACHQAKVLGRKKGRMSSSK

SEQ ID NO: 157486 - protein, 142 aa, Glycine max
  Coding DNA Sequence Number=SeqID_40708
MTGRLLAGSLTFDCRIMHYIIVRILLPHSSNLAQAFEEDLILMWVFLTGRQIDWAHLVRYRMHKALRANAPLPYPQLVTLFLHHFQIPLDDEPFVQVKRSFAIGVGAVTSFGYRMDTRLMQLKEDMGYIWQSFDLPPPPPPS

SEQ ID NO: 157487 - protein, 36 aa, Glycine max
  Coding DNA Sequence Number=SeqID_40709
EVNSRGGGVLLDESPTNAGPNDLVGGNGHSVELTEA

SEQ ID NO: 157488 - protein, 72 aa, Glycine max
  Coding DNA Sequence Number=SeqID_40710
MKRGGLNRLCELSAERRTEEKLSKEEKDPNFLVDFRCLAPIIRQFVKFRDMPEIKENTDAQSVRFCDTPEIK

SEQ ID NO: 157489 - protein, 100 aa, Glycine max
  Coding DNA Sequence Number=SeqID_40711
  Subcellular localization annotation: CTP_CleavageSite=37; ConfidenceScore=5.42e-01
MDRQLDYLVFAQTAPVQTFCWHVTTSFSTGDIRQPRRSSMPWPCLFPSCTGPCLCSSCTGPCLCPRCTGPCLCPRYAGPVYVPGALVPTIVPDALVLPSI

SEQ ID NO: 157490 - protein, 680 aa, Glycine max
  Coding DNA Sequence Number=SeqID_40712
  Gene Ontology: Mol. function=protein serine/threonine kinase activity; Cellular component=spindle pole body; Biological process =protein amino acid phosphorylation
  Homolog annotation: Hit_ID=Q9LER4; Match level="QueryCoverage=80%, HitCoverage=99%, E-value=0.0, Identity=67%"; Hit description=Protein kinase-like protein
  Pfam annotation: Domain name=Pkinase; Domain location=16-277; Score =245.2; E_value=1.4e-70; Accession=PF00069.15; Description=Protein kinase domain
  Pfam annotation: Domain name=Pkinase_Tyr; Domain location=16-277; Score=89.3; E_value=1.2e-23; Accession=PF07714.7; Description =Protein tyrosine kinase
  Pfam module annotation: Pfam domain module=Pkinase::Pkinase_Tyr; Domain location=16-277::16-277
MEHVLEKRFPLNSEDYKLYEEVGEGVSASVYRALCVPLNEIVAIKVLDLEKCNNDLDGIRREVQTMNLIDHPNVLRAHCSFTAGHNLWVVMPYMAGGSCLHIMKSNYPEGFEEPVIATLLHEVLKALVYLHAHGHIHRDVKSGNILLDSNGAVKLADFGVSACMFDAGDRQRSRNTFVGTPCWMAPEVMQQLHGYDFKADIWSFGITALELAHGHAPFSKYPPMKVLLMTLQNAPPGLDYERDKRFSKAFKELVATCLVKDPKKRPSSEKLLKHHFFKQARASKYLARTILEGLAPLGDRFRLLKAKQADLLVQNKALYEDKDQLSQKEYIRGISAWNFNLEDLKSQAALIQDDDIPNAEESQRDKKQKDRLDDFKVSAERLSPGAANHSDDAPTQDKEDGFNNLPDLESSLASFPSKPLQALKGCFDMCEDDVNNSSPRNLDHDGRIDNESSGTSTSLQQNATSHQKKFPSGSLLPDNFLFPKKIVTDGDRDYLQTKYSSDRNHSGPLQYRQKRDTNNLPLVDDTSDGAFVQFRGRFKVTPADLSPMGPSNSTSGPLVSPTSPPNPNFLSVAILPSLQCILQQNGLRHNRISNGFFQEEIIKLIKYAEQSSGKNTESMEAGIVDILQAPPATTRERELHFQVIQLQQSNGILFEELQKQKMKNVQIHANYYSLPMQGRF

SEQ ID NO: 157491 - protein, 271 aa, Glycine max
  Coding DNA Sequence Number=SeqID_40713
  Homolog annotation: Hit_ID=Q6B388; Match level="QueryCoverage=59%, HitCoverage=100%, E-value=1e-80, Identity=85%"; Hit description =Hemolysin-coregulated protein
  Pfam annotation: Domain name=DUF796; Domain location=4-147; Score =207.1; E_value=3.9e-59; Accession=PF05638.2; Description=Protein of unknown function (DUF796)
MAIPVYLWLKDDGGADIKGSVDVKDREGSIEVVAQDHNIYIPTDNNTGKLTGTRIHTPFMFTKEIDSSSPYLYKAVTTGQTLKSAEFKWYKINDAGQEVEYFNTRLENVKVVKVNPLMHDVKNPSYEKHNHLEQLELRYEKITWTYKDGNIIHSDSWNERATAVTPDADGETCPQLLAKPLCAEGTVKKQRWERGKSISVPSAGMRKYHDWRRYILTGRSPSDAARLAGDMNYEKLKGNSNLYSVRLTQQDRVLFSVAGMSITILEIGGHY

SEQ ID NO: 157492 - protein, 110 aa, Glycine max
  Coding DNA Sequence Number=SeqID_40714
  Gene Ontology: Mol. function=nucleoside-triphosphatase activity; Biological process=protein metabolic process
  Homolog annotation: Hit_ID=Q1R7L8; Match level="QueryCoverage=92%, HitCoverage=11%, E-value=4e-41, Identity=78%"; Hit description=ClpB protein
  Pfam annotation: Domain name=Clp_N; Domain location=28-80; Score =13.5; E_value=0.035; Accession=PF02861.11; Description=Clp amino terminal domain
MEKVFMEHHASTLLRRLNPYCARALEAAASLCQTRAHAEILPEHWLLKLLEQGEGDLTVLARRYEWDMDMLWQDLLAWLDKLPRSVRQRPQLSDTLQTLMQEAWLIASLN

SEQ ID NO: 157493 - protein, 66 aa, Glycine max
  Coding DNA Sequence Number=SeqID_40715
MTAWVPFEQQRNELETRIEEQEARFSHEKALAQQLMTRRKDISQQADVADLQQQLEQAQQGDVLVQ

SEQ ID NO: 157494 - protein, 219 aa, Glycine max
  Coding DNA Sequence Number=SeqID_40716
  Gene Ontology: Mol. function=nucleoside-triphosphatase activity; Cellular component=intracellular; Biological process=protein metabolic process
  Homolog annotation: Hit_ID=UPI00005F98AB; Match level="QueryCoverage =98%, HitCoverage=24%, E-value=4e-86, Identity=76%"; Hit description =COG0542: ATPases with chaperone activity, ATP-binding subunit
MTVAAGGDIFAKRLRFQCQRGQLRFQAYNLFWHRVETHPYTCGGGIQQINRLVRQLAARQIAAGQRDGCAYCIISDMHVVVFGVAGFQAAQHQAGGLVVRLVHFYHLKAALQRGIAFEVLLVFRPGSGGDGTQFATGECRFEQVGGIRAAGLVAGANDSVRFIDKQQNRYRGLLHRINHVFQALFEFALHACARLQQTKVEGAQNNRLQAFRNVAFSDT

SEQ ID NO: 157495 - protein, 536 aa, Glycine max
  Coding DNA Sequence Number=SeqID_40717
  Gene Ontology: Mol. function=aminocarboxymuconate-semialdehyde decarboxylase activity; Biological process=metabolic process
  Homolog annotation: Hit_ID=A0B3A0; Match level="QueryCoverage=63%, HitCoverage=97%, E-value=1e-117, Identity=60%"; Hit description =Amidohydrolase 2
  Pfam annotation: Domain name=Amidohydro_2; Domain location=31-342; Score=154.4; E_value=2.9e-43; Accession=PF04909.4; Description =Amidohydrolase
  Pfam annotation: Domain name=MFS_1; Domain location=295-531; Score= -12.3; E_value=0.0012; Accession=PF07690.6; Description=Major Facilitator Superfamily
  Pfam module annotation: Pfam domain module=Amidohydro_2::MFS_1; Domain location=31-342::295-531
MEIVTAPHLAVRNEWLALHREPPLQPELPIIDAHHHLWDRQTGRYLTHEFSDDIQTSGHRVFSSVYVQCRSMLRRHGPETLKPLGEIEFASGIAAMFASGHYANALGCEAIIGGLSLLAGDAMQPAIESALALSGGRLRGMRNPLAWHPDPRVTSSPVTPPAGLALSEPFRRGAACLAQNGLSLDVWVYHTQLDEIAELARQIPTLQIVLDHCGGPVGVGPYSERDPDMFQQWRSSMRHLAELPNVCVKISGFGMTVRGFPFAAAETPPDSQMLAQAWQPWFETIIALFGAERCMFASNFPVDKGMFSYGVFWNACKRLAQQASPDEQAQLFWRTAATCYRITSVENINDHVTAGGQIIGGILFGFIADKIGRVKTAMTCIAIYSLFSGLLAFTHDQQHFALLRFCGALGMGGMWTSGAALIAETWRPERRARGGALMQMGLPVGAILAISLTAIVSSVNGGLEQGAWRYLFMIGALPVFIMSVVAWFTPESQVWLARQQGKAKRTQPASKLGKHNLKGLLLAFVFIFFIQYLFWG

SEQ ID NO: 157496 - protein, 145 aa, Glycine max
  Coding DNA Sequence Number=SeqID_40718
MASRKCKSIGLGPTTQYDTRRFSSLNTWNRYTDNVLGRNIFPERKVELYHTKLNDFKTELERCNFRKCLTNLVNGSIDLALVKEFCANLYSSEGPSPKQSRVRGHLVKIDAGSINTFLETPVVLAEGETLPTYSRYYRLPTDTER

SEQ ID NO: 157497 - protein, 126 aa, Glycine max
  Coding DNA Sequence Number=SeqID_40719
MEEKKTESEQNEDESQQNKKRIECLGFENLQVEERRTHEEWTKNGEEGGKSSRNCSRKRFRSITKASRLGFSSRKHVFSPKTAEMHSIGEKWGGGCHPAPPSELGCFLLKQPSFQNVLEGARFQKF

SEQ ID NO: 157498 - protein, 206 aa, Glycine max
  Coding DNA Sequence Number=SeqID_40720
  Gene Ontology: Mol. function=transcription factor activity; Cellular component=nucleus; Biological process=regulation of transcription, DNA-dependent
  Homolog annotation: Hit_ID=Q076D7; Match level="QueryCoverage=77%, HitCoverage=76%, E-value=3e-28, Identity=46%"; Hit description=DRE -binding protein 3b
  Pfam annotation: Domain name=AP2; Domain location=42-105; Score =110.5; E_value=5e-30; Accession=PF00847.10; Description=AP2 domain
  Subcellular localization annotation: CTP_CleavageSite=60; ConfidenceScore=5.69e-01
MDGNPFGNVPPPPIQVPDNLAISSSSSPTPTTSSPSPTPSGGVRYRGTRYRSGKWVSEIREPRKTKRIWLGTYPTAEMAAAAYDVAALALKGPDTPLNFPNSILSYPIPASLSATDIRAAAAAAAQARIVRAPQECGETVNPDDGGGQGMSERREEYIDEDELLNMPNLLDDMARGMQVSPLRITSYSSDDSPGNSDGDNLWSYTL

SEQ ID NO: 157499 - protein, 242 aa, Glycine max
  Coding DNA Sequence Number=SeqID_40721
  Homolog annotation: Hit_ID=Q2HRX8; Match level="QueryCoverage=46%, HitCoverage=16%, E-value=1e-16, Identity=38%"; Hit description=IMP dehydrogenase/GMP reductase
  Pfam annotation: Domain name=DUF1723; Domain location=167-216; Score =53.0; E_value=9.8e-13; Accession=PF08330.1; Description=Protein of unknown function (DUF1723)
MVRTRGLGRALGHVTGRGVGRGDRDDSGDAPQRQRPTASARRQRVPVTTAHDEPVVPAPDVEADIFSDDPMTPADVEDTGANIPADTGVQAAEDEHEGFPGGPSDLSVLTQYADHVACSVWMGEEHPELKLSYHERKVHSLGRPVPAIEGLVFGTGLSPLIACSVDTGDRGLLSSFVEQWYRETSSFHLPVGELTITLDDVSSILHMPVDDAVQMLVDLLMVFAEAARVETRQCRGPYVHLQ

SEQ ID NO: 157500 - protein, 424 aa, Glycine max
  Coding DNA Sequence Number=SeqID_40722
  Gene Ontology: Mol. function=nucleoside-triphosphatase activity; Cellular component=intracellular; Biological process=regulation of transcription, DNA-dependent
  Homolog annotation: Hit_ID=UPI00005F7033; Match level="QueryCoverage =95%, HitCoverage=67%, E-value=1e-150, Identity=64%"; Hit description= COG3284: Transcriptional activator of acetoin/glycerol metabolism
ADHHAGFQHLQQRRLHLRRQVFDLFEVQRAAVGQFEFTQLARLFFVGVAAQQFTQPLRLRQQLAVEGDIRPGGAFAGVVDSLAEPLFANPFLPAQQDWMLALGRLLPVTDQPPHLQRGGGHLLEAVADAPQLAADILAQPLERVQQGDETAAIAVENRLERQQGGDKLPLAFEGDFDVLQRLPVGDSALEQGGQRQQLRQRFALALLLVQLQQGGGALVDVLQIAAVIPSHHAVVHAVQQAVKLIQMAVGFRQQAVGVQRVADFAGDGQRQRQIAGGAVGQQTAQRDRTALAAAVVVDRRSAERPAVQRPAHVLPAAHPHRVAFRCCQRRGVAPQHAAALVEDHQQTTTWLHVLAGVFQRRLAERQQIVLAAANRFEGGALSAVRCLPDVGLHQAAAAQPGGVNRLCRAQRRRQFAVVNQPLPA

SEQ ID NO: 157501 - protein, 144 aa, Glycine max
  Coding DNA Sequence Number=SeqID_40723
MAEVDEVQEWIKADMEAMKEQMATMMEAMISMKKIMENKHVFSPYGLPSNYTPPNENVNNSTPILIESQQPQTDHAYVSQPMGETHEISHRNLANFKPHLRYATEGQAVGDIPLQNVEASFMMMNQVDSSSFDNDKDDEKKPKE

SEQ ID NO: 157502 - protein, 71 aa, Glycine max
  Coding DNA Sequence Number=SeqID_40724
MASKKRKASSTPTQARYDRSRNVVVYYTKFDEFKEELERRHWDEKLTDFANNNMDIAIVKEFYANLYDPNG

SEQ ID NO: 157503 - protein, 147 aa, Glycine max
  Coding DNA Sequence Number=SeqID_40725
  Subcellular localization annotation: CTP_CleavageSite=20; ConfidenceScore=5.41e-01
MDRLTTMMSALLSAQNSQAAAAAVEQPLVSTTPLSTVTSPPLFLPPGCTWGMPPPVCGSPQPAVSEVPPPFAQQSAPVPQPSTSFPQAAMTYSAPLIHTIQQEVEPIFQAENVVAFDQMEELQERFDGMPRESRSPPRKRSVREGRL

SEQ ID NO: 157504 - protein, 202 aa, Glycine max
  Coding DNA Sequence Number=SeqID_40726
  Gene Ontology: Mol. function=DNA binding
  Homolog annotation: Hit_ID=Q1S0F5; Match level="QueryCoverage=95%, HitCoverage=40%, E-value=4e-41, Identity=42%"; Hit description=IMP dehydrogenase/GMP reductase
MRAGISYNPLLARRQFGYPIKTKPNNLALTNEFYLNHGDHSNKRERFAQAWSAIRRLHRSQLGKKSDYVHESYTQWVIDRTKSFGLPYRLPRYLSSTIPPSSLPIPFDTKEEFHEQLTKERQEKETWKRRCQELERENETLKGKIAQQSREIFIQNQRMIEKDDLLRRKDALLHQDARRKRRFMDLFSRAHSDSEDPSTPGV

SEQ ID NO: 157505 - protein, 363 aa, Glycine max
  Coding DNA Sequence Number=SeqID_40727
  Gene Ontology: Mol. function=transporter activity; Cellular component= mitochondrial inner membrane; Biological process=transport
  Homolog annotation: Hit_ID=Q4A3J5; Match level="QueryCoverage=93%, HitCoverage=94%, E-value=1e-105, Identity=58%"; Hit description =Mitochondrial carrier like protein
  Pfam annotation: Domain name=Mito_carr; Domain location=114-206; Score=109.1; E_value=1.3e-29; Accession=PF00153.17; Description =Mitochondrial carrier protein
  Pfam annotation: Domain name=Mito_carr; Domain location=16-108; Score= 110.2; E_value=5.9e-30; Accession=PF00153.17; Description =Mitochondrial carrier protein
  Pfam annotation: Domain name=Mito_carr; Domain location=214-308; Score=102.0; E_value=1.8e-27; Accession=PF00153.17; Description =Mitochondrial carrier protein
  Pfam module annotation: Pfam domain module=Mito_carr::Mito_carr::Mito_ carr; Domain location=114-206::16-108::214-308
MSSNDQTSGTSLYIRALICNAASGAAAGAIAATFVSPLDVIKTRLQVHGLPHGQKGSIIITSLQNIVRNEGFRGMYRGLSPTIVALLPNWAVYFTSYEQLKGLLRSRDGCNELTTIGSIIAAAGAGAATAISTNPLWVVKTRLQTQGMRPDVVPYKSVLSALTRITHEEGIRGLYSGIVPSLAGVSHVAIQFPAYEKIKSYIAEKDNTTVDKLTPGSVAVASSISKVFASVMTYPHEVIRSRLQEQGQAKNIGVQYAGVIDCTKKVFQKEGIPGFYRGCATNLFRTTPSAVITFTSYEMIHRFLERVVPQDKGYLHGLSKANELNKPQPKASGSDTDRGQPPSQSNTKASSIPHGNKEQLTRH

SEQ ID NO: 157506 - protein, 163 aa, Glycine max
  Coding DNA Sequence Number=SeqID_40728
  Homolog annotation: Hit_ID=Q1SL15; Match level="QueryCoverage=60%, HitCoverage=12%, E-value=2e-10, Identity=34%"; Hit description =Ovarian tumour, otubain
MDEDQWMYDSIMSEEVDMDDQNEQECGMNEHVDCSDAFNTSQMMFCSKFDQLLMKTDLWRKKDFVRRDTGSRKCGCSFKLHEKPLVGGRLIKDEKTIIVDMTKSMVKPRNILLTLKEHNANSCTTIKQVYNARSAYRSSIGGSDVEMQHLMKLLERDQYISLT

SEQ ID NO: 157507 - protein, 316 aa, Glycine max
  Coding DNA Sequence Number=SeqID_40729
MASRKRKSIGSRPTTQYDTRRFHSLDAWNRYTDNVLGRNILPERKVELYHTEFDDFKTELERHNIHKRLTNLVDGSIDVALVKEFYANLYSSEGPSPKQARVRGHLVKIDTDSLNTFLETPMVLAEGEALPTYSRYCKLPSNPREIEAALCIPGRGFILNTEGHPGRILRKDLTNLAQVWSVLSYSNLAPTSHTSDLTVDRARLIFGLVSHMDMNIGALISGQMTSIAQSNSSRLGFPALITALCRARGVVSNSLTFECLSMVINLAYIRKNCWNPNDLTVSIRGARRARARPADLPSTSTTPTPASTSAAPLVLA

SEQ ID NO: 157508 - protein, 131 aa, Glycine max
  Coding DNA Sequence Number=SeqID_40730
EAEPMEKRLCCDPLTCPVKYPPGIFQEISAPLEVEELEEEEEEKDEEEEARQVVLYFVGGVDYGVNALASSWWRRMLGSSINNLEMIMLLEQKDEVSISIDMEIEEEVINQNMVNGPVGVIKCIVSMTVLT

SEQ ID NO: 157509 - protein, 112 aa, Glycine max
  Coding DNA Sequence Number=SeqID_40731
MTFSKAKLTRIQPHSKDRLLKLCVYVKAPPRKSREKLQRRRKWVQRAQKNKEINVEGKGFKGEGNGVDEALGSFVLWSLDNIVADLASHQGVVKGYKKAVQQSSSKHLTATN

SEQ ID NO: 157510 - protein, 226 aa, Glycine max
  Coding DNA Sequence Number=SeqID_40732
MTDPGSSQEAWERYTDIVVPRKLLPDRNVVVYYTKFDEFKEELERRHWDEKLTDFANNNMDIAIVKEFYANLYDPKDKPPKQVRVRGHLVKFDEDTLNTFLKTVVILEEGEILCSFSRFALLRPDPQELAAKLYILGRGFELNADGQPLKILRKNMTTLAQTWNVLYFFNLIPTSHTSDVTLDRAKLIYGPRKARGKRSEVPTTSAPPETPAPSSSTAPVIPPTST

SEQ ID NO: 157511 - protein, 222 aa, Glycine max
  Coding DNA Sequence Number=SeqID_40733
MEEKGWKNEIENYEEKKEFPKESSQALGACIRAERGLGCAFLALSVCFSMSGLRTEQTVLTNPDIYNDVIPSAGFSRISDLRGLTPISRGLDSWPSNLLDEGLWGHQWWVHPQVDGDCVGGGASGATTLARTQQGPGKVMDGSAGFQQFFLMYDKLIIGLSDSKVKIGKYAPCLSECNEVLPQQLPRGLVGIQDESSSRCIGSTPDNLLCQQGQLGCQGSHL

SEQ ID NO: 157512 - protein, 211 aa, Glycine max
  Coding DNA Sequence Number=SeqID_40734
MARNAKRATRTQHAHENGRTRLVHSLWSHGNTEWCLLKEGNPPRIPPVSLQKQLGTDIRTTSTSRTFYWRGTWSSSRACSMNFRGSGHGVITRLLEKQINIALAWGHVIRFNAETINDFLDTPVVLADREDYLVYSQYLHMYPDHQAITAKLCTPRGGFILNADEAPWKLLWKNLITLAQTWSILSYFNLAHTSHTSNLNVDGARLICDLV

SEQ ID NO: 157513 - protein, 61 aa, Glycine max
  Coding DNA Sequence Number=SeqID_40735
MYINLPIYGSFWQKGAILKKCQRIHRAKLSTRLALSSNSLTRVKHESGATHIVEIKKTFQA

SEQ ID NO: 157514 - protein, 63 aa, Glycine max
  Coding DNA Sequence Number=SeqID_40736
MDEWDGKSSVKWWLDRNIEMTITQATGLQMRTRLKMKGSKESLFPARATHKGCESPLIQPGCS

SEQ ID NO: 157515 - protein, 349 aa, Glycine max
  Coding DNA Sequence Number=SeqID_40737
  Homolog annotation: Hit_ID=A0BRL9; Match level="QueryCoverage=33%, HitCoverage=45%, E-value=3e-09, Identity=31%"; Hit description =Chromosome undetermined scaffold_123, whole genome shotgun sequence
  Pfam annotation: Domain name=Fz; Domain location=112-199; Score= -46.8; E_value=0.1; Accession=PF01392.12; Description=Fz domain
MGPVEVPNFTSCKLSPANQKPEFYWELVTNWFYRIYKHIFCKLLVSSTKAKMGNWASLSLLYACHAVSMTLLEIYHGKPSGVCVSQGGRFPPFKSEGSTPKKGPKDLTLCRIFRKKTCCDVTHTHPALLSVRKLASTGEASQECLHLWELLECSICDPRVGTQPGPPLICASLCERIYEACSNAYFSMDVKTQILAPCGVNDFVCGRAAEWVSNGTDLCLAAGFRVKPSESDIVHIASEETSCYGDKASLGSVADSWKASQFELTRKGESLRMLDDFQQWVREMPFGEKVSWAIGGMVLTAGLVFISKRKSHNQRQKLAAIKRTARKLEGRMMEQWPSNAQENRRRVSR

SEQ ID NO: 157516 - protein, 84 aa, Glycine max
  Coding DNA Sequence Number=SeqID_40738
MQRILGCLAATFSACLAPGRGNDRKQKIQWPIVSGHRLTLVDFRIQLVSTSNRDLRRPCPCYHKICMCMCMYVPYAITFLVKAS

SEQ ID NO: 157517 - protein, 137 aa, Glycine max
  Coding DNA Sequence Number=SeqID_40739
  Homolog annotation: Hit_ID=Q1SKD7; Match level="QueryCoverage=71%, HitCoverage=26%, E-value=2e-10, Identity=35%"; Hit description =Ankyrin
MAPRKLASKRSRKDKAAEGTSSAPEYDSHRFRSAEHQQRFEAIKGWSFLRERRVQLRDDEYTDFQEEIVRRRWASLVTPMAKFDPYIVLEFYANAWPTEEGVRDMRCYRPVPGIPFSAGRGLGVQVWPEEEPVRWAR

SEQ ID NO: 157518 - protein, 143 aa, Glycine max
  Coding DNA Sequence Number=SeqID_40740
MAGPYYGASSFLYGFPSQHADVENSVECGGSCNIWVTISTPRSKHLLQAETSLDQYDVMNCSPSICCCSLWIDLPKLSCFYAPGSFRSGPDNHYFVHGSTHDLLQEDGMNIGQQPTNSAVCPKSYPTGYDSPIWEPFGLRSKI

SEQ ID NO: 157519 - protein, 91 aa, Glycine max
  Coding DNA Sequence Number=SeqID_40741
MALPKPASNMTETSAQPSPMSSKEEIAAGLSTYMGFPERLMQDVGFLVSLFVFHFLYYRACGLFYALVYRGERRDKILRDYGLGLLGSETR

SEQ ID NO: 157520 - protein, 199 aa, Glycine max
  Coding DNA Sequence Number=SeqID_40742
  Homolog annotation: Hit_ID=Q2RAU2; Match level="QueryCoverage=40%, HitCoverage=47%, E-value=1e-14, Identity=49%"; Hit description =Transcription initiation factor IIE, alpha subunit, putative, expressed
MKIGKEETGTIRGEQPREWKMKRLEKKTPGTIRGATKGVRNEKHNHASSPKACWSCWRVAWACSALQLKSFEVHHGCASGEMLVKLAARAFYDDLTSKGENQPKSGRSDNRGIAVVILDALTRRQWVREEDLAKDLKLHTKQLRRTLRFFEEEKIITREYRRENYDSPVTYLNLLFGALGSVLLGSNCNGLDLSPALIL

SEQ ID NO: 157521 - protein, 169 aa, Glycine max
  Coding DNA Sequence Number=SeqID_40743
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q2RAU3; Match level="QueryCoverage=58%, HitCoverage=29%, E-value=1e-20, Identity=49%"; Hit description =Transcription initiation factor IIE, putative
MYSAATAATVDVQLTGKEGEEKIYDVVRYRIHRMKKLLKDELDNKNTIEEYICRKCGKRYNALDALRLVSFEDDDFHCESCNGKLEVESDKFVAQEGGDGDENARRWRHEKLKDMLQKMEKLSPSLDSSPHLWSSPPFFAAIGAAMHHHLIRPSLLIFLTSCQIYSSPV

SEQ ID NO: 157522 - protein, 130 aa, Glycine max
  Coding DNA Sequence Number=SeqID_40744
  Homolog annotation: Hit_ID=P25011; Match level="QueryCoverage=27%, HitCoverage=7%, E-value=2e-07, Identity=75%"; Hit description =G2/mitotic-specific cyclin S13-6
MAKVGEEKVEYIKYSDPQKGAVAMLPPAKTLLPEGLASRHCWHCHHVETTLKPSPLIIVDVEFPSAWISDNPPKMAMYSGICKHGGREREQGDRVGERDSQHLRVHASNEEAALQLGVEAEASDPNVQGD

SEQ ID NO: 157523 - protein, 1505 aa, Glycine max
  Coding DNA Sequence Number=SeqID_40745
  Gene Ontology: Mol. function=ARF guanyl-nucleotide exchange factor activity; Cellular component=intracellular; Biological process =regulation of ARF protein signal transduction
  Homolog annotation: Hit_ID=Q42510; Match level="QueryCoverage=96%, HitCoverage=100%, E-value=0.0, Identity=72%"; Hit description =Pattern formation protein EMB30
  Pfam annotation: Domain name=Sec7; Domain location=563-750; Score =384.3; E_value=1.8e-112; Accession=PF01369.11; Description=Sec7 domain
MGHVKLQTQTGISATEEGSGQCEAEYPNKTTVACMINAEIGAVLAVMRRNVRWGVHYMSDDDQLEHSLVQSLKALRRQIFSWQNQWHVISPALYLQPFLDVIQSDETGAPITGVALSSVYKILTLDVIDQNTVNVGDAMHLVVDAVTSCRFEVTDPGSEEVVLMKILQVLLACAKSKASMMLSNQHICTIVNTCFRIVHQAGTKSELLQRIARYTMHELVRCIFSHLQDIDNTELALVNGNTALKEEVGGINNEHNSANVLENGKLNSANDGRPLSTGIASSTVSDVAATVVDEDTAIASIGKETDLNELQLMNEPYGIPCMVEIFHFLCSLLNVVEHMGMSPRSNTIAFDEDVPLFALTLINSAIELGGPSFHRHPRLLSLIQDELFRNLMQFGLSMSPLVLSMVCSIVLNLYHHLRTELKLQLEAFFSCVILRLAQSKYGASYQQQEVAMEALVDFCRQETFMVEMYANFDCDITCSNVFEDIANLLSKSAFPVNSPLSSLHILALDGLIAVMQGMAERIGNGSLSSEQSPVNLEEYTPFWQEKCENFSDPNNWVPFVCQRKHFKKRLMIGADHFNRDTKKGLEFLQATHLLPDKLDPQSVACFFRYTAGLDKNLIGDFLGNHDEFCVQVLHEFARTFDFKDMMLDTALRLFLETFRLPGESQKIQRVLEAFSERYYEQSQNILANKDAALLLSYSIIMLNTDQHNSQVKKKMSEEDFIRNNRRINGGKDLPRQFLSELYHSICKNEIRTTPEQGSGFPEMTPSRWIYLIHKSKKSAPFIVSDSKAYLDYDMFSILSGPTIAAISVVFDNAENAEVYQTCMDGFLAVAKISAYYHLENILDDLVVSLCKFVTVFDPLSVPESILAFGDDTKARMATETVFTIANRYGDYIRTGWRNILDCILKFHKLGLLPARMASDAAEESELSTETEDGGKQNTNSLSLSRLPSVNTPKRPSGLMSRFSQLLYLGAEEPRSEPTEEQLAAQQCTLQTIQKCHIDSIFTESKFLQAESLLQLAKALTSAGVWPKKGNSTSEDEDTSVFCLELLVAITLNNRDRIELLWQGVYEHISNIVQSTVMPCALVEKAVFGLLRICHRLLPYKENITDELLRSLQLVLKLDARVADAYYEQITQEVSHLMKANASHIRSHLGWRTITSLLSITARHLEAAEAGFDALLFIMSDQAHLLPANYVLCVDAAKQFAESRVGQVERSVMALDLMAGSVSCLEKWTNDAKQATKEEEVAKMLHNIGDMWLRLIHGLKKLCLEQREEVRNHALLSLQNCLTGSVGINLPHSLWLQCFDQVIFSVLDDLLEISQTHSQKDFRNIEGTLVLALKLLCKVFLQLIQDLSQLPGFNKLWLAVLSRLEIYMKVKVRGRRSEKLQELVPELLKNTLLVMKAGRVLVQSNTVDGSSLWELTWLHINNFAPSLQSEVFPEQDSEHLQHKQTEKVEGLGPEESNSVSSNETAGCLGSLEVIMQNITDLIHIFIGTLDVSVRFLVEDMLWLETH

SEQ ID NO: 157524 - protein, 161 aa, Glycine max
  Coding DNA Sequence Number=SeqID_40746
DMTERLLAGSLALESRILHYLIARIAINAPLPYPHLVTLFLQHFNIPLDFEPYVPIKRSFLISAAVVASFGYRKERNGSWAKKGAQPNDDEGQIPVEGDSSLLQSILDRFDGLQTYVGERFDALEQQVDMRFDAMDSRITKVEEEVTIIRDCLDLLPPPSS

SEQ ID NO: 157525 - protein, 99 aa, Glycine max
  Coding DNA Sequence Number=SeqID_40747
MVPRMPSGLSPLDDKGKKVRDQMVPACHRARRLWMTKGEKVRDQIVPACHRARRLWMTKGAEDNVSLCMPSDTTVSEWRKGERNDHNLSLHVIGPVASG

SEQ ID NO: 157526 - protein, 55 aa, Glycine max
  Coding DNA Sequence Number=SeqID_40748
MGVKPSEAINNGPRMKLGFSLKHPETLRIPRRWVLNTVKQRSHANKQWSPNEIRV

SEQ ID NO: 157527 - protein, 211 aa, Glycine max
  Coding DNA Sequence Number=SeqID_40749
  Gene Ontology: Mol. function=receptor activity; Cellular component =integral to membrane
  Homolog annotation: Hit_ID=Q5Z9P4; Match level="QueryCoverage=97%, HitCoverage=55%, E-value=3e-37, Identity=40%"; Hit description =Permease-like
  Pfam annotation: Domain name=DUF803; Domain location=1-178; Score= -86.2; E_value=6.7e-06; Accession=PF05653.4; Description=Protein of unknown function (DUF803)
MAMVSVVLALIIHFEPHYGQTNMLVYLGICSLVGSLTVVSIKAIGIAIKLTLDGISQIVYPQTWFFLTVAIICVITQLNYLNRCCSMGQGQTLLAFVIIVVFKRKTNQRVGLLVLIFKHDPLKVIQRSIKHNVVNSPVLWMIGPGQDISSIASEICGFITVLTGTIILHMTREQEESNMQKTLTWLIGEDMMKDVENEHLILIHDSDYLER

SEQ ID NO: 157528 - protein, 32 aa, Glycine max
  Coding DNA Sequence Number=SeqID_40750
MYDTDLNDHNIHALMNVITYYDVASKEHATRG

SEQ ID NO: 157529 - protein, 35 aa, Glycine max
  Coding DNA Sequence Number=SeqID_40751
MKAARLRSDPNILSHIFTSQNLLYNEFPSFFCKKQ

SEQ ID NO: 157530 - protein, 488 aa, Glycine max
  Coding DNA Sequence Number=SeqID_40752
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q69T67; Match level="QueryCoverage=53%, HitCoverage=40%, E-value=1e-53, Identity=64%"; Hit description =Lustrin A-like
  Pfam annotation: Domain name=DUF231; Domain location=283-446; Score =79.4; E_value=1.1e-20; Accession=PF03005.6; Description=Arabidopsis proteins of unknown function
  Subcellular localization annotation: CTP_CleavageSite=28; ConfidenceScore=5.54e-01
MHVLFSAKRVAFSESFLPHRRRLFTWFSLSTLASLVLLSLFLLSNSLRVPKVLVFVPKFGAVGANSSVGPCPLFPFNTSHSFSNENDTFDTSKSNGSESSVKRIEEGSVVENLHVVNNVSDENIKSVAEGRGLENSSFSSILLSESNHGKQPKHEGGFVGEKSLKNVTVTHNEKMHVGLYDEKCDIFDGKWVRDGSKPYYPLGSCRLIDRDFNCHRNGRPDAEYVKWRWQPNGCIIPSLNATDFLERLRGQRLVFVGDSLNRNMWESLVCILRQSINKKKRVFEISGRREFKKKGVYAFRFEDYNCSVDFVVSPFIVQESTFKGKNGSFETLRLDLMDRTTARGGQWNSGGQCHKETEPIFNEAYLQRYPSKMLALEHVIQQMKTPVVYMNISRLTDYRKDGHPSVYRTGYKASMKQNTAALFEDCSHWCLPGVPDTWNELLYVSLLKYGKVLPLHMQRGCLTLDQQVTKAQLYPCDYTIWVDSKGRK

SEQ ID NO: 157531 - protein, 56 aa, Glycine max
  Coding DNA Sequence Number=SeqID_40753
MYMIKINKLFIPIVSWNTFNKLKRKPDSSHLQIECYGQHKLRNQWLKHKQTVGGGV

SEQ ID NO: 157532 - protein, 55 aa, Glycine max
  Coding DNA Sequence Number=SeqID_40754
MEIDIKERPKEVKSYFSHFQGNQSAPERSSYGERTKKEKVESAQVETSTCNYGEQ

SEQ ID NO: 157533 - protein, 45 aa, Glycine max
  Coding DNA Sequence Number=SeqID_40755
MRFHCYANNAAYYKQRVGRETNLFAEKKKKTLGAPRGEEASSRRR

SEQ ID NO: 157534 - protein, 80 aa, Glycine max
  Coding DNA Sequence Number=SeqID_40756
MEVFGSLAGNDKEKTKKNRFLEACWATSRVSTWWAASNRACPVVQPCPVTAEATDTACVRCESDAGHADEVPHLCFLDLH

SEQ ID NO: 157535 - protein, 139 aa, Glycine max
  Coding DNA Sequence Number=SeqID_40757
MSHPEPMVEENTIEVDSNLDSSLNHETSQHTPVVEEELPYKDHATIFIPISIVETNEPIIDEIVAKTSLVMNVENHLGETDPTNVDPIAFIEAWPSNSMPSKAYEFGHNRPFTHFDEVVAKFQRLDFDPNLKDSLSNPN

SEQ ID NO: 157536 - protein, 108 aa, Glycine max
  Coding DNA Sequence Number=SeqID_40758
  Subcellular localization annotation: CTP_CleavageSite=16; ConfidenceScore=5.04e-01
MVASSHHNISIDQNAYANTKKSTPLPTPRVTTTTTNKGLELILIPGHKEECKKVWETQELLPTSLNTKHFCFAATITSLKPLGKTYALGLIEDQIEMTEVDIDFSAKS

SEQ ID NO: 157537 - protein, 58 aa, Glycine max
  Coding DNA Sequence Number=SeqID_40759
MEEERKRRNITVLLGKTVSRVIQLIARFGANSLLTFGSLLRFLWELWHHMALLKIWEF

SEQ ID NO: 157538 - protein, 474 aa, Glycine max
  Coding DNA Sequence Number=SeqID_40760
  Gene Ontology: Mol. function=transcription regulator activity; Cellular component=nucleus; Biological process=regulation of transcription, DNA-dependent
  Homolog annotation: Hit_ID=Q9LSE2; Match level="QueryCoverage=63%, HitCoverage=57%, E-value=7e-97, Identity=63%"; Hit description =Transcription factor ICE1
  Pfam annotation: Domain name=HLH; Domain location=276-323; Score =36.8; E_value=7.6e-08; Accession=PF00010.16; Description=Helix-loop -helix DNA-binding domain
MSRINNSLVWMDEPEAENTASASWARNSKPNNNNIIITTGTTTTTGFVETSNDLGSLCAFKPMLDVDDEWYNNITNHHHHHQDMAFDPDNLLLHPSAVDSSSSCSPSHLQFFLPPNPKLNPFDMGFLDPQASSSLPLLASETTHFTPPQTSTTTAFAGFQSLQEGSSNPLFLNRSNILRPLESLPPSGAQPTLFQKRAALRKNMNMSDNKKRKEKDEVVVEDVSFDGSGLNYDSDDLTESNYNDAKEKNGGGGVSSNANSTVTGLDQKGKKKGMPAKNLMAERRRRKKLNDRLYMLRSVVPKISKMDRASILGDAIEYLKELLQRINDLHNELESTPVGSSLTPVSSFHPLTPTPPTLPCRIKEELCPSSLPSPNGQPARVEVRLREGRAVNIHMFCGRKPGLLLSTMRAMDNLGLDIQQAVISCFNGFAMDIFRAEYKRLTILLFQQCKEGQDVHPEQIKAVLLDSAGYNGMM

SEQ ID NO: 157539 - protein, 389 aa, Glycine max
  Coding DNA Sequence Number=SeqID_40761
  Gene Ontology: Mol. function=translation initiation factor activity
  Homolog annotation: Hit_ID=Q6ZI51; Match level="QueryCoverage=78%, HitCoverage=60%, E-value=3e-30, Identity=34%"; Hit description =Putative eukaryotic translation initiation factor
  Pfam annotation: Domain name=eIF-4B; Domain location=5-389; Score= -131.8; E_value=1.2e-07; Accession=PF06273.2; Description=Plant specific eukaryotic initiation factor
MAATVSSAWSKPGAWALDSEEHEAELLQQNNDKPLADFPSLAAAAAKPKKKKAQTYSLAEFTAKPDTSFADQDPVVLPTGPRQRTAEELDRTRLGGGFRNYGDRPNRNNSGGGDESSNSRWGSSRVSDEPRRNGFGARDSNRELPPSRADETDNWAASKKPSGGGFERRERDKGGFFDSQSRADESDSWVSNKSFVPSEGRRFSSNGGGERRVVGFGSSGGADSDNWNNKKKSESNIGSSESVGVGGRPKLVLQPRTLSVSNEGDNVGKPKGVNPFGEARPREQVLAEKGQDWKKIDEQLESVKIKETSGGGGDGFGKRGFGSSNGGGGGRAILPESRTERSWRKPQSDDDRPKSCNAVELFALKCSAEKVENEPDQKKEVEDEHVEEN

SEQ ID NO: 157540 - protein, 114 aa, Glycine max
  Coding DNA Sequence Number=SeqID_40762
  Homolog annotation: Hit_ID=Q84RB9; Match level="QueryCoverage=49%, HitCoverage=18%, E-value=4e-07, Identity=51%"; Hit description=Ki1 protein
MPYIKSHHQQQSHKLRQLIPAATTTTEKEEEELGIPLVVVVVLVPLFIFDGFQGLETETLGKTAPAQIIIPQTEKNGCLSYPEKVVTKQIVWPGTHDSATNKIGIPCITRPFAQ

SEQ ID NO: 157541 - protein, 1367 aa, Glycine max
  Coding DNA Sequence Number=SeqID_40763
  Gene Ontology: Mol. function=protein translocase activity; Cellular component=chloroplast outer membrane; Biological process=protein targeting to chloroplast
  Homolog annotation: Hit_ID=Q9SLF3; Match level="QueryCoverage=76%, HitCoverage=86%, E-value=0.0, Identity=60%"; Hit description =Putative chloroplast outer membrane protein
  Pfam annotation: Domain name=AIG1; Domain location=734-920; Score =109.7; E_value=8.5e-30; Accession=PF04548.7; Description=AIG1 family
  Pfam annotation: Domain name=MMR_HSR1; Domain location=734-818; Score= 9.5; E_value=0.00014; Accession=PF01926.13; Description=GTPase of unknown function
  Pfam annotation: Domain name=Miro; Domain location=735-862; Score= -13.0; E_value=0.1; Accession=PF08477.3; Description=Miro-like protein
  Pfam module annotation: Pfam domain module=AIG1::MMR_HSR1::Miro; Domain location=734-920::734-818::735-862
MDYEADGFGANGEGESKRVVGGEGVSEESVAGSDQVKGLETEEVFQEAMEPREQVHDQGSELNLEDTVVDKQYDAETGVALTSALADGNTPDAAQEPDYFKEAVLADADSGKLGGDDVISEQDLEERDGQGSDNVHLDGVDSGVPVDGEIFDESHGVGDDNLESSDGGGGKEESGLNSDREMLVQENGTMVDENSGLVSERAEIDDSEFMTPRENGGMIFENGSTNKVDGVATEPIMESESSEVIPAQGTDAGDLKECGSDTELGDDKIEVKLNASADPSGEIQDDTSEEVHDNSAHMTLEHQDEVTRDMKDDSLGTNMSHEDRNGEEMSTDGIQNTEVRDYGNGHAEAESSPPFLENSSTNLTPSIQEASAAEPKEASNKDDQSQIFDEEHRDHDNTSVVEEPESIQEKIIQQTGTTPSAAEPKEASNKDDQSQIFDEEHRDHDNTSVVEEPESIQEKIIQQTGTTPSAAEPKEASNKDDQSQIFDEEHRDHDNTSVVEEPESIQEKTIQQTGTTPSAAEPKEASNKDDQSQIFDEEHRDHDNTSVVEEPESIQEKIIQQTGTTQVTGEQHVQPAADISSSSKRSAGTVPTPVRPSSENSPAAGPTPVHPTGLGRAAPLLEPASRVVQQPRANGAVSNTQSQQMEDSSSGEAEEYDETREKLQMIRVKFLRLAHRLGQTPHNVVVAQVLYRLGLAEQLRGRNGGRVGAFSFDRASAMAEQLEAAGQEPLDFSCTIMVLGKTGVGKSATINSIFDEVKFNTSAFHMGTKKVQDVVGTVQGIKVRVIDTPGLLPSWADQRSNEKILHSVKHFIKKTPPDIVLYLDRLDMQSRDFSDMPLLRTITEIFGPSIWFNAIVVLTHAASAPPEGPNGTASSYDWFVTQRSHVVQQAIRQAAGDMRLMNPVSLVENHSACRTNRAGQRVLPNGQVWKPHLLLLSFASKILAEANALLKLQDSPPGKPYVARTRAPPLPFLLSTLLQSRPQLKLPEEQFGDEDSLDDDLGESSESDDENEHDDLPPFKPLTKAQVEELSKAHKKAYFDELEYREKLLMKKQLKEEKKQRKMLKKRAESAKDLPSDHSENVEEESGGAASVPVPMPDLALPASFDSDNPTHRYRYLDSSSNQWLVRPVLETHGWDHDVGYEGLNVERLFVVKEKIPLSFSGQVTKDKKDANVQMEISSSVKHGKGKATSLGFDLQTVGKDLAYTLRSETRFTNFRRNNATAGLSFTLLGDALSSGLKIEDKLVASKRFKLVVSGGAMTGRGDIAYGGSLEAQLRDKDYPLGRFLTTLGLSVMDWHGDLAVGCNVQSQIPVGRHTNLVARANLNNRGAGQISIRLNSSEQLQIALIGLIPLLKKLVGYHQQTQFGQY

SEQ ID NO: 157542 - protein, 403 aa, Glycine max
  Coding DNA Sequence Number=SeqID_40764
  Gene Ontology: Mol. function=binding; Cellular component=nucleus; Biological process=protein kinase C activation
  Homolog annotation: Hit_ID=Q9FFG8; Match level="QueryCoverage=98%, HitCoverage=73%, E-value=2e-67, Identity=29%"; Hit description =Selenium-binding protein-like
  Pfam annotation: Domain name=PPR; Domain location=128-162; Score =44.5; E_value=3.5e-10; Accession=PF01535.11; Description=PPR repeat
  Pfam annotation: Domain name=PPR; Domain location=230-264; Score =33.5; E_value=7.2e-07; Accession=PF01535.11; Description=PPR repeat
  Pfam annotation: Domain name=PPR; Domain location=265-299; Score =15.0; E_value=0.12; Accession=PF01535.11; Description=PPR repeat
  Pfam annotation: Domain name=PPR; Domain location=66-100; Score=21.3; E_value=0.0035; Accession=PF01535.11; Description=PPR repeat
  Pfam module annotation: Pfam domain module=PPR::PPR::PPR::PPR; Domain location=128-162::230-264::265-299::66-100
MVAGYAHKGRFAEALRFYGHLRRLSVGYNEFSFASVLIVSVKLKDFELCRQIHGQVLVIGFSSNVVISSLIVDAYAKCGKLEDARRLFDGMPVRDVRAWTTLVSGYATWGDMKSGAELFSQMPKSNSCSWTSLIRGYARNGMGYEAIGVFRQMIRHQVRPDQFTLSTCLFACATIASLKHGRQIHAFLVLNNIKPNNVVVCAIVNMYSKCGSLETAMQVFNFIGNKQDVVLWNTMILALAHYGYGIEAIMMLYNMLKLGVKPNRATFVGILNACCHSGLVQEGLQLFKSMTGGHGVVPDQEHYTRLANLLGQARSFNKSVKDLQMMDCNPGDHGCNSSMGLCRMHGNIDHETEVAAFLIKLQPESSAAYEFLASTYASLGKWELVEKIRHILDERQGRKGSGY

SEQ ID NO: 157543 - protein, 76 aa, Glycine max
  Coding DNA Sequence Number=SeqID_40765
MIEINSEKNQRCIKGGEKKEDKAQLINLWKTEQAGAVGGDSGDVRWKARSEECDKEGKGLGGCKNGVVPASSLLLF

SEQ ID NO: 157544 - protein, 44 aa, Glycine max
  Coding DNA Sequence Number=SeqID_40766
MERERMRNRREQDTCRAKVCVNVYGPKQQQREGIFVPAQILILL

SEQ ID NO: 157545 - protein, 58 aa, Glycine max
  Coding DNA Sequence Number=SeqID_40767
MRRSDRISMVVGLSMWRYDRGRCTIDLMGQCVKGWGLALGAVGDGEYEQFGDEGEGEG

SEQ ID NO: 157546 - protein, 84 aa, Glycine max
  Coding DNA Sequence Number=SeqID_40768
MIAQSWCRVVAPTEPQRWRLPVGGGRMQVVNGDYGGGWSLGWVGRRWGVCEMTREEGEGRGRGKLDLFVGSSGPIATPKGINAP

SEQ ID NO: 157547 - protein, 263 aa, Glycine max
  Coding DNA Sequence Number=SeqID_40769
MRSGNNIIRTVNVTVTVIATAESRIKEVLRHLKRFNTDLPLMLSSRFSCVSTPNTQLKIAVDKYVLYQKANCYKGKELLIEEDEEAPPTKYVKVHPSKLSKHEPEVIKRKKKHTNMDLYAIIRFYRLKAHYPGLEPDEKPPVDGIDHQIGLLSDSESYLLHSRDSFQHGLLMDQGVLCCLPGTCLLFCIFPTPDSSSLITLNPSLKMFILMLNLKLILMCLHLKHMILHLPGSTLAGLRLSYSEQGKNLLKLWKTDDMLRSKL

SEQ ID NO: 157548 - protein, 168 aa, Glycine max
  Coding DNA Sequence Number=SeqID_40770
  Gene Ontology: Mol. function=RNA-directed DNA polymerase activity; Cellular component=chromatin; Biological process=chromatin assembly or disassembly
  Subcellular localization annotation: CTP_CleavageSite=42; ConfidenceScore=5.25e-01
MTSKGAGNGQKSADIARGFYSLPPFGRQSGGGRPYSCGGGKRVATLKAENCVAGRCVMKSMDISSHTLVGIGRGCSSPAGRARRNWTEVDVRSLRRPCGPLTVLRDTRAGWWGSHCGCDSQCELKDWSSPGIIVLGTEGHRVTFARDPPGIPGDRDNASATILDAPAL

SEQ ID NO: 157549 - protein, 723 aa, Glycine max
  Coding DNA Sequence Number=SeqID_40771
  Gene Ontology: Mol. function=RNA-directed DNA polymerase activity; Cellular component=chromatin; Biological process=chromatin assembly or disassembly
  Pfam annotation: Domain name=RVP_2; Domain location=246-359; Score= -36.9; E_value=0.00075; Accession=PF08284.2; Description=Retroviral aspartyl protease
  Pfam module annotation: Pfam domain module=RVP_2::RVT_1; Domain location=246-359::490-659
MADHTTRKTTTDRLEDAVARLTHNQASLNEKYTELSGKVDSILDHLRLHDTNTTHSSPRTSFSQRNHIKLDISRFDGRDSMGWIFKITQLFDYQNTPEEERITVASFYLDGAALSWYQWMFRNGFITSWPGFLQALESRLANRVIGLPPPFMLSCFISGLSPEICREVLALQPISLPQATALAKLQEDKILMLIAENPTPEIDELSQEISTSPAAATNEVSELTPEDPYPHISLHALSGLPSSETFCLYGELNHAHLTILIDSGSMHNFLQPRIAQFLHLPVKSTQPLRVLVRNGSILNCDQLCPDTSLSLQGHHFSVSFHLLPISGADAVLGIEWLKQFGPVVTDYTSLVMKFHHLGQAIEIHADVTNGPEPVSTAQVKRFIQTGSTSTLFHLSILPTAQPGPTSHRLPQSHLPHLVSAIETLLYQYQQLFQTPTTLSPPQAVTHHINLLPSSSPINVRPYQYPHFQKTKIEKQISNLLSASLIRPSTSPYSSPVLLVKKKDGTWRMCVDCRALNAVTIRDRFPIPTIDVLLDELGQSTWFSKLDLRQGFHQILMHEPDIEKTTFRTHHGHYEYRVMAFGLSNAPSTFQAAMNNLLTPFLRCFATVFFDDILVYSKSLSSHIHHLEAVFKALLHGQFYLKRAKCVFAQDQVEYLGHDAFEWNEDSQAAFDNLKLTMTRAPVLALPNFSELFVVEIDASQTAMGVVLTQKDHPVAFFSKVFGP

SEQ ID NO: 157550 - protein, 242 aa, Glycine max
  Coding DNA Sequence Number=SeqID_40772
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=56%, E-value=4e-86, Identity=64%"; Hit description =Integrase, catalytic region
  Pfam annotation: Domain name=rve; Domain location=52-208; Score =122.5; E_value=1.2e-33; Accession=PF00665.16; Description=Integrase core domain
  Pfam annotation: Domain name=zf-H2C2; Domain location=1-34; Score =9.3; E_value=0.021; Accession=PF09337.1; Description=His(2)-Cys(2) zinc finger
  Pfam module annotation: Pfam domain module=rve::zf-H2C2; Domain location=52-208::1-34
MGVAKTSHRLQSSFFWHGLKEDVKRFVRECKVCQQTKSSTRRPAGLLQPLPIPTRVWEDISMDFITHLPASHGFTVIFVVVDRYSKGIHLGALPTQFSAFKVATLFLDLVCKHHGFPRSIVSDRDPIFLSSFWRELFCLHGTLLRMSTAYHPQTDGQTEVMNRILEQYLRSFVHSQPANWFRYLALVEWSYNTSIHTSLGFTPFEVIYGKTPPTLPHYIPGLTSNEAVDNLIHNCQEIHRKL

SEQ ID NO: 157551 - protein, 84 aa, Glycine max
  Coding DNA Sequence Number=SeqID_40773
MGPDGQNSEAFPHSHVAFLFFFLSIEASIKAPNFAHLFYSKSQKEAIFEVVKRTSMWWDFKFQVWVDFFSHDFHGYWVFGRYDG

SEQ ID NO: 157552 - protein, 519 aa, Glycine max
  Coding DNA Sequence Number=SeqID_40774
  Gene Ontology: Mol. function=protein binding; Cellular component =cytoplasm; Biological process=regulation of GTPase activity
  Homolog annotation: Hit_ID=Q5W7F2; Match level="QueryCoverage=99%, HitCoverage=57%, E-value=1e-143, Identity=55%"; Hit description=ARF -GAP
  Pfam annotation: Domain name=ArfGap; Domain location=389-509; Score =141.8; E_value=1.9e-39; Accession=PF01412.9; Description=Putative GTPase activating protein for Arf
  Pfam annotation: Domain name=PH; Domain location=142-277; Score=76.8; E_value=6.6e-20; Accession=PF00169.19; Description=PH domain
  Pfam module annotation: Pfam domain module=ArfGap::PH; Domain location=389-509::142-277
ETFQDLHNARSSFEEARFNLVSALHNVEAKKRFDFLEAVTGVMDAHLRYYRQGYQLLQEMEPFIIEVLAYTQKARESYNEEQISLCERMLEYKKHVHHESMLSLNGPYGSPCRDGPVHPFSRISDKVADAVTESAENGKVQIIRQGYLSKRSSNLRGDWKRRYFVLDSRGMLYYFRKPWSGLNSGNQSSLHRNCATENSAGILSRLLSSHYHGLIPDEKSVARHTVNLLTSTIKIDAEQSDLRFCFRIISPSKSYTLQAENALDQMDWMEKITGVIATLLSAQTLVHHISFLCVLFMLLPKDEDTRLCQRGFIQVVAKRVLGNVEGVLGYVKGILGCGREGTSPCRRGPRFCQSDDSESGDSYSANKTYLLKGSPDDDHAVSGDSIKNEKPIDVLRKVSGNDKCADCGKPDPDWASLNLGILICIECSGVHRNLGVHISKVRSLTLDVKVWDSAVLTMFQCLGNLFANSVWEELLHSTSTSQTDDTPDGSSKTHKKLFHARKPAHDDAISLKERFIHAK

SEQ ID NO: 157553 - protein, 132 aa, Glycine max
  Coding DNA Sequence Number=SeqID_40775
  Gene Ontology: Mol. function=GTPase activator activity; Cellular component=cytoplasm; Biological process=regulation of GTPase activity
  Homolog annotation: Hit_ID=Q6ZD39; Match level="QueryCoverage=95%, HitCoverage=15%, E-value=1e-43, Identity=75%"; Hit description =Putative ARF GTPase-activating domain-containing protein
MNWCGCSSSAWKRVQNRYARDVSSSTKDVESTRGFSMPMEGLGEAYDGDIAFASALENFGGGHNDPLFVTLGGPVMTKFSIALREISTYKELLRSQAEHMLNDRLLNMLNVDILDVKEARRRFEKASLVHDQ

SEQ ID NO: 157554 - protein, 102 aa, Glycine max
  Coding DNA Sequence Number=SeqID_40776
  Gene Ontology: Cellular component=nucleus
MESVDANSEVENDAEMKLLRDKFRLSAISIIESQERLARDLHLFAQHANRKSVNMEDVILCGHRNEHVSGMLRSFSNDLKAKDPQSERKRKKEPKKNDKGTA

SEQ ID NO: 157555 - protein, 887 aa, Glycine max
  Coding DNA Sequence Number=SeqID_40777
  Gene Ontology: Mol. function=hydrolase activity, acting on glycosyl bonds; Cellular component=lysosome; Biological process=carbohydrate metabolic process
  Homolog annotation: Hit_ID=Q9FFX7; Match level="QueryCoverage=95%, HitCoverage=94%, E-value=0.0, Identity=66%"; Hit description=Alpha -mannosidase
  Pfam annotation: Domain name=Alpha-mann_mid; Domain location=270-328; Score=23.4; E_value=3.3e-07; Accession=PF09261.1; Description=Alpha mannosidase, middle domain
  Pfam annotation: Domain name=Glyco_hydro_38; Domain location=41-345; Score=347.7; E_value=1.9e-101; Accession=PF01074.12; Description =Glycosyl hydrolases family 38
  Pfam annotation: Domain name=Glyco_hydro_38C; Domain location=390 -881; Score=371.8; E_value=1e-108; Accession=PF07748.3; Description =Glycosyl hydrolases family 38 C-termi
  Pfam module annotation: Pfam domain module=Alpha-mann_mid::Glyco _hydro_38::Glyco_hydro_38C; Domain location=270-328::41-345::390-881
MENTALCVLWFILLLLGCVISSESKYIRYNTTSTIVPGKLNVHLVPHTHDDVGWLKTIDQYYVGSNNSIQGACVQNVLDSLVPALLADKNRKFIYVEQAFFQRWWREQSDAVQNIVKELVNTGQLEFINGGFCMHDEAATHYIDMIDQTTLGHQFIKEEFGVTPRIGWQIDPFGHSAVQAYLLGAEVGFDSLFFARIDYQDRAKRKDEKTLEVVWRGSKSLGSSAQIFSGAFPENYEPPSNFYYEVNDDSPIVQDDVSLFDYNVPERVNEFVAAAISQAARQLEYFKGKSALGPNTDSLAEALAIAQHHDAVSGTEKQHVANDYAKRLSIGYTEAEKVVAVSLACLTEGATKTGCKNPQTKFQQASSDCPLLNISYCPASEVDSSNGKNLVIVVYNPLGWKREDIIRIPVVNENVVRDSSGKKIQSQLVPILDDFLGLRNYHTVAYLGVSPTVKPKYWLAFSAAVPPLGFSTYYVSYAKKEATISDRDTAYQSWNKSDTITVGLKNLKLVYSVKEGKLTKYINSRSKVKEPLEQAYKFYTGYGNDGTETAQASGAYIFRPDGSPSPIKSNGKSPLTVFRGPIVHEVHQKISPWIYQVGPIPIDDGDGKEIATEIKTNLASNKTFYTDSNGRDFIERVRDYRKDWHLEVNQPVAGNYYPINLGIYLKDKSKEFSILVDRAVGGSSIIDGQLELMVHRRLLQDDSRGVAEALNETVCIHDKCTGLTVLGKYYFRIDPVGEGARWRRSFGQEIYSPLLLAFTESEGHWGDSHVTTFSGIDSSYNLPDNVAIVTLQDLGDGKVLLRLAHLYEIDEDKYLSVKATVELKKVFPNKQINKITEVSLSANQERDEMERKRLVWQVKGSPPEPKVYGVKFIANKSALLLPFTLDI

SEQ ID NO: 157556 - protein, 42 aa, Glycine max
  Coding DNA Sequence Number=SeqID_40778
MEKVYLLLKDGFEEEDSITYLRSAGHAPFHLLRGGSQRTERG

SEQ ID NO: 157557 - protein, 116 aa, Glycine max
  Coding DNA Sequence Number=SeqID_40779
  Subcellular localization annotation: CTP_CleavageSite=31; ConfidenceScore=5.40e-01
LYGNPPGMPPTPPTPPKPVFEKPPPTPPPKPGKMPGNPVPGNPVPGNPVPGNPGPPENPGKPGNPRKLGNPGKKRGKPLLKPKRKPGPPPMPPKPPKFTPRPPDKPAPVTGEATTN

SEQ ID NO: 157558 - protein, 63 aa, Glycine max
  Coding DNA Sequence Number=SeqID_40780
MVHISNSSLKMLSYQSMMILDSAVGGAFMNKLVEESIIILEVVASNYSQLMWGERENTSGPRR

SEQ ID NO: 157559 - protein, 115 aa, Glycine max
  Coding DNA Sequence Number=SeqID_40781
  Gene Ontology: Mol. function=RNA-directed DNA polymerase activity; Biological process=RNA-dependent DNA replication
MANSMIEFQILKFFLVSIQPSKQQHIKQVQWHAPKDLRDMLVVEKFSGTISDFLGGFSVYVGIQNAFVAKLHAVILDIEIAHQRGWHNLWLESDSQLVIAAFENPNIVPWEIRGK

SEQ ID NO: 157560 - protein, 948 aa, Glycine max
  Coding DNA Sequence Number=SeqID_40782
  Gene Ontology: Mol. function=nucleic acid binding; Cellular component= nucleus; Biological process=meristem development
  Homolog annotation: Hit_ID=Q64M78; Match level="QueryCoverage=85%, HitCoverage=82%, E-value=0.0, Identity=48%"; Hit description =Putative AML1
  Pfam annotation: Domain name=RRM_1; Domain location=226-292; Score =59.0; E_value=1.6e-14; Accession=PF00076.12; Description=RNA recognition motif. (a.k.a. RRM, R
  Pfam annotation: Domain name=RRM_1; Domain location=320-386; Score =42.8; E_value=1.2e-09; Accession=PF00076.12; Description=RNA recognition motif. (a.k.a. RRM, R
  Pfam annotation: Domain name=RRM_2; Domain location=756-868; Score =203.0; E_value=7e-58; Accession=PF04059.3; Description=RNA recognition motif 2
  Pfam module annotation: Pfam domain module=RRM_1::RRM_1::RRM_2; Domain location=226-292::320-386::756-868
MAASPGIIFNTSSPHETNAKTGLLMSQTTLSREITEDLHFGREAGNIEMLKDSTTESLNYHKRSWSNVHRQPASSSYGLVGSKIVTNAASRESSLFSSSLSDMFSQKLRLLGNGVLSGQPITVGSLPEEEPYKSLEEIEAETIGNLLPDEDDLFSGVNDELGCSTRTRMNDDFEDFDLFSSSGGMELEGDEHLISGKRTSCGDEDPDYFGVSKGKIPFGEQSSRTLFVRNINSNVEDSELKALFEQYGDIRTIYTACKHRGFVMISYYDIRAAQNAMKALQNRSLRSRKLDIHYSIPKIYLDLMTCQGNSPEKDIGHGTLMISNLDSSVLDDELKQIFGFYGEIREIYEYPQLNHVKFIEFYDVRAAEASLRALNGICFAGKHIKLEPGLPKIATCMMHQSHKGKDEPDVGHSLSDNISLRHKGVSSGFIASGSSLENGYNQGFHSATQLPAFIDNSPFHVNSSIHKITRGASAGKVSGVFEASNAFDAMKFASISRFHPHSLPEYRESLATGSPYNFSSTINTASNIGTGSTESSESRHIQGMSSTGNLAEFNAGGNGNHPHHGLYHMWNGSNLHQQPSSNAMLWQKTPSFVNGACSPGLPQIPSFPRTPPHVLRASHIDHQVGSAPVVTASPWDRQHSFLGESPDASGFRLGSVGSPGFNGSWQLHPPASHNMFPHVGGNGTELTSNAGQGSPKQLSHVFPGKLPMTLVSKFDTTNERMRNLYSRRSEPNTNNNADKKQYELDLGRILRGDDNRTTLMIKNIPNKYTSKMLLVAIDEQCRGTYDFLYLPIDFKAIIINMFLSQFYKWLQNKCNVGYAFINMIDPGQIIPFHKAFHGKKWEKFNSEKVAVLAYARIQGKSALIAHFQNSSLMNEDKRCRPILFHTDGPNAGDPEPFPLGNNIRVRPGKIRINGNEENRSQGNPSSLASGEESGNAIESTSSSSKNSD

SEQ ID NO: 157561 - protein, 133 aa, Glycine max
  Coding DNA Sequence Number=SeqID_40783
  Gene Ontology: Mol. function=RNA-directed DNA polymerase activity; Biological process=RNA-dependent DNA replication
MVEGRAILFILGLIELFAMTLDWIFGTLQPIAPLQDHLNCKKIVQQDNSMLIVIPSLNEVKFAVFSINGKGAHGSDGFGGSNSNLVVLIPKFLEANKIQDYWLIALASFHFKIITKILADRLAIVAPCMISSE

SEQ ID NO: 157562 - protein, 155 aa, Glycine max
  Coding DNA Sequence Number=SeqID_40784
  Gene Ontology: Mol. function=nucleotidyltransferase activity; Biological process=RNA processing
  Homolog annotation: Hit_ID=Q9LSZ7; Match level="QueryCoverage=80%, HitCoverage=25%, E-value=2e-11, Identity=34%"; Hit description =Similarity to polyA polymerase
  Subcellular localization annotation: CTP_CleavageSite=45; ConfidenceScore=5.50e-01
MTFNSVHSLAMIASLKFARKPTLHLRSTPFQCVPKVVPRFLAAVEAEAPTNEQTSVSIREEGKSRLNTDVVQLRNREGPGMEETELRRAWDSQFNDWKHYEKGYDVYLVGGCVRDLILKKTPKDFDIITSAELKEMIASIGGADIVGIPFHYSDA

SEQ ID NO: 157563 - protein, 348 aa, Glycine max
  Coding DNA Sequence Number=SeqID_40785
  Gene Ontology: Mol. function=RNA-directed DNA polymerase activity; Biological process=RNA-dependent DNA replication
MESIREICYLTFSFDWLKRFSTRAFVSKLTQGTSNNFKVFPKLFKDYVEVSRQQLNLSKCWFYGPKITSAKARIIKYILGFQEGFFSSRETGYKERKTPLHHGKTTIGAFGDENSYSGLEKVSEPVKERDLGLRESKWLVGNGATIHLWNDNWLRKALVDKLDIPPSIHSKMQANVANIIHLASWKVPQSLVDLFPNLEQQLRQNDILRQDILDKLALHGKLPMDSNLRKRGCILVFTYGLCLGSFEDIDHLILNTLQTPLNLHLLENLLYILKQHEILIWEPWEDLLMNYACLKTLTLQETSPKPSSIIQVPHKPLVLWWIKCNSDGAIRGNPGLVGCGGIFRDDNN

SEQ ID NO: 157564 - protein, 667 aa, Glycine max
  Coding DNA Sequence Number=SeqID_40786
  Gene Ontology: Mol. function=calcium-dependent phospholipid binding; Cellular component=cytoplasm; Biological process=vesicle-mediated transport
  Homolog annotation: Hit_ID=Q941L3; Match level="QueryCoverage=95%, HitCoverage=94%, E-value=1e-112, Identity=69%"; Hit description =BONZAI1
  Pfam annotation: Domain name=C2; Domain location=194-282; Score=35.0; E_value=2.6e-07; Accession=PF00168.20; Description=C2 domain
  Pfam annotation: Domain name=C2; Domain location=49-146; Score=16.3; E_value=0.0085; Accession=PF00168.20; Description=C2 domain
  Pfam annotation: Domain name=Copine; Domain location=451-597; Score =278.0; E_value=1.8e-80; Accession=PF07002.6; Description=Copine
  Pfam module annotation: Pfam domain module=C2::C2::Copine; Domain location=194-282::49-146::451-597
MGNRLSEVAAGRAAIGGTAADFLNLAAAPIDAVENFLRSRGHHGLFSQIELSFSASGLRDRDVLFKSNPMMVLYARGKNGALEELCRTEVVLNSSSPRWITKHTLIYHFEVVQVLVFRVYDVDTQFHNVDIKMLDLDEQQFLGEATCALSQIITQPDKSLTIDLYTEDSVGSTLSKNCGKLMVHGEECISSKTAIEMVFRCSDLEYKYLFSRTDPFLLISKVVEAGAQIPICKTEVIRNDLNPIWKSVFVNIQQVGSKDSPLIIECYNFNSNGKHDLMGKVQRSLVELENIHNNGQGENLFLPSADGQNHDNKVLKSQLFVEKFTESVQYTFLDYLAGGFELNFMVAVDFTDTSFAPILWLLCLECTHFVSTITSDCHVAFNLLFIGVPHLVGSAEEVQHKFTIAALVEESGCVLFTLRNHLWVPQNANPLRPLLSGSTAASNGNPRLPDSLHYIDPSGRPNAYQRAIVEVGEVLQLYDSDKRFPTWGFGARPIDGPVCHCFNLNGSSHYCEVEGIQGILMAYTSALLNVSLAGPTLFGPVISTAALIASQSVANGGRKYFVLLIITDGVVTDLQETKDAIVKASDLPLSILIVGVGGADFKEMEVLDADKGERLESSYGRVASRDIVQFIPFREVQSGLSVVQAFLAELPAQFLTYVRSRNIQPNL

SEQ ID NO: 157565 - protein, 344 aa, Glycine max
  Coding DNA Sequence Number=SeqID_40787
  Gene Ontology: Biological process=multicellular organismal development
  Homolog annotation: Hit_ID=Q1SMS1; Match level="QueryCoverage=82%, HitCoverage=55%, E-value=1e-140, Identity=83%"; Hit description=WD40- like
  Pfam annotation: Domain name=WD40; Domain location=119-158; Score =13.6; E_value=0.74; Accession=PF00400.22; Description=WD domain, G -beta repeat
  Pfam annotation: Domain name=WD40; Domain location=165-204; Score =9.4; E_value=2.9; Accession=PF00400.22; Description=WD domain, G -beta repeat
  Pfam annotation: Domain name=WD40; Domain location=259-297; Score =17.2; E_value=0.058; Accession=PF00400.22; Description=WD domain, G -beta repeat
  Pfam annotation: Domain name=WD40; Domain location=303-341; Score =8.5; E_value=3.7; Accession=PF00400.22; Description=WD domain, G -beta repeat
  Pfam module annotation: Pfam domain module=WD40::WD40::WD40::WD40; Domain location=119-158::165-204::259-297::303-341
MAERRGGFLKKCHRIAVAWRVSNGGVMAAAIVMVVIAAIMNECHELMLWMEWSTFGKFRLRGASRLSTTDCASQKQRRWPEDLAWHPEGNSLFSVYSADGGDSQVSITNLNKGQGGERVKFLEDKPHVKGIINGIVFMPWENTCFVTGGSDHAVILWNEQDDEKWKPKALHRNLHSSAVMGVAGMQQKQMVLSVGADRRIFGYDVRVGRADFKHQVDSKCMSVLPNPSDFNLFMVQTGTHERQLRLFDIRLRNTELHAFGWKQESSDSQSALINQAWSPDGHYITSGSADPVIHIFDIRYTAHKPSQSIRAHQKRVFRAMWLQSIPLVISISSDLNIGLHKVYS

SEQ ID NO: 157566 - protein, 483 aa, Glycine max
  Coding DNA Sequence Number=SeqID_40788
  Homolog annotation: Hit_ID=Q9FH52; Match level="QueryCoverage=34%, HitCoverage=16%, E-value=3e-25, Identity=44%"; Hit description =Arabidopsis thaliana genomic DNA, chromosome 5, TAC clone:K22G18
MEGEEVLDVDIQEEKLSGFIFMCNRITKPECYCYRVFGLPAGRKDVVEKINPGTYLFLFDTDVKLLYGIYMATSTGKLNIEPLAFCQKFPAQVNLYIVDDAHRKKPDHAVKITSSVMIGSFEGILLASMMFPVQFKIYKDCLPLPVNCFKHAIRDNYQKGSNKFNPELNIRQVRSLIELFRPLHELPIAPGRPFIQKPMNIVYHQISEPPISEGAFLSRMSPNQAPRLLNYKHVNELRKPTGCAYPVHNVMPYSAAAQLVASQGSTNQLYYPASTLALEGTYAPGIGSSHTQPLPDPQYSHQTILNPQPEFHSSLMNSGHAQQLQESQDAHHNIIHPQSEFHSSLMAMGSSHTQSLQGPQYPYQSIPNPSHEFYTPVANAGSSQPQLSRDTHYTHQNILNLQPDAYSTMANTGSSYAQLLPDPQHTHQNAQNPQPDSNSSLVNMSHATVTMQLHTVSSLYHPYVPQEVAPSMYSSQWYVSTSF

SEQ ID NO: 157567 - protein, 146 aa, Glycine max
  Coding DNA Sequence Number=SeqID_40789
  Homolog annotation: Hit_ID=Q1S232; Match level="QueryCoverage=38%, HitCoverage=10%, E-value=2e-09, Identity=58%"; Hit description =Exostosin-like
MRMASFCPSFFLWRAKSLRRDTEEEPFGLSDEEEFVGSGKVGRTTEEKLKHSLFGDDEGMLSASQKGLIGITLNSDWYVPVSKEKSDQDVACRGLDFMFGWVTNLRKDIIEGHTGKNFIEENSWKYALLDERQREKKLISFVREKN

SEQ ID NO: 157568 - protein, 93 aa, Glycine max
  Coding DNA Sequence Number=SeqID_40790
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=P26205; Match level="QueryCoverage=95%, HitCoverage=21%, E-value=3e-35, Identity=77%"; Hit description =Cyanogenic beta-glucosidase precursor
MQLLRVLPKGKLSAGVNHGVNYYNNLINELMANGLQPYVIVFHCDVPQALKDEYGGFLSPHNVDDFRDYAKLCFKEFGNRVKHWITLNEPRSV

SEQ ID NO: 157569 - protein, 85 aa, Glycine max
  Coding DNA Sequence Number=SeqID_40791
MASVLCIGGPARAETGAGAGTGAGVEVEASEGTLALALRDPGKGREAQPRGVGLGHLRNLSRDDGAQVHVHLHDKAIHQPRPVHV

SEQ ID NO: 157570 - protein, 304 aa, Glycine max
  Coding DNA Sequence Number=SeqID_40792
  Homolog annotation: Hit_ID=Q1SMR9; Match level="QueryCoverage=40%, HitCoverage=47%, E-value=2e-26, Identity=55%"; Hit description =Pathogenesis-related transcriptional factor and ERF
  Pfam annotation: Domain name=AP2; Domain location=126-190; Score =142.9; E_value=8.4e-40; Accession=PF00847.10; Description=AP2 domain
MELVRKFKPVDLSHPYENPYSLWKDDIFSRKTKYEYVTITQGHGGGLWVLMKMGRNIRILVVVMSFLSITFNLLVGGGCAQSCLNASPTISLRDQFYGYLIDLGSQLSSLELLLVTLNRFLGSVRRRHYRGVRQRPWGKWAAEIHDPKKAARVWLGTFETAEAAALAYDEAALRFKGSKAKLNFPERVQGTASEFGYLTNQYMSSSSTNSNPIAPHLTTQETYSPSHFQYAQQQFMSGGSNSFSNQDMLRFYGGDNMFVSSQQSASSSSSTALSQQQQEELLKFSMQFGGSSHSNHSGNWRGGH

SEQ ID NO: 157571 - protein, 82 aa, Glycine max
  Coding DNA Sequence Number=SeqID_40793
  Homolog annotation: Hit_ID=Q1SMR9; Match level="QueryCoverage=39%, HitCoverage=12%, E-value=4e-07, Identity=72%"; Hit description =Pathogenesis-related transcriptional factor and ERF
MEGRSISHSSEREEEYGLFPIYSERSQQDMSAMVSALTQVIGGSNSDSLHMHEGLLTSSHNNTSTQNTNEQSQVQQQEQGWG

SEQ ID NO: 157572 - protein, 161 aa, Glycine max
  Coding DNA Sequence Number=SeqID_40794
MASKKRRASSSRLQEPYDTSRFVCEVTWERYKTNVHNRNILPKRNIELAYSHYDEFLRELERRQWHRALTRQMDNHIDLALVKEFYANLYNPEDRSPKQCKGASWKLLRKDLTTLAQTWSVISYSNLAPASHTSDLNMDRARLVYGLVMKMDMDLGSIISR

SEQ ID NO: 157573 - protein, 182 aa, Glycine max
  Coding DNA Sequence Number=SeqID_40795
  Gene Ontology: Mol. function=transcription factor activity; Cellular component=nucleus; Biological process=regulation of transcription, DNA-dependent
  Homolog annotation: Hit_ID=Q1SMR9; Match level="QueryCoverage=67%, HitCoverage=47%, E-value=2e-28, Identity=57%"; Hit description =Pathogenesis-related transcriptional factor and ERF
  Pfam annotation: Domain name=AP2; Domain location=4-68; Score=146.5; E_value=7.1e-41; Accession=PF00847.10; Description=AP2 domain
SVRRRHYRGVRQRPWGKWAAEIRDPKKAARVWLGTFETAEAAALAYDEAALRFKGSKAKLNFPERVQGTASEFGYLTNQHMSSSSTNSNPVAPHLTTQETYSPSHFQYAQQQFMSGESNSFSNQDMLRFYGGDNMFVSSQQSASSSSSTALSQQQQEELLKFSMQFGGSSHSNHSGNWRGGH

SEQ ID NO: 157574 - protein, 99 aa, Glycine max
  Coding DNA Sequence Number=SeqID_40796
MSSRRLGGSSPESYSLPLSFCSHEQASAKDPGRSVHNAPHDHTQHPTYEPGQKLVPKTLEGQCTVPPTNIHNMHMPMHFQHQSTFHFHVIHNINIISSQ

SEQ ID NO: 157575 - protein, 173 aa, Glycine max
  Coding DNA Sequence Number=SeqID_40797
  Gene Ontology: Mol. function=DNA binding; Cellular component=nucleus; Biological process=regulation of transcription
  Homolog annotation: Hit_ID=Q0GYP2; Match level="QueryCoverage=78%, HitCoverage=33%, E-value=5e-56, Identity=82%"; Hit description=LEAFY- like protein
  Pfam annotation: Domain name=FLO_LFY; Domain location=1-173; Score =7.6; E_value=9.7e-17; Accession=PF01698.7; Description=Floricaula Leafy protein
  Subcellular localization annotation: CTP_CleavageSite=49; ConfidenceScore=5.09e-01
MDPDAFTASLFKWDPRTVLPPAPAPPPRPSLLEYAMAPPPVTTAFHPARTAAPRELGGLEELFQAYGIRYYTAAKIAELGFTVSTLVDMKDEELDDMMNSLSQIFRWDLLVGERYGIKAAVRAERRRVEDDDIKRRNNNSNNLLSTDTTTNALDALSQEGTIHHTPYTYFKPN

SEQ ID NO: 157576 - protein, 80 aa, Glycine max
  Coding DNA Sequence Number=SeqID_40798
MQQQTKRGEIIRQKKSIEYDERSISEYHIGTKIQLSHPVEFNYYFNIVLLLLFLLTRAITQHVLTFCSKIYYRHQTIYQL

SEQ ID NO: 157577 - protein, 140 aa, Glycine max
  Coding DNA Sequence Number=SeqID_40799
MGMAKGQPGDDVDFLDMADQDGDGSGLSWGWRWPTCASPHQLQTFRALVESADRKFDYVHDVPAYDNGTSQHQQENCTPEGCATMTYHIHEQKNHVREAGEVQVDMVGTRRDRTTCQIFFVVNKETQGTWAKNEGCSYCS

SEQ ID NO: 157578 - protein, 437 aa, Glycine max
  Coding DNA Sequence Number=SeqID_40800
  Gene Ontology: Mol. function=transferase activity; Cellular component= membrane
  Homolog annotation: Hit_ID=Q5BMA0; Match level="QueryCoverage=86%, HitCoverage=92%, E-value=0.0, Identity=87%"; Hit description =Secondary cell wall-related glycosyltransferase family 47
  Pfam annotation: Domain name=Exostosin; Domain location=73-377; Score= 164.9; E_value=2e-46; Accession=PF03016.6; Description=Exostosin family
MDFWKVGLLSLLCAASAFAIGAVELGRHQPTERISVVVNFIPVSCHVGLTILCIGYGSAGDVLEDDPVGRLKVFVYELPSKYNKKILQKDPRCLNHMFAAEIFMHRFLLSSPVRTLNPEEADWFYTPVYTTCDLTPNGLPLPFKSPRMMRSAIQLISSNWPYWNRTEGADHFFVTPHDFGACFHYQEEKAIERGILPLLQRATLVQTFGQRNHVCLKEGSITIPPYAPPQKMHTHLIPEKTPRSIFVYFRGLFYDVGNDPEGGYYARGARAAVWENFKDNPLFDISTEHPTTYYEDMQRAVFCLCPLGWAPWSPRLVEAVVFGCIPVIIADDIVLPFADAIPWEEIGVFVDEKDVPQLDTILTSIPPEVILRKQRLLANPSMKQAMLFPQPAQPGDAFHQVLNGLARKLPHDRSVFLKPGEKALNWTAGPVGDLKPW

SEQ ID NO: 157579 - protein, 173 aa, Glycine max; identical to SEQ ID NO: 138040
  Coding DNA Sequence Number=SeqID_40801
  Homolog annotation: Hit_ID=Q1SKD7; Match level="QueryCoverage=90%, HitCoverage=41%, E-value=6e-15, Identity=31%"; Hit description =Ankyrin

SEQ ID NO: 157580 - protein, 95 aa, Glycine max
  Coding DNA Sequence Number=SeqID_40802
MVPVELLWRGMSLVVMLAALVPFRPSTVVHVIETPHLARFLVGRQASYLTRKQDRPPRPQHCSNWSSELEQSCFGSPDRPQASRSSAHSHTVGWA

SEQ ID NO: 157581 - protein, 78 aa, Glycine max
  Coding DNA Sequence Number=SeqID_40803
MTSRDQVWSFCTLVSSRGGGPDDTRKYPSEADIVFCTFCSSGNNKSFTCGNFMVTRDSRQPGGAKLVSYTDFRPGTFA

SEQ ID NO: 157582 - protein, 103 aa, Glycine max
  Coding DNA Sequence Number=SeqID_40804
  Homolog annotation: Hit_ID=Q2HSN5; Match level="QueryCoverage=70%, HitCoverage=25%, E-value=5e-12, Identity=45%"; Hit description =Transposase
MTFSVAFAYLEGECINNVVWALEWFRGIFIRCDAIPQVTVMDRDSTLMNAVKTVFPETTNLLCRFHIDKNIKAICKTLVGLSLQNSLGDLCSVYEAMKNMITL

SEQ ID NO: 157583 - protein, 112 aa, Glycine max
  Coding DNA Sequence Number=SeqID_40805
  Homolog annotation: Hit_ID=Q1S717; Match level="QueryCoverage=95%, HitCoverage=14%, E-value=8e-10, Identity=34%"; Hit description =Ovarian tumour, otubain
MVSRYKLNQIATEFERVNYAGIDSSRYGCIMRTTHDLLCACELARYVAGLSEPEVCITEEMEAISKWIKGLDICGKVTLKIKLWEIAYPDLNSMCAPPEKIKTKGAQKKHMT

SEQ ID NO: 157584 - protein, 150 aa, Glycine max
  Coding DNA Sequence Number=SeqID_40806
  Gene Ontology: Mol. function=RNA-directed DNA polymerase activity; Biological process=RNA-dependent DNA replication
MQGQTAHKAESAKKEHTDHLFIHCIKIQPIWSKSMSWMNIKGAFPFSPKQHFMQHISIQMEGLRAKRWRYWWLPVTWSIWKLRNRILFANAEFDTNRLFEDAIFIIWTWLRQFEKDFTVHYNQWSKGVHIVSEILVHYTSRPIRLLMYYI

SEQ ID NO: 157585 - protein, 389 aa, Glycine max
  Coding DNA Sequence Number=SeqID_40807
DEELTDFIDGNIDVAIVKEFYANLYYPEDKSPKQVRVRGHLNKCDEDTLNTFLKTPVIVEEGPYPQELATKLCIPGRGFELNANGYPLKILRKNMTTLAQTWSVLSFSNLIPTSHTSDVTLDKAKLIYGIIMKMDMNVRYLISHQISLIAQHDTSRLVFLALITTLCKARGVQSNSRSLESLSPAINLAYIKKNCWNLDDPTVTFRGPKKARGKRSETPSTSAPETGSPSSSTLPPSSSTETPVIPPAPSQIPILAPLSTDQSSSSRAGGASIAQEPMTEEPLALAPSPSPTAAEEETTPDQTPQPSPSSASAPEETQPSALDLNEDQSQEEHDADWLSEPHSLCEAANSLSGCKTLEEDRLESSTLSTQPARPTRMLSLLALSVLRLA

SEQ ID NO: 157586 - protein, 104 aa, Glycine max
  Coding DNA Sequence Number=SeqID_40808
  Subcellular localization annotation: CTP_CleavageSite=45; ConfidenceScore=5.44e-01
MKAKCNQRWLGDAKTASPVALAFLKVGGKFWVKKTFPSPSFNPSRAGAARPGKLTCTFFFREDISMALYGSAFAYSNPLRDTRLPPSGAFHLSRAGQGTMIYRS

SEQ ID NO: 157587 - protein, 57 aa, Glycine max
  Coding DNA Sequence Number=SeqID_40809
MAEPPATAPIDVDMPRYAVDPCQWIAKRLEHLTNMRMVTAETEAYTLTEECLRIARV

SEQ ID NO: 157588 - protein, 82 aa, Glycine max
  Coding DNA Sequence Number=SeqID_40810
MVVSFFKTHLLLEVASSLSLSSFSIPLSFIFQEEKESIDEEDSRPTSSTWSYIMWYQEHLHLVSYMMPMMKLSCGAELWLDL

SEQ ID NO: 157589 - protein, 45 aa, Glycine max
  Coding DNA Sequence Number=SeqID_40811
MEMSNLESRLKALKLELDEEKKERLQKNRYESAHLSLNSQNKKEN

SEQ ID NO: 157590 - protein, 91 aa, Glycine max
  Coding DNA Sequence Number=SeqID_40812
ALTETLGKLPQQLQAVNYMGALNRQGFQGYNQGGPLGFNQGRNFTQGSSWRNHPGNQFNKEQRSQPGQNSNQGIDLYEKTSKLEETLTQFM

SEQ ID NO: 157591 - protein, 600 aa, Glycine max
  Coding DNA Sequence Number=SeqID_40813
  Homolog annotation: Hit_ID=Q9AGD7; Match level="QueryCoverage=49%, HitCoverage=53%, E-value=1e-110, Identity=72%"; Hit description =Putative transcriptional regulator
  Pfam annotation: Domain name=DUF520; Domain location=96-270; Score =341.3; E_value=1.6e-99; Accession=PF04461.4; Description=Protein of unknown function (DUF520)
RRAFAAGRPDVGDALRDMFDHRAVAHRRVRGDAAQQRLLHFFELFDGTHAVVQQQDRRVARQHALQRIVSDEGVIADVARGSTTLTEQYGCGEEKMPSFDIVSEVELPEVRNAVENANREISTRFDFRNVSASFELNEKNETIKVTSESDFQVKQLVDILREKLLKRGIEGAAIEVPEEIVHSGKSWSVEAKLKKGIESDVAKKIVKLIKDSKLKVQTQIQGEELRVTGKSRDDLQGAMALVRGGNLAAGLVGGDTLPASDFPSAFRPHRRAPAARAADYVAGAHCPATAAAPAPSAAPETAGELLQTIEQIFTKFAGGHALGQIAMRGANHGKIHRPAATGAEWRHLFFLQHAQQTGLQRQRHVTDFIQKQHAAIRFANFADVAIFTGASKCAGLVAKQFGFNQRFGDGGTVDGDKLARAPAALLVQSTADILLAAAGFTINAQRNAGIQQPQHFCAVSSQHARQVMRTTVRHADVAALRRAQAEPVALRANVDRGGNAVGLLLQLRKQLLKRQAGKAVGAESQFAHRQPVGCGQHIVREYQQQFITGVDALRLRMQTEQPLLRMQALLHPQCAGPEISSTPAIWPLGICNGIAAQYRP

SEQ ID NO: 157592 - protein, 822 aa, Glycine max
  Coding DNA Sequence Number=SeqID_40814
  Gene Ontology: Mol. function=transporter activity; Cellular component= integral to membrane; Biological process=transport
  Homolog annotation: Hit_ID=Q8Z8W1; Match level="QueryCoverage=52%, HitCoverage=99%, E-value=0.0, Identity=75%"; Hit description =Hpothetical major facilitator family transport protein
  Pfam annotation: Domain name=COX4_pro; Domain location=10-53; Score =4.2; E_value=3.5e-05; Accession=PF03626.4; Description=Prokaryotic Cytochrome C oxidase subunit IV
  Pfam annotation: Domain name=CTP_transf_1; Domain location=329-550; Score=-76.1; E_value=0.091; Accession=PF01148.10; Description =Cytidylyltransferase family
  Pfam annotation: Domain name=LacY_symp; Domain location=391-783; Score=-303.8; E_value=0.0083; Accession=PF01306.10; Description=LacY protonsugar symporter
  Pfam annotation: Domain name=MFS_1; Domain location=402-748; Score =169.0; E_value=1.2e-47; Accession=PF07690.6; Description=Major Facilitator Superfamily
  Pfam annotation: Domain name=PUCC; Domain location=433-784; Score= -205.3; E_value=0.0067; Accession=PF03209.6; Description=PUCC protein
  Pfam annotation: Domain name=Sugar_tr; Domain location=394-790; Score= -91.3; E_value=0.00052; Accession=PF00083.14; Description=Sugar (and other) transporter
  Pfam annotation: Domain name=UbiA; Domain location=70-352; Score =257.9; E_value=2.1e-74; Accession=PF01040.9; Description=UbiA prenyltransferase family
  Pfam module annotation: Pfam domain module=COX4_pro::CTP_transf _1::LacY_symp::MFS_1::PUCC::Sugar_tr::UbiA; Domain location=10 -53::329-550::391-783::402-748::433-784::394-790::70-352
HSVNEHGASHGSVKSYMIGFILSIILTAIPFWMVMDGSASHGTILGAGAPGLLPASGQQIRGWLEHGGHCLLRSHYPDCGDWLTVDYVEPQLQHDGPLKSHAIDYPLFLVALVGVSLVVASGCVFNNVIDRDIDIKMERTRNRVLVKGLISAKVSLVYATALGIAGFALLYFGANPLAMWLAVMGFVVYVGIYSLYMKRHSVYGTLIGSLSGAAPPVIGYCAVTNQFDAGALILLAIFSLWQMPHSYAIAIFRFKDYQAANIPVLPVVKGISVAKNHITLYILAFMIATLMLSLGGYAGYKYLVVAAAVSVWWLGMALSGYKTSNDKVWARKLFVFSIVAITALSVMMSVDFMAPASKDLLTYVWARNLCRCNLKSQGHKLTEVGMNDNRMTPVELRATWGLGTVFSLRMLGMFMVLPVLTTYGMALQGASETLIGLAIGIYGLAQAVFQIPFGLLSDRIGRKPLIVGGLLLFVLGSLIAATSTSIWGIILGRALQGSGAIAAAVMALLSDLTREQNRTKAMAFIGISFGVTFAIAMVVGPIVTHALGLHALFWMIALLASLGIVITLLVVPNAPGHVLNRESGMVKGSIRAVLANPKLLKLNIGILCLHILLMSSFVALPGQFEQAGFPAAEHWKVYLVTMLVAFVAVVPFIIYAEVKRRMKRVFVGCVALIIIAEIVLWGAAGHFWTLVIGVQLFFLAFNLMEAILPSLISKESPAGYKGTAMGIYSTSQFIGVAIGGSLGGWIFGHFDAQTVFLEPPYVSSLRLVLSDAVLAVPNLEKRLRAQPGVASVFIVPEEKSAYIKIDSKVTSRVELEALLASS

SEQ ID NO: 157593 - protein, 346 aa, Glycine max
  Coding DNA Sequence Number=SeqID_40815
  Gene Ontology: Mol. function=oxidoreductase activity; Cellular component=mitochondrion; Biological process=lysine biosynthetic process via diaminopimelate
  Homolog annotation: Hit_ID=Q4IV21; Match level="QueryCoverage=97%, HitCoverage=98%, E-value=1e-152, Identity=75%"; Hit description=Zinc- containing alcohol dehydrogenase superfamily
  Pfam annotation: Domain name=ADH_N; Domain location=33-142; Score =178.0; E_value=2.3e-50; Accession=PF08240.2; Description=Alcohol dehydrogenase GroES-like domain
  Pfam annotation: Domain name=ADH_zinc_N; Domain location=172-309; Score=144.7; E_value=2.5e-40; Accession=PF00107.16; Description=Zinc- binding dehydrogenase
  Pfam module annotation: Pfam domain module=ADH_N::ADH_zinc_N; Domain location=33-142::172-309
MNMQIKTTMKAAIVKAFGEPLVIEQVPVPSVGPGQILVKIAATGVCHTDLHAAEGDWPIKPNPPFIPGHEGVGQVVAIGEGVKHLKLGDRVGVPWLYSACGHCEHCLDSWETLCLSQQNAGYSVNGSFAEYCLADANYVGIIPDNVEFNEVAPILCAGVTVYKGLKMTDTKPGDWVVVSGIGGLGHMAIQYAVAMGLNVAAVDIDDDKLAFAKRLGASVVANAKQVDPAKVFQESFGGAHGVLVTAVSPKAFEQAIGTLRRGGTMVLNGLPPGKFDLSIFDMVLDGITVRGSIVGTRKDLQEALDFAGRHKVKANVAVEPLTNINDIFARMHAGKIEGRIVVDMSL

SEQ ID NO: 157594 - protein, 85 aa, Glycine max
  Coding DNA Sequence Number=SeqID_40816
MCPSMKRSVGFNGMRFYAKIKGLRKVVVVHANNVVGEGVTHIYGGNDASHVVVGFGGYDGAKVVVVWVATLCVRDDIVIALVETP

SEQ ID NO: 157595 - protein, 422 aa, Glycine max
  Coding DNA Sequence Number=SeqID_40817
  Gene Ontology: Mol. function=prephenate dehydratase activity; Cellular component=cytoplasm; Biological process=L-phenylalanine biosynthetic process
  Homolog annotation: Hit_ID=Q6JJ29; Match level="QueryCoverage=90%, HitCoverage=93%, E-value=1e-151, Identity=68%"; Hit description =Prephenate dehydratase
  Pfam annotation: Domain name=PDT; Domain location=170-349; Score =309.9; E_value=4.6e-90; Accession=PF00800.9; Description=Prephenate dehydratase
  Subcellular localization annotation: CTP_CleavageSite=71; ConfidenceScore=5.39e-01
FPSPKRKNSKQSLPITYFTFHTTLILYLFLPYSSVKPLDNMQSLSPPTSNALNLKHVFRPRLGASSRISVKCAFGFEPVSYGVGSSRADWQSSCAILASKVVSQEQPSADQNSGTTDHIAAVNGHKAAVSDFQLVPIGNLAEANNKPLPPKPLTISDLSPAPMHGSKLRVAYQGVPGAYSEAAAGKAYPNCEAIPCDQFEVAFQAVELWIADRAVLPVENSLGGSIHRNYDLLLRHRLHIVGEVQLPVHHCLLALPGVRKEFLTRVISHPQALAQCEHTLTKLGLNVAREAVDDTAGAAEFVASNNLRDTAAIASARAAELYGLNVMADGIQDDPSNVTRFVMLAREPIIPAHGTSVLFKVLSAFAFRNISLTKIESRPHRNRPIRLVDDANVGTAKHFEYLFYVDFEASMAEVRAQNALAE

SEQ ID NO: 157596 - protein, 438 aa, Glycine max
  Coding DNA Sequence Number=SeqID_40818
  Gene Ontology: Mol. function=transporter activity; Cellular component= integral to membrane; Biological process=transport
  Homolog annotation: Hit_ID=Q9ZUY2; Match level="QueryCoverage=96%, HitCoverage=58%, E-value=0.0, Identity=77%"; Hit description =Putative membrane transporter
  Pfam annotation: Domain name=Xan_ur_permease; Domain location=3-391; Score=148.9; E_value=1.3e-41; Accession=PF00860.11; Description =Permease family
EDTCSVISTVLFVSGVTTLLHTSFGSRLPLIQGPSFVYLAPVLAIINSPEFQGLNGNKFKHIMKELQGAIIIGSAFQTFLGYSGLMSLLVRLINPVVVSPTIAAVGLSFYSYGFPLVGTCLEIGAVQILVVIVFSLYLRKISVLGHRIFLIYAVPLGLAITWAVAFLLTEAGAYNYKGCDINIPASNMVSEHCRKHVSRMKYCRVDTSNALKSSPWFRFPYPLQWGTPVFHWKMALVMCVVSLISSVDSVGSYHASSLLVASRPPTPGVLSRGIGLEGLSSVLAGLWGTGTGSTTLTENVHTIAVTKMGSRRAIQLGACFLIVLSLVGKVGGFIASIPEVMVAGLLCFMWAMLAALGLSNLRYSEAGSSRNIIIIGLSLFFSLSIPAYFQQYGISPNSNLSVPSYFQPYIVASHGPFRSKYGGCTSANNKYTSIGESS

SEQ ID NO: 157597 - protein, 146 aa, Glycine max
  Coding DNA Sequence Number=SeqID_40819
  Subcellular localization annotation: CTP_CleavageSite=24; ConfidenceScore=5.34e-01
MARAPSDAIVPAPAPVPPPSTPISASADPSIPSSDVIVPMLQSIHHNIFLVMQSSLVWSPAFLLGGGGEAPAAQEPRTQVAEDTLEAREAKDTPEVEAEADVADTPMEAPEEASGTTKADIDDDYVANVTTVQETWDPWPTSAQDD

SEQ ID NO: 157598 - protein, 198 aa, Glycine max
  Coding DNA Sequence Number=SeqID_40820
  Homolog annotation: Hit_ID=Q9ZUY2; Match level="QueryCoverage=85%, HitCoverage=25%, E-value=1e-30, Identity=46%"; Hit description =Putative membrane transporter
  Subcellular localization annotation: CTP_CleavageSite=24; ConfidenceScore=5.26e-01
MSNSDPKTRPRPGPWPPAPAPVVKAMPPASWAKKTGFKPKFSGEANASDSGQISLQPKPREPDTNVDLEAGRARDPANGVAHQNKVPPLPPSKDQLVKKRRDPDGLPKSSVPSTNGQATAEPPPPPPPRRTARHEEVVDAPPQDDDDFVSRHSHMKYELRDSPGLVPIGVYGIQHYLSILGSLILIPLVIVPAMGGSH

SEQ ID NO: 157599 - protein, 123 aa, Glycine max
  Coding DNA Sequence Number=SeqID_40821
MYPPVALLRHLHHAVTHALYVGLVFCRGKSEDPYRLLNCTHGALRPQMRKAEQAPHTPVSPSSIKHERKLGSEAINRTRSVALINIHEFGITSGRENCQETTLQAKPQRELGFVLKRKQHQKI

SEQ ID NO: 157600 - protein, 243 aa, Glycine max
  Coding DNA Sequence Number=SeqID_40822
  Gene Ontology: Mol. function=transcription factor activity; Cellular component=nucleus; Biological process=regulation of transcription, DNA-dependent
  Homolog annotation: Hit_ID=Q3L8J2; Match level="QueryCoverage=75%, HitCoverage=87%, E-value=5e-50, Identity=50%"; Hit description=CBF -like transcription factor
  Pfam annotation: Domain name=AP2; Domain location=75-139; Score =121.1; E_value=3.2e-33; Accession=PF00847.10; Description=AP2 domain
  Subcellular localization annotation: CTP_CleavageSite=82; ConfidenceScore=5.24e-01
MDVTMKKVESESPYYCSSSSPSSTSSESKLSSASPCNPNSPPDPSSWHAETSKKVVVLIPHKRKAGRKKFRETRHPVYRGVRQRNGNKWVCEVREPNKKSRIWLGTYPSPEMAARAHDVAVLALKGTSAVFNFPDSVSLLPVANSSSAADIRLAASKVSSVFGPSSSSSSRVETKPCLVDGFVKTENNVDEVKTVFFDEEAFYNMPVFLDSMAEALLITPPSMKRAFDWDEVDCETDLTLWTD

SEQ ID NO: 157601 - protein, 157 aa, Glycine max
  Coding DNA Sequence Number=SeqID_40823
  Gene Ontology: Mol. function=GPI anchor binding; Cellular component =membrane; Biological process=cell adhesion
  Homolog annotation: Hit_ID=Q2PES4; Match level="QueryCoverage=93%, HitCoverage=41%, E-value=2e-38, Identity=52%"; Hit description =Putative fasciclin-like arabinogalactan protein FLA2
  Pfam annotation: Domain name=Fasciclin; Domain location=43-157; Score= -9.4; E_value=0.022; Accession=PF02469.12; Description=Fasciclin domain
MGPTSKACTPLHHHKNFFAAQDNDDSLHCFYVKSVKEMPYYISVLQISAAISSADAEAPTATPSKAVPSFKENVGSGLTVFCPTDSTVSGFVPKYKNLTKAQKVSLLLYHATPVYESLQMLKSSNQIMNTLTTEGVNKYDLSEGKEVNLITKVNTSV

SEQ ID NO: 157602 - protein, 53 aa, Glycine max
  Coding DNA Sequence Number=SeqID_40824
MESKRESRERKLRSRNHIKLLKILALLGSDNKQASGHMYSVLGDIMRGNGRRG

SEQ ID NO: 157603 - protein, 162 aa, Glycine max
  Coding DNA Sequence Number=SeqID_40825
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=66%, HitCoverage=26%, E-value=6e-34, Identity=67%"; Hit description =Protein kinase like protein
MTVRQRGKGGIGALPEEDVPFMFRRPIIITDVEVAAGAELGEEAEPFGGVDGGVEGGEEGVVERFENFSLGLGSSLLAAAGELLLVHDLGGEHDGEGAVVEFGEVDGADVAGAKAAGEEEVGGEDAAAGGVRSDPVDGGPAGVGGGRVGLAVGGEVGGGGGR

SEQ ID NO: 157604 - protein, 66 aa, Glycine max
  Coding DNA Sequence Number=SeqID_40826
MGTTDFTLVYHGDTSCALAGYLDFDYAVDLDARRTVTSFYGGWVFELQKGPSMVIFGHGVAAKDKG

SEQ ID NO: 157605 - protein, 111 aa, Glycine max
  Coding DNA Sequence Number=SeqID_40827
MGIAPTRHPVDPEKSNRALGFPALVTGLYQSYRVPVPPSKVMPSRHRDRARRTPGGPKEVQQGPGVSSSDYGPLSVLRSARRPNKIIRPRINRAFIKKYCAPRRAQGETPQ

SEQ ID NO: 157606 - protein, 66 aa, Glycine max
  Coding DNA Sequence Number=SeqID_40828
MAGIFFLLKQQNSLEIMSVIILGTPQRALLRASEGEAHGCAFQRRKDARSHHQRLFVENVGKTEGP

SEQ ID NO: 157607 - protein, 454 aa, Glycine max
  Coding DNA Sequence Number=SeqID_40829
  Gene Ontology: Mol. function=protein binding; Cellular component =extrachromosomal circular DNA; Biological process=cell wall catabolic process
  Homolog annotation: Hit_ID=UPI00005F72F3; Match level="QueryCoverage =94%, HitCoverage=45%, E-value=1e-119, Identity=51%"; Hit description= COG2931: RTX toxins and related Ca2+-binding proteins
MLSSGDAARAATDRARSYASERLNEEITDWLSSAGTARTKLSVDNKGRLNGSELDVLVPFRDTPDAFLFTQAGIRHIDDRTTANLGLGQRHFVDNKWMFGYNAFLDYDLTRDHSRLGLGLEYGRDYLKVGTNGYFRLSNWRGSPDLKDYDERPANGFDIRSEAWLPQYPQLGASLAYEQYFGNEVGVISKDVRGKNPAAFSAGLTYTPIPLVSLGLERKQDTNGDGNTLLNLGLNYEMGAPWSKQIDPDAVRDMRTLTGNRYDLVERNNQIVLEYRKQEVIRLKLPSLVTGLSGETRPLDIGINAKYGLDYVEWDDASLVQAGGKVQGQKGQYSVVLPPYTPSGENSWTISAVAYDKKGNVSKRKETQVSVTSAGISATKSTFSSSEAALPADGESTSDLILELRDENNNPVTGLSDKVVLNIAMQAGDGSEPTLSAVQETSAGTYKSVMTAGT

SEQ ID NO: 157608 - protein, 193 aa, Glycine max
  Coding DNA Sequence Number=SeqID_40830
  Homolog annotation: Hit_ID=Q1SDS1; Match level="QueryCoverage=60%, HitCoverage=23%, E-value=8e-12, Identity=33%"; Hit description=IMP dehydrogenase/GMP reductase
ARRVAHGSSSACPLFVYVDWDQHLARIGGRTISWFPRWKEGNEGVLFSCGEYPNIPLIGTRGCINYNPTLAIRQLGYPMRGAPAEESLSPFLVRDFDAQSFKIIQRIHKAWESPLRKDKELRGIRNGIIGGYHEWLKVHTRGLDWLSKLKIINEENFEAPKEDEEVRALKTELRKARLAKEKFKLVATDIRKE

SEQ ID NO: 157609 - protein, 610 aa, Glycine max
  Coding DNA Sequence Number=SeqID_40831
  Gene Ontology: Mol. function=protein binding; Cellular component =cytoplasm; Biological process=regulation of GTPase activity
  Homolog annotation: Hit_ID=Q6H462; Match level="QueryCoverage=99%, HitCoverage=86%, E-value=1e-157, Identity=46%"; Hit description =Putative ADP-ribosylation factor-directed GTPase activating protein
  Pfam annotation: Domain name=Ank; Domain location=517-549; Score =40.5; E_value=5.8e-09; Accession=PF00023.20; Description=Ankyrin repeat
  Pfam annotation: Domain name=Ank; Domain location=550-582; Score =25.9; E_value=0.00014; Accession=PF00023.20; Description=Ankyrin repeat
  Pfam annotation: Domain name=ArfGap; Domain location=314-446; Score =193.4; E_value=5.4e-55; Accession=PF01412.9; Description=Putative GTPase activating protein for Arf
  Pfam module annotation: Pfam domain module=Ank::Ank::ArfGap; Domain location=517-549::550-582::314-446
VEHVLIDRLTEFMNVDLQDAKDSRRRFDKAVHSYDQSREKFVSLKKNTPEDVVAELEEDLQNSKSAFEKSRFNLVNSLMNIEVKKKYEFLESISAIMDAHLRYFKLGYDLLSQMEPYIHQVLTYAQQSKELANIEQDKLAKRIQEYRTQAELENIRASSNYIETVLGSDGTHVVGLNSYRSFEAGVQPATTKGEASNWPFLVQTVKQGYLLKRSSSSRGDWKRRFFVLDNQGNLYYYRVKGVKPMAENEADRMDWVNKITGAITSLFNSQFLQQPQFGRVHSQNKNSAAGASLASQSEDSQKSLRDGIYSKEVVSVSKILRGIPGNDKCAECSAPDPDWASLNLGILLCIECSGVHRNLGVHVSKVRSITLDVRVWENTVLELFDNLGNAYCNSVWEGLLLLDHERLGESNVPMKPCSTDAFQHKEKYIQAKYVEKSLIIREEDIPGNPSVSIRIWQAVQAVNVREVYRLIVTSTSNLINTKYYDESHHAADAKGHQHDPEACLRVEETTETERCFRGWSLLHLACHSGSALMVELLLQFGADVNMCDYHERTPLHHCITSGKNQLAKFLLRRGARPSVKDAGGLTVLERAMERGAITDEELFILLAECQ

SEQ ID NO: 157610 - protein, 48 aa, Glycine max
  Coding DNA Sequence Number=SeqID_40832
MVKYRAKSKTEMNQGAWGRVRVDARPVISRSSSRVWLRTIKKHYWEAA

SEQ ID NO: 157611 - protein, 338 aa, Glycine max
  Coding DNA Sequence Number=SeqID_40833
  Gene Ontology: Mol. function=oxidoreductase activity; Cellular component=proton-transporting two-sector ATPase complex; Biological process=response to gibberellin stimulus
  Homolog annotation: Hit_ID=Q84RC3; Match level="QueryCoverage=98%, HitCoverage=93%, E-value=9e-98, Identity=53%"; Hit description =Gibberellin 2-oxidase 1
  Pfam annotation: Domain name=2OG-FeII_Oxy; Domain location=193-293; Score=152.5; E_value=1.1e-42; Accession=PF03171.10; Description=2OG -Fe(II) oxygenase superfamily
MIDSNPPLVQHYGALVRNSGEEAKKAKSFNDQNHPLVDACDLPLIDLSGLKSSNERERKACTAAICKAASEWGFFQVVNHGISHDLLRKMREEQVKLFEVPFEKKVTCGLLNNPYRWGTPTATRSKHFSWSEAFHIPLTMISEAASWGEFTSLREAINEFAPAMLEVSRLLASILAQNLGYPEDALEKLCDAGTCFLRLNHYPCCPKSKDEIFGLVPHTDSDFLTILYQDHVGGLQLMKDSKWVAVKPNPDALIVNIGDLFQAWSNDEYKSVEHKVVANNKMERYSIAYFLCPSYSTVINGCKGPSVYRKFTFGEYRHQIQEDVKKIGHKIGLSRFLL

SEQ ID NO: 157612 - protein, 156 aa, Glycine max
  Coding DNA Sequence Number=SeqID_40834
MDLTVEDLMAIAEQYVKDYENKDRKERSSRQRESKWQFQDTNETGTTLDSSCENRISSGSGREDLSNSTSTTGELIATSTSQTGDPAQDMLDLFLGPLLRKTLEKEKIKSVVENAKITHEFSRQSQDKLAGEEMVPLMKKRNTLKDKVAMFLDQDM

SEQ ID NO: 157613 - protein, 132 aa, Glycine max
  Coding DNA Sequence Number=SeqID_40835
  Gene Ontology: Mol. function=DNA binding; Cellular component=nucleus
  Subcellular localization annotation: CTP_CleavageSite=33; ConfidenceScore=5.21e-01
MVPMGNYFGLSSSSEMMIYSGNSSIINSSNPVMGQMSQAGNLSSSSLLLDSVPGLKHDTGLAVEWSVDEQYRLEEGLAKYADEPSIMRYIKIAALLPDKTVRDVALRCRWLTWNFLFPMHSNLLVSPSPPKP

SEQ ID NO: 157614 - protein, 226 aa, Glycine max
  Coding DNA Sequence Number=SeqID_40836
  Gene Ontology: Mol. function=hydrolase activity, hydrolyzing O -glycosyl compounds; Cellular component=extracellular region; Biological process=carbohydrate metabolic process
  Homolog annotation: Hit_ID=Q1S4V5; Match level="QueryCoverage=98%, HitCoverage=44%, E-value=5e-85, Identity=69%"; Hit description =Glycoside hydrolase, family 10; Galactose-binding like
  Pfam annotation: Domain name=Glyco_hydro_10; Domain location=1-225; Score=-31.2; E_value=2.5e-10; Accession=PF00331.11; Description =Glycosyl hydrolase family 10
WYSTENVQGREDYSVADAMLQFVKQHNIAVRGHNIFWDDPRYQPGWVPSLSPYQLNSAVEKRVRSVVSRYRGQLISWDVVNENLHFSFFEGKLGQAFSGRIFHEAHNIDGQTTLFLNEYNTIEDSRDGVSIPARYIQKLKKIQSYPGNAGLPIGIGLEAHFSGPGINFPYLRASIDYLAATRLPIWITELDVASQPRQSQYFELALRELHGHPMGMLWTDSFLNGG

SEQ ID NO: 157615 - protein, 47 aa, Glycine max
  Coding DNA Sequence Number=SeqID_40837
MAATSRSLPQQGDAKMNVVNFQTIPRGSAHVSIPTWEVGGPYIDKDD

SEQ ID NO: 157616 - protein, 66 aa, Glycine max
  Coding DNA Sequence Number=SeqID_40838
MWDATVFRVFNEDFPLYIKHEDLSEIAHGGQCLSIFVIQLWIMHLTETGMRAGNFNVYGFLEPQSI

SEQ ID NO: 157617 - protein, 62 aa, Glycine max
  Coding DNA Sequence Number=SeqID_40839
MVRVTPFCENAPTIWDQHRLKGTLKPSVFNPKAQTPKNPLGPHLPHSGPTPKTILFTHKHTS

SEQ ID NO: 157618 - protein, 106 aa, Glycine max
  Coding DNA Sequence Number=SeqID_40840
  Homolog annotation: Hit_ID=P26264; Match level="QueryCoverage=46%, HitCoverage=19%, E-value=1e-14, Identity=73%"; Hit description =Protein cysQ
MGLGILPLFCASCRSAGHSALRHSRHDRTMILIIKANTLSCGCHSAPAKISGDGLPGAGDAIMQVYDGAQPLDVTRKSDDSPVTAADLAAHQVIVQGLAALTPDVP

SEQ ID NO: 157619 - protein, 383 aa, Glycine max
  Coding DNA Sequence Number=SeqID_40841
  Homolog annotation: Hit_ID=Q1YJF4; Match level="QueryCoverage=81%, HitCoverage=43%, E-value=6e-98, Identity=57%"; Hit description =Putative phage host specificity protein
AAGAALGGIFGPVGAIIGRAAGALAGNAVDRALLSDGRTVSGARLSTARIPGADEGAAINRLYGTARIGGTLIWATRFEESRVVQRRGGKGNRGPRAETYRYFANLAIGLCEAEAALVRRVWADGREIDLTGIEMRFYPGSATQLPDPLIEAKQGSGNAPAFRGLAYVVIERLPLEAYGNRIPLMQFEVVRPVGGLEKSIRAVTVIPGATEHGYATVPVSEHTGMGESRVMNRNGLTAETDWRAAIDELQALCPALQSVALVVSWFGTDMRAGECRILPGVEVGDREGETTPWSVAGLTRAGAHPVSHHHGGPAYGGTPNNEGVLQAIATSRRGPEVCLYPFVRWTCRGNGCGSLWQGRTGRLCWGAHHLLSRPGARIADRTA

SEQ ID NO: 157620 - protein, 79 aa, Glycine max
  Coding DNA Sequence Number=SeqID_40842
MSSSLCKYLYSTRMDYSEGHYPVYSISNTAFPPSEGKFSEACVNLPSITSQGSLVEATNDQGSSHRGTSDINLRFCILP

SEQ ID NO: 157621 - protein, 528 aa, Glycine max
  Coding DNA Sequence Number=SeqID_40843
  Gene Ontology: Mol. function=nucleic acid binding; Cellular component= intracellular
  Homolog annotation: Hit_ID=Q6YS82; Match level="QueryCoverage=54%, HitCoverage=74%, E-value=8e-78, Identity=53%"; Hit description=RRM -containing RNA-binding protein-like
  Pfam annotation: Domain name=zf-RanBP; Domain location=158-187; Score= 23.7; E_value=0.00067; Accession=PF00641.9; Description=Zn-finger in Ran binding protein and others
  Pfam annotation: Domain name=zf-RanBP; Domain location=94-125; Score =32.2; E_value=1.8e-06; Accession=PF00641.9; Description=Zn-finger in Ran binding protein and others
  Pfam module annotation: Pfam domain module=zf-RanBP::zf-RanBP; Domain location=158-187::94-125
KETNEPKGDATVTYEDPHAAVAAVEWFNNKDFHGNTIGVFIAESKNKDEQAYNAAVEPVVADDVGGLEETTKDVNGGSGRGRGQNDSSGKAWQQDGDWLCLNTSCSNVNFAFRGACNRCGTARPAGASGISGAGGRGKGRAAQESGGIGRPAGGGLFGPNDWPCPMCGNINWAKRTKCNICNTNKPGHNEGGVRGGRGGGYKELDEEEIEETRRRRREAEDDGELYDEFGNLKKKYRAKTQQAEAARGLPGSGRAGWEVEELGMLEKVETEEGSAMMGRAGTESEAKKRGLAVGIERGRGEETEIGIMLIEIEIMGEIEIGTEVDTVTEISSKSASGCVDYHAVLAFCGRISIALNSILKFGGSTSCNLINAHFTWHGPFVQPMTASWIREQCANMSSRAGKGPAIRSYRRRKTALDLDLNRLPAGENREQEGPSTQAVPQEIQLEQQPQVTQPPMIDVEAIDDDVVECTPRAFAEGGSVKKTPEPPKELVFNCPICMGPMDCIKAAISAQGKCPTCRKKVVAKDLIR

SEQ ID NO: 157622 - protein, 65 aa, Glycine max
  Coding DNA Sequence Number=SeqID_40844
MKRLWENYDDPNNIRKKIIEECSGGKEGDRCMTSKKGVKNNGGKGDKVGETWEEEGGLQIENRME

SEQ ID NO: 157623 - protein, 120 aa, Glycine max
  Coding DNA Sequence Number=SeqID_40845
  Gene Ontology: Mol. function=DNA binding; Cellular component=nucleus; Biological process=response to DNA damage stimulus
  Homolog annotation: Hit_ID=Q682D3; Match level="QueryCoverage=76%, HitCoverage=24%, E-value=1e-14, Identity=43%"; Hit description=DNA -repair protein XRCC2 homolog
MADASAYCDIDTQFFITIEVISHQCSVTLHCRLEKEKEVHGVGVHLLMIDSIGAFHWMDRASMFLSQRENSKKKLFLQTMSEAVVQNIRKLLQVHPMLIIATKSVVFGNRYSTASNDVKV

SEQ ID NO: 157624 - protein, 236 aa, Glycine max
  Coding DNA Sequence Number=SeqID_40846
  Homolog annotation: Hit_ID=Q013I8; Match level="QueryCoverage=36%, HitCoverage=42%, E-value=4e-09, Identity=33%"; Hit description =Homology to unknown gene
MNIMSTHQCSWPVRIQDHPDKGSINKAPFSRGSEFLNVGYHAQKYGHSARKCRPIFASSVSNSMDPSDSDDTDKKKPQNGEMGGVNSEMLRESLEKIVGEDDSTFSGFDLATLIRNKYGRSYDVQLIKKEFMGRNLLAMNVMWKYMEQRSFPLTEEEYILRLDDIANTLKCWGAVSHIRNSLEKSKERPRIGKVLFLNFESWLKTVSFLDNNIINEKEGHSERWIHVFLREDRRYK

SEQ ID NO: 157625 - protein, 187 aa, Glycine max
  Coding DNA Sequence Number=SeqID_40847
  Gene Ontology: Mol. function=ubiquitin-protein ligase activity; Cellular component=ubiquitin ligase complex; Biological process =protein ubiquitination
GTFLEDAMLVSCGHSFGGLMLRRVIETSKCTLCNVEIETGSLIPNHALRAAAAAVKHEDDRRLFRNAALRKRRKEMGDQMDSMRRVNGENGDFTAADGLQRGVQYPFLVNEKVVIKGNRRTPEKFVGKEAVITSQCLNGCSANGGSGGDGGGSVDIGHDDVSGNGRAGGGGADVCGGGGKGRTIVKC

SEQ ID NO: 157626 - protein, 560 aa, Glycine max
  Coding DNA Sequence Number=SeqID_40848
  Gene Ontology: Mol. function=binding; Cellular component=nucleus; Biological process=mRNA editing
  Homolog annotation: Hit_ID=Q94I34; Match level="QueryCoverage=82%, HitCoverage=75%, E-value=1e-101, Identity=40%"; Hit description =Putative selenium-binding protein-like
  Pfam annotation: Domain name=PPR; Domain location=174-208; Score =34.2; E_value=4.4e-07; Accession=PF01535.11; Description=PPR repeat
  Pfam annotation: Domain name=PPR; Domain location=276-310; Score =31.8; E_value=2.4e-06; Accession=PF01535.11; Description=PPR repeat
  Pfam annotation: Domain name=PPR; Domain location=311-345; Score=9.9; E_value=0.5; Accession=PF01535.11; Description=PPR repeat
  Pfam annotation: Domain name=PPR; Domain location=377-411; Score =38.8; E_value=1.9e-08; Accession=PF01535.11; Description=PPR repeat
  Pfam annotation: Domain name=PPR; Domain location=412-446; Score =12.6; E_value=0.24; Accession=PF01535.11; Description=PPR repeat
  Pfam annotation: Domain name=PPR; Domain location=448-481; Score =13.1; E_value=0.21; Accession=PF01535.11; Description=PPR repeat
  Pfam module annotation: Pfam domain module=PPR::PPR::PPR::PPR::PPR::PP R; Domain location=174-208::276-310::311-345::377-411::412-446::448 -481
MLALPRWSNTLVSLFKKHQTLEQCKQIQSIIVTSGLYSTQDNNTLFLTKLLQCVPFSQNQNTCLLLLFDTINTPNTRLLNKMIAACSHPHISLLCYAKLRQKGVQPDKHTFPLLLKTFSKSIAQNPFMIYAQIFKLGFDLDLFIGNALIPAFANSGFVESARQVFDESPFQDTVAWTALINGYVKNDCPGEALKCFVKMRLRDRSVDAVTVASILRAAALVGDADFGRWVHGFYVEAGRVQLDGYVFSALMDMYFKCGHCEDACKVFNELPHRDVVCWTVLVAGYVQSNKFQDALRAFWDMLSDNVAPNDFTLSSVLSACAQMGALDQGRLVHQYIECNKINMNVTLGTALVDMYAKCGSIDEALRVFENMPVKNVYTWTVIINGLAVHGDALGALNIFCCMLKSGIQPNEVTFVGVLAACSHGGFVEEGKRLFELMKHAYHLKPEMDHYGCMVDMLGRAGYLEDAKQIIDNMPMKPSPGVLGALFGACLVHKAFEMGEHIGNLLVNQQPNHSGSYALLANLYKMCQNWEAAAQVRKLMKGLRVVKAPGYSRIEVDGFNS

SEQ ID NO: 157627 - protein, 85 aa, Glycine max
  Coding DNA Sequence Number=SeqID_40849
  Homolog annotation: Hit_ID=Q9C6C3; Match level="QueryCoverage=56%, HitCoverage=6%, E-value=2e-10, Identity=62%"; Hit description=GCN4 -complementing protein, putative; 3111-9506
MASAFVKLDDSPMFQRQLYSLEETTDELTDRCQKLYKGCRKFMNDFLEYSRKKYRASFSPLFMVVPRGFLLLIKYAKKLDSFVAF

SEQ ID NO: 157628 - protein, 86 aa, Glycine max
  Coding DNA Sequence Number=SeqID_40850
MDKMNVHIITRGTLRAKGHLGAVGARPGELKLSAEAMSSPKQVSFFIMKLFGGPGEPKTSLGELGFRKTKEKTLLPPFWVFFVFLI

SEQ ID NO: 157629 - protein, 288 aa, Glycine max
  Coding DNA Sequence Number=SeqID_40851
  Gene Ontology: Mol. function=transcription factor activity; Cellular component=membrane; Biological process=regulation of transcription, DNA-dependent
  Homolog annotation: Hit_ID=Q62A75; Match level="QueryCoverage=87%, HitCoverage=92%, E-value=1e-45, Identity=40%"; Hit description =Transcriptional regulator, LysR family
IALRSRGPAAGDRHSHAERADPGHRASPQHAPVRPQPARSAVDLRRRGVPGGSPRCAAPIRTGRTLGRRAGRGSAQPVPQPLPGRGTAGERMADGRAPAAAAGRPGGCGVLPASDGCTRQFRRTHPGRRPVLRGPAGNPSAGAGPRAGTAGVIGPGKLRHAGAAGGRNGSRAPRRVHSTYPFPARASGGGVGRGVGRRWFGGDRAIGTATHAGAARNDLSATGRPHHRLDHRCAVPAGGDLACGATADRAGEGDAVQAHRHVAPGLSAARQVDDCYTCATCIRIRWTS

SEQ ID NO: 157630 - protein, 226 aa, Glycine max
  Coding DNA Sequence Number=SeqID_40852
MVAMSGDCGNVGYGCGGGEGSVIVGSGGGGDDGSNVSGDGGGSDSGGGAMVATIGDCENVGYGCGGSDESGIVRSGGDGVVAMTTMSVVAPSGDGCNDISSGCGGGDGCGGGCNIRDFLLLGGSPTTTLHTMTLHSIFLLVKTIHRSESFVAFGSLSFRCDLFACYMVVVIMTMIVTIMMVTMLVVMVMSVVIVMARTMMVVVVVAVVAVSYDGGGGVVVVMMEQW

SEQ ID NO: 157631 - protein, 136 aa, Glycine max
  Coding DNA Sequence Number=SeqID_40853
  Homolog annotation: Hit_ID=Q07X11; Match level="QueryCoverage=33%, HitCoverage=22%, E-value=2e-09, Identity=63%"; Hit description =Conserved hypothetical flavoprotein oxygenase
  Pfam annotation: Domain name=DUF1471; Domain location=50-136; Score =49.7; E_value=9.6e-12; Accession=PF07338.3; Description=Protein of unknown function (DUF1471)
VAVHIDESLLEDGIYQTAKAQPILRAGGPTAYYSIDESQRFDMIRPDAPMRTFLLAPAFIALALLSSPTQANNPETAAVAVGPLRPSGSVSASGASTLDDLQAQLAQKAHQQGAIAWRINAAGGGNKLAGSAIIYK

SEQ ID NO: 157632 - protein, 304 aa, Glycine max
  Coding DNA Sequence Number=SeqID_40854
  Gene Ontology: Mol. function=transferase activity, transferring phosphorus-containing groups; Cellular component=membrane; Biological process=peptidyl-histidine phosphorylation
  Homolog annotation: Hit_ID=Q89RB0; Match level="QueryCoverage=60%, HitCoverage=21%, E-value=3e-78, Identity=75%"; Hit description=Two -component hybrid sensor and regulator
  Subcellular localization annotation: CTP_CleavageSite=30; ConfidenceScore=5.48e-01
TTPAALNAPLQGASHSPFRLRNCWEGRSVRASSLLRQLAKGGMCCKAIKLGNARVFPVTTLANWSSTAVAAALELVDPPGCRNSIGRRPKRRGRRNTLARQGDDEFREGTRFRGDVNRPAVLLDHDVVAQRQAEPRSLARRLGGEERVEHLGSDAVGDAGTVVAHADLDAVAPVPGRDRQRRFVAGITVGGPLLGGVEAVRHQVQKDPRYLLGVEVGETGRRIVIAHEGHVEARFRRAGPVIGKIQALLDQPVDLDRSMLAGSGARVQQHVLDDRVRALAVLDDIKLIDTVDLEGGPGTSFCSL

SEQ ID NO: 157633 - protein, 128 aa, Glycine max
  Coding DNA Sequence Number=SeqID_40855
MEEKSKRGHKEHSCTESPTLNIDPPSPVARHLKWKIARTKRHGQMTSKVAQEIADKIDSLQEQATQGSFVPHGRQDILNTALGRPEHPGRVRVAGTGVTISQYFGQASRASSTSSPSINQQQLADIIG

SEQ ID NO: 157634 - protein, 389 aa, Glycine max
  Coding DNA Sequence Number=SeqID_40856
  Gene Ontology: Mol. function=nucleotide binding; Cellular component =intracellular; Biological process=multicellular organismal development
  Homolog annotation: Hit_ID=Q9SVA6; Match level="QueryCoverage=99%, HitCoverage=90%, E-value=1e-154, Identity=73%"; Hit description=GTP -binding-like protein
  Pfam annotation: Domain name=Dynamin_N; Domain location=67-176; Score= -46.5; E_value=0.1; Accession=PF00350.13; Description=Dynamin family
  Pfam annotation: Domain name=MMR_HSR1; Domain location=65-173; Score =116.7; E_value=6.8e-32; Accession=PF01926.13; Description=GTPase of unknown function
  Pfam annotation: Domain name=Miro; Domain location=66-183; Score= -2.8; E_value=0.01; Accession=PF08477.3; Description=Miro-like protein
  Pfam annotation: Domain name=TGS; Domain location=347-389; Score =12.3; E_value=0.0076; Accession=PF02824.11; Description=TGS domain
  Pfam module annotation: Pfam domain module=Dynamin_N::MMR _HSR1::Miro::TGS; Domain location=67-176::65-173::66-183::347-389
MATVMQKIKDIEDEMAKTQKNKATAHHLGLLKAKLAKLRRELLTPSSKGAGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGISVCTGSLVSSLIDFYLASDFDFGPKKEGFRSEAGGLTSKLATREVLLHVTICSCGRLNKEPPNLTFRKKDKGGLNLTSTVTTTHLDLETVKAICSEYRIHNADITLRYDATADDLIDVIEGSRVYIPCIYVVNKIDQITLEELEILDKLPHYCPISAHLEWNLDGLLEKIWEYLNLTRIYTKPKGMNPDYEDPVILSSKKRTVEDFCDRIHKDMLKQFK

SEQ ID NO: 157635 - protein, 202 aa, Glycine max
  Coding DNA Sequence Number=SeqID_40857
MPDNRNHGHGVGKFLPRGIHELLHRFRCFLESLHITARTFSQSESNTESTTQNKPGASESRSKTATLHISPSARENKHARAKTLRTVTWRLVRFQCGSDGDPTVVEVWFEGCAVKEHRDWGRERCFVQERVRCELTLVAKAWFVCGTTMPGFEAWKWNRRALCISVCDTNTSSESTITRQDCSFCTLWAPERRRQQLLPAPP

SEQ ID NO: 157636 - protein, 535 aa, Glycine max
  Coding DNA Sequence Number=SeqID_40858
  Gene Ontology: Mol. function=4-alpha-glucanotransferase activity; Cellular component=chloroplast; Biological process=carbohydrate metabolic process
  Homolog annotation: Hit_ID=Q1S9B5; Match level="QueryCoverage=99%, HitCoverage=99%, E-value=0.0, Identity=67%"; Hit description =Glycoside hydrolase, family 77
  Pfam annotation: Domain name=Glyco_hydro_77; Domain location=73-532; Score=490.5; E_value=1.9e-144; Accession=PF02446.8; Description=4 -alpha-glucanotransferase
  Subcellular localization annotation: CTP_CleavageSite=34; ConfidenceScore=5.50e-01
MGLALNISVCCFPQQRCPTLFKPTITKQTLSFPTASAFSSVTQLSVGQDLPANYSDWVPSPDPELRRRCGILLHPTSFRGPYGIGDLGDEAFRFIDWLHHSGCSVWQVLPLVPPGRKANEEGSPYSGQDANCGNTLLISLEGLVEDGLLEKHELPQPIDAGRVNFSLVADLKDPLITKAAERLISSEGELKTQLENFRRDPDISCWLEDAAYFAAIDDSLNTISWQWQKVHSYAQSKGISIMGDMPIYVGYHSADVWANKKQFLLNRKGFPLLVSGVPPDAFSETGQLWGRASPGAAVKLCLGDLLVMGSNPETASLHMQGIDHFRGFAGYWAVPSEAKVAMLGKWKVGPGISLFDAIFRAVGRINIIAEDLGVITEDVVQLRRSIGAPGMAVLQFGFGGGANNPHLPHNHECNQVVYTGTHDNDTKGPGYALQKSVKVCDRKLIGGWWEALNQEEKSNGDEISWALIQRVLASVAQTAIIPMQDVLGLGNSARMNIPATQFGNWGWRIGSSVSFDGLEREADRLREMLSMYGRL

SEQ ID NO: 157637 - protein, 370 aa, Glycine max
  Coding DNA Sequence Number=SeqID_40859
  Gene Ontology: Mol. function=shikimate kinase activity; Cellular component=chloroplast; Biological process=aromatic amino acid family biosynthetic process
  Homolog annotation: Hit_ID=Q30CZ9; Match level="QueryCoverage=99%, HitCoverage=61%, E-value=2e-61, Identity=66%"; Hit description =Putative shikimate kinase
  Pfam annotation: Domain name=SKI; Domain location=1-166; Score=131.9; E_value=1.7e-36; Accession=PF01202.12; Description=Shikimate kinase
  Pfam annotation: Domain name=SKI; Domain location=197-361; Score =83.6; E_value=6.1e-22; Accession=PF01202.12; Description=Shikimate kinase
  Pfam annotation: Domain name=Thymidylate_kin; Domain location=3-141; Score=-48.2; E_value=0.05; Accession=PF02223.8; Description =Thymidylate kinase
  Pfam module annotation: Pfam domain module=SKI::SKI::Thymidylate_kin; Domain location=1-166::197-361::3-141
MASGKTTVGRILSEALSYSFYDSDALVVKEVGGISVTDIFKHYGEPFFRNKETEVLQKVSIMHRHLISTGGGAVGISVWLDVPVEVLTQRITAEGTDSRPLLHYEGGDAYTKTITHLSSLFEERSEAYANANVKVSLENMAAKLGRRDVLDLSPTAIAMEFQDEAPRNLKWFKACKFSAMVHSKKLGRTEPNGSAGDALVEEEVDGTAVADIFKHNGEPFFRNKEEKIGTSEGGGHTEVLRKLSMMHRYVISTGGGAVVRPINWKYMQQGISVWLDVPVEALAQRITAVGTDSRPLLHYEEGDAYTKTFMRLSALFKERSEAYANANVKVSLENMAAKLGSRDESDLSPTAIAMEALEQIKGFLMGEDGC

SEQ ID NO: 157638 - protein, 345 aa, Glycine max
  Coding DNA Sequence Number=SeqID_40860
  Homolog annotation: Hit_ID=Q8H291; Match level="QueryCoverage=84%, HitCoverage=89%, E-value=3e-68, Identity=45%"; Hit description =Putative ATP/GTP binding protein
MSKRANKRKAKQDEQPKQRKKRSTTIKPAEHEEYFEDQRNLEDLWRETFPVGTEWDQLDSVYQYKWNFSNLENAFEEGGVLHGKRVYLFGCTEPQLVWFKDESKVVCIPVVVAVVSPFPPSDKIGINSVQREFEEIIPMKQMKMDWIPYIPLEDRAALKHLKLDRVKKYEYCLPYFYHPFKEDELEQSTEVQIIFPAEPKPVFCEFDWELDELEEFTDKLIEEEELLEDQKDTFKEFVKEKVREAKKANREAREARRKAIQEMSEEARAAFENMRFYKFYPVQSPDAPDVSNVKVGIMERLMRFCNWIQDDANFVCRLVLPDTKDLVIYDVQKATSWCLVRSVGV

SEQ ID NO: 157639 - protein, 416 aa, Glycine max
  Coding DNA Sequence Number=SeqID_40861
  Gene Ontology: Mol. function=transmembrane receptor activity; Cellular component=membrane; Biological process=defense response
  Homolog annotation: Hit_ID=Q9FVK2; Match level="QueryCoverage=65%, HitCoverage=89%, E-value=1e-76, Identity=51%"; Hit description =Resistance protein MG13
  Pfam annotation: Domain name=TIR; Domain location=14-144; Score =106.6; E_value=7.3e-29; Accession=PF01582.10; Description=TIR domain
MALRSGSSSFTYDLFLSFRGSDTRQGFAANLYKALANRGIYTSIDDEELQSGEEITPTLLKAIEESRISMAVLSVNYASSSFCLDELATIFDCAERKALLVFYKVEPSHVRHRKVSYGEALAKKEERFKHNMDKLPKWKMPFYQAANLSGYHFKDGYAHEYEFIGRMVEQVCCKINPTCLHVADYLVGLESQVSKVMKLLDVGSDDGVHHMTGIHEKSNKHELQHFQSILLSYILGKKKIKLASEQQGVSMIQHRLQRKKVLLILDDVDKLEQLLPLALEEVKDLQFIAKLFSQFHQSREPSSSFWFHNKFPDKVLSLVIAPVGDNGSRMFSPNPMVFINGKAHESVISWNEEMVRMEMDCIYLVDLQLIFGNLYEVPLENEWNHVEVTYVGVIKTSILKASRIYVIKQERSTEDI

SEQ ID NO: 157640 - protein, 1145 aa, Glycine max
  Coding DNA Sequence Number=SeqID_40862
  Gene Ontology: Mol. function=receptor activity
  Homolog annotation: Hit_ID=Q1S9C4; Match level="QueryCoverage=99%, HitCoverage=97%, E-value=0.0, Identity=81%"; Hit description=Zinc finger, RING-type; SPla/RYanodine receptor SPRY
  Pfam annotation: Domain name=SPRY; Domain location=147-269; Score =129.2; E_value=1.2e-35; Accession=PF00622.18; Description=SPRY domain
MAEDIPRVGGFSAGLAVILNDKDSKKNSPKTRLLSCCDDLGQQSVERTLEYVFGLPNRSLNSLTGLVDRNFICSVIRNDFSRYNVKLSDSHGERDGICINSKNGNGHVVIGLEESSICGDIKVIKSPFLIESMAMFSSARASACVWKGKWMYEVMLETSGIQQLGWATLSCPFTDHKGVGDADDSYAYDGRRVSKWNKDAETYGQSWVVGDIIGCCIDLDRDEILFYRNGNSLGVAFQGIRKLGPGFGYYPAVSLSQGERCELNFGARPFKYPIEGYLPLQAPPSKSYFVTQLLQCWSRLLDMHSVERAEHSLVQKLRRVKRFVSLEEIFHPASYAICEELFSILEADDGITEYMVWGPMLSFMFEVFGLHAPHDYSSMDKVVEILLQFQGSHVLFEHILNALSCGCKIASLVLIECPYSGSYSHLALACHLLRQEELMVLWWKSPDFEFLFEGFLSRKTPNKQDLDSMIPTVWWPGSCEDASYEGNMMLTTTALSESIGKIEEKHRDLCRLVIQFIPPTNSPQLPGAVFRTFLRSLLLKNRGAERNIPPPGVSSNSVLVSVYTVVLHFLSEGFALGDICGWLKSCKADVGFLHRGGEQTFPVHLFLKNDPHRADISRLGGSYSHLSKLHPTIDHEMEVIQWDEGCMDSEETRVTHSTRQKPCCCSSYDSDFTRNFKVPAKYLAKGSSGHCSSIPERPAHVAAECSDGSLNDEITDKPSSSDQSEPEYGYRQVHHMKSVPKDTNMSTDTLQEEELLDALLWLYHVGLAPNFKQASYYMTHQAQSISLLEETDKQIRERACSEQLKHLKEARNEYREEVTFVVTHFNDPRISSADLRDLLLQSISVLVQYREYLATFESNEAATQRMPKALLSAFDNRSWIPVMNILLRLCKGSGFSFSKNGESSSSSVLFQRLLREACISDEGLFSSFLNRLFNTLSWTMTEFSVSVREMQEKYQQRKCCVIFDLSCNLTRILEFCTHEIPQAFLSGPDTNLRRSLRRHNQPPEKVNRGMILAPLVGIILNLLDATNSAEYRENNDLLDVFASMDCPDTVQYGFQYLLDYNWDGSFRGEAYVAKYEQLENFLSLLTCRTVLHHDKVDSVGDTDLDDGLCCICYACEANAQIAPCSHRPAKEELLFYGCLVPVEVS

SEQ ID NO: 157641 - protein, 160 aa, Glycine max
  Coding DNA Sequence Number=SeqID_40863
  Homolog annotation: Hit_ID=Q9ZU94; Match level="QueryCoverage=52%, HitCoverage=31%, E-value=9e-08, Identity=42%"; Hit description =Expressed protein
MLLSLVTGGWELGTTFRQGSLMPILLGNDCGTWHCNITEKRKGSEDLVTSSSCPRPDESNIILLNETIVELRIIVRGVEVVELDDRMRYGARALVIGEVTATLEEAIDDIIGGKDGEVVVVGEGDRVDEGGEEQVDNVFISEIRSELRLGVDLHKSDKGS

SEQ ID NO: 157642 - protein, 111 aa, Glycine max
  Coding DNA Sequence Number=SeqID_40864
MEQPKNYLTPPAKQLENSQADTRSIAHVVYPRIQWHNVFLTTKRRESLRRWTLKRSQVIFNKKKFGYCRSKLHDESRLIQRSFDDNKGNDKKLKGQEHFMITKMMISRIKE

SEQ ID NO: 157643 - protein, 116 aa, Glycine max
  Coding DNA Sequence Number=SeqID_40865
  Homolog annotation: Hit_ID=Q338G4; Match level="QueryCoverage=64%, HitCoverage=72%, E-value=9e-15, Identity=48%"; Hit description =Expressed protein
MEQSKECCSSTSNRNSLSEANGISDKNAPWLSVPQFGDWDQKGQVPDYSLDFSKIRETRKQNKTNISRASLGNEEELTASATNNANTVHSDEHQHPHYNQTNSPTLLFVGIVENWE

SEQ ID NO: 157644 - protein, 490 aa, Glycine max
  Coding DNA Sequence Number=SeqID_40866
  Gene Ontology: Cellular component=cytoplasm; Biological process =apoptosis
  Homolog annotation: Hit_ID=Q5RGB3; Match level="QueryCoverage=63%, HitCoverage=88%, E-value=5e-18, Identity=27%"; Hit description=Novel protein
  Pfam annotation: Domain name=PDCD2_C; Domain location=324-478; Score=- 13.2; E_value=2.6e-06; Accession=PF04194.4; Description=Programmed cell death protein 2, C-terminal putative domain
MGELELKFFSDNEAIYIKMFCVSLKATIEAHNSGSKHWYSASEEEREGGAKKDAESSDGSVNDGIESLKAFNWKEEFVEKNKPRGFGLSEYEKMCSWSWKTTLRGVGAAFWLRLGRKKKKKMSATASATLLGMPGPWAYDYHEPSDPYTTKIGGLPDWPLPINTDLLRCAECTGQLCLVAQVYAPLSHHRTLFVLGCVSPNCGTAWRVLRLQNVADVDTSQQKHAASVAEVPIATVSDDDDDDDAIDMDFEQLGKALFEAGTLASNTKRKKPRKKCQNKLPSSSPHPKTTTTIVQNDVPVVPCFYIYAQEEQSLGDISSVCSSYSSLSIKGNGSDVEDPDPSQAEETWEKEQYEYDKALNADRTYLKFKKRLDAYPEQCFRYSYGGRPILAAADKINPGSCSLCGRPMQFEMQLMPPLLYFLQEALGDQRKMVEKWDWMTLIVYTCSESCCEGIEQAKSNNKGWIIAEEAVVAQCEEPLAVQLGVEEAIA

SEQ ID NO: 157645 - protein, 54 aa, Glycine max
  Coding DNA Sequence Number=SeqID_40867
MEENELHFCVFSGKHDELAKRAYELAMRTYRAKRVHLVRMNTHPPVEIHVAKRG

SEQ ID NO: 157646 - protein, 156 aa, Glycine max
  Coding DNA Sequence Number=SeqID_40868
  Gene Ontology: Mol. function=sequence-specific DNA binding; Cellular component=nucleus; Biological process=regulation of transcription
  Homolog annotation: Hit_ID=Q2PJS3; Match level="QueryCoverage=75%, HitCoverage=66%, E-value=2e-51, Identity=78%"; Hit description=WRKY21
  Pfam annotation: Domain name=WRKY; Domain location=97-142; Score=8.8; E_value=5.9e-05; Accession=PF03106.6; Description=WRKY DNA -binding domain
MDYYFGNPNPKPYDNRHSAVVNTESPSSEFMLSDYLVLEDAVDNQESWSQSTETESSEKGNSSDVSHGKCENNGIKRKKEEVSQMITFRTRSQLEVMDDGYKWRKYGKKTVKNNPNPRLNKSMSRHDYEWRGKSGNHVNHALLNRIGYWARYVIPS

SEQ ID NO: 157647 - protein, 60 aa, Glycine max
  Coding DNA Sequence Number=SeqID_40869
MKETIRSFQEWTREDSSKSMISVSFNGPELFLYLIQFPFFAIAGGTLPVAKCKGCGCGRH

SEQ ID NO: 157648 - protein, 236 aa, Glycine max
  Coding DNA Sequence Number=SeqID_40870
  Gene Ontology: Mol. function=DNA binding; Cellular component =intracellular; Biological process=regulation of transcription, DNA -dependent
  Homolog annotation: Hit_ID=Q6D013; Match level="QueryCoverage=99%, HitCoverage=85%, E-value=1e-101, Identity=79%"; Hit description =Acetate operon repressor
  Pfam annotation: Domain name=HTH_IclR; Domain location=29-117; Score =117.9; E_value=2.9e-32; Accession=PF09339.1; Description=IclR helix -turn-helix domain
  Pfam annotation: Domain name=IclR; Domain location=147-236; Score =74.5; E_value=3.3e-19; Accession=PF01614.9; Description=Bacterial transcriptional regulator
  Pfam module annotation: Pfam domain module=HTH_IclR::IclR; Domain location=29-117::147-236
  Subcellular localization annotation: CTP_CleavageSite=18; ConfidenceScore=5.09e-01
MATPAPAKRGKKPRTAPVASAPAGGQVQSLTRGLRLLELIAESHGSVALTELAQQAGLPNSTTHRLLTTMQQQGFVHQVGDLGLWTIGAHAFVVGSSFLQSRNLLAIVHPILRRLMEEAGETVNLAVLDLSDYQAVIIDQVQCTQLMRMSAPIGGKLPMHASGAGKAFLAHLSDDQVTTLLHQKGLHHYTPKTLMSPHSLKENLALIRKMGFSHDDEEHALGLRCVAAPIYDEHGE

SEQ ID NO: 157649 - protein, 137 aa, Glycine max
  Coding DNA Sequence Number=SeqID_40871
  Gene Ontology: Mol. function=homocysteine S-methyltransferase activity; Biological process=folic acid and derivative biosynthetic process
  Homolog annotation: Hit_ID=P13009; Match level="QueryCoverage=70%, HitCoverage=7%, E-value=1e-40, Identity=80%"; Hit description =Methionine synthase
METIFVFNGMNANAGLLVGSAGRFAAGGRKRVTFAHLKVVPDFRGSRFADWPCDVKGNNDLLVLSKPDVIREIHDAYLAAGADILETNTFNATPIAMADYEMAALSAEINFEAAKLARACADAWTAKTPDRPRYVAG

SEQ ID NO: 157650 - protein, 369 aa, Glycine max
  Coding DNA Sequence Number=SeqID_40872
  Gene Ontology: Mol. function=binding; Cellular component=chloroplast envelope; Biological process=photosynthesis, light reaction
  Homolog annotation: Hit_ID=Q1SQT1; Match level="QueryCoverage=95%, HitCoverage=95%, E-value=1e-100, Identity=57%"; Hit description=TPR repeat
  Pfam annotation: Domain name=TPR_1; Domain location=181-214; Score =15.6; E_value=0.074; Accession=PF00515.18; Description =Tetratricopeptide repeat
  Pfam annotation: Domain name=TPR_1; Domain location=268-301; Score =1.9; E_value=3.2; Accession=PF00515.18; Description=Tetratricopeptide repeat
  Pfam annotation: Domain name=TPR_1; Domain location=302-335; Score =8.5; E_value=0.52; Accession=PF00515.18; Description=Tetratricopeptid e repeat
  Pfam annotation: Domain name=TPR_2; Domain location=181-214; Score =19.1; E_value=0.016; Accession=PF07719.7; Description=Tetratricopepti de repeat
  Pfam annotation: Domain name=TPR_2; Domain location=268-301; Score =12.2; E_value=1.2; Accession=PF07719.7; Description=Tetratricopeptide repeat
  Pfam annotation: Domain name=TPR_2; Domain location=302-335; Score =13.5; E_value=0.77; Accession=PF07719.7; Description=Tetratricopeptid e repeat
  Pfam module annotation: Pfam domain module=TPR_1::TPR_1::TPR_1::TPR _2::TPR_2::TPR_2; Domain location=181-214::268-301::302-335::181 -214::268-301::302-335
  Subcellular localization annotation: CTP_CleavageSite=97; ConfidenceScore=5.59e-01
MTSTSITTFSIYSQSQPKFLNLLQHPLIHTRTKRTSISFQPPIVRATLFSTFTSSHTPSTPSSNFPSGRALSKFLSEKVAFFLIGSFLLSGCFSKRSAFAEAAPSVGSGAVLEQNMNPTEEKNEEEKSEEEVEEMWESILEKDPKNVEALKVVLYGKIRKGKSKEAVKFVEDLIAAEPNEVEWRLLLALCYETMGQLSKAKKLFREILKKRPLLVRALHCVGIIICTISAEKGLAMAMHKNHEGPAVFEMLNNAQELASRENRVTEERNIRILIAQMHVVQGNLEEGLKRFQELIDQNPRDFRPYICQGIIYSLLGKNEEAAQQFETYQTLVPEEFPQRGFLDDVAIAAKRTSLEQFKKEFRDQFSYRK

SEQ ID NO: 157651 - protein, 157 aa, Glycine max
  Coding DNA Sequence Number=SeqID_40873
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1SQS9; Match level="QueryCoverage=98%, HitCoverage=38%, E-value=1e-57, Identity=60%"; Hit description =Glycoside hydrolase, family 17
  Pfam annotation: Domain name=X8; Domain location=60-125; Score=49.3; E_value=1.3e-11; Accession=PF07983.3; Description=X8 domain
MAHKKGTPLHPGAMDIYLFSLTDENLKSIEPGNFERHWEIFRYDGRPKFPIDFSGQGQDKWPVAAKGVVYQERFGCSCEKLDLAGNASFAFNQYFQTRDQSVEACDFNGMATIVKQDPSKGSCLFPIEIQSSGEMLRAMCTIGSLFIGLPLFFITFT

SEQ ID NO: 157652 - protein, 42 aa, Glycine max
  Coding DNA Sequence Number=SeqID_40874
MIVVITTVDGSHVDGDNDGYNDDHRDDGAAITVVDLMYADHH

SEQ ID NO: 157653 - protein, 405 aa, Glycine max
  Coding DNA Sequence Number=SeqID_40875
  Gene Ontology: Mol. function=protein binding; Cellular component =membrane; Biological process=defense response
  Homolog annotation: Hit_ID=Q2L359; Match level="QueryCoverage=97%, HitCoverage=39%, E-value=7e-74, Identity=39%"; Hit description =Putative CC-NBS-LRR resistance protein
  Pfam annotation: Domain name=NACHT; Domain location=197-360; Score= -26.9; E_value=0.0072; Accession=PF05729.3; Description=NACHT domain
  Pfam annotation: Domain name=NB-ARC; Domain location=150-405; Score =43.1; E_value=4.9e-13; Accession=PF00931.13; Description=NB-ARC domain
  Pfam module annotation: Pfam domain module=NACHT::NB-ARC; Domain location=197-360::150-405
MADFFVFDIAETLLEKLASYVSEEASRAYDVYEDLQGIKDTLSIVKGVLLDAEEKKEQKHGLREWLRQIQNVCFDAEDVLDGFECHNLRKQVVKASGSTGMKVGHFFSSSNSLVFRLRMARQIKHVRCRLDKIAADGNKFGLERISVDHRLVQRREMTYSHIDASGVMGRDNDREEIIKLLMQPHPHGDGDGDKSVCVIPIVGIGGLGKTTLARLVFNDKRMDELFQLKMWVCVSDDFDIRQIIIKIINCASASTSAPSIALAHHESINNLDIEQLQSQLRHKLSGLTYLLVLDDIWNDDRAKWIELNDLIKVGAVGSKILVTTRSDSIASMVGTVPSYVLEGLSVENCLSLFVKWAFKEGEEKKYPNLVDIGKEMVKKCQGVPLAVRTLGSSLFLNFDLERWEF

SEQ ID NO: 157654 - protein, 212 aa, Glycine max
  Coding DNA Sequence Number=SeqID_40876
  Gene Ontology: Mol. function=magnesium chelatase activity; Biological process=chlorophyll biosynthetic process
  Homolog annotation: Hit_ID=O65808; Match level="QueryCoverage=98%, HitCoverage=16%, E-value=5e-51, Identity=52%"; Hit description =Magnesium chelatase subunit
MNQQSKRKHALEQAQALGIKVQEAETRVFSNTSDPTPQTLTWLWRILHGMMRISSRTHILTESLLDFDYHAPVDVTFQNPDSSEISLTDVSHYLDSDPSNLVQNPRKDGKKHSPYIADTTTANAQVCTLAQTVRFDARTMLLNRKWYEEACCLVDMRVLTRLRREQIQWRCSATLGQVDKWVYEEANTNFIHDMQMLNKPINTNPNFFRKLV

SEQ ID NO: 157655 - protein, 342 aa, Glycine max
  Coding DNA Sequence Number=SeqID_40877
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=89%, HitCoverage=19%, E-value=1e-121, Identity=64%"; Hit description =Chromo
  Pfam annotation: Domain name=rve; Domain location=102-258; Score =95.1; E_value=2.1e-25; Accession=PF00665.16; Description=Integrase core domain
  Pfam annotation: Domain name=zf-H2C2; Domain location=43-84; Score =13.8; E_value=0.0052; Accession=PF09337.1; Description=His(2)-Cys(2) zinc finger
  Pfam module annotation: Pfam domain module=rve::zf-H2C2; Domain location=102-258::43-84
MEDYRSSNEASHYAVRQGLLYWKDRLVIPVEEEMVQRILQEYHSSPIGGHAGITRTLARLKAQFYWPKMQEHVKEYVQNCVICQQAKVSNTLPSGLLQPLPIPQQVWENVAMDFITGLPSVNGFSVIMVVVDRLTKYAHFLPLKADYSSKSVAETFMNNIVKLHGIPKSIVSDRDRVFTSSFWQNLFKLQGTTLAMSSAYHPQTDGQSEILNKCLEMYLRCFTYENPKGWVKALPWSEFWYNTAFHTSLGLTPFKALYGREPPTLTRQPCTTLDPVELREQLINRDNLLAKLKNNLARAQQVMKTQADKKRQEVSMKGGTKKEKEWNTCSMTLFLVPCTRLI

SEQ ID NO: 157656 - protein, 92 aa, Glycine max
  Coding DNA Sequence Number=SeqID_40878
  Gene Ontology: Mol. function=protein binding; Biological process =defense response
  Homolog annotation: Hit_ID=Q1T4B1; Match level="QueryCoverage=94%, HitCoverage=9%, E-value=4e-12, Identity=38%"; Hit description =Disease resistance protein
MAEYFLFDIAESLLGKLASYVYDEASRAYDLCEDVQGIKDTLSIVKGVLLDAEEKKEQKHGLREWLRQIQNVCLDAEDVLDGFECHNLTSHF

SEQ ID NO: 157657 - protein, 881 aa, Glycine max
  Coding DNA Sequence Number=SeqID_40879
  Gene Ontology: Mol. function=protein binding; Cellular component =membrane; Biological process=defense response
  Homolog annotation: Hit_ID=Q7G752; Match level="QueryCoverage=90%, HitCoverage=99%, E-value=1e-122, Identity=34%"; Hit description =Putative NBS-LRR type resistance protein
  Pfam annotation: Domain name=LRR_1; Domain location=586-607; Score =12.4; E_value=1.4; Accession=PF00560.23; Description=Leucine Rich Repeat
  Pfam annotation: Domain name=LRR_1; Domain location=609-631; Score =12.0; E_value=1.6; Accession=PF00560.23; Description=Leucine Rich Repeat
  Pfam annotation: Domain name=LRR_1; Domain location=633-655; Score =14.9; E_value=0.29; Accession=PF00560.23; Description=Leucine Rich Repeat
  Pfam annotation: Domain name=LRR_1; Domain location=680-701; Score =1.9; E_value=1.2e+02; Accession=PF00560.23; Description=Leucine Rich Repeat
  Pfam annotation: Domain name=LRR_1; Domain location=703-726; Score =11.2; E_value=2.3; Accession=PF00560.23; Description=Leucine Rich Repeat
  Pfam annotation: Domain name=LRR_1; Domain location=733-755; Score =0.8; E_value=2e+02; Accession=PF00560.23; Description=Leucine Rich Repeat
  Pfam annotation: Domain name=LRR_1; Domain location=776-798; Score =0.1; E_value=2.7e+02; Accession=PF00560.23; Description=Leucine Rich Repeat
  Pfam annotation: Domain name=LRR_1; Domain location=800-822; Score =3.6; E_value=60; Accession=PF00560.23; Description=Leucine Rich Repeat
  Pfam annotation: Domain name=LRR_1; Domain location=824-851; Score =2.7; E_value=90; Accession=PF00560.23; Description=Leucine Rich Repeat
  Pfam annotation: Domain name=NACHT; Domain location=197-360; Score= -25.8; E_value=0.0059; Accession=PF05729.3; Description=NACHT domain
  Pfam annotation: Domain name=NB-ARC; Domain location=150-472; Score =207.3; E_value=3.7e-59; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::NACHT::NB-ARC; Domain location= 586-607::609-631::633-655::680-701::703-726::733-755::776-798::800 -822::824-851::197-360::150-472
MAESFVFHIAESLLQKLASYVSEEASRAYDVYEDLQVIKGTLSIVKGVLLDAEEKKEQKHGLREWLMQIQNVCFDAEDVLDGFECQNLRKQVVKASGSTRMKVGHFFSSSNSLVFRLSMARQIKHVRCRLDKIAADGNKFGLERISVDHRLVQRREMTYSHIDASGVIGRDNDREEIIKLLMQPHPHGDGDGDKSVCVIPIVGLGGMGKTTLAKLVFNDKRIDELFQLKMWVCVSDDFDIRQIIIKIINCASASTSAPSIALAHHESINNLDIEQLQSQLRHKLSGLTYLLVLDDIWNDDRAKWIELNDLIKVGAVGSKILVTTRSDSIASMVGTVPSYVLEGLSVENCLSLFVKWAFKEGEEKKYPNLVDIGKEMVKKCQGVPLAVRTLGSSLFLNFDLERWEFVRDHEIWNLNQKKDDILPALKLSYDQMPSYLRQCFAYFSLFPKDFGHIGSHFVSLWGSFGLLRSPSGSQKVENIARQYIAELHSRSFLEDFVDFGHVYYFKVHDLVHDLASYVAKEEFLVVDSRTRNIPKQVRHLSVVENDSLSHALFPKSRSVRTIYFPMFGVGLDSEALMDTWIARYKYLRVLHLSDSSFETLPNSIAKLEHLRALNLANNCKIKRLPHSICKLQNLQVLSLRGCMELQTLPKGLGMLMSLRKFYITTKQSILSEDEFARLRNLHTLSFEYCDNLKFLFKVAQVSSLEVLIVQSCGSLESLPLHILPKLESLFVKRCERLNLSFNSESPIQKLRMKLLHLEHFPRQQILPQWIEGATNTLQTLFIVNFHSLEMLPEWLTTMTHVKMLHIVNCPRLLYFPSDMNRLSALEDLDIDGCPELCRKCQPLSGEYWSSIAHIKRVSFGEKKEGKLLFQTQTWIRLGLRD

SEQ ID NO: 157658 - protein, 384 aa, Glycine max
  Coding DNA Sequence Number=SeqID_40880
  Gene Ontology: Mol. function=protein binding; Cellular component =membrane; Biological process=defense response
  Homolog annotation: Hit_ID=Q2QR01; Match level="QueryCoverage=87%, HitCoverage=39%, E-value=2e-37, Identity=31%"; Hit description=NB -ARC domain containing protein, expressed
  Pfam annotation: Domain name=LRR_1; Domain location=113-135; Score =8.2; E_value=8.2; Accession=PF00560.23; Description=Leucine Rich Repeat
  Pfam annotation: Domain name=LRR_1; Domain location=137-159; Score =14.4; E_value=0.42; Accession=PF00560.23; Description=Leucine Rich Repeat
  Pfam annotation: Domain name=LRR_1; Domain location=184-203; Score =2.6; E_value=94; Accession=PF00560.23; Description=Leucine Rich Repeat
  Pfam annotation: Domain name=LRR_1; Domain location=207-230; Score =11.4; E_value=2.1; Accession=PF00560.23; Description=Leucine Rich Repeat
  Pfam annotation: Domain name=LRR_1; Domain location=237-259; Score =0.5; E_value=2.3e+02; Accession=PF00560.23; Description=Leucine Rich Repeat
  Pfam annotation: Domain name=LRR_1; Domain location=280-302; Score =7.8; E_value=9.8; Accession=PF00560.23; Description=Leucine Rich Repeat
  Pfam annotation: Domain name=LRR_1; Domain location=304-326; Score =10.6; E_value=2.9; Accession=PF00560.23; Description=Leucine Rich Repeat
  Pfam annotation: Domain name=LRR_1; Domain location=328-354; Score =2.2; E_value=1.1e+02; Accession=PF00560.23; Description=Leucine Rich Repeat
  Pfam annotation: Domain name=LRR_1; Domain location=90-111; Score =13.5; E_value=0.77; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=113-135::137 -159::184-203::207-230::237-259::280-302::304-326::328-354::90-111
MDFGNLYFFKIHDLVHDLALYVAKGELLVVNSHTHNIPEQVRHLSIVEIDSFSHALFPKSRRVRTILFPVDGVGVDSEALLDTWIARYKCLRVLDLSDSTFETLPDSISKLEHLRALHVTNNCKIKRLPHSVCKLQNLQFLSLRGCMELETLPKGLGMLISLEQLYITTKQSILSEDEFASLRNLQYLSFEYCDNLKFLFRGVQIPSLEVLLIQSCGRLESLPLHFLPKLEVLFVIQCEMLNLSLNNESPIQRLRLKLLYLEHFPRQQALPHWIQGAADTLQTLSILNCHSLKMLPEWLTTMTRLKTLHIVNCPQLLSLPSDMHHLTALEVLIIDGCPELCRKCQPQSGVCWSFIAHIKCVCIGETKGKLHSQMLSRLRLRLRD

SEQ ID NO: 157659 - protein, 365 aa, Glycine max
  Coding DNA Sequence Number=SeqID_40881
  Gene Ontology: Mol. function=hydrolase activity; Cellular component =cytosol
  Homolog annotation: Hit_ID=UPI00006DBC1C; Match level="QueryCoverage =68%, HitCoverage=56%, E-value=2e-50, Identity=41%"; Hit description =COG0402: Cytosine deaminase and related metal-dependent hydrolases
  Pfam annotation: Domain name=DUF606; Domain location=243-365; Score =44.6; E_value=3.4e-10; Accession=PF04657.4; Description=Protein of unknown function, DUF606
MAQLEPELWAEARRLGLPIVTEFFGAEMASELKSLHQQGLLGPDNIFNHCTALPDEGWEILREAGVRVNVCPRSDSHYGIESGMFAIEAAQRHGINPGLSVDNETSYSTDMFMEMRVAFYLQRVMGMHKQHCCDSGHSLTTLPAAQLLKSATVDGATCAGLQDKVGSLTPGKQADLILINAADLNLYPNGNAFGTVVHATERSNIDTVMIGGRIVKQNGKVLGVDSERLRAAIDESREHLFAAAGYEPDIFAEKFLPLTTLNSQLAKGLGGDPVTAAFFSFTAGALSLGIYSLLRGGLFSSLAAIPSQPAWSLAGGLIGACALFSYVVLAPKIGFSALLGLAIVGQLLSSQMIDHFGLLGAVRRP

SEQ ID NO: 157660 - protein, 62 aa, Glycine max
  Coding DNA Sequence Number=SeqID_40882
MAEESEGPIEEREIIPVWLSVVPNTSPRRPAVPKKLTSFPGRSLATLFRPHPHAVPETGDTT

SEQ ID NO: 157661 - protein, 123 aa, Glycine max; identical to SEQ ID NO: 121971
  Coding DNA Sequence Number=SeqID_40883

SEQ ID NO: 157662 - protein, 403 aa, Glycine max
  Coding DNA Sequence Number=SeqID_40884
  Gene Ontology: Mol. function=protein binding; Cellular component =membrane; Biological process=defense response
  Homolog annotation: Hit_ID=Q2L360; Match level="QueryCoverage=99%, HitCoverage=54%, E-value=1e-76, Identity=39%"; Hit description =Putative CC-NBS-LRR resistance protein
  Pfam annotation: Domain name=NACHT; Domain location=197-358; Score= -32.4; E_value=0.019; Accession=PF05729.3; Description=NACHT domain
  Pfam annotation: Domain name=NB-ARC; Domain location=150-403; Score =78.8; E_value=1.7e-20; Accession=PF00931.13; Description=NB-ARC domain
  Pfam module annotation: Pfam domain module=NACHT::NB-ARC; Domain location=197-358::150-403
MAESFVFDIAESLLGKLASYAYEEASRAYGVYEDLKGIKDTLSIVKGVLLDAEEKKEHKHGLREWLRQIQNVCFDAEDVLDEFECQGSQKQVVKASGSVRVKVGHFFSSSNSLVFRLRMAHQIKDVRERLDKIAADGNKFGLEKIEVDLRLVQRREMTYSHVDASDVIGRETDKEEIIKLLMQPHPDGDGYGDRSLCVIPIVGIGGLGKTTLAKLVFNDKRMDELFQLKMWVCISDEFDIRQIIIKIINSASASAPNIALAYQENINSLDIEQLQTRLRHKLSLQKFLLVLDDIWNDDYTKWIDLKNLIKVGAVGSKIIVTTRSNSIASMMGTIPSYVLEGLSPENCISLFVRWAFKEGQEKEYPNLMEIGKEIVKKCKGVPLAVRSLGSSLFSTSDLDKWEF

SEQ ID NO: 157663 - protein, 79 aa, Glycine max
  Coding DNA Sequence Number=SeqID_40885
  Gene Ontology: Mol. function=protein serine/threonine kinase activity; Biological process=protein amino acid phosphorylation
  Homolog annotation: Hit_ID=Q9LKZ5; Match level="QueryCoverage=97%, HitCoverage=7%, E-value=7e-19, Identity=73%"; Hit description =Receptor-like protein kinase 2
MCVFNCLKEHNIIGKGGADILYKGVILNRDQVAMKRLLALSKGSFLIMALMQRFRLWEGFNMDTLLERRVSVQTGREIS

SEQ ID NO: 157664 - protein, 99 aa, Glycine max
  Coding DNA Sequence Number=SeqID_40886
MGTQKSNMFDAPFKYMVPEDKEIPDRPLPSHWTPSMQAYNTSGSTPTPFLNQQAAGSHMPLYMWVNQVNNTLLQSDALHDPRMLSSKPTVAGVILNLSS

SEQ ID NO: 157665 - protein, 331 aa, Glycine max
  Coding DNA Sequence Number=SeqID_40887
  Gene Ontology: Mol. function=protein binding; Cellular component =membrane; Biological process=defense response
  Homolog annotation: Hit_ID=Q2QR01; Match level="QueryCoverage=83%, HitCoverage=35%, E-value=1e-30, Identity=32%"; Hit description=NB -ARC domain containing protein, expressed
  Pfam annotation: Domain name=LRR_1; Domain location=109-131; Score =9.0; E_value=5.9; Accession=PF00560.23; Description=Leucine Rich Repeat
  Pfam annotation: Domain name=LRR_1; Domain location=12-35; Score=0.1; E_value=2.7e+02; Accession=PF00560.23; Description=Leucine Rich Repeat
  Pfam annotation: Domain name=LRR_1; Domain location=156-180; Score =6.5; E_value=18; Accession=PF00560.23; Description=Leucine Rich Repeat
  Pfam annotation: Domain name=LRR_1; Domain location=182-205; Score =6.8; E_value=15; Accession=PF00560.23; Description=Leucine Rich Repeat
  Pfam annotation: Domain name=LRR_1; Domain location=255-277; Score =2.4; E_value=99; Accession=PF00560.23; Description=Leucine Rich Repeat
  Pfam annotation: Domain name=LRR_1; Domain location=279-304; Score =1.4; E_value=1.6e+02; Accession=PF00560.23; Description=Leucine Rich Repeat
  Pfam annotation: Domain name=LRR_1; Domain location=62-83; Score =14.3; E_value=0.45; Accession=PF00560.23; Description=Leucine Rich Repeat
  Pfam annotation: Domain name=LRR_1; Domain location=85-107; Score =14.9; E_value=0.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=109-131::12-35::156 -180::182-205::255-277::279-304::62-83::85-107
MVDACTRNIPEHVRHISIVENGLPDHAVFPKSRSLRTITFPIEGVGLASEIILKTWVSRYRYLRVLDLSDSSFETLPNSIAKLGHLRVLDLSNNGKIKRLPNSICKLQNLQVFSVSGCMELKALPKGIGMLINLRELKITTKQSSLSQDEFANLSNLQTLSFEYCVNLKFLLEKAQLTQLSSLQILVVRSCGSLMSLPLYILPKLDALFVADCGMINLFLGDESPIKRWRMKFLHVENFPWLQVLPEWIEGAADTLQTLMIYNLPKLKFLPECLPRMTHLKRLHVAECPSLLFHPSHIHCLTTLEDLSVDGCPAWDWEYMASRSLPDNTMK

SEQ ID NO: 157666 - protein, 732 aa, Glycine max
  Coding DNA Sequence Number=SeqID_40888
  Gene Ontology: Mol. function=metalloendopeptidase activity; Cellular component=extracellular space; Biological process=proteolysis
  Homolog annotation: Hit_ID=Q0WVU4; Match level="QueryCoverage=96%, HitCoverage=67%, E-value=0.0, Identity=64%"; Hit description =Putative zinc protease
  Pfam annotation: Domain name=Peptidase_M16_C; Domain location=394 -582; Score=24.6; E_value=0.00023; Accession=PF05193.11; Description =Peptidase M16 inactive domain
MIQKSWIKKMMMIDDSYLGNLYWIFVGWATRLYAGESDWSLDFSFFKVVIDLTDAGHEHIQDIIGLLFKYIELLQRSGVCKWIFEELSAVCETKFHYQDKIRPSDYVVDIASNMQFYPVKGWLTGSSLPSKFSPSVIQMVLDQLSPDNVRIFWESKKFEGLTDKVEPWYGTAYSLEKITGSAIQGWVLSAPDENMHLPAPNKFIPTDLSLKVVQEKEKFPVLLSRSTYSALWYKPDTLFSTPKAYVKIDFNCPYSGNSPEAKVLTHIFTELLMDYLNEYVAKYKSKEFLLNFSFSAYYAQVAGLYYSISHTDGGFEVTLRGYNHKLRILLETIVEKIATFEVKTDRFSVIKEMVTKEYQNFKYQQPYQQAMYYCSLILQDQTWPWIEQLDVLPALQVEDLAKFVPAMLSRTFLEFYIAGNIESHEAPSMVKHIEDVLFNCSKPLCKPLFSSQHLANRVVKLESGMNYFYPSECLNPENENSALVHYIQVGRDDFKLNVKLQLFALVAKQPTFHQLRSVEQLGYITVLMQRNYCGIHGLQFIIQSTVKSPGNIEQRVEAFLQMFETKLLEMTVDEFKICLTYSLCCVSFELNSHWKKYKHRFNMNNKGYLHVHLMGMCTNVKLEKHKNLWEESSFFWQEINYGTLRFDRKDYEIEALRQLTLQELIDFFNEYVKVGAPRKKTLSVRVHGNRHSSEYKAEVSEPHLAKIDNICTFRRSQSLYGSFKGLSGQMKL

SEQ ID NO: 157667 - protein, 183 aa, Glycine max
  Coding DNA Sequence Number=SeqID_40889
  Gene Ontology: Mol. function=metalloendopeptidase activity; Cellular component=extracellular space; Biological process=proteolysis
  Homolog annotation: Hit_ID=Q93YG9; Match level="QueryCoverage=98%, HitCoverage=15%, E-value=2e-57, Identity=66%"; Hit description =Insulin degrading enzyme
  Pfam annotation: Domain name=Peptidase_M16; Domain location=30-183; Score=45.9; E_value=1.3e-10; Accession=PF00675.10; Description =Insulinase (Peptidase family M16)
MAVGKEDVEIVKARIDKRDYRRVVLRNSLQVLLISDPDTDKCAASMDVGVGYFSDPAGLEGLAHFLGIFALSDFDSLLSRIGFDMFRIFVVEHMLFYASEKYPVEDSYSKYITEKSETLKGEDGGETHGGSTNAFTSSEHTNYFFDVNTDGFEEALDRFAQFFNKPLMSADATMREIKAVDSG

SEQ ID NO: 157668 - protein, 407 aa, Glycine max
  Coding DNA Sequence Number=SeqID_40890
  Gene Ontology: Mol. function=protein binding; Cellular component =membrane; Biological process=defense response
  Homolog annotation: Hit_ID=Q2L360; Match level="QueryCoverage=95%, HitCoverage=54%, E-value=3e-78, Identity=42%"; Hit description =Putative CC-NBS-LRR resistance protein
  Pfam annotation: Domain name=NACHT; Domain location=194-349; Score= -24.6; E_value=0.0047; Accession=PF05729.3; Description=NACHT domain
  Pfam annotation: Domain name=NB-ARC; Domain location=150-406; Score =95.5; E_value=1.6e-25; Accession=PF00931.13; Description=NB-ARC domain
  Pfam module annotation: Pfam domain module=NACHT::NB-ARC; Domain location=194-349::150-406
MTELVLFSIAESLIAKLASQAYEETSQVLGLYHHLQEFTQTLSLVKAVLLDAEEKQQQNYELQEWLRQVKHVFSDAENVLDEFECETLRKEVVQAHGSATTKVAHFFSTSNPLVFRYRLAQHIKKIKKRLDKVAADRHKFGLETTDIDRRVVHRRDMTYSYVVDSDVIGRNHDKENIIRLLVQQNPNNNDKSLSVISIVGIPGLGKTTLAKIVFNDRRIHELFQLKMWVCVSNDFNIKQVVIKILNSNKDSAHQQNLDMVDMEQLQSQLRNKLASKKFLLVLDDVWNEDLVKWVELRDLIQVDATGSKILVTTRSHVTASMMGTVPSYILEGLSLEDSLSLFVKWAFKEEEKRNSYLVNIGKEIVKKCNGVPLAVRTLGSLLFSKDNREEWEFVRDNEIWNSMKSES

SEQ ID NO: 157669 - protein, 185 aa, Glycine max
  Coding DNA Sequence Number=SeqID_40891
  Homolog annotation: Hit_ID=Q8H0W7; Match level="QueryCoverage=36%, HitCoverage=48%, E-value=2e-24, Identity=79%"; Hit description =Expressed protein
  Pfam annotation: Domain name=Auxin_repressed; Domain location=7-113; Score=125.9; E_value=1.1e-34; Accession=PF05564.3; Description =Dormancyauxin associated protein
MGLLDHLWDDTVAGPRPENGLGKLRKHHTFAFRSASGKESDSGSVKSYGEDLPEDAVRVTRSIMIVKPPGGNQSPSGSAPASPAGSTPPVSPFSGRAHSVLMHIQVLKVSASDITLRVLLESFMTSYLKQKQLDIEVEVSIEDAVDEVIYELESPSVFGEGRHQMRTRRQARTDQALLLLSMCDK

SEQ ID NO: 157670 - protein, 47 aa, Glycine max
  Coding DNA Sequence Number=SeqID_40892
KVKAENREREEYLDLRRKSTAECEETRGGEVRCGRKLGFGFGSHFIR

SEQ ID NO: 157671 - protein, 67 aa, Glycine max
  Coding DNA Sequence Number=SeqID_40893
MCASQRASKPVRRKEADWWDPPNWRCGMNRKLGYGAQLRANLDPTKGVGRLRQQDGGHGSRNPLRSV

SEQ ID NO: 157672 - protein, 89 aa, Glycine max
  Coding DNA Sequence Number=SeqID_40894
  Subcellular localization annotation: CTP_CleavageSite=53; ConfidenceScore=5.71e-01
MPGADHKQPNHKGGETSSSTESNGGSQNVRLSIPILPNSSSSLVSMTYSPSFNSSQLVAQRKLFAESQIGRTSFQRLLEPNSGSWNCSL

SEQ ID NO: 157673 - protein, 204 aa, Glycine max
  Coding DNA Sequence Number=SeqID_40895
  Gene Ontology: Mol. function=protein binding; Cellular component =membrane; Biological process=defense response
  Homolog annotation: Hit_ID=Q6PW75; Match level="QueryCoverage=80%, HitCoverage=49%, E-value=6e-18, Identity=33%"; Hit description=Rust resistance protein rp3-1
  Pfam annotation: Domain name=LRR_1; Domain location=116-138; Score =11.2; E_value=2.3; Accession=PF00560.23; Description=Leucine Rich Repeat
  Pfam annotation: Domain name=LRR_1; Domain location=140-162; Score =3.3; E_value=70; Accession=PF00560.23; Description=Leucine Rich Repeat
  Pfam annotation: Domain name=LRR_1; Domain location=18-40; Score=5.3; E_value=29; Accession=PF00560.23; Description=Leucine Rich Repeat
  Pfam annotation: Domain name=LRR_1; Domain location=41-63; Score=8.9; E_value=6.3; Accession=PF00560.23; Description=Leucine Rich Repeat
  Pfam module annotation: Pfam domain module=LRR_1::LRR_1::LRR_1::LRR _1; Domain location=116-138::140-162::18-40::41-63
ITTKLRVLPEDEIANLSSLRILRIEFCNNVESLFEGIKLPTLKVLCIANCQSLKSLPLDIEHFPELETLLVDNCDVLEFSKEHNNQNSNLRLKIVNFISLPQLVTLPHWLQGSKDTLQYLLISSCNNLVGLPEWLSAMTCLKTLCVTSCPNMLSLPDGIHRLTTLERLEIDGYPESLQHLTIDEPEEVKEENGAGNSDRTPPTR

SEQ ID NO: 157674 - protein, 143 aa, Glycine max
  Coding DNA Sequence Number=SeqID_40896
  Homolog annotation: Hit_ID=Q1SRN1; Match level="QueryCoverage=59%, HitCoverage=6%, E-value=2e-07, Identity=31%"; Hit description =Integrase, catalytic region
MDPISIKLDDDNYSAWKAEALGKIKESSLEKFITMKDFGGQPPMLSEEYKSWIEQDQVLYTWLLDSLHPKLLHRIERCECALEFWKVIEVETLVLEGRPRPLLPLSLDWGACSGNRKVPHHLRVEVTADNTLDTGTLMMYVNL

SEQ ID NO: 157675 - protein, 63 aa, Glycine max
  Coding DNA Sequence Number=SeqID_40897
LEIEEIRQQYKRNLEETAMVQLMRMNLDAECPETSNEDMAIEEELGPESAAADILLSLKPGTS

SEQ ID NO: 157676 - protein, 100 aa, Glycine max
  Coding DNA Sequence Number=SeqID_40898
  Gene Ontology: Mol. function=hydrolase activity, acting on glycosyl bonds; Biological process=carbohydrate metabolic process
  Homolog annotation: Hit_ID=Q944B5; Match level="QueryCoverage=67%, HitCoverage=17%, E-value=3e-12, Identity=61%"; Hit description =Dehiscence-related endopolygalaturonase
MPCKTQLMEKSAIQIKNVMYQNITGTSTSDIAVKLACSENFPCQEIEEMLPMLYVTMLNCLTWETLTLVANHKERSQRHLLLPPYGKKDTFMCMGPTCDI

SEQ ID NO: 157677 - protein, 116 aa, Glycine max
  Coding DNA Sequence Number=SeqID_40899
  Gene Ontology: Cellular component=nucleus; Biological process =regulation of progression through cell cycle
  Homolog annotation: Hit_ID=Q6YXW5; Match level="QueryCoverage=63%, HitCoverage=6%, E-value=1e-09, Identity=56%"; Hit description=Cyclin- like protein
  Subcellular localization annotation: CTP_CleavageSite=50; ConfidenceScore=5.13e-01
MSKVSGVISRQVLPACGLVALFVYSALSSGQGQDNLSRGIRSSLLTFFPRNQVEVPNDRSIGKLCDYTARNPLCIPKNYPISKKIHQLQLLTENSRIFFLSKCIKCLQKEQKYATH

SEQ ID NO: 157678 - protein, 51 aa, Glycine max
  Coding DNA Sequence Number=SeqID_40900
  Homolog annotation: Hit_ID=Q9M442; Match level="QueryCoverage=97%, HitCoverage=17%, E-value=3e-12, Identity=91%"; Hit description =Putative imbibition protein
MSQSGYMNSPRKSELYASDEIWMVWEAGWRGMTMVLDTYMQCIHCRQSYEQ

SEQ ID NO: 157679 - protein, 190 aa, Glycine max
  Coding DNA Sequence Number=SeqID_40901
MGGIGVGVGETFLDLKEKGKGCENLVSGKKRNFPSATRYVEVCGSHGGGGCLGDGTMMGLVGCKGGVGWLQWWCLGAAMVFGDWVEVRCGGHGVLGERKLGRRKKRKRRATAIVGSTSVSSETSHTDGPNQLYTHIHDAAVGCEQIKAIVDDFHFGELRQSKSGWAKNVWLERSEHCLSRLLRGKTEREE

SEQ ID NO: 157680 - protein, 292 aa, Glycine max
  Coding DNA Sequence Number=SeqID_40902
  Gene Ontology: Mol. function=nucleic acid binding; Cellular component= intracellular
  Homolog annotation: Hit_ID=Q5NDD4; Match level="QueryCoverage=99%, HitCoverage=100%, E-value=1e-115, Identity=67%"; Hit description =Putative zinc finger protein
  Pfam annotation: Domain name=zf-AN1; Domain location=105-145; Score =8.1; E_value=0.0073; Accession=PF01428.7; Description=AN1-like Zinc finger
  Pfam annotation: Domain name=zf-AN1; Domain location=16-55; Score =17.4; E_value=0.0005; Accession=PF01428.7; Description=AN1-like Zinc finger
  Pfam annotation: Domain name=zf-C2H2; Domain location=227-250; Score =8.8; E_value=1.2; Accession=PF00096.16; Description=Zinc finger, C2H2 type
  Pfam annotation: Domain name=zf-C2H2; Domain location=263-286; Score =15.7; E_value=0.17; Accession=PF00096.16; Description=Zinc finger, C2H2 type
  Pfam module annotation: Pfam domain module=zf-AN1::zf-AN1::zf -C2H2::zf-C2H2; Domain location=105-145::16-55::227-250::263-286
MGTPEFPHLGKHCSVSYCKQLDFLPFTCDRCNQVYCLLHRGYIKHKCTKANKQDVTVAICPLCAKGVRLIPDQDPNITWDNHVNVDCDPSNYEKVTEKRKCPAPGCKEVLVFSNTIKCRDCLKDHCLKHRFGPDHKCSGPQKLETSFSFMGLLNRSRKEGPKPNLASTTSSKWSSSFLNVASNIRASAETGMSKLSDEINQVWQAATTRDGMGQSSGSGNRNDHQVEQCPQCRSKFSSVTALVDHVQQVHERNGNRLGVKKIDACPKCSKGFLDPVSLVEHVERDHGGGSGA

SEQ ID NO: 157681 - protein, 101 aa, Glycine max
  Coding DNA Sequence Number=SeqID_40903
MGSEMQPFVETPPKVVEPNRYSHRSIETLVVVIAVITIVGVIAGMIARLCGGRHFGGNGENDIEGWVEKKCRSCIDGGLPPPPPPPEEPKPAPAPEGDASK

SEQ ID NO: 157682 - protein, 478 aa, Glycine max
  Coding DNA Sequence Number=SeqID_40904
  Gene Ontology: Mol. function=hydrolase activity, acting on glycosyl bonds; Cellular component=amyloplast; Biological process =carbohydrate metabolic process
  Homolog annotation: Hit_ID=Q944B5; Match level="QueryCoverage=92%, HitCoverage=99%, E-value=1e-159, Identity=65%"; Hit description =Dehiscence-related endopolygalaturonase
  Pfam annotation: Domain name=Glyco_hydro_28; Domain location=99-442; Score=512.1; E_value=6.4e-151; Accession=PF00295.8; Description =Glycosyl hydrolases family 28
MALLKHLLLSFTMIIISFVACYSTLQEDPPSSIYVDHSPSIDDGGTVKNLIEQSTNVLSLNRFDKRNSLKKVSVNDYGAKGNGDTDDTEAFKKAWDVVCSSGEAILVVPQANYLLKPIRFSGPCEPNVEVQISGTLDASDDPSDYEDDSKHWLVFDNIKKLFVYGGGTIDGNGNIWWKNSCKRNKKRPCKDAPTALTFYNCEDLTVENLRIENAQQIHVSFQDSVNVQVSGLNVTAPEDSPNTDGIHVTNTQNIQISSSVIGTGDDCISIVHGSKDVEATDITCGPGHGISIGSLGAGKSKEFVSGIRVNRAKIFGTKNGVRIKTWQGGSGSASDIQFQNIEMDNVTNPIIINQNYCDKKKKPCKKLLSKKSAIQIKNVLYQNITGTSASDIAVRFDCSDKFPCQEIVLQNIDLQCEGGDDADAMCNNVELSYLGHVRPRCNSKKRKAFTTITSILKYFSCWKQGWLGGEELEGKRRC

SEQ ID NO: 157683 - protein, 887 aa, Glycine max
  Coding DNA Sequence Number=SeqID_40905
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=99%, HitCoverage=99%, E-value=0.0, Identity=71%"; Hit description =Putative receptor-like protein kinase
  Pfam annotation: Domain name=LRRNT_2; Domain location=24-60; Score =9.9; E_value=0.079; Accession=PF08263.3; Description=Leucine rich repeat N-terminal domain
  Pfam annotation: Domain name=LRR_1; Domain location=111-133; Score =19.5; E_value=0.012; Accession=PF00560.23; Description=Leucine Rich Repeat
  Pfam annotation: Domain name=LRR_1; Domain location=135-157; Score =18.3; E_value=0.027; Accession=PF00560.23; Description=Leucine Rich Repeat
  Pfam annotation: Domain name=LRR_1; Domain location=159-181; Score =9.7; E_value=4.3; Accession=PF00560.23; Description=Leucine Rich Repeat
  Pfam annotation: Domain name=LRR_1; Domain location=183-205; Score =2.0; E_value=1.2e+02; Accession=PF00560.23; Description=Leucine Rich Repeat
  Pfam annotation: Domain name=LRR_1; Domain location=207-229; Score =12.1; E_value=1.5; Accession=PF00560.23; Description=Leucine Rich Repeat
  Pfam annotation: Domain name=LRR_1; Domain location=231-253; Score =14.9; E_value=0.29; Accession=PF00560.23; Description=Leucine Rich Repeat
  Pfam annotation: Domain name=LRR_1; Domain location=255-277; Score =11.1; E_value=2.4; Accession=PF00560.23; Description=Leucine Rich Repeat
  Pfam annotation: Domain name=LRR_1; Domain location=279-301; Score =7.4; E_value=12; Accession=PF00560.23; Description=Leucine Rich Repeat
  Pfam annotation: Domain name=LRR_1; Domain location=303-325; Score =17.0; E_value=0.069; Accession=PF00560.23; Description=Leucine Rich Repeat
  Pfam annotation: Domain name=LRR_1; Domain location=327-349; Score =15.3; E_value=0.23; Accession=PF00560.23; Description=Leucine Rich Repeat
  Pfam annotation: Domain name=LRR_1; Domain location=351-373; Score =14.1; E_value=0.5; Accession=PF00560.23; Description=Leucine Rich Repeat
  Pfam annotation: Domain name=LRR_1; Domain location=375-397; Score =14.2; E_value=0.48; Accession=PF00560.23; Description=Leucine Rich Repeat
  Pfam annotation: Domain name=LRR_1; Domain location=399-421; Score =10.1; E_value=3.7; Accession=PF00560.23; Description=Leucine Rich Repeat
  Pfam annotation: Domain name=LRR_1; Domain location=423-446; Score =0.6; E_value=2.2e+02; Accession=PF00560.23; Description=Leucine Rich Repeat
  Pfam annotation: Domain name=LRR_1; Domain location=448-470; Score =18.6; E_value=0.023; Accession=PF00560.23; Description=Leucine Rich Repeat
  Pfam annotation: Domain name=LRR_1; Domain location=472-493; Score =5.0; E_value=34; Accession=PF00560.23; Description=Leucine Rich Repeat
  Pfam annotation: Domain name=LRR_1; Domain location=87-109; Score =16.4; E_value=0.1; Accession=PF00560.23; Description=Leucine Rich Repeat
  Pfam annotation: Domain name=Pkinase; Domain location=606-881; Score =25.9; E_value=4.2e-10; Accession=PF00069.15; Description=Protein kinase domain
  Pfam annotation: Domain name=Pkinase_Tyr; Domain location=606-881; Score=-40.6; E_value=5.6e-10; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =24-60::...
  Pfam module annotation: Domain location=111-133::135-157::159 -181::183-205::207-229::231-253::255-277::279-301::303-325::327 -349::351-373::375-397::399-421::423-446::448-470::472-493::87 -109::606-881::606-881
MEFVCLLYILLAWCLSSSELVGAELQDQDILNAINQELRVPGWGDANNSNYCTWQGVSCGNHSMVEGLDLSHRNLRGNVTLMSELKALKRLDLSNNNFDGSIPPAFGNLSDLEVLDLSSNKFQGSIPPQLGGLTNLKSLNLSNNVLVGEIPIELQGLEKLQDFQISSNHLSGLVPSWVGNLTNLRLFTAYENRLDGRIPDDLGLISDLQILNLHSNQLEGPIPASIFVPGKLEVLVLTQNNFSGELPKEIGNCKALSSIRIGNNHLVGTIPKTIGNLSSLTYFEADNNNLSGEVVSEFAQCSNLTLLNLASNGFTGTIPQDFGQLMNLQELILSGNSLFGDIPTSILSCKSLNKLDISNNRFNGTIPNEICNISRLQYLLLDQNFITGEIPHEIGNCAKLLELQLGSNILTGTIPPEIGRIRNLQIALNLSFNHLHGSLPPELGKLDKLVSLDVSNNRLSGNIPPELKGMLSLIEVNFSNNLFGGPVPTFVPFQKSPSSSYLGNKGLCGEPLNSSCGDLYDDHKAYHHRVSYRIILAVIGSGLAVFMSVTIVVLLFMIRERQEKVAKDAGIVEDGSNDNPTIIAGTVFVDNLKQAVDLDTVIKATLKDSNKLSSGTFSTVYKAVMPSGVVLSVRRLKSVDKTIIHHQNKMIRELERLSKVCHDNLVRPIGYVIYEDVALLLHHYFPNGTLAQLLHESTRKPEYQPDWPSRLSIAIGVAEGLAFLHHVAIIHLDISSGNVLLDANSKPLVAEIEISKLLDPTKGTASISAVAGSFGYIPPEYAYTMQVTAPGNVYSYGVVLLEILTTRLPVDEDFGEGVDLVKWVHSAPVRGDTPEQILDAKLSTVSFGWRKEMLAALKVAMLCTDNTPAKRPKMKNVVEMLREITQN

SEQ ID NO: 157684 - protein, 984 aa, Glycine max
  Coding DNA Sequence Number=SeqID_40906
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=99%, HitCoverage=99%, E-value=0.0, Identity=73%"; Hit description =Putative copper-transporting ATPase 3
  Pfam annotation: Domain name=E1-E2_ATPase; Domain location=403-643; Score=306.6; E_value=4.6e-89; Accession=PF00122.10; Description=E1 -E2 ATPase
  Pfam annotation: Domain name=HMA; Domain location=127-191; Score =53.7; E_value=6.2e-13; Accession=PF00403.16; Description=Heavy-metal- associated domain
  Pfam annotation: Domain name=HMA; Domain location=202-266; Score=2.4; E_value=1.1; Accession=PF00403.16; Description=Heavy-metal-associated domain
  Pfam annotation: Domain name=HMA; Domain location=50-114; Score=54.6; E_value=3.3e-13; Accession=PF00403.16; Description=Heavy-metal -associated domain
  Pfam annotation: Domain name=Hydrolase; Domain location=647-878; Score=123.2; E_value=7.6e-34; Accession=PF00702.16; Description =haloacid dehalogenase-like hydrolase
  Pfam module annotation: Pfam domain module=E1-E2_ATPase::HMA::HMA::HMA ::Hydrolase; Domain location=403-643::127-191::202-266::50-114::647 -878
MATKFLALACLRNNEGSGYLSPRPHYPSMPKYPKGVTEEEGSSNVSSKALFSVVGMTCSACAASVEKAVKRLPGIRQAVVDVLNNRAQVLFYPSFVNEETIREVIEDAGFQATFIRDDNETSVQICRIRIQGMTCTSCSSTVESALQSIQGVVKAQVALATEEAEVHYTPNVVTYNQILEAVEDTGFQATLISTGEDMSRIDIQVEGIRTGRSMRLIENSLQALPGVQGVETHPEFNKVSLSYKPDLTGPRNFINVIEETGSRRFKAKIFPEEGGRRNSHRREEIRQYYRSFLWSLVLTIPVFLTSMVLMYIPGIKHGVDAKVVNMLTVGEIIRWVLATPVQFIIGKRFYSGAYKALRLGSPNMDVLIALGTNAAYFYSVYSVLRAATSQGFKGTDFFETSAMLISFILLGKYLEVLAKGKTSNAIAKLMNLTPDTAILLTLDSEGNVVGEEEIDSRLIQKNDVIKVIPGAKVAADGFVIWGQSHVNESMITGEARPVAKRKGETVIGGTVNENGVLHVKATWVGSESALSQIVRLVESAQMAKAPVQKFADRISKYFVPLVILISFSTWLAWFLAGRFHAYPKSWIPSSMDSFQLALQFGISVMVIACPCALGLATPTAVMVGTGVGASQGILIKGGQALENTHKVNCVVFDKTGTLTIGKPVVVNTKLLTNMVLREFYELVAAAEVNSEHPLAKAIVEYAKKLRDDENPIWPEARDFVSIAGHGVKAMVRNKEILVGNKSLMEDHNVALPIDAEEMLAEAEAMAQTGIIVSINREVVGVLAVSDPLKPAAQEVISILKSMKIRSIMVTGDNWGTANSIAREVGIETVIAEAKPDQKAEKVKDLQASGCRVAMVGDGINDSPALVAADVGMAIGAGTDIAIEAADIVLMKSNLEDVITAIDLSRKTFSRIRLNYIWALGYNLLGIPIAAGALFPSTQFRLPPWIAGAAMAASSVSVVCCSLMLKYYRRPKKLDNLEIRGISIE

SEQ ID NO: 157685 - protein, 199 aa, Glycine max
  Coding DNA Sequence Number=SeqID_40907
  Gene Ontology: Mol. function=monooxygenase activity; Cellular component=membrane; Biological process=electron transport
  Homolog annotation: Hit_ID=Q1SI93; Match level="QueryCoverage=93%, HitCoverage=36%, E-value=7e-75, Identity=73%"; Hit description=E -class P450, group I
MAEMIRDSRVMEKVQIEVREVFNMKGRVDEICIDELKYLKSVVKETLRLHPPAPLLLPRECGQACEINGYHIPVKSKVIVNAWAIGRDPKYWSEAERFYPERFIDSSIDYKGTNFEYIPFGAGRRICPGSTFGLINVEVALAFLLYHFDWKLPNGMKSEDLDMTEQFGVTVRRKNDLYLIPVPSNPFQRIYPLNSVNWS

SEQ ID NO: 157686 - protein, 131 aa, Glycine max
  Coding DNA Sequence Number=SeqID_40908
  Gene Ontology: Mol. function=monooxygenase activity; Biological process=electron transport
  Homolog annotation: Hit_ID=Q1SI93; Match level="QueryCoverage=63%, HitCoverage=15%, E-value=1e-14, Identity=55%"; Hit description=E -class P450, group I
MIVKISPSWRCIKGPYILAKSLNFRCGVDVTKWSMFPMIGIFHGPGGIFGDESVFLRLLPIFSATKMKREKDMITANILSTSESMIQKRILVAVYCFLLVSAAAVARSVDGGGGGIGHGGGSSCSGKRVIF

SEQ ID NO: 157687 - protein, 649 aa, Glycine max
  Coding DNA Sequence Number=SeqID_40909
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q41140; Match level="QueryCoverage=94%, HitCoverage=98%, E-value=0.0, Identity=74%"; Hit description =Pyrophosphate--fructose 6-phosphate 1-phosphotransferase alpha subunit
  Pfam annotation: Domain name=PFK; Domain location=112-365; Score= -160.8; E_value=0.0089; Accession=PF00365.10; Description =Phosphofructokinase
MVKIPESGGLVSAVYFFGIKVVESMDSDYGIPRELSDLQKIRSLYQPELPPCLQGTTVRVEFGDATTTADPTDALTVCRAFPNTYGHPLAHFLRATAKVPDAQIITEFPPIRVGIVFCGRQSPGGHNVIWGIHNALKIHNPNSVLLGFLGGSEGLFAQKTLEITDDILSTYKNQGGYDLLGRTKDQIRTTEQVNAALAACNNLKLDGLVIIGGVTSNTDAAQLAETFVVAKCPTKVVGVPVTLNGDLKNQFVETNVGFDTICKVNSQLISNVCTDALSAEKVILGEEVAASKLTLSEIAKQITDAIQARAEQDKYHGVILLPEGLIESIPEVYALLKEIHGLLRQGVEVDKISSQLTPWASALFEFLPPFIRRQLLLYPESDDSAQLSQIETEKLLAYLVEVEINKRLHCGLALIAFSDLKKEGTYKGKKFNAICHFFGYQARGSLPSKFDCDYAYVLGHICYHILAAGLNGYMATLTNLKNPVNKWKCGAAPIASMMTVKRWSPNPGATSIGKPAIHPATVDLRGKAYELLRQKAQSFLMDDIYRNPGPLQFDGPGADAKVITLSVEDQDYMGRIKKLQEYLEQVLPINLVILTALEFRAYFSYSMVRTIVKPGCPQEVLKAALSVMASVTEVLAAMSTSYTNTLASL

SEQ ID NO: 157688 - protein, 886 aa, Glycine max
  Coding DNA Sequence Number=SeqID_40910
  Gene Ontology: Mol. function=monooxygenase activity; Cellular component=membrane; Biological process=electron transport
  Homolog annotation: Hit_ID=Q1SKI2; Match level="QueryCoverage=94%, HitCoverage=94%, E-value=0.0, Identity=61%"; Hit description =Arthropod hemocyanin/insect LSP; E-class P450, group I
  Pfam annotation: Domain name=p450; Domain location=525-877; Score =115.5; E_value=1.5e-31; Accession=PF00067.12; Description=Cytochrome P450
  Pfam annotation: Domain name=p450; Domain location=61-524; Score =333.5; E_value=3.6e-97; Accession=PF00067.12; Description=Cytochrome P450
  Pfam module annotation: Pfam domain module=p450::p450; Domain location=525-877::61-524
MATKLVIFIRTFRTPYWSLVTMDSEVLNLLALILPFLLFVIVALKIGRRNLKKSESTPKIPPGPWKLPIIGNILHLVTSTPHRKLRDLAKIYGPLMHLQLGELFIIVVSSAEYAKEIMKTHDVIFAQRPHSLASDILSYESTNIISAPYGHYWRQLRKICTVELFTQKRVNSFKPIREEELGNLVKMIDSHGGSSSINLTEAVLLSIYNIISRAAFGMKCKDQEEFISVVKEAITIGAGFHIGDLFPSAKWLQLVSGLRPKLDIIHEKIDRILGDIINEHKAAKSKAREGQDEAEEDLVDVLLKFKDGNDRNQDICLTTNNIKAIILDIFGAGGETSATTINWAMAEMIKNPRAMNKAQLEVREVFDMKGMVDEICIDQLKYLKSVVKETLRLHPPAPLLLPRECGQTCEIHGYHIPGKSKVIVNAWTIGRDPNYWTEAERFHPERFFDSSIDYKGTNFEYIPFGAGRRICPGITLGLINVELTLAFLLYHFDWKLPNGMKSEDLDMTEKFGVTVRRKDDLYLIPVTSRPFLVFTIIVSSAEYAKEIMKTHDLIFASRPHTLVADILAYESTSLSINLAEIVVLSIYNIISRAAFGMKSQNQEEFISAVKELVTVAAGFNIGDLFPSVKWLQRVTGKIKAIEGKDETEEDLVDVLLKFLDVNDSNQDICLTINNMKAIILDIFAAGGETATTTINWVMAEIIRDPRVMKKAQVEVREVFNTKGRVDEICINELKYLKSVVKETLRLHPPAPLLLPRECGQTCEIDGYHIPVKSKVIVNAWAIGRDPKYWSEAERFYPERFIDSSIDYKGTNFEYIPFVAGRRICPGSTFGLINVELALAFLLYHFDWKLPNEMKSEDLDMTEEFGLTVTRKEDIYLIPVTSRPFSY

SEQ ID NO: 157689 - protein, 244 aa, Glycine max
  Coding DNA Sequence Number=SeqID_40911
  Gene Ontology: Mol. function=DNA binding; Biological process=DNA integration
  Homolog annotation: Hit_ID=Q0KIN0; Match level="QueryCoverage=45%, HitCoverage=6%, E-value=1e-07, Identity=32%"; Hit description =Integrase core domain containing protein
RLFLMFDFFLAKLWQEDHSSRSVPFAVATGSPGEATGIEFESTGTSSFLLTKASKIPFRDKFDSQAAKCVFLGYSSTKKGYQWYHSDFGKLFVTRDVEFEETTSYYNKSEDVLHDVFPLPISYNIPIDSELIISPNSPDIAIDTCNKPTCPASIDKDTESANTPLNTKGASSDCSQVDSFDCTQGELVPTEHVTLELQDVHHRQYPARNHAHPLNLQDFVIVNHENCIYSLKTKEFSQNDSTIY

SEQ ID NO: 157690 - protein, 60 aa, Glycine max
  Coding DNA Sequence Number=SeqID_40912
  Homolog annotation: Hit_ID=Q1T4K6; Match level="QueryCoverage=81%, HitCoverage=9%, E-value=2e-11, Identity=78%"; Hit description =Unnamed protein product; contains similarity to nuclear protein ZAP gene_id:MQB2.8-related
MDIPLAFRDQVRSLHFRSYIQGSGGCATRNVHEFTQEDIEKMSKRWEGASSLYLQLDVKA

SEQ ID NO: 157691 - protein, 89 aa, Glycine max
  Coding DNA Sequence Number=SeqID_40913
MLQCEGFSSKLRYDFEIANGENVRNWVANVVLKFHDNPTVNESEIVVFLRQVWWAAGKRKGAMIYFTGEVSGSSSGWPSCVKEKNRKLT

SEQ ID NO: 157692 - protein, 175 aa, Glycine max
  Coding DNA Sequence Number=SeqID_40914
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=75%, HitCoverage=25%, E-value=2e-49, Identity=75%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=5-175; Score=39.2; E_value=1.3e-08; Accession=PF00361.10; Description=NADH -Ubiquinoneplastoquinone (comple
MLSPEACLGHLAYLIIFFCHAKFPTLIVALLHVTSKVAASASATRIFDIPFYFSSNEWHLLLEILAILSMILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLS

SEQ ID NO: 157693 - protein, 545 aa, Glycine max
  Coding DNA Sequence Number=SeqID_40915
  Homolog annotation: Hit_ID=Q6AWX7; Match level="QueryCoverage=72%, HitCoverage=73%, E-value=7e-24, Identity=41%"; Hit description =Growth-regulating factor 12
  Pfam annotation: Domain name=QLQ; Domain location=76-112; Score=11.0; E_value=0.015; Accession=PF08880.1; Description=QLQ
  Pfam annotation: Domain name=WRC; Domain location=128-173; Score =97.2; E_value=4.8e-26; Accession=PF08879.1; Description=WRC
  Pfam annotation: Domain name=WRC; Domain location=427-472; Score =65.3; E_value=2e-16; Accession=PF08879.1; Description=WRC
  Pfam module annotation: Pfam domain module=QLQ::WRC::WRC; Domain location=76-112::128-173::427-472
MEAKPLRTVPSSHNTSGVGGGPQKKIGMEHKMESRVVDERKRVVMVKEENSTSSPNSVELHLGFDASHSTPQEINHVITEAQRRELHHQVFIFNHLAYNLPPPYHLVQFPSNMSEYSFLGFDHGIMVDPEPHRCRRTDGKKWRCGKNVVPNQKYCERHMHRGRNRSRKPVETSQVNSPLATKPCSKSHTKPSSKTQFEISSPNLIAIPHIDTSSTPSRSLSVTNCSSANNRSKNRAGYADYLMSFSSASTVSPGTTLATPVAPKIAAFSSATSVVASDSKSCLKICQKDNQSKSCISNNIGVKSGGKGSIVGDTNTNGISTGISFSPTSVLQELEYYRIETDTLSSPTLPEQQTQSYQTFFHLVGSVIYDCHVMFQLIMNPDVAQTFLNSLTCSYQSPQIQRGINSIIAISVSGCNPSYLNDGTNIEAASGRCRRTDGKKWQCKSAVLPGQKYCATHMHRGAKKRLTSHEPAATATSSAVTVARLPYSSATTNIQKAHCAIPNTNLSMSVQAREAFIQCNEKSQSSSDTDTTISDTLNEYSYASF

SEQ ID NO: 157694 - protein, 309 aa, Glycine max
  Coding DNA Sequence Number=SeqID_40916
  Pfam annotation: Domain name=AT_hook; Domain location=33-45; Score =14.9; E_value=0.061; Accession=PF02178.9; Description=AT hook motif
MVENRLRWFGHVERRPVDSVVRRVDQMGRRQTIRGRGRPKKTIREVIKKDLELNDLDRSMVLDRTLWRKLIHVADPTYRISKAQDTEDDSVDYMEKNWSGNLHTADRSERNAALVSPLLATYTQRKNKSVRFESETDLATYGSSSDDWHMKENKSPNSQSAYKPSPYPTPLKLFDEMQTPGTVYPASLEELRTGKAQVRSQFVYPTNKPGDNVFWCKILEERDFNLEEDSSELSDLVEKAQNETPTPEKGSKKFSKENDDEVKSNLSARISPVSTIKEHSPMPFKWWYDNGIPNSTTKYKEHLISAHCP

SEQ ID NO: 157695 - protein, 138 aa, Glycine max
  Coding DNA Sequence Number=SeqID_40917
MSRHGTKGERELLRAPSIIAGEPSKHVAGKHFRKTLFQKLLRPIPEEVVPEVSFGRTSSGMGLSNFRKNVFQKFLRPIPEEVLPKDTSGTTSSGIGLSNFWKKVFRKFFRKLPDELLPEPPDDDLPEPPDDDLPDEVC

SEQ ID NO: 157696 - protein, 84 aa, Glycine max
  Coding DNA Sequence Number=SeqID_40918
MDSSLTTKGEGRLGNTVGKSIKNALEVVVALSTDKIHKSQWNTIVSFDSFDVSVRNKWNVAVFQDAVLVLEFGCLDCLVSYYIT

SEQ ID NO: 157697 - protein, 160 aa, Glycine max
  Coding DNA Sequence Number=SeqID_40919
PSSENFPENVLPELPEEPLTGLPEVSAVSLLSPFFSASSPLVFYPKVTILRGVRETNLVRGEEEDEVRACLAGEEEAVRGEGRTSFAEGMSSSRKLYKCKKENFEGCYDLMGVETSLQSRNTQLLKDVTTLISLDVAYGNSILKHNNPMVIRIVIANVDV

SEQ ID NO: 157698 - protein, 365 aa, Glycine max
  Coding DNA Sequence Number=SeqID_40920
TQNSLLRDDTCFFIQPDITQSYNVHVEFHPLPGEELSSGVPQSSLEFLSNSAKILSSSNGLILCRATGENEVKLFITNPATQSWLPIPTPGEYKQNGTSIGAVDLKIVLECDDKDDYMVYLFYDNLVDWSSSNLDCKVYHSNEGVWKSKQERFFTGSRKLKFDMPVHHRGAVHFISDCFPSWNKKSPYFRPYIMSYNFESGNSRMLRVPKEARKGSHDLTCDMGIFKWGKATDPNQSICLVRLRKHVFTIWTLTHYETSEWRRVLKIRVKAMVKDHPIIRVKGYAVLNGDLLVFATEKKVYGCGLKDMRIQEICDHEFDFNVLRFTSYKDTLRTFGTGAGTLPLSLHTCGTRAGTLPLPSHKQFW

SEQ ID NO: 157699 - protein, 66 aa, Glycine max
  Coding DNA Sequence Number=SeqID_40921
MTKPKPNYTMNVIDQAKSSRIFKVYWNYFRSMTRDRLAQSKGGREKSYVEIVSLKQLLITLTSMWT

SEQ ID NO: 157700 - protein, 371 aa, Glycine max
  Coding DNA Sequence Number=SeqID_40922
  Homolog annotation: Hit_ID=Q9FNE4; Match level="QueryCoverage=69%, HitCoverage=26%, E-value=1e-13, Identity=25%"; Hit description =Arabidopsis thaliana genomic DNA, chromosome 5, P1 clone:MPO12
MVNAIGLNVGKKRKGSEDDGMALKRVQKKKELLVETDGDVLSAKNDGKGGEENSNIGSLLQSIEKNIGAFDEGKSEERNGKGNLSRERKRSKYLSPPFTIPIRGQREVYIEPESLKVSRKAKVSQRSAGADGLSSLPMYKGRSSLYSQGSLCELYKKNQPGRKRKMLESEEDGMLKELNLSTDEHLSSLKQNYGPKKRRKETASGKKGNEENAAGFSMPSRSDLVSVFSKFGALNEAETNMFRTNYTARVSFLRTSDAQKAYNHSQNNNPFGSPVDVTFQLLHSSDVCCCSYSGFVLTEGIIGLLFSRSPATLSSGVLFEGGLLFLNSFSMKSTKRNINPIANMVGIPIPKSVQMGQDKISVDDTKRNNSA

SEQ ID NO: 157701 - protein, 100 aa, Glycine max
  Coding DNA Sequence Number=SeqID_40923
  Homolog annotation: Hit_ID=Q10NY2; Match level="QueryCoverage=60%, HitCoverage=5%, E-value=7e-12, Identity=50%"; Hit description =Expressed protein
  Pfam annotation: Domain name=LisH; Domain location=6-32; Score=23.8; E_value=0.00063; Accession=PF08513.1; Description=LisH
MAHLDKDLTLLVLQYFNEENLKEAARSLGHESGLYFDLKYFEDIVLEGRWDETENYLSVFTNESHEDSTSGGFNLSSVSLTFGNSIGAVEGITEGISGNR

SEQ ID NO: 157702 - protein, 118 aa, Glycine max
  Coding DNA Sequence Number=SeqID_40924
  Gene Ontology: Mol. function=oxidoreductase activity; Cellular component=membrane; Biological process=electron transport
  Homolog annotation: Hit_ID=O22162; Match level="QueryCoverage=85%, HitCoverage=20%, E-value=2e-27, Identity=57%"; Hit description =Putative cytochrome P450
MRCTLDSIFKVGFGTELNCLDGSSKEGSEFMKAFDESNALIYWRYVDPFWKLKRFLNIGCEATLKRNVKIIDDFVHGVIKTRKAQLALQQEYCINLSSLIKYSKIQLSNSQEFCLHLN

SEQ ID NO: 157703 - protein, 68 aa, Glycine max
  Coding DNA Sequence Number=SeqID_40925
MTTSDFRRSYMKNLRDKNNGKLHLLLRILSTWIDSLYVSYGLTIRKNHRNQCISTKTDTTTKDYLFRE

SEQ ID NO: 157704 - protein, 83 aa, Glycine max
  Coding DNA Sequence Number=SeqID_40926
  Subcellular localization annotation: CTP_CleavageSite=31; ConfidenceScore=5.43e-01
MVSGSLGSPLGWKLVHPINTSSRKSHLVLKVESHVTRPTSPMTFLLKCQRRGIFVPFAAQNVKWFDEGVVIRSMRWEWVRNLK

SEQ ID NO: 157705 - protein, 662 aa, Glycine max
  Coding DNA Sequence Number=SeqID_40927
  Gene Ontology: Mol. function=protein-tyrosine kinase activity; Cellular component=integral to membrane; Biological process=protein amino acid phosphorylation
  Homolog annotation: Hit_ID=P93756; Match level="QueryCoverage=92%, HitCoverage=91%, E-value=1e-146, Identity=44%"; Hit description =Putative receptor-like protein kinase
  Pfam annotation: Domain name=B_lectin; Domain location=19-128; Score =34.3; E_value=4.1e-07; Accession=PF01453.15; Description=D-mannose binding lectin
  Pfam annotation: Domain name=PAN_1; Domain location=266-346; Score =34.6; E_value=3.5e-07; Accession=PF00024.16; Description=PAN domain
  Pfam annotation: Domain name=PAN_2; Domain location=266-331; Score =2.3; E_value=0.00078; Accession=PF08276.2; Description=PAN-like domain
  Pfam annotation: Domain name=S_locus_glycop; Domain location=133-255; Score=-21.3; E_value=0.0014; Accession=PF00954.11; Description=S -locus glycoprotein family
  Pfam module annotation: Pfam domain module=B_lectin::PAN_1::PAN_2::S _locus_glycop; Domain location=19-128::266-346::266-331::133-255
MVIFHLGSLTFQMNLTSLVLAFVSIRSLYHMTNKQWSGLLELMIKGTDPVDSLKGFIAWRRGTGNRAVASATLRDNGNLVLIDTEQNIIWQSFDTPSDTLLPGQSLSVYETLRAMTKNPMSSTYTLYMNPSSQLQLQWDSHIIYWTSESPSSASNLTAFLTAGGALQLQDPSLKAVWSVFGEGHNDYVNYRFLRLDVDGNLCLYSWIEASQSWRSVWQAVEDQCKVFATCGQRGVCVFTASGSTDCRCPFEVTESNQCLVPYDQECESGSNMLTYKNTYLYGIYPPDDSVVISTLQQCEQLCLNDTQCTVATFSNNGRPQCSIKKTKYVTGHADPSLSSISFIKRCSGPFAVNPGLTKSPPPKLPPRLCVPCLMGAVSGTRKNSTMQNVALAFTSPNPKGLNVFSFSEIKSLTRDLKDRIGPNMFKGVLPKNHLIAVKDLNASIEERKFQTPECCYEVGQHPPQEPCEAGRLLLEFGSHGNLKCENVMLDENSVAKVCEYGFAIEDGEATYCGFSAEKDVGDFGKLVLTLLTGCQDHEQLCEWAYTEWMEGRAVNVVDKRIDGVVNAEELERALRISFWWCLQMDERRRPSMEEVVRVLDGTLNVDPPPQPCLAQAVTRRRFTRKWSRISDFSSVYACSIFRDLFSFVSLFQSPSCSTCIVE

SEQ ID NO: 157706 - protein, 178 aa, Glycine max
  Coding DNA Sequence Number=SeqID_40928
  Gene Ontology: Mol. function=RNA-directed DNA polymerase activity; Cellular component=chromatin; Biological process=chromatin assembly or disassembly
MAEQDTAKTAFHTHQGHYEYKVMSFGLSNASSNVQATIKFIVGYASIASPLTSLLQKDDLKHAMTQASVLALSNFSTPFTLETNASRSAMGAILMQHDHPMAFFSKTLEQQVYLSKLLGYNYLIQYKSGKPNVVADALSRLPPPANGQFLVLSMPNFIFLDALQEHLQASASFQARVQ

SEQ ID NO: 157707 - protein, 350 aa, Glycine max
  Coding DNA Sequence Number=SeqID_40929
  Gene Ontology: Mol. function=RNA-directed DNA polymerase activity; Cellular component=chromatin; Biological process=chromatin assembly or disassembly
MSPPPMVTSLAYYPKDNNIFGIGFDDSTILIYHVRQARGTLFKLTQKGVVNEYLDEFGKPANHIVDLPPSFLLSCFISGLMLKLHREVPPPPHYQTPLHFYPPPHPTLHYTQTQVKRLNPEEMTHKRERDLYYNCDEKWGPNHPCKVHLFMLIAEEDDVAPNPPPLSPDTLPDTTSPDSTHAQINFQCPFKDIDTRSPSSLWFCSSFSCDGAHQWEYHPQIHPIQGSQISTTSHHNHHAITIDSGKRGADIVLGIQWLKQLGPTITCYDTLTMQFRYDGAFVTLQVEIEKQVTEMLSASVIQLSHSPFSSQMLLVKKRDGNWRFYVDYRALNVLMVKDHFPMSMIDELLD

SEQ ID NO: 157708 - protein, 313 aa, Glycine max
  Coding DNA Sequence Number=SeqID_40930
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=P52902; Match level="QueryCoverage=51%, HitCoverage=43%, E-value=1e-46, Identity=61%"; Hit description =Pyruvate dehydrogenase E1 component subunit alpha, mitochondrial precursor
  Pfam annotation: Domain name=E1_dh; Domain location=62-290; Score =6.1; E_value=6.7e-10; Accession=PF00676.10; Description =Dehydrogenase E1 component
MAKSTTDPTQDPTNPLHLHHSDGLGLVLTSQTLDHKNYITRNKAMKLSGKNKITTSLLTFFRDMALMRRMKIAADSLYKAKLIRGFCHLYDGQEAVAVGMEAASQKWTPSSPPTATTAPSSAAAARSPRSSPSSWAAGMGARRGRESGFYGGHGIVGAQVPLRCGLAFAQKYSKDESVTFAMYGDGAANQGQLFEEALNIAALWDLPAILITDFEKHADNLTNYYKVYEESPRDHILLAWNCARATLLCPAIEYPRDRGACSTVRMGCVGGIALCDQRAAAHGGCIPVKSARLHCRRRLGGPPGRVENRTRLR

SEQ ID NO: 157709 - protein, 119 aa, Glycine max
  Coding DNA Sequence Number=SeqID_40931
  Homolog annotation: Hit_ID=Q9LIH4; Match level="QueryCoverage=44%, HitCoverage=39%, E-value=1e-13, Identity=66%"; Hit description =Arabidopsis thaliana genomic DNA, chromosome 3, P1 clone:MFD22
MASTSTTRTRIKWQKLKETKQQTSMTRPCEHATPSSSSSKEQGIKYVEEESINEEDVCSSGCATPKAKRFRIPEVQTCPPAPKKRRVVPNCSSKRSPIAFFASPDIELFFFSALRNVSA

SEQ ID NO: 157710 - protein, 49 aa, Glycine max
  Coding DNA Sequence Number=SeqID_40932
MVPHLPFCNKGNEEDKVRKFENNLTRRKDFTLGLHCATNSEDDGGDQCQ

SEQ ID NO: 157711 - protein, 168 aa, Glycine max
  Coding DNA Sequence Number=SeqID_40933
  Gene Ontology: Mol. function=metal ion transporter activity; Cellular component=membrane; Biological process=metal ion transport
  Homolog annotation: Hit_ID=Q1RW15; Match level="QueryCoverage=26%, HitCoverage=10%, E-value=1e-09, Identity=77%"; Hit description=Mg2+ transporter protein, CorA-like
MGFIGSVVEALLGQVLMWGIRPSEMVIMSSSRTSTLEVEAYPALEELISQLSTLNLERVRQIKSRLVALSSRVQKVYARSSSTNPSVTLAHVIKSQKQYRWNNGILGEGLFPYKVYRKATLCTHPDKVQQKWSADRGTRFVCYVISLLAGLARRNLADTEVQADRGTS

SEQ ID NO: 157712 - protein, 662 aa, Glycine max
  Coding DNA Sequence Number=SeqID_40934
  Homolog annotation: Hit_ID=Q01B42; Match level="QueryCoverage=30%, HitCoverage=26%, E-value=2e-09, Identity=25%"; Hit description =Homology to unknown gene
MEGEEELLWKSEPQRESIVSVSLARAITSLLTSRPKKLHDSIHRLSSHSRSHTSLASLEDSLWFFLSFVTDSRTNNSSLDEVLLPVIDNALKSKHGDQAMILLSWLFQDELLFQPVAEALASIVSRKHVHDRYLLLGWCLLLRNLVEFENSAHQSMFGGIRGRYGDLLKILSTCLPDLAGIVSKGSTLQDGFELPSRLGVSAADCFLSLSGALTKVAESKKSKLNTRAKDQEITFVQSPTIDKKVNLESKSLLMSKIERDYTLWHHLDDIICLVQRLLSWSKKSRFLHAKGLGQVLKWLEEIKDHYGSFQHEAALKTDSNVLKTGDLLLSSCWKHYSMLLHLEDKKFSQHYKELLNQYMSGIQHYMDNHTGGGYTDNNDGGLETRKFFLNCLCLLLGRLDSKRFESMVSEFGMNISCILVPQLNCTDEDVIVGVVSIFKAIILRPDYSQEDALTDNRQANSVIPFLLHLLDEQDGTAKAVVMLIAEYCSMSEGDQCLMEVLKRLASGNISQRRNAMDVISEVLHISSKSQNLMPSSAWQDMANKLLERLGDEETKIREQASKLLPMIDPPLYLPALVGLVYSPDESQSSASDAIIGVLKHHNQRIEIIFLLLDCLSNMSKSLDLTQSTGDKGLTQSQNLAHRVRVALTYILYLDTISNRCGI

SEQ ID NO: 157713 - protein, 511 aa, Glycine max
  Coding DNA Sequence Number=SeqID_40935
  Gene Ontology: Mol. function=heat shock protein binding; Cellular component=intracellular; Biological process=metabolic process
  Homolog annotation: Hit_ID=Q9LTF4; Match level="QueryCoverage=98%, HitCoverage=85%, E-value=1e-160, Identity=57%"; Hit description =Selenium-binding protein-like
  Pfam annotation: Domain name=PPR; Domain location=175-209; Score =21.8; E_value=0.0024; Accession=PF01535.11; Description=PPR repeat
  Pfam annotation: Domain name=PPR; Domain location=278-312; Score =28.1; E_value=3.1e-05; Accession=PF01535.11; Description=PPR repeat
  Pfam annotation: Domain name=PPR; Domain location=313-347; Score =30.6; E_value=5.5e-06; Accession=PF01535.11; Description=PPR repeat
  Pfam annotation: Domain name=PPR; Domain location=348-382; Score=8.9; E_value=0.66; Accession=PF01535.11; Description=PPR repeat
  Pfam annotation: Domain name=PPR; Domain location=414-448; Score=1.7; E_value=4.7; Accession=PF01535.11; Description=PPR repeat
  Pfam annotation: Domain name=PPR; Domain location=74-108; Score=32.7; E_value=1.3e-06; Accession=PF01535.11; Description=PPR repeat
  Pfam module annotation: Pfam domain module=PPR::PPR::PPR::PPR::PPR::PP R; Domain location=175-209::278-312::313-347::348-382::414-448::74-108
MVVLSDCRDICKVLVWFTHTRSLRKGLQLHGQVIKLGFEAIPLVCHHLINFYSKTNLPHSSLKLFDSFPHKSATTWSSVISSFAQNDLPLPALRFFRRMLRHGLLPDDHTLPTAAKSVAALSSLPLALSLHALSLKTAHHHDVFVGSSLVDTYAKCGDVNLARKVFDEMPHKNVVSWSGMIYGYSQMGLDEEALNLFKRALEQDYDIRVNDFTLSSVLRVCSASTLFELGKQVHGLCFKTSFDSSCFVASSLISLYSKCGVVEGGYKVFEEVKVRNLGMWNAMLIACAQHAHTGRTFELFEEMERVGVKPNFITFLCLLYACSHAGLVEKGEHCFGLMKEHGIEPGSQHYATLVDLLGRAGKLEEAVLVIKEMPMQPTESVWGALLTGCRIHGNTELASFVADKVFEMGAVSSGIQVLLSNAYAAAGRWEEAARARKMMRDQGIKKETGLSWVEEGNRVHTFAAGDRSHGKTREIYEKLEELGEEMAKAGYVADTSFVLKEVDGDEKSQTI

SEQ ID NO: 157714 - protein, 119 aa, Glycine max
  Coding DNA Sequence Number=SeqID_40936
  Homolog annotation: Hit_ID=Q8R993; Match level="QueryCoverage=66%, HitCoverage=33%, E-value=2e-07, Identity=37%"; Hit description =Aspartate racemase
MVNISPLYDDVSWPADEGVLGVVGVAPWATLDFCQQLYGLVQADKEWQYPRLIIDNNSKIPSRGRHLQLGERDPSPWIHATITELAAAGATVAVVPCCIMMRLRNSTPRSSMSLHPPNS

SEQ ID NO: 157715 - protein, 67 aa, Glycine max
  Coding DNA Sequence Number=SeqID_40937
MAFGTTAARPGELMLHLEVTGLPRQAGSFSPKQFGGPSEPEASLGELGSRKFTKKTLLPPLWYLSHP

SEQ ID NO: 157716 - protein, 92 aa, Glycine max
  Coding DNA Sequence Number=SeqID_40938
  Subcellular localization annotation: CTP_CleavageSite=24; ConfidenceScore=5.07e-01
MSPPPLGPHNHSQTHLKLSGWLPLQALVSADLHTTKSLKLSGTWTFLSLELSKHAEVSRKGQTPFQNLISGLNRWLCSCSFSHSTDGLKRCT

SEQ ID NO: 157717 - protein, 162 aa, Glycine max
  Coding DNA Sequence Number=SeqID_40939
METFQVSLVIKNYIGLNSSLEDTYEQEPCFCRPPQNLSHTDPEAAGPMTSRDKIWSFCTLVSSRGGGPDDTRRYLTVICTLLSSRGGGPDDKQRQNLAAGPMIRGDTLRLSAPFCHPEAAGPMTSRDKIWSFCTLVSSRGGGPDDTQRYLTVIRTLVSSRGG

SEQ ID NO: 157718 - protein, 103 aa, Glycine max
  Coding DNA Sequence Number=SeqID_40940
MEVKVQQNFGFVQKNACVWLAVESLVQNEFWMFASRSQRSKCRLMHYRLPLGRIDGDPVLRETRIWATWEYVSSVGGEQQGMVGLCAHCGCGKLVVHHRPTAT

SEQ ID NO: 157719 - protein, 201 aa, Glycine max
  Coding DNA Sequence Number=SeqID_40941
AHMKGITGAPYRARCDALTVTDVCWLPYTEHGGFGYIQSIPPPPVSASLSYDDIDDRWMHFADHAQASKIHRRLGSGLSKPGLAWPFPIPTGQVSADYMEWFFRISHPFMIPTQARDQPRHAPAADPEEYLQPPIPQVLVAFDPPPHAVAIVERLERVLNLRMFTVGTKLHDIMQDCLTIARGGASIDGSVRARQRRRTEH

SEQ ID NO: 157720 - protein, 63 aa, Glycine max
  Coding DNA Sequence Number=SeqID_40942
  Gene Ontology: Mol. function=amino acid transporter activity; Cellular component=integral to membrane; Biological process=auxin mediated signaling pathway
  Homolog annotation: Hit_ID=Q8L884; Match level="QueryCoverage=89%, HitCoverage=11%, E-value=2e-25, Identity=96%"; Hit description=Auxin transporter-like protein 4
MWKPQKFKYIYLLATLYVFTLTIPSAVAVYWAFGDMLLNHSNAFSLLPKNGFRDAAVSSCSFT

SEQ ID NO: 157721 - protein, 168 aa, Glycine max
  Coding DNA Sequence Number=SeqID_40943
  Gene Ontology: Mol. function=sequence-specific DNA binding; Cellular component=intracellular; Biological process=regulation of transcription, DNA-dependent
  Homolog annotation: Hit_ID=P75995; Match level="QueryCoverage=99%, HitCoverage=33%, E-value=2e-49, Identity=60%"; Hit description =Hypothetical protein ycgG
  Pfam annotation: Domain name=EAL; Domain location=1-167; Score=70.3; E_value=6e-18; Accession=PF00563.11; Description=EAL domain
MAKVVTQLKPLLPKLPDGFHIGVNISARHINAPSFIGDCRIFGKGFQGKAVKLVLEVTEREPLIDNPHLVENLNALHNAGFVIALDDFGTGYSGLSCLNALAIDYIKIYKSFVNRVSEENDSTILLDCVIDLAKKLSLRIVAEGVETKEQLEYLNRNEITLLQGLLFW

SEQ ID NO: 157722 - protein, 118 aa, Glycine max
  Coding DNA Sequence Number=SeqID_40944
MTSIVCKDRSHKTPSGPEEVQQGPGVSSSDYGPLSILRSARRPQQGRRRARHHNSLGKASSEQQTHHHHLQNPPQFIYKGWSVAYDTWSTSRRPSPKPQLFWMKKHVSVKKIQAEVLP

SEQ ID NO: 157723 - protein, 95 aa, Glycine max
  Coding DNA Sequence Number=SeqID_40945
  Homolog annotation: Hit_ID=Q1SJY4; Match level="QueryCoverage=62%, HitCoverage=12%, E-value=6e-08, Identity=43%"; Hit description=Zinc finger, CCHC-type
MANNQCPFIIEGTSLTRPPSFTGEDYLYWKDKMEITTKKIWDLLSTNYEGTEDVKLEKDTTLTIHYESFNMKDGEFVDDMFGRLQVLLNNLEALG

SEQ ID NO: 157724 - protein, 93 aa, Glycine max
  Coding DNA Sequence Number=SeqID_40946
  Subcellular localization annotation: CTP_CleavageSite=50; ConfidenceScore=5.26e-01
MATVGSEPACARTVHDVASSFSSKWQHSSTVKKQPRARIPQCSLRIRACSSMANKKDIYNQVDVPHPPMSMAHSSDSGKMPMGLMGDLLPLII

SEQ ID NO: 157725 - protein, 340 aa, Glycine max
  Coding DNA Sequence Number=SeqID_40947
  Gene Ontology: Mol. function=oligopeptide transporter activity; Cellular component=integral to membrane; Biological process =oligopeptide transport
  Homolog annotation: Hit_ID=Q1SHX0; Match level="QueryCoverage=97%, HitCoverage=57%, E-value=1e-124, Identity=57%"; Hit description =Ribosomal protein S2; Oligopeptide transporter OPT superfamily
  Pfam annotation: Domain name=OPT; Domain location=76-339; Score= -249.2; E_value=0.013; Accession=PF03169.6; Description=OPT oligopeptide transporter protein
METRASNKKASHLPLQQFISVTTPLLDLEKEAEVSSSGVSQERVVIEDAEKDEFKVNDCPIEQNQPFENLFGLAPIITLPLGKLMAATLSTRPVRVPFTKGSFLLNPGPFSLKEHVLITIFATSGSSGVYAINIITIVKAFYHRSIHPVSLFRAFHEKEKRPKGGNTRLQFFFLVFVIGSGMNSLGISSFGLDWNTVAGFLGSPLAIPGFAIINLLIGFVLDIYVVIPVANWSNLYDAKKFPLISSHTFDSTGAIYNVTRILNPITFEIDLNSYNNYSKIYLSNAFVFEYGLGFATLIATISHVALFHGEMILQVWRKTTRTLKEQLGDVHTRIMKKNYE

SEQ ID NO: 157726 - protein, 148 aa, Glycine max
  Coding DNA Sequence Number=SeqID_40948
  Gene Ontology: Mol. function=translation release factor activity, codon specific; Cellular component=cytoplasm; Biological process =translational termination
  Homolog annotation: Hit_ID=Q1SS34; Match level="QueryCoverage=93%, HitCoverage=34%, E-value=3e-56, Identity=79%"; Hit description=Class I peptide chain release factor; PCRF
MTVAFIMHKYSVSWKIEDAVLRAEMFASTALEMEEATWIKQEEMVRDFDMWDDPAKSNDILVKLANSAKVVDSLKDLKYKVEEAKLINQLAEINAIDYGLYKQAYETSLDVSEIVDLYEISKLLKGPFDMAGACLVIKAGPKGMYPKV

SEQ ID NO: 157727 - protein, 374 aa, Glycine max
  Coding DNA Sequence Number=SeqID_40949
  Homolog annotation: Hit_ID=Q9FLQ5; Match level="QueryCoverage=82%, HitCoverage=48%, E-value=6e-88, Identity=54%"; Hit description =Arabidopsis thaliana genomic DNA, chromosome 5, P1 clone:MCO15
MVMEANSNTSDSANYMGRIPTSPLLYARLRTGELVLRLGADCPSGDLTLLETGEPAYSPVTQEGPLLTEDLIKETEEFVLRTGSVGAGCSQLLSDMQAFKAANPGCILEDFVRWYSPPDWMESEGSTEDRDSFYGGESMSSRGQLSLRMQKEGNLWRELWETSKSVPAVKQTPLYDEDLAVEGILDAFEDIQPSELYRQLFVSLLGLGFAIAETMLSGDIDTSKLFNDCKEYIVTTSQSDGFHEKVNELVQMYETVEKMLLNPDKALKMMKHMEESTMTTDEPKRRFSTGEPKHRFKRFSHIFGGKDKLLTPVRKDEVNDEEKQIRHSFSSFFDSKSSLFSKKPPKPGNLYPGEQPLSLERLDSYLDKVQFHPI

SEQ ID NO: 157728 - protein, 357 aa, Glycine max
  Coding DNA Sequence Number=SeqID_40950
  Gene Ontology: Mol. function=tetrahydrofolylpolyglutamate synthase activity; Cellular component=extracellular space; Biological process= folic acid and derivative biosynthetic process
  Homolog annotation: Hit_ID=Q8W038; Match level="QueryCoverage=75%, HitCoverage=33%, E-value=2e-57, Identity=47%"; Hit description =Dihydrofolate synthetase
MTLGCISTFNFFLDQICYWVINRKDNRRDKKREEAVLLTHLISDYNTVDAAIIEVGLGGKEDSTNVIKEPTVCGITSLGMDHTEILGDTIGQIASHKAGIFKYFMCLCAPSPPSFFAFSSEKWMPSLFLKPKVPAFTVPQPPEAMDVILERAKELMPNARCSHLVQSGEGMAIEQNGESGVAFALLVCTLTKDNVPLEVTEPFDCKQIKGLELGLSGDHQFYNAALAVSLSRCWLQRTGNWGEKYQNDSNLPHEFIRGLSTAYFSGRAQIVYDSYPNSDGSEIFSKNYGGELIFYLDGAHSPESMEACAKWFSNAVRRYEILPHLSFKVENAEESSENGHLLHESKTLGQFEKSFRQ

SEQ ID NO: 157729 - protein, 166 aa, Glycine max
  Coding DNA Sequence Number=SeqID_40951
  Gene Ontology: Mol. function=tetrahydrofolylpolyglutamate synthase activity; Cellular component=mitochondrion; Biological process=folic acid and derivative biosynthetic process
  Homolog annotation: Hit_ID=Q8W038; Match level="QueryCoverage=89%, HitCoverage=24%, E-value=2e-32, Identity=50%"; Hit description =Dihydrofolate synthetase
  Subcellular localization annotation: CTP_CleavageSite=66; ConfidenceScore=5.01e-01
MVGVSHFTWWHMKSTIKTKWAYSCLPAFTCIHNFTGQRFIYKTSSEVHFERESNSVTNGQLQNFPTSSYETAMEKISSLITCQRRGEKPPIANKLEVMSLYLKILGLEEDINRLNIIHVAGTKGKGSTCIFCEAILRECGFRTGVFTSPHLIDVRERFRIDGLVIE

SEQ ID NO: 157730 - protein, 106 aa, Glycine max
  Coding DNA Sequence Number=SeqID_40952
MALNSWNFNLLGEHLALKSVASVDNSSVMEPRQKECIGAVMVIQVIRSQPLSPPPPDLSLHTVASGVSQLIPTDGHQRFMFCKTDDMLIEKMWKKIAASPVEIQIN

SEQ ID NO: 157731 - protein, 179 aa, Glycine max
  Coding DNA Sequence Number=SeqID_40953
  Gene Ontology: Mol. function=translation release factor activity, codon specific; Cellular component=cytoplasm; Biological process =translational termination
  Homolog annotation: Hit_ID=Q1SS34; Match level="QueryCoverage=93%, HitCoverage=42%, E-value=6e-68, Identity=78%"; Hit description=Class I peptide chain release factor; PCRF
  Pfam annotation: Domain name=RF-1; Domain location=75-177; Score= -20.4; E_value=0.0025; Accession=PF00472.11; Description=Peptidyl -tRNA hydrolase domain
MYLRWAKRQGYEGRIVDKCLYKNGGINSAIIEFEFECAYGYLSGEKGVHYLIRGSPNESSQLEASSATVDVIPMFLESACDLEIDSEDLIISSPLIHGKNKRQTDHTVCIQHIPTGISVQSYGERSHFANKMKALNRLKAKLLVTTKEQGVASIKSIQKKTLSIYGKKKFGGMSLIRTS

SEQ ID NO: 157732 - protein, 384 aa, Glycine max
  Coding DNA Sequence Number=SeqID_40954
  Homolog annotation: Hit_ID=Q6D0Y0; Match level="QueryCoverage=54%, HitCoverage=97%, E-value=1e-74, Identity=65%"; Hit description =Putative membrane protein
  Pfam annotation: Domain name=AsnC_trans_reg; Domain location=47-114; Score=22.8; E_value=0.00092; Accession=PF01037.11; Description=AsnC family
  Pfam annotation: Domain name=DUF161; Domain location=197-278; Score =79.4; E_value=1.1e-20; Accession=PF02588.6; Description =Uncharacterized BCR, YitT family COG1284
  Pfam annotation: Domain name=DUF161; Domain location=292-373; Score =60.4; E_value=5.8e-15; Accession=PF02588.6; Description =Uncharacterized BCR, YitT family COG1284
  Pfam module annotation: Pfam domain module=AsnC_trans_reg::DUF161::DUF 161; Domain location=47-114::197-278::292-373
MTQVDDYDLKILTLLQSNGRLTNQELSDLVGLSASQCSRRRINLEQANLILGYHARLSPDAEAAIVDAFKTTGDADYLLKVAVADLAALSALISQLVAGHQSVAHVKTSVICAVFRAKRAPETEFVHESIILQQIDAHKPAIKRLSYQLDNRWHPSAATGSRRCGAFFANERHHLQRDRTMDNAVQPSRIPHTRTEDALAIVLGTLMVSFGVILLKQAGALTGGTAGVAFLISYLSPLSFGSAFFLINLPFYWLAIRRMGWEFTLKTFCAVGLVSLFTHLHPLFIHFSALNPFYATLFGNVVMGIGFIVLFRHKASLGGINILALWLQDRSGLRAGKLQMALDTCVVLASLFVVSLPMLLASIAGAVMLNLIIAMNHRPGRYFV

SEQ ID NO: 157733 - protein, 54 aa, Glycine max
  Coding DNA Sequence Number=SeqID_40955
MGNEGQSIADTQDSAIVIQWVATNNSDNGFSSKSCMEQGAEQYLLSLFLNPNRT

SEQ ID NO: 157734 - protein, 95 aa, Glycine max
  Coding DNA Sequence Number=SeqID_40956
MPDGLIEAVPSWSSLLENRSIGVNISTTVKSEAVFCHVIMFKAWFCHIETKLVLVSVLEHLAMKKKNNNDELSIRLGEKFGGRHQTLVDTQAPYK

SEQ ID NO: 157735 - protein, 80 aa, Glycine max
  Coding DNA Sequence Number=SeqID_40957
VGGKIEKENTSLCPITREKERKQKGNTIDGEMDKARKRFSTEYPSINQVKYENQVLLHCVPDSYENGSQLKHHRKEIHEV

SEQ ID NO: 157736 - protein, 62 aa, Glycine max
  Coding DNA Sequence Number=SeqID_40958
MAAGLRQRTPFHKTSVLNLFLALSISPSMVLPCDVLFWLTAGSCDWITASCWRCIKALEKMI

SEQ ID NO: 157737 - protein, 193 aa, Glycine max
  Coding DNA Sequence Number=SeqID_40959
  Homolog annotation: Hit_ID=Q1SWQ8; Match level="QueryCoverage=44%, HitCoverage=32%, E-value=3e-08, Identity=42%"; Hit description =Nucleic acid-binding, OB-fold; TonB box, N-terminal
MFNFTMFDDIVSGSISTDFLIDVISEVVEIGQWNLHGKPKKVVFTMKDGCESIMSCTLWESLALKFKDCFDRHVSGSVVLLLNLAKIKEGNGCCFIEAKLGLLNHGSVFKAQILTHEFPLHFKTSCASSINSGKTMDNVPKIKTESGLKDENHLPHVARQSHAPPMLLQTPFNQTTNTCTTSAPGKIVVTYTL

SEQ ID NO: 157738 - protein, 301 aa, Glycine max
  Coding DNA Sequence Number=SeqID_40960
  Gene Ontology: Mol. function=hydrolase activity, acting on ester bonds; Cellular component=cellulose and pectin-containing cell wall; Biological process=lipid metabolic process
  Homolog annotation: Hit_ID=Q9AYM7; Match level="QueryCoverage=76%, HitCoverage=99%, E-value=1e-115, Identity=85%"; Hit description =CPRD47 protein
  Pfam annotation: Domain name=Lipase_GDSL; Domain location=2-282; Score=127.0; E_value=5.4e-35; Accession=PF00657.12; Description=GDSL- like LipaseAcylhydrolase
  Subcellular localization annotation: CTP_CleavageSite=52; ConfidenceScore=5.34e-01
MVDGMAPKRHKTVINMGVRTEKLGLPTSPPYLSLVSNVHNNSNNVSFLRGVNFASGGAGIFNVSDNGFRQSIPLPKQVDYYSLVHEQLAQQIGASSLGKHLSKSIFIVVIGGNDIFGYFDSKDLQKKNTPQQYVDSMASTLKVLLQRLYNNGAKKFEIAGVGAIGCCPAYRVKNKTECVSEANDLSVKYNEALQSMLKEWQLENRDIGYSYFDTYAAIQDLVHNPTSYGFANVKAACCGFGELNAQIPCLPISSMCSNRKDHIFWDAFHPTEAAARIFVDEIFNGPSKYISPINMEQLLAI

SEQ ID NO: 157739 - protein, 75 aa, Glycine max
  Coding DNA Sequence Number=SeqID_40961
MKKIQGLQAPHGATSALAQNKILQKSMSQCHILLEHCVPAASSIRLSKIIHLIICSHKHKARDHHKIQTQTTHRE

SEQ ID NO: 157740 - protein, 164 aa, Glycine max
  Coding DNA Sequence Number=SeqID_40962
MSLGCSRCSWHHFLNTNDIDTRKIFMLKTLSSLVMVEDMNEELEEMLKVSFENLSATDFALQLRSLLCGFLKFSVMLIGGTWCTTTTTVDAKILRFGGKRKLELSKCYVKIRNISGFRRDTERGIYMKEWGELGALTGCNNSFHEQLVYGQEGCAARSLPLNGR

SEQ ID NO: 157741 - protein, 191 aa, Glycine max
  Coding DNA Sequence Number=SeqID_40963
  Gene Ontology: Mol. function=acyltransferase activity; Cellular component=endoplasmic reticulum; Biological process=metabolic process
  Homolog annotation: Hit_ID=Q1SHX4; Match level="QueryCoverage=67%, HitCoverage=29%, E-value=2e-48, Identity=76%"; Hit description =Phospholipid/glycerol acyltransferase
MWFSEYLFLERSWAKDESTLKSGIQQLSDFPLPFWLALFVEGTRFTQAKLLAAQEYATSTGLSVPRNVLIPRTKIMANKMEDRIRIMVLLAQVSHMRSFVPAIYDITVAIPKSSPAPTMLRLFKGQPSVGIPICPHKRGRALASVSAFRCNPVEDWTSSPAAGVVVEMMYPVCPEELEPGLAPDTPIFSMA

SEQ ID NO: 157742 - protein, 202 aa, Glycine max
  Coding DNA Sequence Number=SeqID_40964
MDNGCMIDTPTSTHFMGVTFNILALNLVNRLPIISFTLWKNLYTTALNGYVKFAPPLPQPPAPEYHPMDDVIYVLNSPARGDPPTNDAFSEPPPFVIDHPMDDAFDHVHDVDDIPIPDEDCIHALVVQYHMPLDLLPLDKSPPFYVLGMADEFLTSSSSSPPYIIDHREKGGDVPDGHMHDMDDVDLDDLEGTETDHGEDSF

SEQ ID NO: 157743 - protein, 91 aa, Glycine max
  Coding DNA Sequence Number=SeqID_40965
MRFTLEEFEKEPSNGTLKTLPKLAALSTSLLAWLEPKYTRGHILESEGIVDAKKALLELTYVRNRQDKAVSWDTVDVQASEEHGVGCPKSV

SEQ ID NO: 157744 - protein, 892 aa, Glycine max
  Coding DNA Sequence Number=SeqID_40966
  Homolog annotation: Hit_ID=Q1STQ3; Match level="QueryCoverage=8%, HitCoverage=47%, E-value=1e-14, Identity=52%"; Hit description =Bromodomain
  Pfam annotation: Domain name=Bromodomain; Domain location=170-241; Score=21.0; E_value=2.4e-05; Accession=PF00439.15; Description =Bromodomain
MVQIARRKKGRPSKADLARRSGESQSDPRRSLRRRSVRYNIIDYDGDYLDDDEEDERRREKKKLKLMAKLNQDGGEEEEEEEREEEEENETATNHTRAESREEHAPVEEYDDEKEQEEENENEQEEENEEDEDSVVKGRKVESKGLHSVSVNVSVSGAPVILQSGIPLPDKRTLELILDKLQKKDTYGVFADPVDLEELPDYLDVIEHPMDFATVRKKLGNGSYTTLEQFEARSIQELGRKKFEKLRIGFERSQIELKSEEKAGSNYLVKKQPKKPLARASQEPVGSDFSSGATLATIADVQPTSHLMQGGSRCERSGNIDGILEANAFWIDANQERADDVLSGKGLLSKWGRKSSVLDESRRASYNMSNQPIVRSDSIFMTFESKMKHLVGLDAEYSYARSLARFGASLGPIAWKIASHRIQNALPAGCKFGRGWVGEYEPLPTPILMVNNRVQKETSLDMKLHSTTELPKGNQNCKNVESSIEHPVNGQMLEGKHPSMPDFEGKPFFGSAGVRLSAPFNIRNQEQNAQSRMLGKSEKNGLKQVELNSLPSSNQNNNGLVAKFTSHAPAANSLAAESKPREMVPRNMFKQPDTNGVVGGESANGKVRNTSLNRQVTGSSPESTLHQSSRAAPAVVHGQEQGLGDPVQLMRMFAERAQKQHTSSNHLLVDIPPVTLSGPSGQRNDSGNASAAAAHAWMSVGAGGFKQGPGNSSSPKNQISADSLYNSTRELHQHISRIRGEFPSGGMPFQPFQAVAPQPIHTGAVSQFPNRPMVFPQLASADQSRFQMQSPWRGISPHSQSRQKQETLPPDLNIDFESPGSPLSVGFRSFSPVFLLIRQKHAITVSQLDPEDSGQQQKLFENDKTMKVSSSKGAVRATRFLKLSDAPITYCS

SEQ ID NO: 157745 - protein, 105 aa, Glycine max
  Coding DNA Sequence Number=SeqID_40967
  Subcellular localization annotation: CTP_CleavageSite=42; ConfidenceScore=5.25e-01
MFSNLRSQDVPQVTQTPPIQGSVVWKPPRVGLFKLNFDASVRQGTGTGMGMIVRDHQGQVLVAATYLSDVVMEIREVEATTFRWAIIKAVLDKLGSIAIEPNHIY

SEQ ID NO: 157746 - protein, 857 aa, Glycine max
  Coding DNA Sequence Number=SeqID_40968
  Homolog annotation: Hit_ID=UPI00004BF617; Match level="QueryCoverage =22%, HitCoverage=29%, E-value=8e-18, Identity=32%"; Hit description =bromodomain containing 9 isoform 1
  Pfam annotation: Domain name=Bromodomain; Domain location=163-251; Score=94.5; E_value=3.2e-25; Accession=PF00439.15; Description =Bromodomain
MVQIARRRKKGRPSKADLARRSGQSPAAASQPDSRRSLRRRSVRYNIIDYDGDYLSDEEDERRREKKKLKLMAKLNQDGEEEEEREEEEEIETTPSRTRAEPVEEYDDDEKEQEEENENEQEEENEEDKDSVVKGRKVESKGLHSFPVSGAPVILQSGIPLPDKRTLELILDKLQKKDTYGVFADPVDPEELPDYHDVIKHPMDFATVRKKLGNESSYTTLEQFESDVFLICSNAMQYNAPETIYHKQARSIQELGRKKFEKLRIGFERSQIELKSEQKAGSNYLVKKQPKKPLACASQEPVGSDFSSGATLATIADVQPTSHLMQSGRCERTGNIGGILEANAFWIDANQEKAEDVLSGKVLLSKWGRKSFVLDESRRASYNMSNLPIARSDSIFMTFESGMKHLVTVGLHAEYSYARSVARFSASLGPIAWKIASHRIHQALPAGCEFGRGWVGEYEALPTPVLMVNNCVQKETSLVMKLHSATELPKADQNCKNVESSIEHPVNRQMLEGKHPSMPDSEGKPFFGSAGVRLSAPVNILNEEQNAQSRKLGNSESKGSKQLELNSLPSSNQNNKGLVAKFTSNAPAANSLAAESKPREMASRNMFKQPDTNGVVNGELANVKVTNTSLNRQVTGSSPESTSNQSSRAAPSVVHGQGASDPVQLMRLLAERAHKQHTSSNDLLVDTPPVTLSGPSGQRDDSGNASAAAAEAWMSAGAGGFKQGPRNSSSPKNQISADSLYNSTREFRQHISRIRGEFPPGGMPFQPFLAVAAQPIHTGAVSLFPNQPMVPQLASFDQSRFQIQSPWRGLSPCSLSRQREEALPPDLNIGFQSPGSPAKQTSGVPVDSQQPDLALQL

SEQ ID NO: 157747 - protein, 93 aa, Glycine max
  Coding DNA Sequence Number=SeqID_40969
MMLSLTSGETVRELMLVGAAHARACAGVRVVLALEFGSSCAACCSFHFDSKTGFGVGSASSAITVILSPPLSLWQPPWHLHLKPAHHTVMALP

SEQ ID NO: 157748 - protein, 114 aa, Glycine max
  Coding DNA Sequence Number=SeqID_40970
MFRPLVSVAKTLFSSSGCRHDEVPEAQDFRQGEKITPLGCCPWSAFTIRQVNRRLARRSKKIVKAQGIHHEGKCSSGSYQFKGKTGGGSSSSVMKHLSLCNFFYIMGGFYNKLA

SEQ ID NO: 157749 - protein, 115 aa, Glycine max
  Coding DNA Sequence Number=SeqID_40971
MVFKNQHAHTKKAIAGAGGALDINFELKNSKAPRSPLPPGNKANLLFSRHRQRRTKKMEKCSQISDGGSQNLTNETSNLSSDWPRNCNSFDMQPVGNYGDPCLILSHGGSKTMIV

SEQ ID NO: 157750 - protein, 102 aa, Glycine max
  Coding DNA Sequence Number=SeqID_40972
MYIVACCLRLLLCGDGGNISSSNDSRNTGGGHGDSDSGGHDINGGGSDNVVVTVNDGGGGDSSDRSSISGGGDNNVDDVGDNSDSSGGGGGGGDGGVGGGTK

SEQ ID NO: 157751 - protein, 116 aa, Glycine max
  Coding DNA Sequence Number=SeqID_40973
MKLSPVQLRVLVLNITDSTGKGKSWELGGLEREKKAVMVIAENEIGEDQKEIGAPKSPWKTPTVDGKGGDVSVMMGTESWPRLSDAQRPPKNLETAAAAASVTSAGEIAPRPPSMQ

SEQ ID NO: 157752 - protein, 396 aa, Glycine max
  Coding DNA Sequence Number=SeqID_40974
  Gene Ontology: Mol. function=aminoacyl-tRNA ligase activity; Cellular component=chloroplast envelope; Biological process=translation
  Homolog annotation: Hit_ID=Q5JL23; Match level="QueryCoverage=95%, HitCoverage=97%, E-value=1e-102, Identity=51%"; Hit description=ABC -type transport system-like
  Pfam annotation: Domain name=MCE; Domain location=129-219; Score =61.7; E_value=2.5e-15; Accession=PF02470.10; Description=mce related protein
  Subcellular localization annotation: CTP_CleavageSite=45; ConfidenceScore=5.52e-01
MVGNPALHVSSLPTYFFSSLIILPRNPSSSIPLPIRRQTQINRIRVTSADSGHGQRPSSSSSEAKKPLSALSNIPWAIWRQTLRPLSDFGFNGRSIWEGGVGLFLVSGTVLFVLSLTWLRGFQIRSKFRKYTVVLEFAEACGISKGTPVRIRGATVGNVIGVNPSLKSIEAVVEEKLNSVYLLFSSPVGDDKTVIPRNSLIKVNQSGLLMETKIEITPREPIPTPSVGPLHQDCTKEGLIVCDREKINGDQGTSLDTLIGIYIRLGRDIEKIGIINSYTMAQRVFSIIEEAKPLLTQIKAMAEDVQPLLAEVRDCGVLKEVENLTQNLIQASDDLRRVHSSVMTPENTELFQKSINTISFTLKNFENISKDIVGFTGDETTKRSLKLLLQNLSRHL

SEQ ID NO: 157753 - protein, 78 aa, Glycine max
  Coding DNA Sequence Number=SeqID_40975
  Gene Ontology: Mol. function=sequence-specific DNA binding; Cellular component=nucleus; Biological process=regulation of transcription, DNA-dependent
  Homolog annotation: Hit_ID=O81788; Match level="QueryCoverage=53%, HitCoverage=15%, E-value=6e-14, Identity=85%"; Hit description =WUSCHEL-related homeobox 13
MYVKVMTDEQLETLRKQIAVYGTICEQLIEMHRTLSAQQDLAVPFISTKSSKAQLAEQQDAVIINSFISVFDFYHFYG

SEQ ID NO: 157754 - protein, 167 aa, Glycine max
  Coding DNA Sequence Number=SeqID_40976
  Gene Ontology: Mol. function=carbohydrate transporter activity; Cellular component=integral to membrane; Biological process =carbohydrate transport
  Homolog annotation: Hit_ID=Q9S3J9; Match level="QueryCoverage=86%, HitCoverage=36%, E-value=5e-44, Identity=63%"; Hit description=Sugar efflux transporter B
ENATRDAAAASRIGGLTAGVLLQPFAAVEAQQAPAEGDQCQRRGDEADVAHAQMQAYLVAQQRAAADAEVVQAGEDRHRHVGGVRRQAQHFGLHRQADGHDRHAPEDAQHRQVAFTAGGRQQQQQAQGQQRDGADKEAGRKTLAVAAEQQAADDAGGAEQQQHQRGE

SEQ ID NO: 157755 - protein, 57 aa, Glycine max
  Coding DNA Sequence Number=SeqID_40977
MWLRTLRRSASVPSQRPCSRRVMRDRAREQPVAGGPALQAVVERKQGRGHERFPVGG

SEQ ID NO: 157756 - protein, 118 aa, Glycine max
  Coding DNA Sequence Number=SeqID_40978
  Gene Ontology: Mol. function=oxidoreductase activity, acting on the CH-CH group of donors; Biological process=electron transport
  Homolog annotation: Hit_ID=Q8P6U5; Match level="QueryCoverage=99%, HitCoverage=14%, E-value=2e-38, Identity=69%"; Hit description=Acyl -CoA dehydrogenase
  Pfam annotation: Domain name=DUF1974; Domain location=1-95; Score= -138.4; E_value=3.6e-07; Accession=PF09317.1; Description=Domain of unknown function (DUF1974)
MAPNEARDRLASGVFLTPCENNPGGRINSYLSKAIMAEPVERKFLKALKSKGIEALDFKSQLDEAVAEGVITQDERSLLEELRTLTLDTITVDDFDTHELRAASYYDRQQKDPHSQAA

SEQ ID NO: 157757 - protein, 52 aa, Glycine max
  Coding DNA Sequence Number=SeqID_40979
MACTSFPRTNVVQTGRGHDCDMKAYYKSMLANTCQQIKCKQTSPYFRKENTE

SEQ ID NO: 157758 - protein, 185 aa, Glycine max
  Coding DNA Sequence Number=SeqID_40980
  Homolog annotation: Hit_ID=Q1SEP8; Match level="QueryCoverage=43%, HitCoverage=14%, E-value=1e-12, Identity=41%"; Hit description =Pectinesterase; Pectinesterase inhibitor
MDYDVHALPFDLILIGCIFKGINKKSLTLKLGFWKHKLQQQWRRIENQGVVICVVAVVQSPKGMNNNNNGGELKTSNRAMIALCQGSNHQKLCHEVLSSLNSTNPMEYIATVVRTSMDSMIKAFSMSDRLTKKVQEQLQSRSLDNVGSLDNLVATSEGFGAEAVEGVAATTTPTIDESKFNFAPA

SEQ ID NO: 157759 - protein, 234 aa, Glycine max
  Coding DNA Sequence Number=SeqID_40981
MERWEESTKYKSNRVTWKMSFLAGRLAGKEAAYFFQESKQAVGKLAQKNPLPKTNNNNLNFHEGYDHADVLPEVLRHSLPSKVFRNDEATSFSFSASKWVLHSDPKTQSSVSPDALNPLRAYLSLPQVTFGPKRWQLPEAANTVSASTANESRQDRYATHVNPEKLKAAGEGLAHVGKAFAVATAFVFGGAALVFGMVASKLELQNAENMSRKWHVERDDVKQKTIIKELSKIW

SEQ ID NO: 157760 - protein, 101 aa, Glycine max
  Coding DNA Sequence Number=SeqID_40982
  Gene Ontology: Mol. function=oxidoreductase activity; Biological process=electron transport
  Homolog annotation: Hit_ID=Q7EYS3; Match level="QueryCoverage=96%, HitCoverage=22%, E-value=8e-24, Identity=45%"; Hit description =Glycine/D-amino acid oxidases-like
  Subcellular localization annotation: CTP_CleavageSite=30; ConfidenceScore=5.03e-01
VLKLSGDKILSSRLIIDAMGNFSPVVKQIRGGRKPDGVCLVVGTCARGFETNSTSDVIFSSSSIKKVGDSKAQLFWEGVSLDNLEILRVIYGIFPTYRQRY

SEQ ID NO: 157761 - protein, 43 aa, Glycine max
  Coding DNA Sequence Number=SeqID_40983
MADVTCGPCNNAWPYPLLLQATPSLHMPRCTRHLQYLKVVGCR

SEQ ID NO: 157762 - protein, 204 aa, Glycine max
  Coding DNA Sequence Number=SeqID_40984
  Gene Ontology: Mol. function=pyruvate kinase activity; Biological process=glycolysis
  Homolog annotation: Hit_ID=Q1S6A6; Match level="QueryCoverage=50%, HitCoverage=17%, E-value=6e-29, Identity=57%"; Hit description=FAR1
MGYMATQKGGLAGVGFNKKDLSNYIEHRMRSTIKDGDAMASLSYLPGKANNDQMFYAKYLISEDGKLMNLFWADVNSRIDYQCFRDMVVFDDMYKKNKYNKPMEHATRLYSEDIFNKVKVQIVNAGGLNMTHRTKALDKQQGNMHNGGGRAKDDVGDPYVSVGDNSYAMKFDDSERVDNGTTDSERADSGTTDKGRLGNGTTIV

SEQ ID NO: 157763 - protein, 191 aa, Glycine max
  Coding DNA Sequence Number=SeqID_40985
  Gene Ontology: Mol. function=oxidoreductase activity; Biological process=electron transport
  Homolog annotation: Hit_ID=Q7EYS3; Match level="QueryCoverage=59%, HitCoverage=18%, E-value=4e-19, Identity=47%"; Hit description =Glycine/D-amino acid oxidases-like
MEYLSSQWGLHSHTRNVAEDPSFRDHKLFPPEPRIMESVSVSGEVGGAGGAYSYEALKRLDQQWSSICSSQEVVQEPQQVVSTIPSLFGSSDLADKAEGSYDVLVCGGTLGIFIATALCARGLRVAIVERNVLKGRDQEWNISTKELLELVEVGVLEEDDIERATAVKFNPVIPELLLFSFQFIYSKNHLN

SEQ ID NO: 157764 - protein, 78 aa, Glycine max
  Coding DNA Sequence Number=SeqID_40986
MEKFGNGNIRIGDEELDFMLGGLDVHLHFVHLVGVVFFSEAWWSFMRCSLIIELALVSCHLDLFLYTLLSAQTLEAEL

SEQ ID NO: 157765 - protein, 175 aa, Glycine max
  Coding DNA Sequence Number=SeqID_40987
MWHYSSRNSLSVSVTLSCIGNSPHGNNHESQGSFESSDMPPITNIFPDEKPQATSPMVINMSLKEVSNRVIGPPINNIFPHEKPQGYPTSHCTPYVHTQHISITMTSSTSRIISSQYHHQHQYHLISMSSSTLKIISSQYHRHHKILHSSYIYIYTNSCLRFTFPKSLDNTNIIQ

SEQ ID NO: 157766 - protein, 168 aa, Glycine max
  Coding DNA Sequence Number=SeqID_40988
  Gene Ontology: Mol. function=heat shock protein binding; Cellular component=nucleus; Biological process=protein folding
  Homolog annotation: Hit_ID=Q1SHY3; Match level="QueryCoverage=92%, HitCoverage=56%, E-value=4e-74, Identity=87%"; Hit description=Heat shock protein DnaJ
MYKKVTEADIEEFEANYRGSDSEKNDLIDLYKKCKGNMNRLFCSMLCSDPKLDSHRFKDILDEAIASGELKAKKAYQKWAKEVSEIKPPTNPLRRREKSNKQSETDLCAIIAQRRNERKGQFDLMFSSLVSKYGGGDTPEPSEEEFEATRRKLETGRSSKNSKQSKRK

SEQ ID NO: 157767 - protein, 648 aa, Glycine max
  Coding DNA Sequence Number=SeqID_40989
  Gene Ontology: Mol. function=protein serine/threonine kinase activity; Cellular component=Hedgehog signaling complex; Biological process=protein amino acid phosphorylation
  Homolog annotation: Hit_ID=Q1SHY2; Match level="QueryCoverage=37%, HitCoverage=100%, E-value=1e-131, Identity=94%"; Hit description =Protein kinase
  Pfam annotation: Domain name=Pkinase; Domain location=16-270; Score =283.6; E_value=3.7e-82; Accession=PF00069.15; Description=Protein kinase domain
  Pfam annotation: Domain name=Pkinase_Tyr; Domain location=16-270; Score=62.0; E_value=2.8e-16; Accession=PF07714.7; Description =Protein tyrosine kinase
  Pfam module annotation: Pfam domain module=Pkinase::Pkinase_Tyr; Domain location=16-270::16-270
METENGDTRSKKMEEYEVIEQIGRGAFGSAFLVLHKSEKKRYVLKKIRLAKQTEKFKRTAHQEMNLIAKLNNPYIVDYKDAWVEKEDHICIITGYCEGGDMAENIKKARGSFFPEEKVCKWLTQLLIAVDYLHSNRVIHRDLKCSNIFLTKDNNIRLGDFGLAKRLNAEDLASSVVGTPNYMCPELLADIPYGYKSDMWSLGCCMFEIAAHQPAFRAPDMAGLINKINRSSISPLPIVYSSTLKQLIKSMLRKNPEHRPTAAELLRHPLLQPYVLRCHNASSNVLPVYPLVNPKDKARRPNKSSGGKDHKDKEAGLVNCLERIHPIEGNADIQISNLPNDVVTISTSAEDNLETRMANLTSYIVESSTSISGSKDGSTTSESTICSVCKEDFKSRPAREMTNNEISSKSTQDSLHEEQRFAAKHFHKLEDDDINAVTAEVEDASCNGGLDNAEAQREDSNLEDSGKSTMSSEGSSSTDKDKSINEERSSLIVHPIRVENDTESGNRLKKSENPDVYTEVPHMNCLMSVSNDALPVKDDDIANGHILCSTHKDDNVVEVDQAPSGISLSVITEVDGDETIKTPLDSPCQQRADALESLLELCAQLLKQDKLEELAGVLRPFGKEAVSSRETAIWLAKSLISSQKFNPET

SEQ ID NO: 157768 - protein, 54 aa, Glycine max
  Coding DNA Sequence Number=SeqID_40990
MAKLGDCAAHFFIAAMVLSTFYVTKTVAQSEIAPTSQMETGAGELQGILAPIHV

SEQ ID NO: 157769 - protein, 111 aa, Glycine max
  Coding DNA Sequence Number=SeqID_40991
MTLKVTFERRGIRGFLGVKRRGVGDWKVHSFVLSFCIPFFFASILMSSSTKEYRSPTKGRSLVAKEVKGIEESEDELSTSSPSSIFDSKGTKDFLVSGGEEVEICEETRKI

SEQ ID NO: 157770 - protein, 135 aa, Glycine max
  Coding DNA Sequence Number=SeqID_40992
  Gene Ontology: Mol. function=RNA-directed DNA polymerase activity; Biological process=RNA-dependent DNA replication
  Homolog annotation: Hit_ID=Q1SKJ4; Match level="QueryCoverage=80%, HitCoverage=16%, E-value=5e-10, Identity=32%"; Hit description=RNA -directed DNA polymerase
MSDSNTYPIYGNYAKDSMHTLRDCEELPKFSAYKINVDGSYKATSGIAACSGFIRDDNGDVTTWFHKKLLPCNAPLVELRGLKFGIHLAKDMNLHSVCVESDSLVVVNLVKGDLVTPPYLKSIIQSIKFDLRKMG

SEQ ID NO: 157771 - protein, 110 aa, Glycine max
  Coding DNA Sequence Number=SeqID_40993
  Gene Ontology: Mol. function=heat shock protein binding; Cellular component=integral to membrane; Biological process=protein folding
  Homolog annotation: Hit_ID=Q1SHY3; Match level="QueryCoverage=83%, HitCoverage=33%, E-value=4e-37, Identity=87%"; Hit description=Heat shock protein DnaJ
  Pfam annotation: Domain name=DnaJ; Domain location=23-86; Score =126.6; E_value=6.9e-35; Accession=PF00226.21; Description=DnaJ domain
MAQKKKARVSDDEEMEVQHDQTSLYQVLGVERTASQQEIKKAYYKLALRLHPDKNPGDDEEAKEKFQQLQKVISILGDEEKRALYDQTGCVDDALTLFSKTRLLLLLANQ

SEQ ID NO: 157772 - protein, 148 aa, Glycine max
  Coding DNA Sequence Number=SeqID_40994
MEMYVAISIRIRDLDVATCKACRPWIFFINGLLCFLKINGSKLEKEESPLIQDQVQDSPLSVLRRHEACALKYKGQHQVNSEEALVRHQKYEPHLRNEKLNDGASNCKGSGADVTLEGTDNVSIKQSIKFNWKASNNQAEYESLIASD

SEQ ID NO: 157773 - protein, 87 aa, Glycine max
  Coding DNA Sequence Number=SeqID_40995
MMRRNLTCPLVVGNCTRMFIPHMAKGQGDVMLWSALDDACVINLSGQPIVTGADDFGYNAQASGVHSSNSYVHFVQDVLHMVFIDPL

SEQ ID NO: 157774 - protein, 91 aa, Glycine max
  Coding DNA Sequence Number=SeqID_40996
MQKYYHLVKQLLEHFVHKELAHVDRGQKDQANALARLVSTKRPSQHQTFIQETSPPPPSMLSRSSQVGLLLADGCLLYGPTWSPTPCFRRQ

SEQ ID NO: 157775 - protein, 69 aa, Glycine max
  Coding DNA Sequence Number=SeqID_40997
MAQHRIGHNGVWVVHGGWQEVETGKEGHICPLCFLWGAGRKQIGAGSKIGVTSPKGPEIDVYHKKKTDV

SEQ ID NO: 157776 - protein, 94 aa, Glycine max
  Coding DNA Sequence Number=SeqID_40998
MKLKNLSPLFVENSKEPKWIVSQNNRDFWALGSIACKRWWESDSDSDFRVLPLGMCSLPSSFCASTVLLCFLLISFSLSLSNTTISVLLLLLYV

SEQ ID NO: 157777 - protein, 122 aa, Glycine max
  Coding DNA Sequence Number=SeqID_40999
MEAMKDQMTSMMEAMMSIRRMMEDNVAAIATTSAATEVDPTHLSVINQTSHPAPYMVGQGGEVLGSMGGPHMVQSKNSFPPYGLPPKYTPPNAVHVPSENANHSILVLFESQQPQLGHAPFA

SEQ ID NO: 157778 - protein, 70 aa, Glycine max
  Coding DNA Sequence Number=SeqID_41000
MEKTDPSLNKDEGIAQDADAPLREMEQELTFHLDPWSPTINGYLEAVVINKKRKKNEEDIVNSTKQHKKN

SEQ ID NO: 157779 - protein, 211 aa, Glycine max
  Coding DNA Sequence Number=SeqID_41001
LWAWERCPTLAPSVIPPQQQNAPLAYRWLGGELHHIGNDNLLEFRRKLDVMKRDEGEISETLHFMVSPAGRRVCTFDDLLPCIEKITLLYEEEDRILEAHQDAPPSQPQFEHQQFNILQRSVETRGLGRRRQTVDAAPYSLPPMPEREHGMYYTPPVFTQEPSQMAPMYSYPHDFQPGYSMTGIFGSSPPSGGTPSFTQNNELPTPNAPLG

SEQ ID NO: 157780 - protein, 111 aa, Glycine max
  Coding DNA Sequence Number=SeqID_41002
  Pfam annotation: Domain name=zf-CCHC; Domain location=70-87; Score =27.6; E_value=2.8e-05; Accession=PF00098.13; Description=Zinc knuckle
MELMRLKQHEENDKKKKGIALKASSSIQEEKDDDFSFFVKRFNKFLRNKGNQRRTNFNSKKRGEDSSSVPKCYECNQSGHLRVDCPSFKRRMEKSDRKTFKDKKAKKAYIT

SEQ ID NO: 157781 - protein, 92 aa, Glycine max
  Coding DNA Sequence Number=SeqID_41003
MPSQNESSFSIPAFICLDRLSPPAWAHTDRRYLQIAYSIAGELSGVGSVGVRALATIPCRRKISQSMLELCLSGLGRPFAKGRCYFYFLCDY

SEQ ID NO: 157782 - protein, 59 aa, Glycine max
  Coding DNA Sequence Number=SeqID_41004
MEYLLVGDEQKRKTESKNAKKDDPRAANSSIPWVWLLKGGKRRVARPGEPSSPRRAQLA

SEQ ID NO: 157783 - protein, 92 aa, Glycine max
  Coding DNA Sequence Number=SeqID_41005
MVMQSYPLRALDKRLQEDWARDARKGPRVMAIKAGHVELHVRAANRRGRWVKRRGNLTLGEAIDGLLQSVGGDLPSMVLRHIGGRSDHLLAN

SEQ ID NO: 157784 - protein, 151 aa, Glycine max
  Coding DNA Sequence Number=SeqID_41006
  Gene Ontology: Mol. function=RNA-directed DNA polymerase activity; Cellular component=chromatin; Biological process=RNA-dependent DNA replication
MADPNTSVSIVKEIEKFGVARTGAWVIKPRKPCNAVGVIGIGQANIASTLSGFGATSCAKMMWLRGEHNHIFPQKWLERIIHGCLRSRRGIIKAKGHDLKLIMSLVHLKSCLMNVPSFFLTRSIGEENRLWLGWIKPTASIAVTCFFTSIF

SEQ ID NO: 157785 - protein, 130 aa, Glycine max
  Coding DNA Sequence Number=SeqID_41007
  Gene Ontology: Mol. function=RNA-directed DNA polymerase activity; Biological process=RNA-dependent DNA replication
  Homolog annotation: Hit_ID=Q1SL34; Match level="QueryCoverage=90%, HitCoverage=21%, E-value=6e-14, Identity=34%"; Hit description =Endonuclease/exonuclease/phosphatase
MLDDSGLIDGGFQESTFTWRRDCNTQYFHGVTTIRRRKNTFEAIQDTNGNWVANSDELERLVTNFFATLFKDDTPRSDLCMNGVFPQFPTYKLDWFKEVISDEDIHKVVFSMGNFKALGKDGFQVVFYKS

SEQ ID NO: 157786 - protein, 80 aa, Glycine max
  Coding DNA Sequence Number=SeqID_41008
  Homolog annotation: Hit_ID=Q8H1G4; Match level="QueryCoverage=60%, HitCoverage=10%, E-value=5e-08, Identity=65%"; Hit description =Putative formamidase
MIVYLWPFLTYICKVYLLLSYIPCEAGIFGIVDAPNAVATLTIPTTIFDQLTPEAIDKNGVLVGDQTTQKFVELANHVEK

SEQ ID NO: 157787 - protein, 70 aa, Glycine max
  Coding DNA Sequence Number=SeqID_41009
MACGGHHWSWVVEEEFLGWFGGVLREGGMKIVFFMLKNIFIIYRSRLTSSSHSTMAHGGHRWSWWLRRSF

SEQ ID NO: 157788 - protein, 145 aa, Glycine max
  Coding DNA Sequence Number=SeqID_41010
  Gene Ontology: Mol. function=nucleic acid binding; Biological process= DNA integration
  Homolog annotation: Hit_ID=Q1S4N1; Match level="QueryCoverage=99%, HitCoverage=15%, E-value=4e-27, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKESETIKGYSNRLLNITNKVREQRRLMREESTVKGALAVKPQNVTKYKNFDGSGSSSKSTNAKGNWKKSYPPCQHYGKKGHPPFRRWKRLDAKFSECNQMGREAIIYKSKNQPHAEVARSIDQEEEKEYLFAATCFSSIESSQN

SEQ ID NO: 157789 - protein, 148 aa, Glycine max
  Coding DNA Sequence Number=SeqID_41011
MKVQPIAIDIDSKKVKDTGGNSSGGGGSERVSAKVALEKLGLLGENGAEFHGGAATGAMLVMEEDEDEETLLVRVVARGDEDGGGCHVHTDLDEEDEWVEAVGPGVDWGLDCEGGGGGEGGSGGDAVGGDDHREEQRWHGREEGEEDC

SEQ ID NO: 157790 - protein, 119 aa, Glycine max
  Coding DNA Sequence Number=SeqID_41012
MDRSCMKESHISDEYENGVKQFLQFTECKAPSLRGKFFYPCVKYGNRRLQLVNDIRSHIICDGIIPNYKKWIWQGELPDMPTVSHTELVDVDMGHRIEDMIHVLGQDDFQQAHATCTFV

SEQ ID NO: 157791 - protein, 71 aa, Glycine max
  Coding DNA Sequence Number=SeqID_41013
MSLYKLGYYSNLLNVIIKTTMQDLAKNVVATIVEAMPCHSTMALGKNSVMQGCKERQSREDQAETKKMQRC

SEQ ID NO: 157792 - protein, 36 aa, Glycine max
  Coding DNA Sequence Number=SeqID_41014
TDLKTNQLKNKERTKNGGKSSRNCSRKRLRRVTEAP

SEQ ID NO: 157793 - protein, 142 aa, Glycine max
  Coding DNA Sequence Number=SeqID_41015
MPPSLLGIGWSFTTIWMTIGSDRYIRVQRISISKLPTPKSIVLEPVKSSKVRLMKHNHIPHHLVEAKLHDESRLIQRCFDDNKGDDKKLKGQSKNEFKIESRTLQDSRGKLISRIKNEDSRIKLPRIKIKIQDSRFKNQEKT

SEQ ID NO: 157794 - protein, 63 aa, Glycine max
  Coding DNA Sequence Number=SeqID_41016
MAERINESTNVRLGFRGPSNLRGRRRSLLSVALEEAGGVAVDELSGAHVVSNDGGGEGIAIGE

SEQ ID NO: 157795 - protein, 95 aa, Glycine max
  Coding DNA Sequence Number=SeqID_41017
MVVSKVVVFLGLILAALMSVACSQSAAPAPAPAPTSDVFDPMDKKDTCNQCYENRFGHRLDQGTGLVGQRSNRLHPLSDDVIDGVLRHHAYSLTT

SEQ ID NO: 157796 - protein, 469 aa, Glycine max
  Coding DNA Sequence Number=SeqID_41018
  Gene Ontology: Mol. function=DNA binding; Biological process=DNA integration
  Homolog annotation: Hit_ID=Q1SS72; Match level="QueryCoverage=98%, HitCoverage=62%, E-value=1e-30, Identity=30%"; Hit description =Integrase, catalytic region
MSEEQDESLSVHSPYYLHPSENPAIALVFPLLDPTIYNSWSRSAFMALSAKNKLQLPFIKASYGWTTQLISGKIRKHDTHKLIITWDELESYQPDPVCTCVSKCSCDALVEVKKRKDQDRIMEFMCGLNDQYNHVRSNILMMDPLSLINKVFSYMAQQESYYGRDNHTAETCYRKNGLPPNFFSNRGGKGGGGRGGTGGKNSSGKVCTCYGIINHTVDECYKKHSYPPSHKFYKLQGVSVNNTVKEEENVSSSETSDNGHDIKITQQYQRMIGTVDVVEGLYKLRVLTANPVPKANNNFISIKSVLSCNKEVVDVWQFSTLTNNRKKLDPRASAFVFLGFKPHTKGYIIFDLSSRATMVFRHVIFHEDCYPYASSSASQSFPTFLGHSCPTIYDHGKELDFSSPPSHSTILDNSQSPNTSIDHSQLDSSDTSFDMSNSPIIVARRRSSKERTKPKKFQDFHTTFTSTIT

SEQ ID NO: 157797 - protein, 314 aa, Glycine max
  Coding DNA Sequence Number=SeqID_41019
  Gene Ontology: Mol. function=DNA binding; Cellular component=nucleus; Biological process=DNA integration
  Homolog annotation: Hit_ID=Q8XSC0; Match level="QueryCoverage=81%, HitCoverage=91%, E-value=2e-87, Identity=60%"; Hit description =Isrso16-transposase orfb protein
  Pfam annotation: Domain name=rve; Domain location=145-303; Score =140.1; E_value=6.2e-39; Accession=PF00665.16; Description=Integrase core domain
YATTGRGKSAAEEAGCRSEPRQGDAAGRAGKKELTLARLREWVRDLQVRYGASERQVCFALRVSRSSFRYRSVAADDSALRLRIREITETRVHYGYRRVHVMLRREGWRDNHKRIYRLYYEQGLSLRLKRPRRNKSAQRRQPQPQGLYSNHVWGMDFVSDALFDGRRLRLLTVIDLYTRECLGICVGQNLRSTEVVEMLNSIAIRRPLPQLLKTDNGSEFAGKMLDRWVHERGIRIDFSRPGTPTDNATVESFNGRLRQECLNENWFMSLEDARCKIEGWRIHYNQRRPHSALGWMTPSEFAEKSAGWQNMQPE

SEQ ID NO: 157798 - protein, 145 aa, Glycine max
  Coding DNA Sequence Number=SeqID_41020
  Homolog annotation: Hit_ID=Q9FK19; Match level="QueryCoverage=58%, HitCoverage=19%, E-value=1e-14, Identity=43%"; Hit description =Arabidopsis thaliana genomic DNA, chromosome 5, TAC clone:K19E1
MESYSQDVLDEDMDFGKILSKIQRSKTNMKWEFEAGMLAAFGKDPELCMKAVCALYRQQTSVEQLSKGALLSNQRGFNKFDAYNSKKLTHPMPEGSLLCEGMGEGHFVHSLTLAYAKRLFPDLNPYQPVIGAQLYLCARAYPLWH

SEQ ID NO: 157799 - protein, 87 aa, Glycine max
  Coding DNA Sequence Number=SeqID_41021
  Gene Ontology: Mol. function=DNA binding; Biological process =translation
  Homolog annotation: Hit_ID=UPI00005F807B; Match level="QueryCoverage =89%, HitCoverage=88%, E-value=6e-22, Identity=67%"; Hit description =COG3311: Predicted transcriptional regulator
  Pfam annotation: Domain name=Phage_AlpA; Domain location=24-74; Score= 100.0; E_value=6.9e-27; Accession=PF05930.2; Description=Prophage CP4- 57 regulatory protein (AlpA)
  Subcellular localization annotation: CTP_CleavageSite=3; ConfidenceScore=5.00e-01
MFSVSRPVNTTPSPAVHSDYTPRERFIRLPEVLYTTGLSRSTVYEMMTRKQFPVQISLGGKNVAWLASEVEQWMDERIANRHQGTTA

SEQ ID NO: 157800 - protein, 227 aa, Glycine max
  Coding DNA Sequence Number=SeqID_41022
MGEEKEMLDPNVVGRSMPQCCRCNELEERCKKAEVRCEELGFELQKKKEHCEELGAKVMALEGEKFEFEDKVKVLSKGLERLIEVSGGEIKPIVDLAEDNDKVLQCEKIRAESEVEVWKVKYKKLESWAVQFGMGRDDDEENGKEQESKPISNEGNLHLDTSFGFWQNLEKVAALGNKKIRDIQSVGTPSDGIFHRSHILDVLPSRKTKQLTFQTEESHSKKWLRLL

SEQ ID NO: 157801 - protein, 46 aa, Glycine max
  Coding DNA Sequence Number=SeqID_41023
STWTTGLSAPGGLVAKDCTRVGLHVCFNIDKDADATAGGGERGGGE

SEQ ID NO: 157802 - protein, 74 aa, Glycine max
  Coding DNA Sequence Number=SeqID_41024
MKKSLHQLLNKNLQLRVLAFHGKEAPFTLKKRNQEKLFAYKGVGMSPPPLGISQQQQQRLIPLGGVGYMDQLPP

SEQ ID NO: 157803 - protein, 47 aa, Glycine max
  Coding DNA Sequence Number=SeqID_41025
MAEDLGAIAEDLERVINLRMVTEGTDLYDIMTRCLRRARGKEKRLSY

SEQ ID NO: 157804 - protein, 453 aa, Glycine max
  Coding DNA Sequence Number=SeqID_41026
  Homolog annotation: Hit_ID=Q1XRY8; Match level="QueryCoverage=44%, HitCoverage=59%, E-value=3e-29, Identity=37%"; Hit description =Hypothetical protein precursor
  Pfam annotation: Domain name=SGL; Domain location=232-441; Score= -100.8; E_value=0.0062; Accession=PF08450.2; Description=SMP -30GluconolaconaseLRE-like region
MSHSADQQIADTANTPYEQLDFVAVALYGDAVQLKPLTKKHAAQVDGAHRGAVRRCAVGEGLSAADSAELMADLVLIEGVGAELVLAAVERESADGEERQQQPFAAADRTVAAEGLGGQFGVHGEGDGAAVAASLEWHGDDPVAGGEIAMLEHYYPANMGAKPVTDEQHKRLVAVQAALELIKATLSDTNDGNGVDFQLKAAEKHIGPMADAIQEALNGVMQAQAAQRIDFSPDAAGAYPEGIAWNARAGAFLVSSLRGGQLGLVYPDGRYRRFSTGSGLITTSGMLVDAERNRVLVCNEDVGVSLNSASGTRNRVAQVLEFNLDTGALQQTYDLSSLSRGPTLANDLALDVQGNIYVTDSFQPQIYKIDRATRQVSILVRSARLIPADAPAAAQGTQPYLNGIVYHPDGYLIAADYTRGLLWKVTLDNAPAISEIRLPQRLKGRTGCGSKRP

SEQ ID NO: 157805 - protein, 101 aa, Glycine max
  Coding DNA Sequence Number=SeqID_41027
MVNDIFTLSRHMENIVQPKPSAGLKGKPHQHALTHHAFLYFNKQKLGPPRPKSCFGIYPNSRKLSASKKWHFTEHLVGALLGTNNKGMGTMWLAPSSQNTT

SEQ ID NO: 157806 - protein, 58 aa, Glycine max
  Coding DNA Sequence Number=SeqID_41028
MSRNFTDCLTMGVKFLEAVKRRLHAIKQWSPDDIREPIGKIKKTVFSPHRGRRTHEQR

SEQ ID NO: 157807 - protein, 72 aa, Glycine max
  Coding DNA Sequence Number=SeqID_41029
TVGERWRQFKSDLTRKWALVADQDGAEDTVCEKYDISKEKWAQFCQSRRDPSWEDVRKKAQAIQKQNTPDNC

SEQ ID NO: 157808 - protein, 102 aa, Glycine max
  Coding DNA Sequence Number=SeqID_41030
MKRRKRDFIGKKEVLGCLPLVFAPGRPPLPPCPTSPVNLSRHATCQCCVARDRMLGMESRVSLLAAVERESTETRDGKVDHGDACCWSLSRMEPRMSNNMKK

SEQ ID NO: 157809 - protein, 127 aa, Glycine max
  Coding DNA Sequence Number=SeqID_41031
  Homolog annotation: Hit_ID=Q7XCW8; Match level="QueryCoverage=30%, HitCoverage=3%, E-value=3e-07, Identity=66%"; Hit description =Kinesin heavy chain, putative, expressed
MALYLFNLYLSLGLGLNGASMIHVARRYLDVDDYFKDAVFGISMEGTFVEGIKEEVVLSPAHALSLIAVGEDHVREHIPVISSMLCAMHFYTDMCKRGTYIGCNKLSYVARSVKSIEINLETETGFM

SEQ ID NO: 157810 - protein, 111 aa, Glycine max
  Coding DNA Sequence Number=SeqID_41032
MKINWVNIVMENMLKTKQIGTFQCPCVVLISRILDHFKVDVTNEIENFVELEYELKIKVLKQMRYIEVDDGSGWIEKLKDTPIEDTEEKPMTLLEMMMMMMAKMDKLLMIH

SEQ ID NO: 157811 - protein, 106 aa, Glycine max
  Coding DNA Sequence Number=SeqID_41033
MEEHYGDVYQFNYLKKDSIQPKFMNLAWLKVQHFVFPKVLEYHGLQKLVGKFITMSHDLWKEIDGLSDEGMITNEKGLQDVGVKFNKLATYKIMMKNPKEAPKGKT

SEQ ID NO: 157812 - protein, 47 aa, Glycine max
  Coding DNA Sequence Number=SeqID_41034
  Homolog annotation: Hit_ID=Q1T6I7; Match level="QueryCoverage=81%, HitCoverage=14%, E-value=1e-07, Identity=74%"; Hit description=No apical meristem (NAM) protein
MKKTLVFCGGGAPKGNMTIRVMHEYDLTLKELGGTNPGQVSNSTKDS

SEQ ID NO: 157813 - protein, 152 aa, Glycine max
  Coding DNA Sequence Number=SeqID_41035
MGDHLEDMIRDLGQESFQQAHAPMYEVLQSDSKKPFYTGCKNSLTLSSAVLSLLNVKARPNTPISLGLIAWCVCANFAGKCIKPYLIEQAFSSLFGLTKYTMVKANANKKHNPPTCYIYLITCIQIHLYLAIYLINCQVVYVIIVLDQFVSN

SEQ ID NO: 157814 - protein, 56 aa, Glycine max
  Coding DNA Sequence Number=SeqID_41036
MTLRLAPPSCLARRAALILMPAIFFCRAKRPEVALSGGCALSPTDEISSTVTFSTS

SEQ ID NO: 157815 - protein, 152 aa, Glycine max
  Coding DNA Sequence Number=SeqID_41037
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=43%, HitCoverage=10%, E-value=2e-15, Identity=59%"; Hit description=E3 ubiquitin ligase PUB14
MTPSSNTYAYRMLLLHTGCCCCCPLHTGQQTLVIRIGSPRNRENVAAVLWSLCTRDPLQLKLAKEHGAEAALQELSENGTNRAKIKVGSILELLQRMEGGPAIKSAATAEPGSQKGKKLEGGRWGEVKILGGPLDTKCYTINGQITKAVPNF

SEQ ID NO: 157816 - protein, 50 aa, Glycine max
  Coding DNA Sequence Number=SeqID_41038
  Subcellular localization annotation: CTP_CleavageSite=29; ConfidenceScore=5.02e-01
MASFSQLQSQMQSQAPPEPLVGPGPSGPRVSTKGSCVDPSGNDPETGDSD

SEQ ID NO: 157817 - protein, 460 aa, Glycine max
  Coding DNA Sequence Number=SeqID_41039
  Gene Ontology: Mol. function=potassium ion transporter activity; Cellular component=integral to membrane; Biological process =potassium ion transport
  Homolog annotation: Hit_ID=Q9LD18; Match level="QueryCoverage=91%, HitCoverage=53%, E-value=0.0, Identity=75%"; Hit description =Potassium transporter 4
  Pfam annotation: Domain name=K_trans; Domain location=45-457; Score =372.9; E_value=5e-109; Accession=PF02705.7; Description=K+ potassium transporter
MASIGGCATRLASRVREWNRNPELRLLGILLRSLLSWVNLSRNLLLAYQSFGVVYGDLSTSPLYVFTSTFKGKLQNHHDEETIFGTFSLIFWTLTLIPLLKYVFILLSADDNGEERLYELCDCDPSMILLSSGGTFALYSLLCRHAKFNLLPNQQAADEELSSYKYGPSSQAIASSPLKRFLEKHKRLRTALLVVVLFGACMVIGDGVLTPAISGELVLLACVILVGLFALQHCGTHKVAVMFAPIVIIWLVSIFSIGVYNTIHWNPKIVRAISPYYIIKFFSRTGKEGWVSLGGILLCITGTEAMFADLGHFTASSIRLAFAFVIYPCLVVQYMGQAAFLSKNLDSVDNGFYDSIPDPVFWPVFIIATLAAIVGSQAVITATFSIIKQCHALGCFPRVKVVHTSKHIYGQIYIPEINWILMILTLAITIGFQDTTIIGNAYGNLFPYEPLSLSLSPCLW

SEQ ID NO: 157818 - protein, 40 aa, Glycine max
  Coding DNA Sequence Number=SeqID_41040
MEKEESNQMKQVSMMEMKCTLEYEQRLRQGERSVVIYSLI

SEQ ID NO: 157819 - protein, 283 aa, Glycine max
  Coding DNA Sequence Number=SeqID_41041
  Gene Ontology: Mol. function=ATP-dependent helicase activity; Biological process=regulation of transcription, DNA-dependent
  Homolog annotation: Hit_ID=Q94JY9; Match level="QueryCoverage=94%, HitCoverage=32%, E-value=2e-81, Identity=60%"; Hit description =Putative helicase
  Pfam annotation: Domain name=CarD_TRCF; Domain location=144-246; Score=67.5; E_value=4.2e-17; Accession=PF02559.6; Description=CarD -likeTRCF domain
  Subcellular localization annotation: CTP_CleavageSite=58; ConfidenceScore=5.71e-01
MASSSSSLLPRSHIPTPLISKISSSPRTWSLFILTYPSHPKNNNNNNNNKRLFLSPTNAVYTQSPYTPSTPSKTELHNDPITVLNERIRRDLSKKEAFRTVMDSEEAGKYMKMVKVQQQRGLQKLKGDRESKDGVFSYKVDPYTLRSGDYVVHRKVGVGRFVGMRFDVAKNSSQPTEYVFIEYADGMAKLPVNKAAKMLYRYSLPNETKKPKALSKLSDTSAWEKRKVKGKVAIQKMVVDLMELYLHRLKQRRPLYPKSPAMAEFAALFPYEPTPDQKRVTLY

SEQ ID NO: 157820 - protein, 136 aa, Glycine max
  Coding DNA Sequence Number=SeqID_41042
  Subcellular localization annotation: CTP_CleavageSite=30; ConfidenceScore=5.40e-01
MYPLLFSVTTTQVDVPSTCTTKDVPSNVLRQSSQAVSPLNLCERETKDISGGRRETQKNSGEQGLETKKFRKLFGKGRRRKMRSKRFQDFSKVVQEILKVVRVVIGNRLPESKNSGNLDNFEKNYFEKQICAMFVL

SEQ ID NO: 157821 - protein, 237 aa, Glycine max
  Coding DNA Sequence Number=SeqID_41043
  Gene Ontology: Mol. function=ATP-dependent helicase activity; Cellular component=phycobilisome; Biological process=regulation of transcription, DNA-dependent
  Homolog annotation: Hit_ID=Q2HRX1; Match level="QueryCoverage=90%, HitCoverage=43%, E-value=1e-107, Identity=91%"; Hit description =DEAD/DEAH box helicase
  Pfam annotation: Domain name=DEAD; Domain location=7-161; Score =110.7; E_value=4.3e-30; Accession=PF00270.19; Description=DEADDEAH box helicase
  Pfam annotation: Domain name=ResIII; Domain location=10-155; Score= -32.2; E_value=0.023; Accession=PF04851.6; Description=Type III restriction enzyme, res subunit
  Pfam module annotation: Pfam domain module=DEAD::ResIII; Domain location=7-161::10-155
AFIDVERDLTERETPMDRLICGDVGFGKTEVALRAISCVVSAKKQAMVLAPTIVLAKQHFDVISERFSVYPDIKVGLLSRFQTKAEKEENLDKIKNGSLDIIVGTHSLLGDRVTYNNLGLLVVDEEQRFGVKQKEKIASFKTSVDVLTLSATPIPRTLYLALTGFRDASLMSTPPPERVPIKTHLSSFSEDKVVSAIKYELDRGGQVFYVLPRIKGDSQLKISIQTFKAPNFNKFIN

SEQ ID NO: 157822 - protein, 266 aa, Glycine max
  Coding DNA Sequence Number=SeqID_41044
  Gene Ontology: Mol. function=ATP-dependent helicase activity; Biological process=regulation of transcription, DNA-dependent
  Homolog annotation: Hit_ID=Q94JY9; Match level="QueryCoverage=88%, HitCoverage=32%, E-value=1e-104, Identity=72%"; Hit description =Putative helicase
  Pfam annotation: Domain name=TRCF; Domain location=120-228; Score= -26.3; E_value=0.018; Accession=PF03461.5; Description=TRCF domain
MEKFALGEIKILICTNIVESGLDIQNANTIIIQDVQQFGLAQLYQERLAAIEECRELGQGFQLAEKDMGIRGFGAIFGEQQSGDVGNVGIDLFFEMLFESLSKVEDHRVVSVPYHSVQVDININPHLPSDYINYLENPLKIINDAERVAEKDIWSLMQFTENLRRQYGKEPRSMEILLKKLYLRRMAADLGITSIYSSGKMIYMKTNMSKKVFKMMTESMASDLHRNSLVLEGDQIKDIRTDWGLSVDNGEYVLPFKMYNQSHINE

SEQ ID NO: 157823 - protein, 79 aa, Glycine max
  Coding DNA Sequence Number=SeqID_41045
MVELILTLYCCCCWLLRSPTNRGTGRIDVDVDGADGIGARAEEGGISKDGGASDLFPLALRDPLKVTKRSSRFQQFFFT

SEQ ID NO: 157824 - protein, 121 aa, Glycine max
  Coding DNA Sequence Number=SeqID_41046
MNHHSSPLKPHTERNPSIGVESSKLASWFRLRMKPNLTFTVFFEKSYVFDDWDATYLLLMWLLMTLIGGGGCIDLVGCPLCGKLEWLKNLSISEGMLRSFNSSMVIVLDGAHVLYLIWHGK

SEQ ID NO: 157825 - protein, 149 aa, Glycine max
  Coding DNA Sequence Number=SeqID_41047
MDFRNKLDNDTLSQILMSLHEKAKGYFRFYKRSIILKFCSCQCNRGSMKDTLKLPRNKIRITVTSKKTVKGSSRCGVSTENYGGSWWILVAMVMEKKLETLEMVLEEGRRKKWCFSKATRITKVETLKCFSSRKRKRFSHAKHRNTDRN

SEQ ID NO: 157826 - protein, 37 aa, Glycine max
  Coding DNA Sequence Number=SeqID_41048
MNALSGPCRAKRVHPTDEPRLSAPCALSLSVIRLRLS

SEQ ID NO: 157827 - protein, 342 aa, Glycine max
  Coding DNA Sequence Number=SeqID_41049
  Subcellular localization annotation: CTP_CleavageSite=20; ConfidenceScore=5.09e-01
MGSKSTLRLMRTLGPSLASLAQSSWSLLSNALRGYLMLPMDGFHMSLVEDNLLMAMVLLIPCEKGNGTENLDVLIGDIGFPACVGGGLDDCRVGVGVASLSDELEPSKDGILMGSFGVKDLHPTLVFLFFGIKEGIISCDLPLTPSDWSSPRMSPLDFALLLSKESLILFSESKSLHSFIFISRSGQLLLPPLLNIILINMRDGHISSNVNFHCLQVDNNEVGFVDEGDIVDVIHSSQSFHVPKNVDVDRVWKVEWNLTHQMEEQNIPLEHSDKFWVYHQSVVGVIADSVEKQVVVPVVIMVVARAMFLLEFDMINGSGMEKEEREETPLQGEDESRRSSPP

SEQ ID NO: 157828 - protein, 212 aa, Glycine max
  Coding DNA Sequence Number=SeqID_41050
MEMLEARIQHLHQLQKVDRAKYKATWKIRQEKKAKQRVDAASKRTTAVKRKVELTRPNKMVSKPTTIPAEAPKMVETTPVTVAMEPKAKANEVPTESTSHEATSKDATAVIIHATSSGPTPINFSPLEVVTKTEVKKMIRLAMDSFAENQKAENEVFKCTLQQAIVTQFSILGESLILNLQQAQMRLSSVVVAPMSLPSTQPPPLVTHTSNP

SEQ ID NO: 157829 - protein, 119 aa, Glycine max
  Coding DNA Sequence Number=SeqID_41051
  Gene Ontology: Mol. function=DNA binding; Biological process=DNA integration
  Homolog annotation: Hit_ID=Q1T035; Match level="QueryCoverage=75%, HitCoverage=11%, E-value=3e-27, Identity=60%"; Hit description =Integrase, catalytic region
MKHLRHSELTTQEPYELWKGQNPNISYFHPFGCKSFLLNTKDNLGKFDSKSDNGIFLGYSETSKALRVYNLRILTVEEAIHVKFDDNEFDKDLSELDESFVDLSLDNGIKEKKPSEKEG

SEQ ID NO: 157830 - protein, 117 aa, Glycine max
  Coding DNA Sequence Number=SeqID_41052
MSNSNKNIALATTIITTGTTTIHIDGEPTTHDEHYFNINMLEGCVVHGHHRICHRMHKKKEAHSRKARRRPMKTMSQKLSMGRTSRRYMGRKMSITTFYMTWPKSGPTSLKKVSCIK

SEQ ID NO: 157831 - protein, 187 aa, Glycine max
  Coding DNA Sequence Number=SeqID_41053
MLRVLHNIGICIIKVDELLALEQGVRILGVVNQLNLLFSVGHVFIEVELEALLLPLITDRESWANFAKHHVDISTSADVVLKGITEVSCSNPVTVQDERLFDDLVKGEKDRGKRVISAHLGEQGYFRVKQHLAWASCKEIGSVLKVIERRGKEEEERRENETEAIPNRDRNQLVHRSSFGVLCSSSG

SEQ ID NO: 157832 - protein, 118 aa, Glycine max
  Coding DNA Sequence Number=SeqID_41054
  Subcellular localization annotation: CTP_CleavageSite=51; ConfidenceScore=5.52e-01
MVRMSPQWLPNGTTRTTFPSPAPSKEKQKQSAKSSHPLERAFKLTSPVVISSMDPSNENPTPQLLWSKEYIVATYPLTGGRGEKPKEHLPKRKTRESLHQRLFEENGVALAPTYPQVR

SEQ ID NO: 157833 - protein, 118 aa, Glycine max
  Coding DNA Sequence Number=SeqID_41055
  Homolog annotation: Hit_ID=Q6Z7T4; Match level="QueryCoverage=50%, HitCoverage=9%, E-value=3e-14, Identity=58%"; Hit description =Putative AAA family ATPase
MGFLEAAYVDNGAVDVQESAKKERERIEELLRSRGIRYGSYPRFTVYVKGQKVSIKFQIPPNCEVSQLIANLTAHLGTKAEGHGGGSDMLLRAWDSLPIEKTRSSCVLNLQNFLKGVF

SEQ ID NO: 157834 - protein, 106 aa, Glycine max
  Coding DNA Sequence Number=SeqID_41056
  Homolog annotation: Hit_ID=Q2HRV5; Match level="QueryCoverage=46%, HitCoverage=9%, E-value=2e-14, Identity=93%"; Hit description=DNA repair metallo-beta-lactamase
MGTIPGLNLKHVKTPVALCSHLRKHIKSSISFRNSRDPENLALQPISKVGLHLFSISSISNIHSWNYLVRPQNLYEDKVLRSWSAHYREPLKEGRKTTCKLYCSTR

SEQ ID NO: 157835 - protein, 218 aa, Glycine max
  Coding DNA Sequence Number=SeqID_41057
  Homolog annotation: Hit_ID=Q2HRV5; Match level="QueryCoverage=90%, HitCoverage=42%, E-value=2e-47, Identity=56%"; Hit description=DNA repair metallo-beta-lactamase
MTLSTAPSPPPALEEEPLPHDGDDYHGIVSLDDEGFPSQFPESGTASEKSSFAADFYRSGTDWSSLLLSLEDSKQSDLAQDSGKKMKQANLFQIWGFKRNDAIGSVESGPSKSGCCDDGGGSSERKIVKPENRCSIFPDTGKEFENAKSSRKRKGSCGENRGQCSLLMLFVMGVLKGAQHIFLLISIAITMVALARNGHMALYIALLSQEGSFKCVSR

SEQ ID NO: 157836 - protein, 55 aa, Glycine max
  Coding DNA Sequence Number=SeqID_41058
  Gene Ontology: Mol. function=manganese ion binding; Cellular component=mitochondrion
  Homolog annotation: Hit_ID=Q93ZY7; Match level="QueryCoverage=94%, HitCoverage=25%, E-value=9e-14, Identity=65%"; Hit description=Nudix hydrolase 12, mitochondrial precursor
MAHLPEIPLGIWEFRSKTSQDLCSVEGGCRGYMFALEVTEELETWPEQKNHARQW

SEQ ID NO: 157837 - protein, 79 aa, Glycine max
  Coding DNA Sequence Number=SeqID_41059
  Gene Ontology: Mol. function=manganese ion binding; Cellular component=mitochondrion
  Homolog annotation: Hit_ID=Q52K88; Match level="QueryCoverage=82%, HitCoverage=33%, E-value=1e-17, Identity=66%"; Hit description=Nudix hydrolase 13, mitochondrial precursor
MPQKKNICIPYRWTKDNTDQMGETREIIEVLMVSSPKRDDLVFPKGGWEDDETVTEAACREALEEAGVKGILRVGSISL

SEQ ID NO: 157838 - protein, 83 aa, Glycine max
  Coding DNA Sequence Number=SeqID_41060
MAEDRKPENQDQNVELEPPSIVEDMPECQSMSPNCYKRSSTMQHHVVCFTPMKLKACKIASFVKTGSVTKGQKIMLLLTTYNS

SEQ ID NO: 157839 - protein, 39 aa, Glycine max
  Coding DNA Sequence Number=SeqID_41061
MAEDKKLEKQDQNVELEPPSIVVEDVSECQLLTMKEKSG

SEQ ID NO: 157840 - protein, 216 aa, Glycine max
  Coding DNA Sequence Number=SeqID_41062
  Gene Ontology: Mol. function=transition metal ion binding; Cellular component=chromatin; Biological process=DNA integration
MKILKAYTKNLHCPEASIVERYIAEEAIEFFSDYIEKAKPVGLPKSRHDDRVADTIFVDENSSETLRKLADGPKRNVITWKGYDINKYSFYTKEQDDKSIMQNSGVTLRAEFEHIASLHDDNPYVAFIPYFGFIDEIWELNYVKFTVCAFKCKWVGSDTDVWTDDVGFTLVDLKKLGYHNDLFIMAEQSKQVFYVQDPCDERWCMVLHGKIIGVNV

SEQ ID NO: 157841 - protein, 123 aa, Glycine max
  Coding DNA Sequence Number=SeqID_41063
MDIEEDTEIPLILGRPFMLIANCVVDMGKEKHLHDRNICSKMDELKNEMVLVARAKLAPAHERDHLAKCNLMRILKLAKYRLKAQVEKDKAPEWRRMKAQVEKDEGPEAETLSRLLIVAEGPN

SEQ ID NO: 157842 - protein, 115 aa, Glycine max
  Coding DNA Sequence Number=SeqID_41064
MELSCSCKRPPVRQLLIMVHSFEPTQHVTFHVKSHLRNVLLQRNLVKSKKLFYLEQLVKWFESTKGHCRSDKEVMKVEWPRLGKMICCCGVKCQRRGESGGWGLEGGVFGVEVIV

SEQ ID NO: 157843 - protein, 129 aa, Glycine max
  Coding DNA Sequence Number=SeqID_41065
MTSRGIRNGHRKSRRQFWCVFKPYPYLVIALSLHDQCLAKEGYGGYEGEEGEGYEHVQTHWKKLKEVLGGLGRIHGSSLIDYHIFVIGYTVQVETMTIFRVSGLIIYEYIVIDYIVLESVPTSDQEHFN

SEQ ID NO: 157844 - protein, 177 aa, Glycine max
  Coding DNA Sequence Number=SeqID_41066
MIIETEDLLCLPNRHFKSKGEGAAKRLHKGLSINIGKTLSRDIFSMVRKKGSPPGLLCLTIALCARRRINITNNFTQPYKDLKPTIDAHYILKIFWQALECQKGSEVANEAGTGTEDVVDVGEVKVEVGPNVDVETTITTTADVNDEVGAKEEIVSKDTIMGVPQESIIEKKCATTK

SEQ ID NO: 157845 - protein, 235 aa, Glycine max
  Coding DNA Sequence Number=SeqID_41067
  Gene Ontology: Mol. function=transcription factor activity; Cellular component=nucleus; Biological process=regulation of transcription, DNA-dependent
  Homolog annotation: Hit_ID=Q9M644; Match level="QueryCoverage=77%, HitCoverage=87%, E-value=6e-22, Identity=37%"; Hit description =AP2/EREBP-like transcription factor LEAFY PETIOLE
  Pfam annotation: Domain name=AP2; Domain location=32-96; Score=108.8; E_value=1.6e-29; Accession=PF00847.10; Description=AP2 domain
  Subcellular localization annotation: CTP_CleavageSite=26; ConfidenceScore=5.35e-01
MNPRTTSSSKAKKKQTTTTQESPHQRASSSWGGRYLGVRRRPWGRYAAEIRDPSTKERHWLGTFDTADEAALAYDRAARAMRGSRARTNFVYADTTPGSSVTPIISPDQPQPDPVLSFDPFSLLAFPSGSYSASVAASQFSQQQQQPDNNNNNNIINNSNNNKDSTIELPPLPPDITSSVGYEGFYNNDGGYYWEEDDNYLHNPMFSTMPAVSDNVAAAAGSSQVFDFGNSSFFF

SEQ ID NO: 157846 - protein, 182 aa, Glycine max
  Coding DNA Sequence Number=SeqID_41068
MGSSQKPPLQKRFYQVKIKSLEVTSLRELGQLMGQLQWQAFAKPMDFQLVPTVKEFEEILGCPLGGRKPYLFSGFYPSTTRVAKYQGSVWRKGQRPWQIKANELSFIDILALLIFGVVLFPNMEGLVDLAAIDTFLAFHHGKESPVVAILAMYDTFDRGCPSIRYKVTARASKKERRIGTNS

SEQ ID NO: 157847 - protein, 52 aa, Glycine max
  Coding DNA Sequence Number=SeqID_41069
MHMTQMQFTNTGAREIVSFLDTTSRGSKVPQQGIKTEPMCDAYAKGATQECT

SEQ ID NO: 157848 - protein, 139 aa, Glycine max
  Coding DNA Sequence Number=SeqID_41070
MTVVDNIKTTIPKTRNAKEFMELVEECSQTVDKSLVGTLMSTLTTIKFDGSCTMHEHVIEMTNITPRFKTLEMTVNGNFLIQFILNSLSFEYGPFQMSYNRQMEWISYNPNHKPRREVRLHRELSESSSKSSQDLSFNP

SEQ ID NO: 157849 - protein, 67 aa, Glycine max
  Coding DNA Sequence Number=SeqID_41071
CCMCAFFTCVEEWPDEVSLSRPGWTHKFETWGVAHNIKGPLTAGKPCFTVYSVADIVGMFADAGARD

SEQ ID NO: 157850 - protein, 357 aa, Glycine max
  Coding DNA Sequence Number=SeqID_41072
  Gene Ontology: Mol. function=protein serine/threonine kinase activity; Cellular component=cytoplasm; Biological process=protein amino acid phosphorylation
  Homolog annotation: Hit_ID=Q1SD37; Match level="QueryCoverage=98%, HitCoverage=86%, E-value=1e-153, Identity=72%"; Hit description =Protein kinase; NAF
  Pfam annotation: Domain name=NAF; Domain location=272-332; Score =112.5; E_value=1.2e-30; Accession=PF03822.5; Description=NAF domain
  Pfam annotation: Domain name=Pkinase; Domain location=23-233; Score =185.8; E_value=1e-52; Accession=PF00069.15; Description=Protein kinase domain
  Pfam annotation: Domain name=Pkinase_Tyr; Domain location=23-231; Score=-47.5; E_value=1.5e-09; Accession=PF07714.7; Description =Protein tyrosine kinase
  Pfam module annotation: Pfam domain module=NAF::Pkinase::Pkinase_Tyr; Domain location=272-332::23-233::23-231
WFLVMVILNLGRKEEQGVRLGKYELGKTLGEGNFGKVKLARDTHSGKLFAVKILDKSKIIDLNNIDQASKGKLKEAEGRKIFQQLIDCVSFCHNKGVFHRDLKLENVLVDAKGNIKITDFNLSALPQHFREDGLLHTTCGSPNYVAPEILANKGYDGATSDIWSCGVILYVILTGYLPFDDRNLAVLYQKIFKGEVQIPRWLSPGSQNIIKRMLDANPKTRITMAMIKEDEWFKEGYTPANPEDEEESVYIDDEDFSIHDVSHEADQGCPRSPTLINAFQLISMSSSLDLSGLFEQEDVSERKIRFTSIHSPKDLVERIEDIVTEMGFRVQKKNGMLKVIQEIKVQKCPGSFSVEAE

SEQ ID NO: 157851 - protein, 66 aa, Glycine max
  Coding DNA Sequence Number=SeqID_41073
MGMQTCARAIQLRKSHRSLIPKQEFSHFESRKEEVFQNAILLFGLAIPEAKKEVQGAIWRCRKQQP

SEQ ID NO: 157852 - protein, 456 aa, Glycine max
  Coding DNA Sequence Number=SeqID_41074
MERRLGRETKGSLSLQKRMAETRRREKPAPDLTDFMNDMFFGAADMDHKTYDLTGSTGVHDDDYDDEGFDDSTRSNSARLTQEWLREARQIVASSPSRCDSPARPLGSPRFGATQPPSPLPSSSDRRDALSRTRSARRYRAMEGISDEILSKTAKHTRNKSDTFAQPSSDGDGSPATAVHNWFANILKPTNNNSNTQPSPSPPDSPKSSLPPRQPHPRKSRFKTEPSAAPHPQGIQPPNSRRTFKTSTPSPENSPSDSAPLSPPRNLVESAHRRTISSSTCSRERIAPRHAFPKGEEASLNGFLKEQRILLQKISRGELHAANAQIVLSGPSNSTASMVAAICHAWLLGYRQKENDGGSERVVVVPVMNVKRGSMWKLKQAAWLFHHAGLDANSLLFIDEVDMESLLMTGQLSVLVVGQDVLNTTGEVGSQCTVVTDNYCEDAYDLLQNYMLKKLL

SEQ ID NO: 157853 - protein, 244 aa, Glycine max
  Coding DNA Sequence Number=SeqID_41075
  Gene Ontology: Mol. function=hydrolase activity
  Homolog annotation: Hit_ID=Q6ZJ14; Match level="QueryCoverage=97%, HitCoverage=71%, E-value=3e-89, Identity=62%"; Hit description =Calcineurin-like phosphoesterase family-like
  Pfam annotation: Domain name=Metallophos; Domain location=17-242; Score=17.5; E_value=0.015; Accession=PF00149.18; Description =Calcineurin-like phosphoesterase
MGSANGLAAIHGKEPLFSFGLISDVQYADIPDGRSFLGVPRYYRHSIVVLQRAVKEWNNSKRHKFVINFGDIVDGYCPKDQSLSTVKKLVDEFEMFNGPVYHLIGNHCLYNLPRSKLLPLLKIKSFESHAYYDFSPVPEYRFVVLDGYDISAIGWPQDHPKTFEALKFLREKNPNEDKNSPTGLVGLERRFLMFNGAIGKEQMEWLNSVLQEATKLKQKVVVCCHLPLDPGASSKEALLWNYAE

SEQ ID NO: 157854 - protein, 691 aa, Glycine max
  Coding DNA Sequence Number=SeqID_41076
  Gene Ontology: Mol. function=quinolinate synthetase A activity; Cellular component=chloroplast; Biological process=NAD biosynthetic process
  Homolog annotation: Hit_ID=Q2QTL0; Match level="QueryCoverage=65%, HitCoverage=98%, E-value=0.0, Identity=69%"; Hit description =Expressed protein
  Pfam annotation: Domain name=NadA; Domain location=243-563; Score= -73.1; E_value=2.5e-09; Accession=PF02445.7; Description=Quinolinate synthetase A protein
  Pfam annotation: Domain name=SufE; Domain location=71-197; Score =37.5; E_value=4.7e-08; Accession=PF02657.6; Description=Fe-S metabolism associated domain
  Pfam module annotation: Pfam domain module=NadA::SufE; Domain location=243-563::71-197
  Subcellular localization annotation: CTP_CleavageSite=53; ConfidenceScore=5.94e-01
MAAYTTFSFFSTPQNQKTFFLQPFKRHVSFLKPFKCVRPGSASTRFRPNPVISSSALRTSALVVPSKLEHLAEEFGSLREPVERVKRLLHYAAAMAPMPESNRVDANRVMGCTARVWVEVGIDEEGKVRVAADSDSEITRGFCACLVWVLDGSEPDEVMKVTTDDLTALNVGLPGGSGRSRVNTWHNVLVSMQKRTKQLLAQREGKVPFESFPSLVISSDGVFPKGTYAEAQAKYLFPNELKVDELVNVLKEKKIGVVAHFYMDPEVQGILTAAQKQWPHIHISDSLVMADSAVKMAKAGCQFITVLGVDFMSENVRAILDQAGFSEVGVYRMSNEQIGCSLADAAATRTYMEYLTAASRSTSLHVIYINTKLETKAYAHELVPTITCTSSNVVQTILQAFAQVPDLSIFYGPDSYMGANIKDLFQQMTKMTDEEIAAIHPEHSQDSIRSLLPRLHYFQDGTCIVHHLFGHEVVEKIKEMYCDAFLTAHLEVPGEMFSLAMEAKRRGMGVDRVQEALDRNIDDHLQFVLGTESGMVTSIVATVRSLLEPVKSSSERAKVTVEIVFPVSSDSISTTTSSLSSGLQTAKVGDIILPVVPGIASGEGCSIHGGCASCPYMKMNSLGSLLKVSNHLPDEENILSAYKAERFKLQTPNGRSVADVGCEPILHMRNFQATKKLPEKLVDQILRPQHS

SEQ ID NO: 157855 - protein, 202 aa, Glycine max
  Coding DNA Sequence Number=SeqID_41077
MDTSKQTIPIKIPHQGENEDWDDDDRGSLMKTSRKRKTLSSSSTGQQGSKKISKAKTDDKIKLPPKPPRFQQPSKSITSKPLKADVSKGIDDSDEDVHISSFFKAISSATIKQNANKIVDLSSSQDLSQTGDDKVIGINTCISILTDSDIPVSTIDAHNVGEIEGTEGQDAQSHSVSSPSKAMSISKPIIEENVIEVDSTLH

SEQ ID NO: 157856 - protein, 113 aa, Glycine max
  Coding DNA Sequence Number=SeqID_41078
MGAKHLTRTKEWSHVIEQRSPDEIRTVEELRAGAEKLSQGNDLLAKGIDGFFEVVMTSGDTLLRSVRIDKTVNDRSPGHNRDMQVVHELCNSLTLHKLDFKDSFRGGLLTDTH

SEQ ID NO: 157857 - protein, 220 aa, Glycine max
  Coding DNA Sequence Number=SeqID_41079
  Homolog annotation: Hit_ID=Q1SKD7; Match level="QueryCoverage=98%, HitCoverage=56%, E-value=8e-07, Identity=22%"; Hit description =Ankyrin
MASRKRKVIASRPREPYDTTRFISEGAWERYAQNVWNILPERNVILYISEYEEFHRELERRNWHKALTRQPDGHIDVALVKEFYANLYDSKGKSLRQVRVRGELIKFNAESLNAFLETPMILELGEHYTMYSRFCHSRPDPQEFAAILCIPGRGFVLNAEGAPWKLLMKDLTTLAQTWSVLSYSNLALTSHTSDLNMDTARLVYGLVMKMDMDLGSLISG

SEQ ID NO: 157858 - protein, 609 aa, Glycine max
  Coding DNA Sequence Number=SeqID_41080
  Gene Ontology: Mol. function=RNA-directed DNA polymerase activity; Biological process=RNA-dependent DNA replication
NLDNKNGESYEEEAKIMAGEILHGKPYSCLVLKPNKGQGPSDGKVEYDFDISKAYRIFEHLIKDQQIRLKKGHKIQSLDKLKGKKYCKWHNSYIHFTTNCIVFRKDVHRALKEDHFKLANKGLAKMEVDTDPFPKLDINMVSYEEPSSKSKKTKQNGMKTLHITANNEDNGWLKMIKPFAKKEAIKKMKQTLAIMAYLKARSQGEITINKVALALDQAFGVDTRRMNQNGGDQAKVQGNKYNLGSQWEKDVTQDIYQDHPMEQELKQIEDSLLEAWLNDDDLLRAEINGKTIARVFVDCGAILNIIPLATRPSMLVNDCPFLPDVRMAEALFYSPYLDPIQIPKNHDKDRIVETAMVDTPKETEPRDSYWPSCENRLVLKHYPSRLFLSDIDNLLDDATHNYYLKIERMLGQATSKNEYVMPIVDMLVDVAAIHRCLGALGIYKMLVMSFGLKNVRATYQKVMNLIFHDVIDKNMEVYIDDVVVKSADMNQHLADLEQALQKMRFHGLQMNPTKCVFDVLANNFLGFLVHQKPNSARKKKAFSPLLKVKDKDQFTYEEEQKLAFDQIKQVLDAPSVLVPVPPILGKALKLYIFTVKQSIRCLLTQDAED

SEQ ID NO: 157859 - protein, 121 aa, Glycine max
  Coding DNA Sequence Number=SeqID_41081
MEIIIQQAQGSTQSIIYKLNMGARDSSFMNKHYQICHSKFATEVPEGSGVAGVGAGSAGGGAGTGGVEEEGVEVSGPLALVLRVPRKGLKSQRIGYYSSGYAQSCKMCKKAKPRGVELGHL

SEQ ID NO: 157860 - protein, 376 aa, Glycine max
  Coding DNA Sequence Number=SeqID_41082
  Gene Ontology: Mol. function=dihydrolipoyllysine-residue acetyltransferase activity; Cellular component=chloroplast stroma; Biological process=acetyl-CoA biosynthetic process from pyruvate
  Homolog annotation: Hit_ID=Q9SQI8; Match level="QueryCoverage=98%, HitCoverage=79%, E-value=1e-124, Identity=63%"; Hit description =Dihydrolipoamide S-acetyltransferase
  Pfam annotation: Domain name=2-oxoacid_dh; Domain location=179-373; Score=187.6; E_value=2.9e-53; Accession=PF00198.13; Description=2 -oxoacid dehydrogenases acyltransferase (catalytic domain)
  Pfam annotation: Domain name=Biotin_lipoyl; Domain location=1-63; Score=32.1; E_value=2.2e-07; Accession=PF00364.12; Description =Biotin-requiring enzyme
  Pfam annotation: Domain name=E3_binding; Domain location=109-145; Score=57.0; E_value=6.2e-14; Accession=PF02817.7; Description=e3 binding domain
  Pfam module annotation: Pfam domain module=2-oxoacid_dh::Biotin _lipoyl::E3_binding; Domain location=179-373::1-63::109-145
MTEGKIVSWVKSEGDVLSKGDSVVVVESDKADMDVETFYNGILAVIVVAEGQTAPVGAPIGLLAETEAEVAEAMAAANSAPTPPPKASDTSPAPAPAPEVSDSPRKAVATPYAKKLAKQHKVNIGSVVGTGPFGRVTPADVEKAAGILPAESNVAPAAVDSAPPKAAAAAPAASSASIPGSSVVAFTTMQSAVAKNMVESLSVPTFRVGYPVTTDALDALYEKVRKKGVTMTAILAKAAAMALVQHPVVNASCKDGKNFAYNSNINIAVAVATNGGLITPVLQDADKLDLYLLSQKWKELVEKARAKQLQPHEYNSGTFTLSNLGMFGVDRFDAILPPGQGAIMAVGASKPTVLADKDGFFTVKSKMLVSIIDKFV

SEQ ID NO: 157861 - protein, 199 aa, Glycine max
  Coding DNA Sequence Number=SeqID_41083
  Subcellular localization annotation: CTP_CleavageSite=54; ConfidenceScore=5.04e-01
MLAASSYHSPLFVSIGPTYCSPVANAEPSSASLDRLEAAIVKLATAQLRFATTQASMNSKLDAIFLKLNTMVPSQPSPSYSSAKSPPPTETMSPLLPKVTSQFFQSSSSAKPPPTAKTMPPPLPMVASHLPINAKHYAPSSDPRQVASHRFCTEPPSCHILPSDLHLSLFVVFAAKVRDMELDHPFLLPTPNTLRTRCF

SEQ ID NO: 157862 - protein, 361 aa, Glycine max
  Coding DNA Sequence Number=SeqID_41084
  Gene Ontology: Mol. function=nucleic acid binding; Biological process= DNA integration
  Homolog annotation: Hit_ID=Q1S0A6; Match level="QueryCoverage=98%, HitCoverage=28%, E-value=2e-88, Identity=47%"; Hit description=Zinc finger, CCHC-type; Peptidase aspartic, catalytic; Polynucleotidyl transferase, Ribonuclease H fold
MGHVGIMDLEYSRTFFVTIVSYLETAKELWDDIKERFSVVNGPCIQQLKLDLTQRKQGGLSMVAYHGKLKALWDDLANYEQLSTCTCKGLTCGKMYSILEHEERLRIITRSKEERIEVMALAAQAGARIKRREKRTDLSARIATNLGDCPRNDDKIGGRGRGQNRTEGTGSNSRCAQKGPVNAHVVQNLGSNISGDMENSGMTGLSKEQWQTLVELLNNLKVTPNESMIGKTKLNSWILDNGASNHMIGTLQHLCDVWKVPGCPVGLPNRHTATSTKERTIRLVGGLRLENVLYVPQLNCNLISISQLSDESNCNVQFTANLCVIQDRTLKMLIGAGERRDGLYFFREILKVKACRVEGIT

SEQ ID NO: 157863 - protein, 156 aa, Glycine max
  Coding DNA Sequence Number=SeqID_41085
MSRSLGAYLRCFTAKLHSVFHVSLLCCYIGPPPTTLTSLPKEVCSIKEDQEFIATEKEKATFESPHSPDAQVPSTWKVELNIALFDQSTSFNSNSKTVCLASTHTTQDTNTGSSPSSDQVMIRVHPATSESTPLATNTDVPQQILDTSLVIEDETF

SEQ ID NO: 157864 - protein, 238 aa, Glycine max
  Coding DNA Sequence Number=SeqID_41086
  Gene Ontology: Mol. function=nucleic acid binding; Cellular component= beta-galactosidase complex; Biological process=DNA integration
  Homolog annotation: Hit_ID=Q1S0A6; Match level="QueryCoverage=98%, HitCoverage=16%, E-value=9e-89, Identity=68%"; Hit description=Zinc finger, CCHC-type; Peptidase aspartic, catalytic; Polynucleotidyl transferase, Ribonuclease H fold
MQQLPPEKKALRCKWVYRMKYHLDGTIEPFKARLVILDNHQVEGINYTKTFAPIAKMVTVCTVLVVATTKAWELHQMGMHNAFLHGDLHEEVFMKMPPGFSASQSDMVCKLRKSLYKLKQAPRWWFSNFSIALKSFGFQQSYLDYSLFILHREDTQLVVLVYVDNLIITGNTPSAIKHFMLYLSTCFHMKDLGILKYFLGIEVDRNPTGIFLCQHKYALDIIFEAGLLGAKPAATPLE

SEQ ID NO: 157865 - protein, 97 aa, Glycine max
  Coding DNA Sequence Number=SeqID_41087
MAGSKESIGISSMWCELCDFKEVYPLNFGANGDIYTTEVVVTYTIVIPEPPDIQIPNTHDENEPLGRGCHVKYPPTQLQDYVIHMIKKLSPFTRSSA

SEQ ID NO: 157866 - protein, 90 aa, Glycine max
  Coding DNA Sequence Number=SeqID_41088
  Gene Ontology: Mol. function=RNA-directed DNA polymerase activity; Biological process=RNA-dependent DNA replication
  Homolog annotation: Hit_ID=Q8LM84; Match level="QueryCoverage=96%, HitCoverage=4%, E-value=5e-17, Identity=55%"; Hit description =Putative retroelement
MPGLSRELVEHRLPICECKKPVKQAQRRFAHDVLEAIKVKIERPLKAKFIRTIGDLNAETPKDEYLMLIANMLIDSTVGNKILSLLDGYS

SEQ ID NO: 157867 - protein, 320 aa, Glycine max
  Coding DNA Sequence Number=SeqID_41089
  Gene Ontology: Mol. function=oxidoreductase activity; Cellular component=integral to membrane; Biological process=electron transport
  Homolog annotation: Hit_ID=O81970; Match level="QueryCoverage=86%, HitCoverage=55%, E-value=1e-137, Identity=90%"; Hit description =Cytochrome P450 71A9
  Pfam annotation: Domain name=p450; Domain location=34-320; Score= -123.7; E_value=2.4e-05; Accession=PF00067.12; Description=Cytochrome P450
MISFTVFVFLTLLFTLSLVKQLRKPTAEKRRLLPPGPRKLPFIGNLHQLGTLPHQSLQYLSNKHGPLMFLQLGSIPTLVVSSAEMAREIFKNHDSVFSGRPSLYAANRLGYGSTVSFAPYGEYWREMRKIMILELLSPKRVQSFEAVRFEEVKLLLQTIALSHGPVNLSELTLSLTNNIVCRIALGKRNRSGADDANKVSEMLKETQAMLGGFFPVDFFPRLGWLNKFSGLENRLEKIFREMDNFYDQVIKEHIADNSSERSGAEHEDVVDVLLRVQKDPNQAIAITDDQIKGVLVAGNPRGLEAPIRALIFNNKKHYNQ

SEQ ID NO: 157868 - protein, 411 aa, Glycine max
  Coding DNA Sequence Number=SeqID_41090
  Gene Ontology: Mol. function=protein serine/threonine kinase activity; Cellular component=nucleus; Biological process=protein amino acid phosphorylation
  Homolog annotation: Hit_ID=P51567; Match level="QueryCoverage=98%, HitCoverage=99%, E-value=0.0, Identity=80%"; Hit description =Serine/threonine-protein kinase AFC2
  Pfam annotation: Domain name=Pkinase; Domain location=98-404; Score =223.2; E_value=6e-64; Accession=PF00069.15; Description=Protein kinase domain
  Pfam annotation: Domain name=Pkinase_Tyr; Domain location=98-404; Score=-23.4; E_value=4.9e-11; Accession=PF07714.7; Description =Protein tyrosine kinase
  Pfam module annotation: Pfam domain module=Pkinase::Pkinase_Tyr; Domain location=98-404::98-404
MEMERVFEFPHTYMDRRPRKRARLGWDIPEVPKAQVGLFCGQDVGTISSFAPSRGPSEHTTSSLFVKPVARNGSPPWRDDDKDGHYMFTLGENLTSRYKIHTKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGKQLLECIAFMHDLRMIHTDLKPENILLVSPEYVKVPDYKSSSRSSCSYFKRVPKSSAIKVIDFGSTTYEREDQNYIVSTRHYRAPEVILGLGWSYPCDIWSVGCILVELCTGEALFQTHENLEHLAMMERVLGSLPQTMMKRVDRHAEKYVRRGRLDWPEGATSRESIKAVMKLPRLQGLLRYDPSERLTAKEALRHSFFMREHFRR

SEQ ID NO: 157869 - protein, 82 aa, Glycine max
  Coding DNA Sequence Number=SeqID_41091
MDGIDPCNYYSTSVKIITTIIAATTNTLIVVITTVVATSSSGDDDNNDDHVSNDNSGHDNYHNVVGGNDSKEDNNHLDGNND

SEQ ID NO: 157870 - protein, 315 aa, Glycine max
  Coding DNA Sequence Number=SeqID_41092
  Gene Ontology: Cellular component=integral to membrane; Biological process=peroxisome organization and biogenesis
  Homolog annotation: Hit_ID=Q8L431; Match level="QueryCoverage=94%, HitCoverage=67%, E-value=2e-94, Identity=57%"; Hit description =Proline transport protein-like
  Pfam annotation: Domain name=Aa_trans; Domain location=1-300; Score =8.7; E_value=1.1e-07; Accession=PF01490.8; Description=Transmembrane amino acid transporter protein
MGLILLGGKALKAINSEFSDSPLRLQYYIVITGAAYFFYSFFFPTISAMKNWLGASAVVTFTYIIFLLIVLIKDGRSNSNRDYDIGESEVMNKVFNAFGAISAIIVCNTSGLLPEIQSTLRKPAMKNMRKALYLQYTVGVLFYYGVTVMGYWAYGSMVSAYLPENLSGPKWIDVLINAIVFLQSIVTQHMFVAPIHEALDTKFLEIDKAMHSGENLKRLFLLRALFFTGNTFVAAAFPFMGDFVNFLGSFSLVPLTFMFPSMVFIKVKGRTARIEKKAWHWFNIVFSFLLTIATTISAIRLIVNNIQKYHFFADA

SEQ ID NO: 157871 - protein, 72 aa, Glycine max
  Coding DNA Sequence Number=SeqID_41093
MAKKMTKFDKYWDVIHDIMGDAIVLDLSSPILKGGNVEGDELCSLKSKILEQSSTLVNEITSDDEGLCYITM

SEQ ID NO: 157872 - protein, 163 aa, Glycine max
  Coding DNA Sequence Number=SeqID_41094
  Gene Ontology: Biological process=response to brassinosteroid stimulus
  Homolog annotation: Hit_ID=Q84UT5; Match level="QueryCoverage=95%, HitCoverage=96%, E-value=2e-21, Identity=33%"; Hit description =Hypothetical protein OsBLE3
  Pfam annotation: Domain name=DUF588; Domain location=2-142; Score =166.0; E_value=9.3e-47; Accession=PF04535.3; Description=Domain of unknown function (DUF588)
MAKTRRVCHLLLRFLAFAATLAAVIMMATSHETATIFTVSFEAKYTNSPAFKYFVIAYSVITVYGFLVLFLPAKSLLWQLVVALDLVFTMLVVSSFSASLAIAQVGKKGNSDAGWLPICDSVPKYCDQATRALIAGFIAMIIYIILLLHSIHTVIDPLLLRKS

SEQ ID NO: 157873 - protein, 425 aa, Glycine max
  Coding DNA Sequence Number=SeqID_41095
  Gene Ontology: Mol. function=ATP binding; Cellular component =ubiquitin ligase complex; Biological process=electron transport
  Homolog annotation: Hit_ID=Q1S771; Match level="QueryCoverage=79%, HitCoverage=88%, E-value=1e-57, Identity=39%"; Hit description=WD40 -like
  Pfam annotation: Domain name=WD40; Domain location=133-168; Score =5.7; E_value=7.8; Accession=PF00400.22; Description=WD domain, G -beta repeat
  Pfam annotation: Domain name=WD40; Domain location=202-238; Score =21.2; E_value=0.0037; Accession=PF00400.22; Description=WD domain, G- beta repeat
  Pfam annotation: Domain name=WD40; Domain location=242-279; Score =37.0; E_value=6.7e-08; Accession=PF00400.22; Description=WD domain, G-beta repeat
  Pfam annotation: Domain name=WD40; Domain location=287-326; Score =14.3; E_value=0.45; Accession=PF00400.22; Description=WD domain, G -beta repeat
  Pfam annotation: Domain name=WD40; Domain location=332-368; Score =26.8; E_value=7.7e-05; Accession=PF00400.22; Description=WD domain, G-beta repeat
  Pfam annotation: Domain name=WD40; Domain location=379-424; Score =29.8; E_value=9.4e-06; Accession=PF00400.22; Description=WD domain, G-beta repeat
  Pfam annotation: Domain name=WD40; Domain location=90-125; Score =13.5; E_value=0.77; Accession=PF00400.22; Description=WD domain, G -beta repeat
  Pfam module annotation: Pfam domain module=WD40::WD40::WD40::WD40::WD4 0::WD40::WD40; Domain location=133-168::202-238::242-279::287 -326::332-368::379-424::90-125
MSISTNRRPSQLDRISIHRAILISNTLTNLILWVQQISGGPHQATPLSILHLPSVKPFTYATWLSNRKSQQLLMFPLQQLPFATMNDSTNYCVASLKTVTAHITCLAVHRNLLYAASLNLINVFDLISHYSHIDAFNQSSTSGFVKSITFTNSKVFTAHQDRKIRVWLITPSKRHRLLSSLPTVTDRLRRCIVPRNYVTVRRHKTRLWIQHCDTVSGLAVNQRFMYSVSWDRSFKVWDLLSYRCLESVKAHEDAINAVAVNGDGTVYTASADGSIKIWRREGEAKRHKLVSTTGRRKSTVNALALDGGGGAGLFSGGCDGEICRWECGKNGVVKMETLRGHGGAILCLIHVAGLLASASADLTVRIWRRERESSGDGGYCCRAVLEGHEKPVKSLVAFSDGEGDSNGVVTLFSGSLDGEIRVWRV

SEQ ID NO: 157874 - protein, 50 aa, Glycine max
  Coding DNA Sequence Number=SeqID_41096
MAVMNAGTGAKGRGSVEEGRISAEVVGGGGWLCGEAATERGYGNKLLVAR

SEQ ID NO: 157875 - protein, 497 aa, Glycine max
  Coding DNA Sequence Number=SeqID_41097
  Gene Ontology: Mol. function=protein binding; Cellular component =autophagic vacuole; Biological process=culmination during fruiting body development
  Homolog annotation: Hit_ID=Q9FGS2; Match level="QueryCoverage=98%, HitCoverage=98%, E-value=0.0, Identity=67%"; Hit description =Arabidopsis thaliana genomic DNA, chromosome 5, TAC clone:K6A12
  Pfam annotation: Domain name=ATG16; Domain location=17-188; Score =23.6; E_value=3.7e-07; Accession=PF08614.1; Description=Autophagy protein 16 (ATG16)
  Pfam annotation: Domain name=WD40; Domain location=234-272; Score =30.3; E_value=6.9e-06; Accession=PF00400.22; Description=WD domain, G-beta repeat
  Pfam annotation: Domain name=WD40; Domain location=276-314; Score =18.5; E_value=0.024; Accession=PF00400.22; Description=WD domain, G -beta repeat
  Pfam annotation: Domain name=WD40; Domain location=318-357; Score =39.8; E_value=9.2e-09; Accession=PF00400.22; Description=WD domain, G-beta repeat
  Pfam annotation: Domain name=WD40; Domain location=361-398; Score =33.0; E_value=1e-06; Accession=PF00400.22; Description=WD domain, G -beta repeat
  Pfam annotation: Domain name=WD40; Domain location=402-440; Score =26.1; E_value=0.00012; Accession=PF00400.22; Description=WD domain, G-beta repeat
  Pfam module annotation: Pfam domain module=ATG16::WD40::WD40::WD40::WD 40::WD40; Domain location=17-188::234-272::276-314::318-357::361 -398::402-440
MAKAGKSQEEIASEAIKHTLRALRKRHLLEEAAHAPAVLALSRPIVSQGVVIMGINAVTWIMGSEWKEKEENLQVELQQCYKAQSRLSEQLVVEVAESRASKALLQEKENALADLQKELTELRDECSQLKVDLEEKIKSLEVIVSENSELKAQLEQMTIKANKAEAENKMLIDRWMLEKMKDAERLNEANALYEEMVEKLRASGLEQLARRQVDGIVRQSEEGAEFFLESNIPSICKYRLRAHEGGCASMLFEYNSSKLITGGQDRLVKMWDANTGSLSSTLQGCLGSVLDLTITHDNRSVIAASSSNNLYVWDVNSGRVRHTLTGHTDKVCAVDVSKISSRHVVSAAYDRTIKVWDLVKGYCTNTIIFHSNCNALSFSMDGQTIFSGHVDGNLRLWDIQSGKLLSEVAAHSLAVTSLSLSRNGNVVLTSGRDNLHNLFDVRSLEVCGTLKAMGNRVASNWSRSCISPDDNHVAAGWSGIGKPLASADKNGIVCVWT

SEQ ID NO: 157876 - protein, 79 aa, Glycine max
  Coding DNA Sequence Number=SeqID_41098
  Homolog annotation: Hit_ID=Q2NKU0; Match level="QueryCoverage=72%, HitCoverage=73%, E-value=1e-07, Identity=46%"; Hit description =Similar to stimulated by retinoic acid 13
  Subcellular localization annotation: CTP_CleavageSite=50; ConfidenceScore=5.08e-01
MAINLFQANNLFFEVGVGTSKKNRSTSANANALKLTSELLRIFITEAVQRAATIAEAEGASQIEPTHLEIILPQLLLDF

SEQ ID NO: 157877 - protein, 302 aa, Glycine max
  Coding DNA Sequence Number=SeqID_41099
  Gene Ontology: Mol. function=nucleic acid binding; Biological process= DNA integration
  Homolog annotation: Hit_ID=Q1T010; Match level="QueryCoverage=98%, HitCoverage=25%, E-value=1e-51, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTNQEYIADYFNRIQTLVNAMKACKGELTNQQIIDKVLRTLTLHFDHIVVAIKESKDLDSMKVEELQNSLEAHEQRVNERRKGGWKKKGKGKWKWGRSGGVGISSNGQDQYHTDLDQGESSNRRSAGQAQNKGGKKKFDKRKVQRYNYNKWGHFANEYWSEKGGKGKQNDEANLAQYEGSDSDQVLLMVTRNSENDNSSSWYLNTGCSNHMIGRRDWLIDFDANVKNKTNLPSLGQLLEKGFSKEMKQNHIEIFDYKHKLLLKAPLSKNRTFRVNLSAVEVQCFSTTNAEEEKWLWHCYLAI

SEQ ID NO: 157878 - protein, 385 aa, Glycine max
  Coding DNA Sequence Number=SeqID_41100
  Gene Ontology: Mol. function=peptidase activity; Biological process =aromatic compound metabolic process
  Homolog annotation: Hit_ID=Q2QTQ5; Match level="QueryCoverage=69%, HitCoverage=72%, E-value=1e-100, Identity=65%"; Hit description =Expressed protein
  Pfam annotation: Domain name=BAAT_C; Domain location=138-291; Score= -82.8; E_value=0.043; Accession=PF08840.1; Description=BAAT  Acyl-CoA thioester hydrolase C t
  Pfam annotation: Domain name=Peptidase_S9; Domain location=98-271; Score=-76.9; E_value=0.031; Accession=PF00326.11; Description=Prolyl oligopeptidase family
  Pfam module annotation: Pfam domain module=BAAT_C::Peptidase_S9; Domain location=138-291::98-271
MVLCKRGKSQTCIEEKKAKRYVKEKELFREVSVACRSPKKKIGHCKHMSHTVSATCPRSVGVGNVSNTWTWHSSEVFVLPKLWPSPGQVKSEDTTKSISADSLLAFFILACMQPRYDYSGYGQSSGKPSENNTYADIEAAYKYLEENYGTKQEDIILYGQSVGSGPTLDLATRLPRLRAVVLHSPILSGLRVMYPVKRTYWFDIYKNIDKIPLVKCPVLIIHGTDDEVVDCSHGKQLWELCKEKYEPLWLKGGNHCNLELYPEYLRHLRKFISIIENSPSQGQTLWKSIGGVEEARRSVDCFEAPRMSADLRDKPRKSTDKQEQLKFQGHKLSNVETVEKSRISFDHVARSQRNKENHDKSRKSVDVHFGRARKSFDWLDKIRAR

SEQ ID NO: 157879 - protein, 331 aa, Glycine max
  Coding DNA Sequence Number=SeqID_41101
  Gene Ontology: Mol. function=DNA binding; Cellular component =chromatin; Biological process=DNA integration
MKIVTPEEAWTKCKPSVNHLSIFGSLCYRHIPDEKRKKLDDKSEALMLVGYHPTGAYKLYNPNSKPLNWEQAIEQKHWREAMNEEINAIERNQTWELVDPPTSKQPIDVKWVFKLKLKPDVSIEKYKARMVARGFLQRAGEDYTEVYAPVARMETIRLVIAIASSKGWPLFQLDAKFAFLTGPLEEEVYVLQSPGSDHLEIEEFKGRMKFEFEMTDLEVLNYFLGLECVYTKIDIFLHQKRYTQEVFRRFQVENCNEAVTLVEAKLKLIKREDEKAVDGTLFKQIVGSLRFLCNNRPDISFGVCLVSRFMSDPRVSHMVAAKRIQRYLKGR

SEQ ID NO: 157880 - protein, 41 aa, Glycine max
  Coding DNA Sequence Number=SeqID_41102
MEIEARIFFVRSTSNTFTLAHDWTKQVEDFLFDIYNWAERR

SEQ ID NO: 157881 - protein, 450 aa, Glycine max
  Coding DNA Sequence Number=SeqID_41103
  Gene Ontology: Mol. function=zinc ion binding; Cellular component =integral to membrane; Biological process=peroxisome organization and biogenesis
  Homolog annotation: Hit_ID=Q8L431; Match level="QueryCoverage=95%, HitCoverage=96%, E-value=1e-145, Identity=57%"; Hit description =Proline transport protein-like
  Pfam annotation: Domain name=Aa_trans; Domain location=40-435; Score =204.4; E_value=2.6e-58; Accession=PF01490.8; Description =Transmembrane amino acid transporter protein
MDVEGRASKGKSLTLNLEQGQQEKGTQNDDYGLASAHAIDQDSWQQVGLMLVTSFNCGWILSFSNLVMWPLGWTWGIICLIVVGFYTAYANWLLAAFHFIDDRRFIRYRDLMGYVYGKSMYHLTWVFQFLTLLLGNMGFILLGGKALKAINSEFSDSPLRLQYYIVITGAAYFLYSFFIPTISAMRNWLGASAVLTFTYIILLLIVLVKDGKSRSNRDYDLSGSEVSKVFNAFGAISAIIVANTSGLLPEIQSTLRKPAVKNMRKALYLQYTVGVLFYYGVTVMGYWAYGTMVSAYLPENLSGPKWINVLINAIVFLQSIVSQHMFVAPIHEALDTKFLEIDKAMHSGENLKRLFLLRAFFFTGNTFVAAAFPFMGDFVNFLGSFSLVPLTFMFPSMVFIKVKGRTARIEKKAWHWFNIVFSFLLTIATTISAIRLIVNNIQKYHFFADA

SEQ ID NO: 157882 - protein, 151 aa, Glycine max
  Coding DNA Sequence Number=SeqID_41104
  Homolog annotation: Hit_ID=Q9M0H8; Match level="QueryCoverage=67%, HitCoverage=20%, E-value=2e-30, Identity=58%"; Hit description =Predicted proline-rich protein
MSVVCRWVQGLGVALGDVDSGVDFHKSRRMFPTTAYNPPEDSLSQDVIATVEKSMKKYADNLMRFLEGISSRLSQLELYCYNLDKSIGEMKCDINRDHVEQESRLKSLEKHVQELITILFILCGFTHFDVLDKLLIALGCSYTICSCIILV

SEQ ID NO: 157883 - protein, 52 aa, Glycine max
  Coding DNA Sequence Number=SeqID_41105
MHALLGSFNSGNWSDSDDLDRTGLSCVLSRGIELHVELVDLGSSSSMESFAS

SEQ ID NO: 157884 - protein, 104 aa, Glycine max
  Coding DNA Sequence Number=SeqID_41106
MENNDGLWWLMVDVGDGETTRKQRLKCLNKRCSRERKLLAHSRHLLKDPNGQIMYRCLVKLQTKFREDPTVNEGWAVFLPRKLHVAFSRSFIKRLPPEASSWLL

SEQ ID NO: 157885 - protein, 96 aa, Glycine max
  Coding DNA Sequence Number=SeqID_41107
  Subcellular localization annotation: CTP_CleavageSite=55; ConfidenceScore=5.47e-01
MGPKSILRLMRTLGPSLASLAQSSWSLLSNVIFSTSRYRSRKSNIREYIMEMSTLASKLKALKLEFGEDLLVHLVLISLTAHIRQFKVSYNTQKVP

SEQ ID NO: 157886 - protein, 116 aa, Glycine max
  Coding DNA Sequence Number=SeqID_41108
  Homolog annotation: Hit_ID=Q6QJL5; Match level="QueryCoverage=34%, HitCoverage=9%, E-value=2e-08, Identity=63%"; Hit description =Aspartic protease
DEAGHYNLKHYNNNNNNFLSIATTPVYPKSYGGYSIDLNLGTPPQTSPFILDIGSSLVLLPCTSHYLYSYHQVHVPKVYIKPTLDRHSHEARSRVSILTHQVLQTIISSVIYDFFP

SEQ ID NO: 157887 - protein, 193 aa, Glycine max
  Coding DNA Sequence Number=SeqID_41109
MAFAWPCCLAVFLQVMGLLLDLAGMEGTHLEREVLLEIALEVAVKAAPAVTIVVAAAVAVVVAVAVAADSEKIVAQEMGLLEMVLVVEPRVGVFDIVDRMVNTDSVGAGAQLDLAEGWVACNKEAVEGLESHLVREPEPEPEPGVLEAAAEGLFDEAEQEPTAGCLHQMHWTPEYPGNGDCCIFQNYLMPMLG

SEQ ID NO: 157888 - protein, 130 aa, Glycine max
  Coding DNA Sequence Number=SeqID_41110
  Gene Ontology: Mol. function=RNA-directed DNA polymerase activity; Cellular component=intracellular; Biological process=RNA-dependent DNA replication
MCIDYTDLNRACPKDAYPLPNIDYLADGAARHIMLSFLDAYSGYNQIRMDPVNEEKAEFIAKSKNYCHKVMSFGLKNIEATYQRLIYKVFGAKLGRNLEVYVDDMVIKSNDLPTHIKDFKEVFGQLRKYN

SEQ ID NO: 157889 - protein, 246 aa, Glycine max
  Coding DNA Sequence Number=SeqID_41111
MASSKGCLREPEELGSRVRGPSKEQVANNIIHNIERFANNIIVVMNVVVGPSKHLEYPPITLPGFSWVDGKVGTFFSRYNDKLDIDNLLRQLTICRIKKDKLFPIDLRTCWTDVDPLDLAEDITQHLQGSSIANKLKVDVKKAKDSLDFELSTNIALVGENLELKACIATLELELKGDVEKEEKARIQQKAYDDVYKAHASGFNHSLYQVIFHCEVLDESIFDIDKDVYNKQLVLIDDSMEDGALI

SEQ ID NO: 157890 - protein, 133 aa, Glycine max
  Coding DNA Sequence Number=SeqID_41112
MINKFERQKSLETKIEGRIIMGYINNVDQVRRSFIGLGCNWAITSCTYRKDGMDTTTPLSHQILPVQPAPPPTTISTSTTTNTTTPRPTTVINSQLPHAILCPHGAAGEMVSEDAELASRCVKRDWELDVVII

SEQ ID NO: 157891 - protein, 122 aa, Glycine max
  Coding DNA Sequence Number=SeqID_41113
MNVRGLQATYKGVNGGISIDDVDVHDVIVMMYVVYVHGGAVTMMDIPGHVTRFGTSVCLRLIPMERGYFLMNGTTWHLRVEVREIDAILPRKEPVTRAMSKRLQENWARAAEEGLRVLMNLM

SEQ ID NO: 157892 - protein, 32 aa, Glycine max
  Coding DNA Sequence Number=SeqID_41114
MVKQLREKDIPLIKFVSGGATKDTKFQGQNFF

SEQ ID NO: 157893 - protein, 389 aa, Glycine max
  Coding DNA Sequence Number=SeqID_41115
MEFCLEYIENAKPDRLSESRYDEWEARGYDINKYLFYTKSQVDKSTMQNSGVGLRAESQHFAIVHNDNPCLASMPNFGVIEEIWDLNYVKFDVCVFKCKYVDSNMDPCDESWSVVLHRKTISLNLEDDDSTLDTCLTPFSTQMSNVTEKKKLTMSMKILMIMMKKNKLTSYNMTTLPSSPPSLKSTTPSSSSPKKTRKATQFKLLATRPIEMERPRIHAKFDIPKAPDQRMKKKILKTVAERWRQFKSILTAKWALAQDKEEEDDTVYQKCGINIENGNNFARVIETLHGSQMQSEMQSQGIILPPKLEVGPSAARVSAKGSFIDPLGVYEGLKIIQNIPSGNDQVKVGVEEDKHQAAGLPKPVDRPEHEDDPLYQMTLMIPELFLKTM

SEQ ID NO: 157894 - protein, 644 aa, Glycine max
  Coding DNA Sequence Number=SeqID_41116
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=94%, HitCoverage=69%, E-value=1e-135, Identity=45%"; Hit description=DNA polymerase III like protein
  Pfam annotation: Domain name=AAA; Domain location=227-417; Score= -2.8; E_value=0.00034; Accession=PF00004.19; Description=ATPase family associated with various cellular activities (AAA)
  Pfam annotation: Domain name=DNA_pol3_delta; Domain location=268-538; Score=-65.0; E_value=0.0036; Accession=PF06144.3; Description=DNA polymerase III, delta subunit
  Pfam module annotation: Pfam domain module=AAA::DNA_pol3_delta; Domain location=227-417::268-538
MNYCGISCQEGLQDDGLVYSNPKQQGISGDKSPNESCCSNHEGRGLDLVSIMPSSNHLKDGESCYLSIATRVEHSKSARKSLCKNQVKPSEVIGDIASHVGSQQCLSVFDACSARSASEHIAQEVDVLDSHHGCGLRSCLSKSPRFRESNRYSEIESLPLILQHVNETDLNGHRSMRHIGVEISPTSETPRSLSMKFRPKSFSDLVGQNVIGKSLLGAISTGRISSFYIFHGPRGTGKTSASRIFAAAMNCLSPLEQKPCGLCRECVLFFLGRSKNVKEVDSLRINRADKVKSLVKSACIPPASSSFKVFIVDECQVLHGETWACLLNCLENVSPRVVFVMITPDLDKLPRSAVSRAQRYHFAKIKDADIARRLKKICVEEGLESEQVALDFIAARSCGSLRDAETMLDQLSLLGKKITISLVHELTGVISDDELLDLLDLALSSDTSNTVIRARKLVRTRIDPLQLISQLANLIMDILAGKCELGASETRTRFCNRYTSEADMQKLSHALRILSETEKQLRISKNQTTWFTAALLQLSSVEYSSVDTNDAKLCARAVSNGDGDICSTPPKGDSLEHLATTGQCDDKPYTLGLGVQEDHKGTLDSIWYKATEMCQSSRLKTFLRKQGKLSSVCISQGPTTREWE

SEQ ID NO: 157895 - protein, 120 aa, Glycine max
  Coding DNA Sequence Number=SeqID_41117
MAAEWRRKRERRRHFKEKMSLEEAHHHRRPWIRAWRKKEMNEGRGREEHEILCSKRALKSEIIGPNLGPWAQKSTLRFMRTLGPSSAALAQSSCSLLLMVLVIGPFLGRIASVPILWIPL

SEQ ID NO: 157896 - protein, 701 aa, Glycine max
  Coding DNA Sequence Number=SeqID_41118
  Gene Ontology: Mol. function=isomerase activity; Cellular component =cytoplasm; Biological process=protein amino acid phosphorylation
  Homolog annotation: Hit_ID=Q8LDN5; Match level="QueryCoverage=99%, HitCoverage=99%, E-value=0.0, Identity=69%"; Hit description =Topoisomerase-like protein
  Pfam annotation: Domain name=MA3; Domain location=122-233; Score =146.0; E_value=1e-40; Accession=PF02847.7; Description=MA3 domain
  Pfam annotation: Domain name=MA3; Domain location=286-397; Score =174.2; E_value=3.2e-49; Accession=PF02847.7; Description=MA3 domain
  Pfam annotation: Domain name=MA3; Domain location=419-530; Score =144.5; E_value=2.7e-40; Accession=PF02847.7; Description=MA3 domain
  Pfam annotation: Domain name=MA3; Domain location=582-691; Score =159.8; E_value=7.2e-45; Accession=PF02847.7; Description=MA3 domain
  Pfam module annotation: Pfam domain module=MA3::MA3::MA3::MA3; Domain location=122-233::286-397::419-530::582-691
MASSEGFLTDGQRELLKIASQNAENLSSSPKSQSSLLSDHHVKAPAGGKAQTAGIAVRHVRRSHSGKYGKVKKDGAGGKGTWGKLLDTDIVSHIDRHDPNYDSGEEPYQLVGTTVTDPLDEFKKAVVSIIEEYFSNGDVELASSDLKELGSCEYYPYFIKRLVSVAMDRHDKEKEMASVLLSALYADVISPAQIRDGFFILLESADDLAVDILDAVDILALFLARAVVDDILPPAFLARAKKALPESSKGVQVIQTAEKSYLSAPHHAELVERRWGGSTHITVEEVKKKIADLLREYVDSGDTLEACRCIRELGVSFFHHEVVKRALILAMEIRSAEPPMLKLLKEAAEEGLVSSSQMVKGFSRLAESLDDLALDIPSAKALFQSFVPKAISEGWLDASLTKPATEDGEIQEDEKVRKYKKESVTIIHEYFLSDDIPELIQSLEDLGAPEYNPIFLKKLITLAMDRKNREKEMASVLLSALHIEIFSTEDIVNGFVMLLESAEDTALDILDASNELALFLARAVIDDVLAPLNLEEIGCRLPPKCSGSETVRMARSLIAARHAGERLLRCWGGGTGWAVEDAKDKIMKLLEEYESGGVVSEACQCIRDLGMPFFNHEVVKKALIMAMEKKNDRMLDLLQECFSEGLITINQMTKGFTRIKDGLDDLALDIPNAKEKFGFYVEHAQSNGWLLPSFDSPATDA

SEQ ID NO: 157897 - protein, 340 aa, Glycine max
  Coding DNA Sequence Number=SeqID_41119
  Gene Ontology: Mol. function=nucleic acid binding; Cellular component= nucleus
  Homolog annotation: Hit_ID=Q9STM4; Match level="QueryCoverage=87%, HitCoverage=86%, E-value=2e-60, Identity=42%"; Hit description =Putative zinc finger CCCH domain-containing protein ZFN-like 6
  Pfam annotation: Domain name=zf-CCCH; Domain location=144-170; Score =38.7; E_value=2e-08; Accession=PF00642.15; Description=Zinc finger C- x8-C-x5-C-x3-H type (and similar)
  Pfam annotation: Domain name=zf-CCCH; Domain location=191-217; Score =33.4; E_value=7.7e-07; Accession=PF00642.15; Description=Zinc finger C-x8-C-x5-C-x3-H type (and similar)
  Pfam annotation: Domain name=zf-CCCH; Domain location=239-265; Score =49.8; E_value=9.1e-12; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=144-170::191-217::239-265
MEGSESDSVSLSISNGEEPQLGRPSSPAAPPEPSDLNHAAEEETLSGELQSKLDLKDVDESEEKVSDFNDGGGVCDEETGKGDGDSKGWETNSWNEEVGVDVDVDGDGDGDGDDDVDGDVDGDDEVEKKEGRNSGGTHHYPLRPEAEDCAFYMKTGNCKFGFNCKFNHPIKRKSQAVKEKAGEREETTERSGMTECKYYQRSGGCKFGKSCKYNHTRGKISTAPAPLLELNFLGLPIRPGERECPYYMRTGSCKFGANCKFNHPDPTAVGGGGGNPPSGYGNGGSISLQGVSQTSVPSWSSPRTLNEASPFVPMMLSPTQGVSTQSSDWNGYQVHWNCSK

SEQ ID NO: 157898 - protein, 655 aa, Glycine max
  Coding DNA Sequence Number=SeqID_41120
  Gene Ontology: Mol. function=binding
  Homolog annotation: Hit_ID=Q6YT02; Match level="QueryCoverage=86%, HitCoverage=97%, E-value=5e-85, Identity=33%"; Hit description =Putative armadillo repeat containing protein
  Pfam annotation: Domain name=Arm; Domain location=191-232; Score =26.1; E_value=0.00012; Accession=PF00514.13; Description =Armadillobeta-catenin-like repeat
  Pfam annotation: Domain name=Arm; Domain location=234-274; Score=5.8; E_value=2.3; Accession=PF00514.13; Description=Armadillobeta-catenin -like repeat
  Pfam annotation: Domain name=Arm; Domain location=425-461; Score=0.5; E_value=11; Accession=PF00514.13; Description=Armadillobeta-catenin -like repeat
  Pfam annotation: Domain name=Arm; Domain location=462-498; Score=0.1; E_value=12; Accession=PF00514.13; Description=Armadillobeta-catenin -like repeat
  Pfam annotation: Domain name=Arm; Domain location=504-543; Score=5.1; E_value=2.8; Accession=PF00514.13; Description=Armadillobeta-catenin -like repeat
  Pfam annotation: Domain name=HEAT; Domain location=240-276; Score =11.9; E_value=1.5; Accession=PF02985.12; Description=HEAT repeat
  Pfam annotation: Domain name=HEAT; Domain location=380-411; Score =0.6; E_value=37; Accession=PF02985.12; Description=HEAT repeat
  Pfam annotation: Domain name=HEAT; Domain location=426-463; Score =11.0; E_value=1.9; Accession=PF02985.12; Description=HEAT repeat
  Pfam module annotation: Pfam domain module=Arm::Arm::Arm::Arm::Arm::HE AT::HEAT::HEAT; Domain location=191-232::234-274::425-461::462 -498::504-543::240-276::380-411::426-463
MGNPNPNPTPTPEEEKSLKEELLDPILLGERVIKLAQEAESSKVDCTELARKVQVVCDNLRSVVRVVSGAQCLNERPIRRIVGEVFKNLERTLAFIRKCKKHGGVLRQVFSMTTTADFRKVWSLLESSNGDLVWLLTILDSKDGTNVSLPPIASNDPILAWVWTFTYTLQLGQPKDRAEAATELGSLARDNDRTKFIILEEGGVMPLLKLLKEASFPDAQIAAANALVNITTNQDRIVGFIVESHAVPTIVQVLGDSPMRVRVSVANLVSTMAEQHELVREEFIRANVTRPLVSLLSMDMGTVLADPMAGRASIHSLVLNLSNVGEANSDGSSRGSSHQRRDREVESPELRNEVKISCAKALWKLSKGCLSSCRKITETKGLLCLAKIIESESGELQLNCLMAVMEIAAVAESNADLRRAAFKRTAPAAKAVLDQLLRVVQEESDPALRIPAIKAIGSLARNFSGKVPQVIGPLVAQLGNRDVDVASEAAIALGKFVCPDNYNCIDHSKAILELDGIPKLMSLLQINDRQQVHGLKLLCYLALNVGNSKVLEQERALNTLERFARPVQAQHPDMKDLFAKAIHHLTLYQPGAQLHRQPLGLEPCIVLWKHNISLYNITGDKSGPEGILKFSERQSNVCEVKSVAVSERSSRLELK

SEQ ID NO: 157899 - protein, 176 aa, Glycine max
  Coding DNA Sequence Number=SeqID_41121
  Gene Ontology: Mol. function=protein transporter activity; Cellular component=mitochondrial inner membrane; Biological process=protein transport
  Homolog annotation: Hit_ID=Q10QJ0; Match level="QueryCoverage=57%, HitCoverage=51%, E-value=5e-24, Identity=56%"; Hit description =Mitochondrial import inner membrane translocase subunit Tim17/Tim22/Tim23 family protein, putative, expressed
  Pfam annotation: Domain name=Tim17; Domain location=28-163; Score =66.9; E_value=6.4e-17; Accession=PF02466.9; Description =Tim17Tim22Tim23 family
  Subcellular localization annotation: CTP_CleavageSite=38; ConfidenceScore=5.66e-01
MASDATVNSVSEVNNAPNPRKSEGPSSTPSPTTSLLLSAATSTACGALTGSLFGYEAVPKFMFKDAFDGSVSGAGLIKKKGFKGSFMEAGSQAKTFAVLSGVDSLVVCIFGRLRGKHDAINAGLAGCCAGLATSFPGTPQALILNCLTYGAFSFMIEGVTKKRSALAYPMSKKTSA

SEQ ID NO: 157900 - protein, 70 aa, Glycine max
  Coding DNA Sequence Number=SeqID_41122
MENKGGGTTLKNGMEICWELTKIMKRERKGPLSLGDVSGALLTCSPVSDRTLLSLTKYMHTCMRGIQLNI

SEQ ID NO: 157901 - protein, 408 aa, Glycine max
  Coding DNA Sequence Number=SeqID_41123
  Gene Ontology: Mol. function=nucleotide binding; Cellular component =protein complex; Biological process=barrier septum formation
  Homolog annotation: Hit_ID=O65875; Match level="QueryCoverage=73%, HitCoverage=75%, E-value=1e-121, Identity=76%"; Hit description=FtsZ protein
  Pfam annotation: Domain name=Tubulin; Domain location=6-164; Score =201.7; E_value=1.7e-57; Accession=PF00091.15; Description =TubulinFtsZ family, GTPase domain
  Pfam annotation: Domain name=Tubulin_C; Domain location=166-283; Score=104.9; E_value=2.3e-28; Accession=PF03953.7; Description =TubulinFtsZ family, C-terminal domain
  Pfam module annotation: Pfam domain module=Tubulin::Tubulin_C; Domain location=6-164::166-283
YKLDLCQYNGEDDGVEFYAINTDAQALLHSSAENPIKIGELLTRGLGTGGNPLLGEQAAEESKEAIANALQGSDLVFVTAGMGGGTGSGAAPVVARIAKEAGYLTALEAIEKLQKNVDTLIVIPNDRLLDMADEQTPLQDAFRLADDVLRQGVQGISDIITIPGLVNVDFADVKAVMKDSGTAMLGVGVSSSKNRAEEAAEQATLAPLIGSSIQSATGVVYNITGGKDITLQEVNRVSQVVTSLADPSANIIFGAVVDDRYNGEIHVTIIATGFSQSFQKILLTDPRAAKLLDREPGGQESKAASPPLKSSNYPSTECDEKRREKKGWGVVRKDGEGIRERIGGVGERGGYRGTIYISGGENSTLEPYWGYVGPSPVYSEAENRRRVSHYMRKVIDSEHPEISASEFR

SEQ ID NO: 157902 - protein, 177 aa, Glycine max
  Coding DNA Sequence Number=SeqID_41124
  Gene Ontology: Cellular component=protein complex
  Homolog annotation: Hit_ID=Q93Y35; Match level="QueryCoverage=64%, HitCoverage=22%, E-value=3e-16, Identity=46%"; Hit description =Probable 26S proteasome non-ATPase regulatory subunit 6
MEEEGSQQPQLVLAEKLFLLRQPVQDIDKVRYKEDVFTHIKENGNSLSLSLSSPFDFFPSETCSPSPFCSEMVPLYETLVADSVLDLDRALLDFMRAKIEDELTKLDEKIQRDGGNIGMLGCETPVWRADQMEDSPIIGGRGRLKKTIGQTFERDSEWLMASNGSKPQNIYDALRMV

SEQ ID NO: 157903 - protein, 331 aa, Glycine max
  Coding DNA Sequence Number=SeqID_41125
  Gene Ontology: Mol. function=RNA polymerase II transcription factor activity; Cellular component=nucleus; Biological process=regulation of transcription factor activity
  Homolog annotation: Hit_ID=Q8LRG9; Match level="QueryCoverage=99%, HitCoverage=57%, E-value=1e-116, Identity=62%"; Hit description =Putative TAF6
  Pfam annotation: Domain name=DUF1546; Domain location=184-302; Score =160.6; E_value=4.1e-45; Accession=PF07571.4; Description=Protein of unknown function (DUF1546)
PIYGSTSNDPPQFKRAAGHKDLFYIDDKDVDIKDIIEAPLPKAPLDTSITSHWLAIEGVQPAIPENAPVEAPSEIRKSEYKEDGLPVDVKLPVKHLITRELQLYYEKITDLTLNKPGSIPFRRALVSLATDSGLHPLVPYFTFFVADEVAQNLNNLAVLFALMRLVRSLLQNSQIHIELYLHQLMPPIITCIVAKRIGNRLSDDHWELRNFSANLVASICQRWATGAHFYYCMVPKRAMRRSRFGHIYHNLQPRVTKTFLHSFLDPTKALPQHYGAIKGIEALGSRLIRLLILPNLEPYLHLLEPEMQPEKQKNEMKRHEAWQVYGALLIT

SEQ ID NO: 157904 - protein, 125 aa, Glycine max
  Coding DNA Sequence Number=SeqID_41126
  Gene Ontology: Mol. function=structural constituent of ribosome; Cellular component=intracellular; Biological process=translational elongation
  Homolog annotation: Hit_ID=Q8H2B9; Match level="QueryCoverage=50%, HitCoverage=55%, E-value=1e-12, Identity=60%"; Hit description=60s acidic ribosomal protein
  Pfam annotation: Domain name=Ribosomal_60s; Domain location=17-106; Score=54.3; E_value=4.2e-13; Accession=PF00428.9; Description=60s Acidic ribosomal protein
MKVVAAYLLAVLGGNPSPSADDIKNILGAVGAEAEHELIELLLTEVKGKDFNELLASGSEKISAVAGGGAAVAVAAAPAGGAGGGAAPAAEAKEEKKVEEKEESDDVRIWVSVCSTKRLCGTKVQ

SEQ ID NO: 157905 - protein, 56 aa, Glycine max
  Coding DNA Sequence Number=SeqID_41127
MDKGLISRVFGKLFVGGKCRSWEVRNIISEAVHWISKLALDRNRLQFLKQGINSRK

SEQ ID NO: 157906 - protein, 446 aa, Glycine max
  Coding DNA Sequence Number=SeqID_41128
  Gene Ontology: Mol. function=peptidyl-prolyl cis-trans isomerase activity; Cellular component=spliceosome; Biological process=protein folding
  Homolog annotation: Hit_ID=Q9LXM7; Match level="QueryCoverage=88%, HitCoverage=63%, E-value=0.0, Identity=82%"; Hit description =Peptidyl-prolyl cis-trans isomerase
  Pfam annotation: Domain name=WD40; Domain location=122-160; Score =3.2; E_value=15; Accession=PF00400.22; Description=WD domain, G-beta repeat
  Pfam annotation: Domain name=WD40; Domain location=178-216; Score =0.4; E_value=32; Accession=PF00400.22; Description=WD domain, G-beta repeat
  Pfam annotation: Domain name=WD40; Domain location=32-70; Score=22.6; E_value=0.0014; Accession=PF00400.22; Description=WD domain, G-beta repeat
  Pfam module annotation: Pfam domain module=WD40::WD40::WD40; Domain location=122-160::178-216::32-70
MAGMTLKLISLWVAYFWLSGHLKFWKKKPIGIEFAKHFRSHLGPIEGLAVSIDGLLCCTISNDRSVKIYDVVNFDMMVMIRLPYIPGAVDWVYKQGDVKARLAISDRNSSFVHIYDARAGSNDPIISKEIHMGPIKVMKYNPVCDSVLSADAKGIIEYWSPATLQFPENEVNFKLKSDTNLFEIAKCKTSVSAIEVSPDGKQFSITSPDRRIRVFWYRTGKLRRVYDESLEVAQDLQRSDAPLYRLEAIDFGRRMAVEKEIEKTESAPLPNAVFDESANFLIYATLLGIKIVNLHTNKVARILGKVENNDRFLRIALYQGDRNSKKVRKIPSAAANANESKEPLTDPTLLCCAFKKHRIYLFSRREPEEPEDATKGRDVFNEKPPADELLSVSDIGKSVTTSLPDNVVGNLHLHSKGLPFLCYCWGLGLLALMLMRRSIPKFFYYP

SEQ ID NO: 157907 - protein, 120 aa, Glycine max
  Coding DNA Sequence Number=SeqID_41129
MADENAKSSTKPQQHTPPRKATLIILGSDKSKIQLRTELVFLLRPLIPATYSHFTFLTLIESEGGENTYNGNRKPLLVLVVLHPLLLSGQCGKTSNSPSLAHLSSLPNHINYNTNIVIHT

SEQ ID NO: 157908 - protein, 170 aa, Glycine max
  Coding DNA Sequence Number=SeqID_41130
  Gene Ontology: Mol. function=transcription regulator activity; Cellular component=nucleus; Biological process=negative regulation of gene expression, epigenetic
  Homolog annotation: Hit_ID=Q9LXN4; Match level="QueryCoverage=91%, HitCoverage=14%, E-value=1e-32, Identity=51%"; Hit description=WD repeat domain protein
MVVYAFSFSIKVEADESRLREVCESFLGPPTGMVEETSSDSKNLAWDPMVLGMRKHKLLREDILPSMASNRKVQRLLNEFMDLLSEYEIIDANQEQSNPTVPNSSLPETNPIESSSLATDQEHTAPPKLDHNTPLEKEQINFPPALTDEASADTPMTDQANQDAQVKESV

SEQ ID NO: 157909 - protein, 135 aa, Glycine max
  Coding DNA Sequence Number=SeqID_41131
  Gene Ontology: Mol. function=protein binding; Biological process=two -component signal transduction system (phosphorelay)
  Homolog annotation: Hit_ID=Q6PT60; Match level="QueryCoverage=100%, HitCoverage=91%, E-value=4e-14, Identity=28%"; Hit description =Histidine-containing phosphotransfer protein
MTMSILKGLLQGYMKSLFDEGVVNDQFNMIVALKRIGEPDRVVQLIETYFSNVERILFELSRHVDNPKVSFCKLASLAREIEDKSTSIGAEQMKLACSDVIKACNEKHQENFSRSMSWLKIEFSKTKNKLEAFVQ

SEQ ID NO: 157910 - protein, 490 aa, Glycine max
  Coding DNA Sequence Number=SeqID_41132
  Gene Ontology: Mol. function=phosphoric monoester hydrolase activity; Cellular component=endoplasmic reticulum; Biological process =metabolic process
  Homolog annotation: Hit_ID=Q9XGY7; Match level="QueryCoverage=99%, HitCoverage=99%, E-value=1e-168, Identity=58%"; Hit description=Acyl CoA reductase
  Pfam annotation: Domain name=Epimerase; Domain location=15-337; Score= -44.1; E_value=0.0028; Accession=PF01370.11; Description=NAD dependent epimerasedehydratase family
  Pfam annotation: Domain name=NAD_binding_4; Domain location=17-318; Score=351.9; E_value=1e-102; Accession=PF07993.2; Description=Male sterility protein
  Pfam annotation: Domain name=Sterile; Domain location=390-490; Score =79.1; E_value=1.4e-20; Accession=PF03015.9; Description=Male sterility protein
  Pfam module annotation: Pfam domain module=Epimerase::NAD_binding _4::Sterile; Domain location=15-337::17-318::390-490
MELGSIIHFLQDKTILVTGATGFLAKIFVEKILRVQPNVKKLYLLLRARDTESATQRLHAEIIGKDLFRLLKEKLGTRFNSYVSEKLTVVPGDISQEDLNLKDPILGEEIFNQTDVIVNLAATTNFDERYDVALGINTLGVMHVLSFAKKCVKLKVLIHVSTAYVCGEKEGLILEDPHHFGVSLNGVPGLDIDMEKKNVEQKLIQLREEGATEHDIELAMKDLGSERAKMYGWANTYVFTKAMGEMLVGTTKGNMNVVIVRPTMVTSTHTEPFPGWIEGLRTIDSIVVAYGKGKLACFLANLKAVFDVIPADMVVNTMLVAMVAHANQPSDIIYHLGSSVVNPVKYLNLRDYSVRYFMENPWINKDGKPVKVGKVTILSNMDSFRKYMYIRYLLPLKGLELVNAVSCQYFQKMYLDFNRKIRTVMRLVELYKPYLFFNGVFDNMNTEKLLSSARQGGVETEFFYFDPKMIDWEDYFINIHFPGIIKHALK

SEQ ID NO: 157911 - protein, 399 aa, Glycine max
  Coding DNA Sequence Number=SeqID_41133
  Gene Ontology: Mol. function=drug transporter activity; Cellular component=membrane; Biological process=multidrug transport
  Homolog annotation: Hit_ID=Q680B9; Match level="QueryCoverage=98%, HitCoverage=76%, E-value=1e-113, Identity=52%"; Hit description=MRNA, complete cds, clone: RAFL22-63-F13
MEEHPKKKKKGCRNPETKFQFELNSCSKAKDLRGAISLYDDAVSNNTRLNQHHFNALLYLCSNSVADPSLKPTALDYGFRAFRHMSALAVLPNEATVTAVARLAAAKGDADYAFELVKSMGKNYNNALPRLRTYDPALFCFCEMLDADKAYEVEEHMNGVGVSLEEAELAALLKVSARCGRVDKVYEYLHRLRSSVRCVSESTAVVIEEWFRGSKASEVGEAEFDAGRVKEGVLRNGGGWHGQGWVGKGDWVVSRTSVVADGHCCCCGQQLVCVDIDDVETEKFAGSVAALAFEREVKANFSEFQAWLEKHASYEAIVDGANIGLYQQNFADGGFNISQVLDDVVKELYNRSGKKWPLVVLHNKRLRGLMENPSSRRLVEEWMKNGVLYTTPNGSNDDW

SEQ ID NO: 157912 - protein, 206 aa, Glycine max
  Coding DNA Sequence Number=SeqID_41134
  Gene Ontology: Mol. function=nucleoside-triphosphatase activity; Cellular component=membrane; Biological process=proteolysis
  Homolog annotation: Hit_ID=Q1SGD5; Match level="QueryCoverage=99%, HitCoverage=50%, E-value=2e-98, Identity=83%"; Hit description=AAA ATPase, central region; MIT
  Pfam annotation: Domain name=AAA; Domain location=1-123; Score=65.6; E_value=1.6e-16; Accession=PF00004.19; Description=ATPase family associated with various cellular activities (AAA)
  Pfam annotation: Domain name=Vps4_C; Domain location=138-203; Score =130.8; E_value=3.7e-36; Accession=PF09336.1; Description=Vps4 C terminal oligomerisation domain
  Pfam module annotation: Pfam domain module=AAA::Vps4_C; Domain location=1-123::138-203
MARESAPSIIFIDEIDSLCGQRGEGNESEASRRIKTELLVQMQGVGHNDQKVLVLAATNTPYALDQAIRRRFDKRIYIPLPDLKARQHMFKARTIYSIVDRTEGFSGSDISVCVKDVLFEPVRKTQDAMFFFKNPEGMWIPCGPKQQGAVQTSMQELAAKGLASKILPPPIRRTDFEKVLARQRPTVSKADLDVHERFTKEFGEEG

SEQ ID NO: 157913 - protein, 841 aa, Glycine max
  Coding DNA Sequence Number=SeqID_41135
  Gene Ontology: Mol. function=hydrolase activity; Cellular component =intracellular; Biological process=metabolic process
  Homolog annotation: Hit_ID=Q9ZUW3; Match level="QueryCoverage=89%, HitCoverage=94%, E-value=0.0, Identity=40%"; Hit description =Putative selenium-binding protein
  Pfam annotation: Domain name=PPR; Domain location=178-212; Score =34.7; E_value=3.1e-07; Accession=PF01535.11; Description=PPR repeat
  Pfam annotation: Domain name=PPR; Domain location=257-291; Score =30.0; E_value=8.4e-06; Accession=PF01535.11; Description=PPR repeat
  Pfam annotation: Domain name=PPR; Domain location=292-326; Score=2.3; E_value=4; Accession=PF01535.11; Description=PPR repeat
  Pfam annotation: Domain name=PPR; Domain location=359-393; Score =48.3; E_value=2.6e-11; Accession=PF01535.11; Description=PPR repeat
  Pfam annotation: Domain name=PPR; Domain location=456-490; Score =35.6; E_value=1.7e-07; Accession=PF01535.11; Description=PPR repeat
  Pfam annotation: Domain name=PPR; Domain location=558-592; Score =49.9; E_value=8.8e-12; Accession=PF01535.11; Description=PPR repeat
  Pfam annotation: Domain name=PPR; Domain location=674-708; Score=3.3; E_value=3; Accession=PF01535.11; Description=PPR repeat
  Pfam annotation: Domain name=PPR; Domain location=77-111; Score=9.0; E_value=0.64; Accession=PF01535.11; Description=PPR repeat
  Pfam module annotation: Pfam domain module=PPR::PPR::PPR::PPR::PPR::PP R::PPR::PPR; Domain location=178-212::257-291::292-326::359-393::456 -490::558-592::674-708::77-111
MWLPNCLTLKYADDANWALTNTSTNPILRIRRYQYHCHANPLLQSHVVALNARTLLRDSDPRFAQQLFDQTPLRDLKQHNHLLFRYSRCDQTQEALNLFVSLYRSGLSPDSYTMSCVLNVCAGFLDGTVGEQVHCQCVKCGLVHHLSVGNSLVDMYMKTGNIGDGRRVFDEMGDRDVVSWNSLLTGYSWNGFNDQVWELFCLMQVEGYRPDYYTVSTVIAALSNQGEVAIGIQIHALVINLEMLELFLITWRTRISVSWNSMIAGNVINGQDLEAFETFNNMQLAGAKPTHATFASVIKSCASLKELGLVRVLHCMTLKNGLSTNQNFLTALMVALTKCKEMDHAFSLFSLMHRCQSVVSWTAMISGYLHNGGTDQAVNLFSQMRREGVKPNHFTYSAILTVQHAVFISEIHAEVIKTNYEKSSSVGTALLDAFVKTGNISDAVKVFELIEAKDVIAWSAMLEGYAQAGETEEAAKIFHQLTREGIKQNEFTFCSIINGCTAPTASVEQGKQFHAYAIKLRLNNALCVSSSLVTMYAKRGNIESTHEVFKRQMERDLVSWNSMISGYAQHGQAKKALEIFEEIQKRNLEVDAITFIGIISAWTHAGLVGKGQNYLNVMVNGMLEKALDIINRMPFPPAATVWHIVLAASRVNLNIDLGKLAAEKIISLEPQDSAAYSLLSNIYAAAGNWHEKVNVRKLMDKRKVKKEPGYSWIELRDAGYQPDTNYVFHDIEDEQKETIISHHSERLAIAFCLIATLPEIPLQIVKNLRVCGDCHNFIKLVSLVEKRLLLEIQTDFTTLKVVCVHVVTTGDVWANMLFVFRRFFSGSDLCFPKNPSTLSKA

SEQ ID NO: 157914 - protein, 730 aa, Glycine max
  Coding DNA Sequence Number=SeqID_41136
  Gene Ontology: Mol. function=transcription regulator activity; Cellular component=nucleus; Biological process=regulation of transcription
  Homolog annotation: Hit_ID=Q652L2; Match level="QueryCoverage=93%, HitCoverage=69%, E-value=0.0, Identity=70%"; Hit description =Putative HIRA
  Pfam annotation: Domain name=WD40; Domain location=115-153; Score =47.3; E_value=5.3e-11; Accession=PF00400.22; Description=WD domain, G-beta repeat
  Pfam annotation: Domain name=WD40; Domain location=157-195; Score =41.5; E_value=2.8e-09; Accession=PF00400.22; Description=WD domain, G-beta repeat
  Pfam annotation: Domain name=WD40; Domain location=251-322; Score =27.3; E_value=5.5e-05; Accession=PF00400.22; Description=WD domain, G-beta repeat
  Pfam annotation: Domain name=WD40; Domain location=327-365; Score =10.3; E_value=2.3; Accession=PF00400.22; Description=WD domain, G -beta repeat
  Pfam annotation: Domain name=WD40; Domain location=4-41; Score=22.0; E_value=0.0022; Accession=PF00400.22; Description=WD domain, G-beta repeat
  Pfam annotation: Domain name=WD40; Domain location=56-94; Score=36.0; E_value=1.3e-07; Accession=PF00400.22; Description=WD domain, G-beta repeat
  Pfam module annotation: Pfam domain module=WD40::WD40::WD40::WD40::WD4 0::WD40; Domain location=115-153::157-195::251-322::327-365::4-41::56- 94
MIAEKPSWVRHEGMQIFSIDVQPGGLRFATGGGDHKVRIWNMKSVSTDLENDDSSQRLLATLRDHFGSVNCVRWAKHGRYVASGSDDQVILIHERKPGSGTTEFGSGEPPDIENWKVAMTLRGHTADVVDLNWSPDDSALASGSLDNTIHVWNMSNGICTAVLRGHSSLVKGVAWDPIGSFIASQSDDKTVIIWRTSDWSLAHRTDGHWAKSLGSTFFRRLGWSPCGHFITTTHGFQKPRHSAPVLERGEWSATFDFLGHNAPIIVVKFNHSMFRRNLTNAQEVKSVPVGWTNGASKTGSKEPQPYNVIAIGSQDRTITVWTTASPRPLFVAKHFCTQSVVDLSWSPDGYSLFACSLDGSVATFHFEVKELGQRLGDAELDELKRSRYGDVKGRKANLAESPAQLLLEAASAKQTPSKKVVSDVQQNQSKAKAYVDVAVTAKNAELQNDDGKKSGGPVGDVSNKAATSGRISSPVKQREYRRPDGRRRIIPEAVGVPVQQENISGALQQALNFRIVSSDHRKDIERAVSNEDGARVCTLGGAHGRNTDIKERSGVTARATISESLVIEKVPASAGDGSVNVEQSSNLMSSSSLAACSGTLSIRVFDKKSGEDSSPILLEARPREHAVNDIVGLGNTSIMKETEIVCSKGPHTLWSDRISGKVTVLAGNGNFWAVGCDDGCLQAFHRMFYTFWYLGSISCASIKSIQVVNVFISCIFTTGIHTIVVVMLYD

SEQ ID NO: 157915 - protein, 99 aa, Glycine max
  Coding DNA Sequence Number=SeqID_41137
  Homolog annotation: Hit_ID=Q1SRT2; Match level="QueryCoverage=33%, HitCoverage=8%, E-value=2e-10, Identity=84%"; Hit description=Amino acid/polyamine transporter II
MRNVKGTQVIYNKHFPCLAPRSVTAKPLDRQLESIAFEIPDEYVVAPIHVGQITPELMCRCYMEGPRWGRYFVGPIQFAVCYNNEVLCALLGGQCMKVF

SEQ ID NO: 157916 - protein, 47 aa, Glycine max
  Coding DNA Sequence Number=SeqID_41138
MACTGIEISNQGEGETLEVHRDRVCWGKREEKGQVYIVDMGAIVSIK

SEQ ID NO: 157917 - protein, 248 aa, Glycine max
  Coding DNA Sequence Number=SeqID_41139
  Homolog annotation: Hit_ID=Q1STP5; Match level="QueryCoverage=47%, HitCoverage=21%, E-value=6e-07, Identity=34%"; Hit description=IMP dehydrogenase/GMP reductase
EVTITLGDVASLLHLPITSAFHSFEALHVDEAVLLLVELLEVIPDEARAEIAIAAEDYHERKPCAYCWNSKKTLPVSTYRKRLDRLTSDDVFWMPYKRVVWQFGYVQTIPPHSLAPRLCLEDIDGRWIHFSEYFAPVDQICVVPGQCAANYIDWFYMISHPFMRPAHPKDSARHPRIVHDDTYVESDIPQYLVAATAMEEAPIVDACQAIALRLEQLLNLRIVIEGTEAYNVMEDCLRITRGVTTECN

SEQ ID NO: 157918 - protein, 344 aa, Glycine max
  Coding DNA Sequence Number=SeqID_41140
  Gene Ontology: Mol. function=transferase activity; Biological process= protein metabolic process
  Homolog annotation: Hit_ID=Q1SRU1; Match level="QueryCoverage=94%, HitCoverage=58%, E-value=1e-144, Identity=77%"; Hit description =Glycosyl transferase, family 2
MLNIMIAESELKYMIMEEVNANECLLTRMQEMSLDYHFTVEQEVGSATHAFFGFNGTAGIWRIAAINEAGGWKDRTTVEDMDLAVRASLRGWKFLYLGDLQAKSELPSTLRAFRFQQHRWSCGPANLFRKMVMEIVRNKKVKFWKKVYVIYSFFFVRKIIAHMVTFFFYCVVLPLTILVPEVRVPIWGAVYIPSIITTLNSVGTPRSIHLLFYWILFENAMSLHRTKATFIGLLEAGRANEWVVTEKLGDSVNNKNKSNVTKAIRKSRFKFGESIPNSESIEIKSFNCICLADLLHLLELGFAAFLFLCGCYDYVHGKNNYFLYLFLQTITFSIVGFGYVGTIV

SEQ ID NO: 157919 - protein, 69 aa, Glycine max
  Coding DNA Sequence Number=SeqID_41141
MVFFVVVVELNRRRCTPSGSNHLGGRCNKFTGLGRFREDFAESLVSKKCDWEWWDSQTLVTRLRRCLGE

SEQ ID NO: 157920 - protein, 171 aa, Glycine max
  Coding DNA Sequence Number=SeqID_41142
  Gene Ontology: Mol. function=nucleic acid binding; Cellular component= intracellular; Biological process=regulation of transcription, DNA -dependent
  Homolog annotation: Hit_ID=Q8LJS2; Match level="QueryCoverage=66%, HitCoverage=46%, E-value=8e-32, Identity=56%"; Hit description =Histone deacetylase 2a
MEFWGAEVKVGESVKVDPAEFEACIHLSQAALGEAKKDKPEPVVLYMKVGEQKFVLGTLSREKIPQISLELVLEKEFELSHSSKSANSDEDDEDVPLINTENGKPETKAEDLKVPESKKAVAKASGSAKQVKVVEPKKDNEEDSDDDSDDDDFGSSDEEVLICFGFELLLL

SEQ ID NO: 157921 - protein, 879 aa, Glycine max
  Coding DNA Sequence Number=SeqID_41143
  Gene Ontology: Cellular component=chloroplast thylakoid membrane
  Homolog annotation: Hit_ID=Q9FNJ7; Match level="QueryCoverage=61%, HitCoverage=62%, E-value=1e-171, Identity=51%"; Hit description =Arabidopsis thaliana genomic DNA, chromosome 5, P1 clone:MDJ22
  Pfam annotation: Domain name=MORN; Domain location=204-226; Score =17.1; E_value=0.031; Accession=PF02493.10; Description=MORN repeat
  Pfam annotation: Domain name=MORN; Domain location=247-268; Score =2.4; E_value=4; Accession=PF02493.10; Description=MORN repeat
  Pfam annotation: Domain name=MORN; Domain location=341-362; Score =21.8; E_value=0.0024; Accession=PF02493.10; Description=MORN repeat
  Pfam module annotation: Pfam domain module=MORN::MORN::MORN; Domain location=204-226::247-268::341-362
MANDQDQQDSPQQNAPYSDSSSDSDYDSDYSYDEAEDEAFRRAFGQREDGDESSPPENLKRDDPEANFRAFSEALESPAMKELHEELDPLIAEKKNPYDFPRDHEEWTEQDLRELWADGPYEIGGTGWDPVWATDDEWRYVKEQIADGEEPPIAPFYLPYRKHYPPIPDNHYDIATPKDAIEELDRIEEFLKWVSYIFEDGSTYEGTVWDDYAHGKGVYVSDDALVRYSNPDVVDDGFTIPASTSRYEGEWFQNDVEGHGVVEVDIPVIEPAPGSKLEAKMRSQGKIIARDFLSPEDREWLEKDIEDMYYLADGNYEIPFYENEEWVRQFGRKPEKGRYRYAGQWKHGRMHGCGVYEVNERILYGRFYFGEYVDEVSGCDEDISAMHAGIAEVAAAKARMFVNKPDGMVREKRGPYSDPQHPYFYEEEDVWMAPGFINQFYEVPDYWKVYVHEVDQEREMWLNSFYKAPLRLPMPAELEHWWSKEENHKIPEFVLINKEPEPDPEDPSKLIYTEDPLILHTPTGNIINYVEDEKYGIRLFWQPPLGKDEDVDPEKAVFLPLGYDDFYGIEKEEKKESIWMRTILAIENACKPWFDKLDKWTEEQKKINEEEKKAIEEDLELIEAEIGLEEAIEDMEELLRIREKEEEKKAKMGLLDEEDDDNEGDGDDMTSVTKQDEKAPAKVVEVPAEVEEEDDDDWDDEEDDNSAQSSFGSVEQGQTTDQLKGKPGKSPFSASSLAFASSSLISAIPSKLQLSFSFWNKGRSKPKPVPPPCIDSLSNMKTVDSVNFRPVTSQNGSLKAVGKTHGKVKTRSSFGGKFLGVHSQTRSHLLASANSSSNLKEPRVSSDMWLHAAPERDLDSILSLHSSLYYFEQHREIIW

SEQ ID NO: 157922 - protein, 54 aa, Glycine max
  Coding DNA Sequence Number=SeqID_41144
MATARGALKYPVYGIVILRLGIYTDRPNVSKTTFLNEKLHTTPEFQQTLLTTTK

SEQ ID NO: 157923 - protein, 71 aa, Glycine max
  Coding DNA Sequence Number=SeqID_41145
MNPKAVSLLSPVITTKKLYPLLAMNPKAVSLLDPLINQEANLLLAMNPKVVSLLSPVFNQEDLLLKNSHQE

SEQ ID NO: 157924 - protein, 68 aa, Glycine max
  Coding DNA Sequence Number=SeqID_41146
MKLGGRRRYPSGYSYKHYFAIRKTQSTIASRDERRLLHPLSIAANEPVDTRRFTSSSMLPVILTREVR

SEQ ID NO: 157925 - protein, 261 aa, Glycine max
  Coding DNA Sequence Number=SeqID_41147
MQRYLMVIRIICQLEASEPVDTQRLTSSSAPLSSRDGESDDMQRYLMVIRTFCQPEASEPIDMQRLTSSSAPLSSRDGESDDMQRYLMVIRTFCQLEASEPFDTQRLTSSSAPLSSRDGEFDDMQRLLMVIHTFCQLEANDAVDTQRLTLSSASLSSRDGESDDMQRYFMVIRTFCQLEASEPIDTQRLTSSSAPLSSRDGESDDMQRYLMVICTFCQPEASEPIDMQRLTSSSAPLSSRDGESDDMRRYLMVIRTFCQLE

SEQ ID NO: 157926 - protein, 213 aa, Glycine max
  Coding DNA Sequence Number=SeqID_41148
  Gene Ontology: Mol. function=RNA-directed DNA polymerase activity; Cellular component=extracellular region; Biological process=RNA -dependent DNA replication
MSGVISSNLALKWNSEKLDSFSPTRGLRQGDLLSPYLFLLYDCLLFTNAKSSQVSLVREVLYSFCLASRMKINVHTSRFLPSENVPRAKVLRFGGMLEFQHTFNIWQYLGFPLLSVDSRLVGWKGKLLSRAGKVTFAKSILSSMPIYIMHNLCISEGICDSLDSTIKQFYLGWEDWSLGLNGQQPSLQGVEVAWVCTVIGPLTLQCLRNIYGS

SEQ ID NO: 157927 - protein, 92 aa, Glycine max
  Coding DNA Sequence Number=SeqID_41149
MFDQQAVVSPAKPPQRPDPEVDDPLYLMTLTIPELFLQPFQVNWDATMFGVCHPNFPLYIKYEDLSKIAHGSQCLNISVIQLWILHLTKTSI

SEQ ID NO: 157928 - protein, 194 aa, Glycine max
  Coding DNA Sequence Number=SeqID_41150
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=98%, HitCoverage=68%, E-value=1e-93, Identity=74%"; Hit description =Photosystem II D2 protein (Photosystem Q(A) protein)
  Pfam annotation: Domain name=Photo_RC; Domain location=1-194; Score =163.9; E_value=4.3e-46; Accession=PF00124.9; Description =Photosynthetic reaction centre protei
SYLEGCNFLTAAVSTPANSLAHSLLLLWGPEAQGDFTRWCQLGGLWTFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDVTGLWMSALGVVGLALNLRAYDFVSQEIRAAERS

SEQ ID NO: 157929 - protein, 152 aa, Glycine max
  Coding DNA Sequence Number=SeqID_41151
MTGRLLVGSLTFDCRIMHYIIVRILMPRSSNLAQAFEEDLILMWAFLTSRLIDWTHLIHYRMHKALRSSAPLPYPQLVTLLLRHFEIPLDSKPFVQVKRSFAIGVGAVTSFGYRKDIDGQWLKKDAQPPQDKRTPSPSPQRDDSSALMHEVL

SEQ ID NO: 157930 - protein, 461 aa, Glycine max
  Coding DNA Sequence Number=SeqID_41152
  Gene Ontology: Mol. function=hydrolase activity; Cellular component =nucleus; Biological process=mRNA processing
  Homolog annotation: Hit_ID=Q9LKF9; Match level="QueryCoverage=95%, HitCoverage=59%, E-value=0.0, Identity=76%"; Hit description =Cleavage and polyadenylation specificity factor 100 kDa subunit
  Pfam annotation: Domain name=Lactamase_B; Domain location=17-205; Score=29.2; E_value=1.5e-05; Accession=PF00753.17; Description =Metallo-beta-lactamase superfamily
MGTSVQVTPLCGVYNENPLSYLVSIDGFNFLVDCGWNDHFDPSHLQPLARVASTIDAVLLSHADTLHLGALPYAMKRLGLSAPVYSTEPVYRLGLLTMYDQYLSRKQVSEFDLFTLDDIDSAFQSVTRLTYSQNHHFSGKGEGIVIAPHVAGHLLGGTIWKITKDGEDVIYAVDFNHRKERHLNGTVLGSFVRPAVLITDAYNALNNQPYRRQNDKEFGDILKKTLRAGGNVLLPVDTVGRVLELILMLELYWADENLNYPIYFLTYVASSTIDYVKSFLEWMSDTIAKSFEKTRENIFLLKYVTLLINKTELDNAPDGPKVDYFVVLASMASLEAGFSHDIFVEWANDVKNLVLFTERGQFATLARMLQADPPPKAVKVVVSKRVPLVGEELIAYEEEQNRIKKEALKASLMKEEELKTSHGADNDISDPMVIDSGNNHVPPEGNQNYPFQIHVIITFSP

SEQ ID NO: 157931 - protein, 527 aa, Glycine max
  Coding DNA Sequence Number=SeqID_41153
  Gene Ontology: Mol. function=DNA binding; Biological process =regulation of transcription
  Homolog annotation: Hit_ID=Q5NB82; Match level="QueryCoverage=98%, HitCoverage=48%, E-value=1e-77, Identity=39%"; Hit description =Nodule inception protein-like
  Pfam annotation: Domain name=PB1; Domain location=427-509; Score =103.0; E_value=9.1e-28; Accession=PF00564.15; Description=PB1 domain
  Pfam annotation: Domain name=RWP-RK; Domain location=112-163; Score =103.8; E_value=5.1e-28; Accession=PF02042.6; Description=RWP-RK domain
  Pfam module annotation: Pfam domain module=PB1::RWP-RK; Domain location=427-509::112-163
MKPHFQSLKIASGIELEENASIEIIEARNERVNLRFESIPITQSSKSPPRHASPNVGEGLPLEPSEQKIMAYFDGINDGGSLGDNAGGHIDQNTSLKIKTKKKPSERKRGKAEKSISLDVLQHYFTGSLKDAAKSLGVCPTTMKRICRQHGISRWPSRKIKKVNRSLSKLKCVIESVHGAERAFGLNSLSTVSLPIAAGSFSEPSTSNKFNRQTSLTIRPSEPKINEKDFDASGASETKRQAAMEDQFLGLEARAQSPEKVINDRGVATQEIGTKGTNKFRTGSGSSESSGNPTPHGSCHGSPPNEISPPKDIFVTGHSEKCLVLRGSLGSTTLHSTSTPNCTTAYPMPHIVETTEPQELFGGQLLERAGSSKDLRNLCPSADAVLEDQVPEAYKMNPQCSDLPQMQHMDNLNNTLTPFAVRKEVKSVTIKATYKEDIIRFKVSMDCGIVELKEEIAKRLKLEAGTFDIKYLDDDHEWVLIACDADLQECMDISRSSGSNVIRLVVHDILPILGSSCESSGDWKGCI

SEQ ID NO: 157932 - protein, 356 aa, Glycine max
  Coding DNA Sequence Number=SeqID_41154
  Gene Ontology: Mol. function=DNA binding; Biological process =regulation of transcription
  Homolog annotation: Hit_ID=Q5NB82; Match level="QueryCoverage=69%, HitCoverage=26%, E-value=1e-103, Identity=73%"; Hit description =Nodule inception protein-like
MSESKDENPDLPPKSKPQEEHGFAMDFDISLESLWPSDHISLVSNPMSPFLFSTISDQPCSPVWAFSDAEDERLIRIAASAGNTNTTTENLVENYDNKKTVPPLVAIPTSENPDAYCLIKERMTQALRHFKELTEQNVLAQVWAPMRNGNRYALTTSGQPFVLDPHSNGLHQYRTVSLMYMFSVDGENDEIMGLPGRVFQQKIPEWTPNVQFYSSKEYQRLNHAQHYNVRGTLALPVFELAGQSCVAVVELIMTSQKINYAPEVDKICKALEAVKLRSSEILEHQYIQICNEDRQYALAEILEILTVVCETHSLPLAQTWVPCKHRSVLAHGGGHKKSCSSFDGCCMGQVCMSITE

SEQ ID NO: 157933 - protein, 50 aa, Glycine max
  Coding DNA Sequence Number=SeqID_41155
MKKISTTLQGKENEPPPQWIEPKNEWIKVCICSNSRTVPNFIGKCTESLK

SEQ ID NO: 157934 - protein, 83 aa, Glycine max
  Coding DNA Sequence Number=SeqID_41156
  Gene Ontology: Mol. function=ribonuclease H activity; Biological process=DNA integration
MVTEPQSARQPGQHRSHWFSEGDSVLKKVSQALKDNKGKWAPNYEGSFVVKRDFSGGALVLANMDDEELPSPVNSDVFKRYYA

SEQ ID NO: 157935 - protein, 61 aa, Glycine max
  Coding DNA Sequence Number=SeqID_41157
MHEGMHMTQMQSRNAGSQGIVPFLDTTSRGSKGPQQGIKTEPVCDAYAKDAPPRTPHSTTI

SEQ ID NO: 157936 - protein, 46 aa, Glycine max
  Coding DNA Sequence Number=SeqID_41158
MFDVEKCEILRVREAKFGVSGNWSLKWVDPSLKCQLGLVGKLGQSK

SEQ ID NO: 157937 - protein, 171 aa, Glycine max
  Coding DNA Sequence Number=SeqID_41159
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSRKT

SEQ ID NO: 157938 - protein, 328 aa, Glycine max
  Coding DNA Sequence Number=SeqID_41160
  Gene Ontology: Mol. function=helicase activity; Biological process =protein amino acid phosphorylation
  Homolog annotation: Hit_ID=Q9ZQR0; Match level="QueryCoverage=88%, HitCoverage=26%, E-value=6e-69, Identity=42%"; Hit description =Putative helicase
  Pfam annotation: Domain name=DUF889; Domain location=211-328; Score =17.1; E_value=1.2e-12; Accession=PF05970.5; Description=Eukaryotic protein of unknown function (DUF889)
MGFLQDDREYVEAIREAKDWGTANYLRKLFVLILLTGAMSKPEEVWNQCWHWLADDIAYQYTKSTINSDEQKTIYHRIIQVVNNNEGGMFFLYGFVGTGKTFIWRTLANSLRAENQIVIIVASSGIASLLLPGGRTAHSRFKIPIPIFEDSTCNIHQGTELAELLNQTSLIIWDEAPMAHKFCFEALDQSLRDIITDKSKSSQIFGGKVIVFGGDFRQILPVIPRGTRSDIVNAAINSSYLWDSCEILTLTKNMHLHNNLESVDEQETATFAKWILDVGDGIIDDENDGYATIQIPAHLLITQYDDPISAIVKSTFPDLDQHHNNPES

SEQ ID NO: 157939 - protein, 74 aa, Glycine max
  Coding DNA Sequence Number=SeqID_41161
MKNGGKPSRNRPRKRLESVKEVPRLGFSSRKQFFSLILREKRVVVATQLAQANWVASTRRHCLLLEDPGGPKWA

SEQ ID NO: 157940 - protein, 227 aa, Glycine max
  Coding DNA Sequence Number=SeqID_41162
  Gene Ontology: Mol. function=sugar porter activity; Cellular component=membrane; Biological process=transport
  Homolog annotation: Hit_ID=Q39GS4; Match level="QueryCoverage=57%, HitCoverage=38%, E-value=8e-55, Identity=89%"; Hit description=ABC sugar transporter, inner membrane subunit
  Pfam annotation: Domain name=BPD_transp_2; Domain location=1-132; Score=-13.9; E_value=0.00062; Accession=PF02653.6; Description =Branched-chain amino acid transport system  permease component
MIAAQFVLTRTVFGRYLVGIGTNEEAVRLAGVNPRPCKILVFALMGALAGLASLFQISRLEAADPNAGAGLELQVIAAVVIGGTSLMGGRGSVISTFFGVLIISVLAAGLAQIGANEPTKRIITGAVIVVATDRTDQRETGNGDDQGCGIHGGRVVYDRLARGEQLAAGVCGCACDGLGRNPRAELRAVGRGTLAEGACDGDHRPRRAEQHESVFLGTCARHLGSWR

SEQ ID NO: 157941 - protein, 55 aa, Glycine max
  Coding DNA Sequence Number=SeqID_41163
MAEALICCQNLLKPTLQQFIELCPSQELEESKNIMAKFERGTMGIQGARIADGGV

SEQ ID NO: 157942 - protein, 87 aa, Glycine max
  Coding DNA Sequence Number=SeqID_41164
MYLVIFVSIDVTNLTFVNCPLQMNKKLQQLRAPKKKQLQATKLSVEGRGGDPVSSINGNLKERDVMKIHPYTAFVYSFSAAGNPKYI

SEQ ID NO: 157943 - protein, 101 aa, Glycine max
  Coding DNA Sequence Number=SeqID_41165
  Subcellular localization annotation: CTP_CleavageSite=86; ConfidenceScore=5.41e-01
MNLFPSAVHAFSTHESGALRIYCLALFANSPFSTLIRRPMNSLPSAVHVSSTIESGAPRIHFLALFANSPFSIFRRPANSLPSAIRQFSILNLSETHEFIA

SEQ ID NO: 157944 - protein, 102 aa, Glycine max
  Coding DNA Sequence Number=SeqID_41166
MGLRIRLEDGELANSARQSIRGATNSMGSRLDGVGRMNSARLDGGGRMNSARQSIHGLDGGGRMNSARQSTHGSPNKIENGELANSARQSIRGAPDSMVEDA

SEQ ID NO: 157945 - protein, 74 aa, Glycine max
  Coding DNA Sequence Number=SeqID_41167
MCPRRTHQWRWRKPPAMLPVAVARSRVPFPREIASVHGDLACMQRENHITAHTLPIVFPTYNMRLSSCVKCMEG

SEQ ID NO: 157946 - protein, 72 aa, Glycine max
  Coding DNA Sequence Number=SeqID_41168
MHETQCGPPRVHRMNRKAWFEQNRGDGCRPARPGELSSPRRARLLPPEATAFWRNILEGPSGPGCYLHPHFY

SEQ ID NO: 157947 - protein, 160 aa, Glycine max
  Coding DNA Sequence Number=SeqID_41169
MAKGARKFSQKVIKRCAKGDQKVNKPPTHRILVGNQRERTTLGHGFLSFLVYLVTIPYCSDIVWARFFGKLGFWLKACRTAGHDICQGFLFLFSEVNKPPTHRILVGNQRERTTLGHGFLSFLVYLVTIPYCSDIVWARFFGKLGFWLKACRTAGHDICQ

SEQ ID NO: 157948 - protein, 98 aa, Glycine max
  Coding DNA Sequence Number=SeqID_41170
MGFRLKEGFLAKRRKALVYAHPAERRLSGRTRRQLPMPSRQNEKAMEACGTDFTRDVSELDCKTESRGEGVLARPRPLSLSIDFLKDDLAVDDVPARE

SEQ ID NO: 157949 - protein, 252 aa, Glycine max
  Coding DNA Sequence Number=SeqID_41171
  Homolog annotation: Hit_ID=Q9FLQ5; Match level="QueryCoverage=86%, HitCoverage=34%, E-value=7e-56, Identity=54%"; Hit description =Arabidopsis thaliana genomic DNA, chromosome 5, P1 clone:MCO15
SDKQFHDDDFGMQRGDESARSENESKFRNELKHIKWRPPGIGTKQDWQDRINNIRKGRKEVEVTDKVGDVNVGSVPFYDENLYILNVKNDLDAKASEAIPTVEGLTAATKHPIPPSSVLKQLAIAIEAGRQTNSMKDFVASSPAREKAGLSISSVKALVLREKEDKLTSEFSSDEKVVYLINSLFDQEGEFLRRKINSDPEETSISSLPRDIHGAPPESLVVKLAEVIGNFKTLRGMSLFWSRVVDEVCLTK

SEQ ID NO: 157950 - protein, 71 aa, Glycine max
  Coding DNA Sequence Number=SeqID_41172
  Subcellular localization annotation: CTP_CleavageSite=19; ConfidenceScore=5.00e-01
MALRSANMHSSCFFQILPRAQPRSVALSGWLAKPTGWLSERQKQNKNPEWESPLNRREEQCKEHMHEVGQQ

SEQ ID NO: 157951 - protein, 141 aa, Glycine max
  Coding DNA Sequence Number=SeqID_41173
MLNFFTPTPYEISPHTYISTIFHIEQRKTLSFVFDVYDEDEDVVFGNWEVRTTAKFSALSKVEFKSLSPGFATTNALSITDENSFSELNELKLDSCLKMVVVVSSKTLQELRNLKRLIVTHWKWYSRFMRKYLIPQSSYSN

SEQ ID NO: 157952 - protein, 526 aa, Glycine max
  Coding DNA Sequence Number=SeqID_41174
  Homolog annotation: Hit_ID=Q8W1W5; Match level="QueryCoverage=23%, HitCoverage=25%, E-value=3e-55, Identity=79%"; Hit description =Putative transcription factor MYB101
  Pfam annotation: Domain name=Myb_DNA-binding; Domain location=106 -151; Score=49.7; E_value=9.8e-12; Accession=PF00249.21; Description =Myb-like DNA-binding domain
  Pfam annotation: Domain name=Myb_DNA-binding; Domain location=53-100; Score=39.7; E_value=1e-08; Accession=PF00249.21; Description=Myb-like DNA-binding domain
  Pfam module annotation: Pfam domain module=Myb_DNA-binding::Myb_DNA -binding; Domain location=106-151::53-100
MEGMANICDDATDGDNAFLTMFGGDESGGSGGSGGRSGGDQGGGNVEDVALKKGPWTTAEDAILTDYVTKHGEGNWNAVQRNTGLNRCGKSCRLRWANHLRPNLKKGAFSPEEEKIIVDLHSQFGNKWARMAALLPGRTDNEIKNYWNTRIKRRQRQGLPLYSDEHDHNHRSTTPTSPTTPSPCLTPTGSNPNIATSFEFFNQNQQQQQQYQHQYQYQQQQHPLSPTASHHSPLSSPLQHRQPFTSSSPHNFLDHSPLPLSSSSPSPLSFSFQKPAPMLSTPLRFKRYRTSPSYNNHLSDPPLTTQFPHLDGFRFPVSSGFSQFFQPSLLDSDRGVSSSSSLAFQPKLELPSSQYYKPPHEQDIKLDIEFNDPSFQSSSSGFLGDLLFEAQAMASGQNSKKRGYLSLNERNDVFDACQSFENFPSSSLYWPSSTSEPKPKEEAPDFSKFMNEEVSSLLTVVPSSSMHGHEWHNNSATEVSNVQSSGSGKTDDNFVLDIKPITSLFPLSNTASHDENQGCYSWDNLP

SEQ ID NO: 157953 - protein, 84 aa, Glycine max
  Coding DNA Sequence Number=SeqID_41175
MGVNNNLNLGLSGTFWKLGCLRRKQLGGKLLHVVENGFWGFHGFQNPSRGAFVSDSWEILHRSSSFSIRSSSFFSLQPFSFLPF

SEQ ID NO: 157954 - protein, 76 aa, Glycine max
  Coding DNA Sequence Number=SeqID_41176
MKENPLYAKFRFKILPFKEELDALFKDVVAKGKYSYAPSYGTLPNLINESDDVHRPSFDNDNVDLEEGIVKKFSTS

SEQ ID NO: 157955 - protein, 101 aa, Glycine max
  Coding DNA Sequence Number=SeqID_41177
MVDFFVDVGEDHDGDAGDDVEEERCSASRGGEILEFPCIPLFPPMGVASYPMHVLFPPVGVAIYPMAQPIIHPSCWHDSSRHRGEKTQGWFRQCHLRDSLH

SEQ ID NO: 157956 - protein, 274 aa, Glycine max
  Coding DNA Sequence Number=SeqID_41178
  Gene Ontology: Mol. function=binding; Cellular component=microtubule
  Homolog annotation: Hit_ID=Q9T041; Match level="QueryCoverage=72%, HitCoverage=23%, E-value=6e-51, Identity=54%"; Hit description =Microtubule-associated protein TORTIFOLIA1
  Pfam annotation: Domain name=HEAT; Domain location=121-157; Score =3.3; E_value=17; Accession=PF02985.12; Description=HEAT repeat
  Pfam annotation: Domain name=HEAT; Domain location=37-73; Score=8.1; E_value=4.4; Accession=PF02985.12; Description=HEAT repeat
  Pfam annotation: Domain name=HEAT; Domain location=75-107; Score=9.1; E_value=3.3; Accession=PF02985.12; Description=HEAT repeat
  Pfam module annotation: Pfam domain module=HEAT::HEAT::HEAT; Domain location=121-157::37-73::75-107
MVELKQKILTSLSKLSDCDTHQIAVEDLENTILGLLPDAIPMIFNSLYEAATNPKPAVKRVTLRLLAAVCARHSDAAVAHVVRRLKDANSAVRDACRNTVGALIVQYLKGDDGGGGRGGVGTVVGLFVKPLFEAMGEQNKGVQAGAAVCMAKMVECGSGSGGGEAVPVAAFQKLCPRICKLLNSPVSEPYWSRIEAVSSLRKPYPSRAARTQAPTITNYDVGSAIWTDLRKTPLLSAMETTLTNVFDVGLILIWLPAIHAWSQVANAPSKLEPL

SEQ ID NO: 157957 - protein, 622 aa, Glycine max
  Coding DNA Sequence Number=SeqID_41179
  Gene Ontology: Mol. function=diacylglycerol kinase activity; Cellular component=intracellular; Biological process=protein kinase C activation
  Homolog annotation: Hit_ID=Q10MC4; Match level="QueryCoverage=80%, HitCoverage=90%, E-value=1e-157, Identity=39%"; Hit description =Pentatricopeptide, putative, expressed
  Pfam annotation: Domain name=PPR; Domain location=223-257; Score =51.1; E_value=3.6e-12; Accession=PF01535.11; Description=PPR repeat
  Pfam annotation: Domain name=PPR; Domain location=26-60; Score=39.0; E_value=1.6e-08; Accession=PF01535.11; Description=PPR repeat
  Pfam annotation: Domain name=PPR; Domain location=324-358; Score =33.3; E_value=8.5e-07; Accession=PF01535.11; Description=PPR repeat
  Pfam annotation: Domain name=PPR; Domain location=395-429; Score =16.2; E_value=0.09; Accession=PF01535.11; Description=PPR repeat
  Pfam annotation: Domain name=PPR; Domain location=90-124; Score=40.0; E_value=8.1e-09; Accession=PF01535.11; Description=PPR repeat
  Pfam module annotation: Pfam domain module=PPR::PPR::PPR::PPR::PPR; Domain location=223-257::26-60::324-358::395-429::90-124
MNLYAVCGSVGSARRVFEESPVLDLVSWNTLLAGYVQAGEVEEAERVFEGMPERNTIASNSMIALFGRKGCVEKARRIFNGVRGRERDMVSWSAMVSCYEQNEMGEEALVLFVEMKGSGVAVDEVVVVSALSACSRVLNVEMGRWVHGLAVKVGVEDYVSLKNALIHLYSSCGEIVDARRIFDDGGELLDLISWNSMISGYLRCGSIQDAEMLFYSMPEKDVVSWSAMISGYAQHECFSEALALFQEMQLHGVRPDETALVSAISACTHLATLDLGKWIHAYISRNKLQVNVILSTTLIDMYMKCGCVENALEVFYAMEEKGVSTWNAVILGLAMNGSVEQSLNMFADMKKTGTVPNEITFMGVLGACRHMGLVNDGRHYFNSMIHEHKIEANIKHYGCMVDLLGRAGLLKEAEELIDSMPMAPDVATWGALLGACRKHRDNEMGERLGRKLIQLQPDHDGFHVLLSNIYASKGNWGNVLEIRGIMAQHGVVKTPGCSMIEANGTVHEFLAGDKTHPQINDIEHMLDVVAAKLKIEGYVPTTSEVSLDIDEEEKETALFRHSEKLAVAFGLITISPPTPIRVTKNLRICNDCHTVVKLISKAFDRDIVNQMSFNLNALAGKE

SEQ ID NO: 157958 - protein, 233 aa, Glycine max
  Coding DNA Sequence Number=SeqID_41180
  Gene Ontology: Mol. function=nucleic acid binding; Cellular component= intracellular; Biological process=chromatin modification
  Homolog annotation: Hit_ID=Q9FM27; Match level="QueryCoverage=93%, HitCoverage=83%, E-value=4e-71, Identity=55%"; Hit description =Arabidopsis thaliana genomic DNA, chromosome 5, P1 clone:MNF13
MGHADSNAGRTLNQEGGDHQIHCSRERSRTAWKIIQEYLMPFVEKEKYHISKRCRLHPDNDIYRDQEQHKFHTDINEWQCGFCKKSFYEEKHLDQHFDNRHSNLLNLSESQCIADVCGALHCDHEMNSGSKKSKCNPAAAAKNKHLCESLADSCFPVTEGPAASRTSCCTGNRKPFSRGRRKKTNVFYIFVSILLVILLLLYYLYIYLYQRGMKRETQVLKRVSQASRKKKPS

SEQ ID NO: 157959 - protein, 178 aa, Glycine max
  Coding DNA Sequence Number=SeqID_41181
MVGVLVALMVVATSGDDVGGDSDKCGIGDNDSGGGSDDGNTNVNSDSDDIDDDSSSGSGDNVDGDDNKRGIGGNESGDNGGDISNINVTMVVTVVVMVVISTLRAMMIIAMVQLYHSGCILPRLLNLDVKLVPPRVAVGGGGGVNHWWLPAKRKKRKEFSEEVTILHLVELQHLTVLQ

SEQ ID NO: 157960 - protein, 131 aa, Glycine max
  Coding DNA Sequence Number=SeqID_41182
  Gene Ontology: Mol. function=transmembrane receptor activity; Cellular component=membrane; Biological process=defense response
  Homolog annotation: Hit_ID=Q1SHM2; Match level="QueryCoverage=93%, HitCoverage=26%, E-value=1e-38, Identity=62%"; Hit description =Leucine-rich repeat
GLATHEDIFLPSDNYPYWLAHTGEGPSVCFTVPEDFCMKGMALCVVHVSTPEIVATKCLTSVVIVNCTKCTIQIYKRDTVISFNDEDWRDIISHLGAGDKVEIVVTFEHRLVVKKTTVYLIYDEMEPVMKV

SEQ ID NO: 157961 - protein, 83 aa, Glycine max
  Coding DNA Sequence Number=SeqID_41183
  Gene Ontology: Mol. function=binding; Cellular component=microtubule
  Homolog annotation: Hit_ID=Q9T041; Match level="QueryCoverage=91%, HitCoverage=10%, E-value=6e-12, Identity=61%"; Hit description =Microtubule-associated protein TORTIFOLIA1
TQGADFAVRNACRDTMGALATQDSGGAVRGNGEAEQGGAGGGGGVHGQDGGVWWWQRRRGGGAGGSVSKAVSEDLQAAQQSRI

SEQ ID NO: 157962 - protein, 510 aa, Glycine max
  Coding DNA Sequence Number=SeqID_41184
  Gene Ontology: Mol. function=RNA-directed DNA polymerase activity; Cellular component=chromatin; Biological process=chromatin assembly or disassembly
MLCDSDSATQIPHASRIFEAPMQEAHTEEPARGNNRTCTRLGYLRDYVLLAVEVHSIFGPTHHLRSVTTIPEHNTRQATLDRLEEAVHRLTQAQAALSQNHANLAQTQTSMTTKLDSALEHLVALTIPTPTPQPPPHTTSPLPPTPKPHMKLDVPRFDGQDPVGWIFKISQFFDYQGLPDQERITVASFYMDGPALSWVIPGAPVRGSGASAYVVAASSDSRKLQEEKLQDRRRPPRTPPVHQSQVSPPVTSSSLVPSPARPLIKRLTAEELTVRCDKGICYHCDDKWIVGHRCRPRLHLLIADEDDDCIGMPYLAPSIVPEVSNQPQPPLDVPQISLNALSRMPTLETFRIYGTIARHQLQQVPATTMHVMIGNGSTIECNTKFPSVPITIQGFSFAVDLFQLPISGADIVLGVQWLKTLGPVTTDYSSLKMSFTFPSQPTSLSADIPMLPSPALAQQLKCLAQTHDISALYHLTHVPDPQPTFLVYPSSTPPTPLLTKHNPPLLDLLL

SEQ ID NO: 157963 - protein, 205 aa, Glycine max
  Coding DNA Sequence Number=SeqID_41185
  Gene Ontology: Mol. function=pyridoxal phosphate binding
  Homolog annotation: Hit_ID=Q9FGL6; Match level="QueryCoverage=94%, HitCoverage=67%, E-value=1e-17, Identity=43%"; Hit description =Arabidopsis thaliana genomic DNA, chromosome 5, P1 clone:MJM18
MRRRIMKFLNISDNDYMVFTANRTSAFKLVADSYPFQSSKKLLTVCDYENEAVEAMISCSEKRGAKAHSSTCKTKRRCLDQVDSLGLIMITNRTRYLINWLVNSMMKLKHPNAEGVPLVKIYGPKVNLIGDLLWLSMCLIGKVKRLSLSLYRSLLIGTIYLSAMDFSIMFDVYKLWTFVARFLDADFVEKERWRYTTLNQKTIEV

SEQ ID NO: 157964 - protein, 84 aa, Glycine max
  Coding DNA Sequence Number=SeqID_41186
  Gene Ontology: Mol. function=ribonuclease H activity; Biological process=DNA integration
MSHGRLYQKQVKNAFDKKVRTHRFSEGDLVLKKVFQALKDNRGKWAPNYEGPFVVKMAFSGGALVLTNMDGEELPSPVNSDVVK

SEQ ID NO: 157965 - protein, 91 aa, Glycine max
  Coding DNA Sequence Number=SeqID_41187
  Gene Ontology: Mol. function=nucleic acid binding
  Homolog annotation: Hit_ID=Q2HSF6; Match level="QueryCoverage=83%, HitCoverage=5%, E-value=2e-14, Identity=50%"; Hit description =Glycoside hydrolase, family 1; Zinc finger, CCHC-type; Polynucleotidyl transferase, Ribonuclease H fold
MNQNEIIQEMQKRFTHIVNHLASLGKMFPNEDLINKVLRCLSRQWQKKVTAIMGSKDLTNMSLATLFGKLQEHEIELMRLNQHEENDKKKK

SEQ ID NO: 157966 - protein, 182 aa, Glycine max
  Coding DNA Sequence Number=SeqID_41188
  Homolog annotation: Hit_ID=Q1SPB9; Match level="QueryCoverage=99%, HitCoverage=50%, E-value=1e-11, Identity=24%"; Hit description =Transposase
NALNEIAAEVEHLCYLGNNPFSCGCVMRSTHGLPRGWLCEAEVSIKEEVETISKRFEELDVNTKGAPKKSMKRRQISTKHDLSYWEYVDAFHSVQSSNSSVKHSASSSKPPKPTRIIPMLDQFAPFIQGFIHNVVDVKADGNCEYRSIAALLGMREDSWSLVSVDKWMDIKEMGYVIASRYN

SEQ ID NO: 157967 - protein, 87 aa, Glycine max
  Coding DNA Sequence Number=SeqID_41189
  Subcellular localization annotation: CTP_CleavageSite=63; ConfidenceScore=5.11e-01
MTRAAVLDCAGDDYRGGAGFFSVCPATFLKGTAGRGRVLRWPVRSLISPDLQQRRAVVLRRVSAAQLAVGGRAASEAGEPVANTLPI

SEQ ID NO: 157968 - protein, 470 aa, Glycine max
  Coding DNA Sequence Number=SeqID_41190
  Gene Ontology: Mol. function=nucleoside transporter activity; Cellular component=integral to membrane; Biological process =nucleoside transport
  Homolog annotation: Hit_ID=Q1Z5W1; Match level="QueryCoverage=87%, HitCoverage=96%, E-value=1e-155, Identity=65%"; Hit description =Putative transport protein
  Pfam annotation: Domain name=MFS_1; Domain location=52-407; Score =80.0; E_value=7.6e-21; Accession=PF07690.6; Description=Major Facilitator Superfamily
  Pfam annotation: Domain name=Nuc_H_symport; Domain location=45-450; Score=728.8; E_value=3.6e-216; Accession=PF03825.7; Description =Nucleoside H+ symporter
  Pfam module annotation: Pfam domain module=MFS_1::Nuc_H_symport; Domain location=52-407::45-450
  Subcellular localization annotation: CTP_CleavageSite=27; ConfidenceScore=5.50e-01
MATVSQPQDAAPHPARPSRPPAPNPPRLSVIHKIGSTNTGESISMKTTIPKLSFMMFLEWFIWGAWFVPLWAFLSKNGFSPVEIAWCYACTSIAAILSPILVGSLADRFFQAQKVLSLLTIAGAILMFFAAQQTHFSSFFPLLLLYALTYMPTIALTNSIAFSHVGDVERDYPRIRVMGTIGWIASGIACGFLPPLLGFGDISASNVPLLITAASSLLLGLFALTLPATEPKSTGKFSLRVALGLDALHLLKDRSFLVFFVCSFLFSMPLAFYYIFAEGYLTEVGLPHATGWMTLGQVSEIFFLLALPFFIKRFGIGKVLLLGLVTAALRYVFFVFGGDQNLLTFGLLFMGILLHGVSYDFYFITAYIYVDKKAPVAMRNAAQGLITLACQGIGSLLGYRLGGYLMQEMFAYDQPRNGQTFNWAGMWMFGSVMIVIITIAFIVLFRDGKKRSDELTALKTQQPLKAINKR

SEQ ID NO: 157969 - protein, 57 aa, Glycine max
  Coding DNA Sequence Number=SeqID_41191
MMCQRAFTAGGLSWHPIASIPINAARLGDRPSDSPMVGDIGGGRHFLDKGRASRNPW

SEQ ID NO: 157970 - protein, 206 aa, Glycine max
  Coding DNA Sequence Number=SeqID_41192
  Gene Ontology: Mol. function=transcription regulator activity; Cellular component=intracellular; Biological process=regulation of transcription, DNA-dependent
  Homolog annotation: Hit_ID=P0ACM5; Match level="QueryCoverage=90%, HitCoverage=79%, E-value=1e-55, Identity=63%"; Hit description =Putative HTH-type transcriptional regulator yegW
  Pfam annotation: Domain name=GntR; Domain location=23-86; Score=62.3; E_value=1.6e-15; Accession=PF00392.11; Description=Bacterial regulatory proteins, gntR f
  Pfam annotation: Domain name=HTH_11; Domain location=36-83; Score= -0.4; E_value=0.1; Accession=PF08279.2; Description=HTH domain
  Pfam annotation: Domain name=HTH_DeoR; Domain location=26-90; Score= -1.3; E_value=0.084; Accession=PF08220.3; Description=DeoR-like helix- turn-helix domain
  Pfam annotation: Domain name=UTRA; Domain location=106-199; Score= -13.1; E_value=0.029; Accession=PF07702.3; Description=UTRA domain
  Pfam module annotation: Pfam domain module=GntR::HTH_11::HTH _DeoR::UTRA; Domain location=23-86::36-83::26-90::106-199
MTDHNALLARLTTTLAIESRTPLYKRFASAIKEAVRDGTLVHEEILPGEREFSQSLNISRITVRKAMDELEKEGVVFRSRGYGTQICSQFEYSLKEPKGLSQQAVLRGKTPDTVWINKSKIACSAEIAEKLGLSTGSDVYLLKRIRYVDRQAVSVEESWVPARYIADADEIADPAGEIPEPGQCAYAGRSPAAANCPARQCAGAGD

SEQ ID NO: 157971 - protein, 546 aa, Glycine max
  Coding DNA Sequence Number=SeqID_41193
  Gene Ontology: Mol. function=N-acetyltransferase activity; Biological process=metabolic process
  Homolog annotation: Hit_ID=Q63UA3; Match level="QueryCoverage=21%, HitCoverage=62%, E-value=3e-33, Identity=54%"; Hit description =Putative acetyltransferase
  Pfam annotation: Domain name=Glyoxalase; Domain location=218-322; Score=47.0; E_value=6.2e-11; Accession=PF00903.15; Description =GlyoxalaseBleomycin resistance proteinDioxygenase superfamily
HPAADGHNLSAAKEILKMLVALAIVTGARPIVFDLLFTSMHTGGREKRQMKSQEMLQNYSQRVHFYYCILVALKLYVNSKKSGGVRGKNNFLLKWLRNAQNNTIFHPDITSEIEWLRGKIISAGPDADLEPMLQYVYETAKRAETLRLGPVSTSTLINNQQPAQNAPAATQVNARAQDYIPLITAYIAVETKNAAGVQIAIAEAINGDRMQMKDIDVGFTHVAFMVRDLEKSMDFYRRYAGMKVIHTREPDVPAARKADDVSDTPLGKFGHLGIACASREEIDRKTAMAVAEGVLRKAPEEAGEPVGYYVFFADPDGNTLELSFGQRVGLEAIRTAPVADLPHLSRYRNLPDVARYQSWEEFTWQDAEKLYAQQDALPFNSDNTWFQLAVAHQEDDRLIGDIGIHFFDEGRQAELGMTFDAGFQKQGFALEAMSAIVTLLFTQFAKHRLTAVVDTRDIVTISEVSKEEYHLLIQVWEAAVRATHHFLNEQDILRLRQLILENYFDAVVLRKMTDENHDIVGFIGLQDENIEMLFVSPAHHKKGIGA

SEQ ID NO: 157972 - protein, 93 aa, Glycine max
  Coding DNA Sequence Number=SeqID_41194
MVEREMITMMVDTLPVFYYEKLVGYMPSSFADLVFTGERIEVGLKRRKFDYVSSTSTNARRIGAAGAKRKEEDTHAVTLALAWVKPLQTSHGT

SEQ ID NO: 157973 - protein, 77 aa, Glycine max
  Coding DNA Sequence Number=SeqID_41195
MANNPSSAQKKEKTSKRKQELVKVFYTYAHADLEGNLFSTIIGVDMVIDTTVWKEVVGLDMGGARKFDETPNEYNKM

SEQ ID NO: 157974 - protein, 91 aa, Glycine max
  Coding DNA Sequence Number=SeqID_41196
  Gene Ontology: Mol. function=RNA-directed DNA polymerase activity; Cellular component=intracellular; Biological process=RNA-dependent DNA replication
MHRILLEDGAKPVRQPQWRLNPVILDVVKKEVTKLLQAGIIYPISDSQWVSPVQVVPKKTGLAVTKNERDELIPIRVQNSWRVYIDYTRLN

SEQ ID NO: 157975 - protein, 103 aa, Glycine max
  Coding DNA Sequence Number=SeqID_41197
MSLPSAVLVSSSNESGAPRMSLPSAVRQFSILHFYSETHECHCLALVMCPPPSSLEPRECHCLELFANSPFSNLIRRPMNSLASAVHVSSVIKREASEKKKKE

SEQ ID NO: 157976 - protein, 222 aa, Glycine max
  Coding DNA Sequence Number=SeqID_41198
MKREKHASYSSHNSCKSLSEELRDYYERRHRSHRRPHSHRREKERKPQEANINLPYFHGKDNVEANLVLEIRVEQQFKKKSIEKSNGSHSYPKKDQGRGILGVTPSKPKDDKGKTIEKQAPKAKDTLLLNALPCVNHEDFDDIKKNLLEKEGDVNHASFDGVEKKSHVCHHQKGGECESLFQDSLKTKPCLKTMCFQDMQGSGNRLPGSVIDYQKTGLRNSC

SEQ ID NO: 157977 - protein, 106 aa, Glycine max
  Coding DNA Sequence Number=SeqID_41199
MTIICLRVSSGPPPMDDKRVQNDHNLSLRAIENDCVWMAKGRRMTIICLCVPSKMTVSGWQKVSGMTIICLCMSSGSPPLDEKRVQNDHNLSLHAIGHDCVWDGKR

SEQ ID NO: 157978 - protein, 86 aa, Glycine max
  Coding DNA Sequence Number=SeqID_41200
MAHRDKLWSFCVLLSSRGGGLDDTRRQVMVIRTLLLSVRLDEINAQRQIMVILRPLSFRNNKLSDKHAEKNYGHSALFIIQEQQVE

SEQ ID NO: 157979 - protein, 69 aa, Glycine max
  Coding DNA Sequence Number=SeqID_41201
MQNSMRDVYLGAYLNGALKGLDDTPQSKSKAVTRWIVVKDARPLEPERLKALRIQWANFYLKVKNETVS

SEQ ID NO: 157980 - protein, 96 aa, Glycine max
  Coding DNA Sequence Number=SeqID_41202
MATPPSSSPPPPPPSERLLVHVDPATRKVNSPHRKKLRTYFEIVTRDKVDVTYENWKQVSVAQKDLIWEDIQDEFDIPEASYVRTKKKILQTVGEQ

SEQ ID NO: 157981 - protein, 140 aa, Glycine max
  Coding DNA Sequence Number=SeqID_41203
  Subcellular localization annotation: CTP_CleavageSite=4; ConfidenceScore=5.39e-01
GRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 157982 - protein, 83 aa, Glycine max
  Coding DNA Sequence Number=SeqID_41204
  Gene Ontology: Mol. function=DNA binding; Cellular component=nucleus; Biological process=regulation of transcription, DNA-dependent
  Homolog annotation: Hit_ID=Q6R074; Match level="QueryCoverage=48%, HitCoverage=15%, E-value=3e-13, Identity=78%"; Hit description=MYB transcription factor
  Pfam annotation: Domain name=Myb_DNA-binding; Domain location=17-58; Score=20.2; E_value=0.0075; Accession=PF00249.21; Description=Myb -like DNA-binding domain
MAGHMGRGVIEEQVWRKGPWTAEEDRLLVEYVRLHGEGRWNSVARLATNKNSEYFDILTLTVARSRHHSKEHDFGYGGGGNNR

SEQ ID NO: 157983 - protein, 69 aa, Glycine max
  Coding DNA Sequence Number=SeqID_41205
MVSYVKAWMTLWRSQLALHVVLTVYTKLLHTNRGLDGLLETPNTPPKNVQIQGIAIEKTQHSIVLLQQI

SEQ ID NO: 157984 - protein, 348 aa, Glycine max
  Coding DNA Sequence Number=SeqID_41206
  Gene Ontology: Mol. function=two-component response regulator activity; Cellular component=intracellular; Biological process=two -component signal transduction system (phosphorelay)
  Homolog annotation: Hit_ID=Q0KBK0; Match level="QueryCoverage=39%, HitCoverage=78%, E-value=2e-29, Identity=48%"; Hit description =Uncharacterized protein
  Pfam annotation: Domain name=Sigma54_activat; Domain location=1-89; Score=-172.3; E_value=0.0039; Accession=PF00158.16; Description =Sigma-54 interaction domain
ELAESLLFGHAKGAFSGAGAARDGFFQQAAEGTLYLDEGPVRVAARAGKRRIPAAGRRGQPADGLPHHGQRQHRPGTGGGRARLSRRPLLPAGGASGRHDAVGRRAACAGRARLARQRPGIAQPHRPRGGHGGRRHAVGQRPVPRASPGAGGGPGGVAGRRRAARDPADHRRNRRPPGRGGEKAGHFAHDPVEEAARGALTAGRGAGPAEVLDDALQREFGARLADLVAAAAELACRGVDDGAGVGRPRLEDPGVALRAGGNAVVGGIGDAGVGHRDVGGALAGRAQRHVARHGFAGEVVARQRRLRHAQAAPLGRHRVHHEGAVEQAARAGNVGQGGRDQPGGAGLG

SEQ ID NO: 157985 - protein, 330 aa, Glycine max
  Coding DNA Sequence Number=SeqID_41207
  Pfam annotation: Domain name=Transposase_23; Domain location=116-186; Score=-16.8; E_value=0.079; Accession=PF03017.5; Description =TNP1ENSPM transposase
MVRVKTIGEMTTEAAKEIAEKIDSFEERATQGSFIPHGHQDVLTAAIRRPEHPGHVRAAGFGVTIKQYFGSAPWTSRSSSSLPLEELQQLTYPSSVLDAISGTCTASRASGNDPETGDSDRCGLYIEANPARLVTLGKVYEGSTIVHNTPLLLGQVKVGAKEVKDPNAAVPVPTDEVSLVGQTIHTFLAWPTHLVKSLSQQLVVSSAKPPEKSDPEVDDLLYLMTLTIPELFLRPYQVTWDATMFKAFNPDFPLYIKHKDLSEIAHGGQCLSISVHLTKTSMRAGNFDIYGFLEPQFIQRSGQSQFETGSYTKSWIQSSKCDVYLGAYLN

SEQ ID NO: 157986 - protein, 52 aa, Glycine max
  Coding DNA Sequence Number=SeqID_41208
SRIVLGNGQMSGRIQRQRPIKGQMQVETRITIDRSSSHAQLWTSGNRSWEAA

SEQ ID NO: 157987 - protein, 399 aa, Glycine max
  Coding DNA Sequence Number=SeqID_41209
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-60, Identity=32%"; Hit description= UPI00006A17C9 related cluster
  Subcellular localization annotation: CTP_CleavageSite=7; ConfidenceScore=5.04e-01
LHALTFRGLHVVTFRGLHTLAFRGLQVLTFRGLHVLAFRRLHVLTFRGLHTLTFRGLHVLTFRGLHALAFRGLHVLAFRGLHALTSRGLHVPAFIGLHILTIKGLHVLTFRGLHVLTFRGLHVVAFRGLYIFTFRGLHVVTFRGLRALAFRGLHVLAFRGLHALAFRGLQALVFRRLHVLTFKGLHVFTFGGLHVLTFKGQHVLAFRGLHVLPFRGLHVLAFSGLHVLTFRGLHALAFRGLHALAFKGLHVLIFRGLLALTFRGLHVLTFRGLHVLTFKGLHTLAFRGLHAFAFRGLHVLVFRGLLALTFRGLHVFTIRGLHALTFRELHVLAIRGLHTLTFRGLHVLAIRGLHTLTFIGLHVLSIRGLHVLTFKGLHILTFRGLHALTFRGLHVLVFR

SEQ ID NO: 157988 - protein, 205 aa, Glycine max
  Coding DNA Sequence Number=SeqID_41210
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q1H4A6; Match level="QueryCoverage=95%, HitCoverage=30%, E-value=5e-81, Identity=77%"; Hit description =Helicase c2
  Pfam annotation: Domain name=Helicase_C; Domain location=53-154; Score=-5.6; E_value=0.054; Accession=PF00271.21; Description =Helicase conserved C-terminal domain
  Subcellular localization annotation: CTP_CleavageSite=36; ConfidenceScore=5.28e-01
MPEPNSSAYAAAVAAVSLPVLKASRGRAFVLCTSLRAMREVHALLRQAFEENGLDYPLLMQGESNRTELLDRFRTHGNAVLVGSQSFWEGVDVRGEALSCVIIDKLPFAPPDDPVLAARIDKMNAEGKNAFMEYQLPYAVITLKQGAGRLIRDEQDLGVLMICDPRLVDKPYGRRIWQSLPPFRRTRVQQEVEDFFTLINGAAQP

SEQ ID NO: 157989 - protein, 78 aa, Glycine max
  Coding DNA Sequence Number=SeqID_41211
MGLRIRFDGGGCTSSARQSIRGAPDSMAINSWGSGLDGGGCMNGKQFMGLRIRFDGGGCMNSARQSIRGAPDSMVEDE

SEQ ID NO: 157990 - protein, 144 aa, Glycine max
  Coding DNA Sequence Number=SeqID_41212
MKMDMNIGALISRQISLIAQFNSSRLGFPALIIALCKARGVTSDSLTYESLSPAINLAYIKKNCWNLDDPSVTFPRTQKSRARRFEAPCPSAAPTPLTSEPAPGPTPNYAELAGCGPATTSYEHGGVSTEGCLARSLAFSFGRG

SEQ ID NO: 157991 - protein, 104 aa, Glycine max
  Coding DNA Sequence Number=SeqID_41213
MPWKEELHHQESALDKKLREEASMEEKMREGGGGGGHKIEGEKEEEKLNLEMCLTSFTFIKVVTNATRMKGVTLAHGKRICQRHLSIFLEKLEGGGDYTHPSNS

SEQ ID NO: 157992 - protein, 124 aa, Glycine max
  Coding DNA Sequence Number=SeqID_41214
MAYRIEAVILMEIGEPAFRITNLNLNQNEGNLKIELDLIEERMVSEEKLKQGKLAENWEGSYKALQKVGFSSQVSKYQKTYEICRHPGKWVPKLGTPRNEIPNRGRILKRPRKSIGTLGNGFPN

SEQ ID NO: 157993 - protein, 487 aa, Glycine max
  Coding DNA Sequence Number=SeqID_41215
MFKFDSNMFHRFKDRFFKVKATNVTVDGRRGWTRLFSSDCQPYWTCKPSYPYCQHAILVLFWMVGPAKDDVPAPPSSLLSFLLGKEVNLKPESTLLELLKLMKMKLSRAPFSLQALKQAIGLISSSSRLSPTSSQGPPSSSLVVQVVVATTIIFDPPVPPSPPAQGPPSSTTLAMSAPLAAPPSSTVALNKISSLETEVSKWRATAQTVWQVEHPKVSNATIALAEKNELVGKVECTAKEKEELAATVVKFSKTKIKESELKVEKEKGKNKELEEELLMLKKKVIEKHEKGFFKAFRQARFFNKGFELGLFDLFKDVKDDELLDEEEIATGEEDVEEEDDEPMFRLCSLCGLACCRLMSIQCLAFDACRRIMGVVLCVMLVLPYLTDLYEIKNEMTSDHLEFDFKFVEVEGLANQPMMFHFLFAELLTQGCNELTKDSTRLTKGGPWVMQSYPPKALDRRLQEDWTRDPGEGPRVLMSLGIDFGLMG

SEQ ID NO: 157994 - protein, 172 aa, Glycine max
  Coding DNA Sequence Number=SeqID_41216
ANVRIDHRQDGLHDLTGRACGCPPLKEWEGVVPIGDSSSEETRYEASDNESSSFERLMNPHNVDEGNFLPRERVGPSTTPLNEESIFVIAILPSSLLVATGRNDDSDISVSPRNRHRRSVGVPSSPPSVTNYEWVKDYVLKYHSSIASFVGLGALWRQLELAKPGYSSKMIV

SEQ ID NO: 157995 - protein, 157 aa, Glycine max
  Coding DNA Sequence Number=SeqID_41217
MYKDKCAHGPEICPKAHENLRAFSCISGLINLKSSIQCPCGVGLHHMLYAIRSTEKQSTTNSSPSKTDKKVGNYRKKRKVEIFNEVQSQLQQTNTHESYRGIKMRNEHKCHKQSLMAASRLYAEKVKAKTQRKGRTESILEELTTHNDSTMRAMQIL

SEQ ID NO: 157996 - protein, 230 aa, Glycine max
  Coding DNA Sequence Number=SeqID_41218
MEEGVRDKRSCVRGQWIPFDEDAVNQFMGHTLDIARSMAGRRVRIMRTSMTTLTQIWMTLLLSNILPSDHNSDLPLPKCQLVYAILTQVNVHIAQLISNAIYQFAEITPPRHPVDPEKSNRALGFLALITDLCQFYGVSAGIVVRSGIAAVAGGPAATNTTTTSTAAAILGVYVCSPAEDIAPDEHVYAAFAWLNDEPDFRTGSGPAGAPGDEDGAQEDDDMADVLDYFL

SEQ ID NO: 157997 - protein, 312 aa, Glycine max
  Coding DNA Sequence Number=SeqID_41219
  Subcellular localization annotation: CTP_CleavageSite=52; ConfidenceScore=5.29e-01
MAQTWSVFSYSNLAPTSRTSDFNTDRARLVYGLITRMDMNIGSLISGQMTMMAQSNSSRLGFPALITALCRLRGVGSDALISYENLRPVIDLAYIIRNCWNANDQTANFPEARKTKLRAVDVPSSFAPIAGIPASSTSAPLPALADLSAQSSQTSDAKLQSLFEGQILIMQSLQELAQQRPIMSVEQLIGKVVWLGARPSFVGDNESFTAQAPQQHELEPENDHLSEAIIPGAVDFSKRKVETRSNKAAHPGPVLVLADVPFLGMDPSSPQHAADSSTRILEIPEGQTTPVLALDTSPLATPVLHLTDKEDV

SEQ ID NO: 157998 - protein, 101 aa, Glycine max
  Coding DNA Sequence Number=SeqID_41220
MSRGSGDLGDVRRAPGSQQIKGTKTTKRGGLWWLASCESCVIYGLWPLVVEASGNRLPVCVIDYTEEWVTGNRLPGFHVLKLCDSSLASGNRLPRLCNRLP

SEQ ID NO: 157999 - protein, 228 aa, Glycine max
  Coding DNA Sequence Number=SeqID_41221
MASSSSCLSNISIISGPVEGDCGCKISIFHSIFRMGEEDIKLHIRRVVPTYQGQEEIPEEIIPLLRQSGCNWIMKMGYLEINVALITVLIERWRSPLISPTNLSWVDLCEELLGVRPEEERFTHAWIFRFIGGVLFVDSATNYKTKSIGGKLEENWGQLLGPMINQWNNQTDFRVDAYPRQEGLLSFNSDYMVWYRRKTKMFVDPKDENHGDPDVTVHGVAIREIYMD

SEQ ID NO: 158000 - protein, 113 aa, Glycine max
  Coding DNA Sequence Number=SeqID_41222
  Gene Ontology: Mol. function=peptidyl-prolyl cis-trans isomerase activity; Cellular component=integral to membrane; Biological process=protein folding
  Homolog annotation: Hit_ID=P0C1J5; Match level="QueryCoverage=77%, HitCoverage=43%, E-value=5e-21, Identity=55%"; Hit description=FK506- binding protein 2B precursor
  Pfam annotation: Domain name=FKBP_C; Domain location=36-110; Score =37.7; E_value=4.1e-08; Accession=PF00254.18; Description=FKBP-type peptidyl-prolyl cis-trans i
MRLTVVGILATFWISVAADEPPTTLIIDVTHKIPDEECIHKSKLGDQLSMHYTGKLFSNGKKFDSSLDRNQPFQFMLGVGRVIKGWDQIEFLQPGGSTSSRAAATAVELQFAL

SEQ ID NO: 158001 - protein, 74 aa, Glycine max
  Coding DNA Sequence Number=SeqID_41223
MIFAQEQPFQGQCTYSSATTHNLISPLGDASTYRPSTQCVLVDSDLRDPYRASSVPIYQTATFRQSGVTEMGRV

SEQ ID NO: 158002 - protein, 145 aa, Glycine max
  Coding DNA Sequence Number=SeqID_41224
  Homolog annotation: Hit_ID=Q1STZ2; Match level="QueryCoverage=88%, HitCoverage=27%, E-value=3e-10, Identity=28%"; Hit description=IMP dehydrogenase/GMP reductase
MGSSQKPSLKKRFYPVKVKSLGITSLRELGRLMGQLQRQAFRKAYSKIWDLAMVEVSTEAIASLAQYYDQPLRCFIFGDFQLSPMVEEFEEILGCPLGGRKPYLFSGFYPSLARISKKVQISAQELDHQRQVENGVVGIPRKYLE

SEQ ID NO: 158003 - protein, 108 aa, Glycine max
  Coding DNA Sequence Number=SeqID_41225
MATMMEAMMSMEKILEANAVAIAATSAVAKVNPMPPSGLNQINHSTSDMVGLEGKDLGSMGNPHYVQIQNKHAFLPYSLPPNYTPPNVVYTPNENVNNSTSIEPTTTI

SEQ ID NO: 158004 - protein, 109 aa, Glycine max
  Coding DNA Sequence Number=SeqID_41226
MCEIVEPILTTVNPDISQLQISVSTFGARRGAAIKLSLQPPTQMVSTRSGLRSKAYKLHIGAMSRCDKEELSKLKVDHDELEAHVRRPQGDEYSPYTINERTQGESLPQ

SEQ ID NO: 158005 - protein, 198 aa, Glycine max
  Coding DNA Sequence Number=SeqID_41227
MKQEENPVKEHESREKYEEKDEEQAQQQWEKYSTVENQQESILQINNLPHQLIVKKGRQGEHEETLSAILFLITNTFPEMIWNVVPEYMKFMEFLAKRTRCPELPNCSHYAAKLIPGTAWSGARLLIVRDCGSFTAQTPQQVRPDEATPLEPTPAQVEPVPTNPPSPVADPSSSKLEAAPSSSPIIIISEDSIESASG

SEQ ID NO: 158006 - protein, 77 aa, Glycine max
  Coding DNA Sequence Number=SeqID_41228
MSPLPLGPHNHSQTHLKLSGRLPLQALALNRVADFWSFAQPNSGSLNHSCAQPEKDGSTNHALSQRRKAQPIRRHLA

SEQ ID NO: 158007 - protein, 49 aa, Glycine max
  Coding DNA Sequence Number=SeqID_41229
MAPKTCSLSASALDRVDSSCWTKLGQDRIKTNIQQLGYRTSIPRDSTTN

SEQ ID NO: 158008 - protein, 131 aa, Glycine max
  Coding DNA Sequence Number=SeqID_41230
  Gene Ontology: Mol. function=hydroxymethylglutaryl-CoA synthase activity; Cellular component=soluble fraction; Biological process =acetyl-CoA metabolic process
  Homolog annotation: Hit_ID=Q6QLW8; Match level="QueryCoverage=71%, HitCoverage=30%, E-value=5e-32, Identity=56%"; Hit description=HMG -CoA synthase 2
  Pfam annotation: Domain name=HMG_CoA_synt_N; Domain location=1-103; Score=-13.4; E_value=0.0027; Accession=PF01154.8; Description =Hydroxymethylglutaryl-coenzyme A synth
  Pfam annotation: Domain name=SUI1; Domain location=19-82; Score= -19.0; E_value=0.083; Accession=PF01253.13; Description=Translation initiation factor SUI1
  Pfam module annotation: Pfam domain module=HMG_CoA_synt_N::SUI1; Domain location=1-103::19-82
MVRARGKRKISGLNETTFDAPVGVAPLALDMGSMGKVVTSLLEKFNVDLKQIGRLEVGSEIVIDKSKSIKTFLVQAFEVYAEGPACPTGGAAAIAMLLGPNALIAFESKLRGSHMPHAYDFYKPNLANEYP

SEQ ID NO: 158009 - protein, 74 aa, Glycine max
  Coding DNA Sequence Number=SeqID_41231
MAMMKVLCDSYYKDGSYKEEEIPDSLPQQEPSLPNKAFEKGIRGSNDENVKLLKQKCDLGGVRDRGSNMSNMKT

SEQ ID NO: 158010 - protein, 62 aa, Glycine max
  Coding DNA Sequence Number=SeqID_41232
MGCNNWTQPWPVGSEIYPEVHENLRAFFDSSSPILLKPLTHGSSDWSLPMEDYIRKDQTLFQ

SEQ ID NO: 158011 - protein, 288 aa, Glycine max
  Coding DNA Sequence Number=SeqID_41233
  Gene Ontology: Mol. function=nucleic acid binding; Biological process= DNA integration
  Homolog annotation: Hit_ID=Q1T010; Match level="QueryCoverage=57%, HitCoverage=12%, E-value=4e-35, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAMLKNKRPNPNKTTNLRWNQLYQGVLDIISIGVTPLDMNPTKAHRATHREQMKKDDKVIFLIHQCVDSNVLEKIIDYEMTKEAWDVLATTYAGDKQTKKVRLMALRRQLGLLQMESNEMVAKFVNRLVILANQMKSCGEVVTDSMKVEKVLAGLTPNIDHIVSAIEQSKDLETLKLEQLLGSLEAHELKMKNTEGIKKEEKAFEKALFAKNQKKGGGDSWKNKKGKGKWKYNKQESSVLKVRIKRKKEKTMERERRNQRSTFNAITVKSMSIMCGVPKLMTGLIVII

SEQ ID NO: 158012 - protein, 700 aa, Glycine max
  Coding DNA Sequence Number=SeqID_41234
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=54%, E-value=0.0, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAPYTPQHNGTAERRNRTVLNMVRCMLREKHLPHDFWAEAVSTATHILNRCPTKRLDSLTPEEAWSGLKPSVKHFKVFGSLCYRHMPEQNRRKLDSRAQTLILVGYHSTGAYKMFDPLSKKIVISNYVIVDETKEWDWSIGMERQTNETLEVELEGEEIQDEVQIDNEQYVNDEQNVNDGPDVIGVVPLRRSLRQITPPVRFQDYDVFPDAAINVNGELMNLVLLAEAEPVSLEEALANPHWRKAMEEELRSIQKNNTWEMMNLPSNKKAIEVKWVFKTKVKPSGEIAKYKETLVAKARIEIVRLIVGIASMRKWIVSQLDVKSAFLNGPLEEEVYTRQPPGYEKISMEDKKQKFLKCTTEHGVYLKDCGVTGVVMLCLYVDDLLVTRDSKQEIYMFKKEMMDEFEMSDIGRIAYFLGMEFVTTKRGIFLHQKKYATDILKRFNMLDCNSATTPCEPGIKLSTSEDTNLVDSTLYRQLIGSLRYLCNSRPDITYGVGLVSRFMKKPCKDHLLAAKRILRYVKGTLEYGILFPAAKENSEIEIVGYTDADWSGDVGDRKSTSGYMFMLGNAPISWCSKKQDVVALSSCEVEYISAAFGASQALWLGMLLEELNIKCSNVMKLRIDNKSAIDLAKHPIAHGRSKHIEVKYHFLRDQVNKNKLALEYCRSEEQCADMLTKALKPKRLEEMKNKIGMHKLTYLN

SEQ ID NO: 158013 - protein, 257 aa, Glycine max
  Coding DNA Sequence Number=SeqID_41235
  Gene Ontology: Mol. function=nucleic acid binding; Biological process= DNA integration
  Homolog annotation: Hit_ID=Q1RXW3; Match level="QueryCoverage=79%, HitCoverage=35%, E-value=1e-20, Identity=28%"; Hit description=Zinc finger, CCHC-type
MAGNHFPCASINKLSLFCGTNYPFWMVWMKIFMDFVNRGIWSAVVNGYTIPTHVVDNKIIEKPYNSWLFVCTTTKEMWDLIQVTHEGTLEVRRAQKNLLIQEYKTFRMKQGETTGDVEKIFTHIVNHLKGLGKIFEEEEINVKPKVTTISKSKDLATMTRDELFGKLRQYEMELMRMVEEETIDKKHRGLALKTSIPSSDKSEDDNAESSDAENWNLLVRKFNKFLKKKKNYGNRTFQPKKNHKKGELSSSNGYTCF

SEQ ID NO: 158014 - protein, 103 aa, Glycine max
  Coding DNA Sequence Number=SeqID_41236
  Subcellular localization annotation: CTP_CleavageSite=35; ConfidenceScore=5.65e-01
MSPPPLGPHNHSQTQLKLSGRLPLQARFSVGGFVRACALSAILNPLALISGFRLSVCFSRSVDGLKWCALLDDPSLSANAQLILLPDSSLRSVEECCAQRMAR

SEQ ID NO: 158015 - protein, 72 aa, Glycine max
  Coding DNA Sequence Number=SeqID_41237
MGIVSHCALAYPFLSQKEIEIAIDCPILSGDQAFEGQREYTTTTEDVEEDDARVGTRDNGVATTIGGNDMIK

SEQ ID NO: 158016 - protein, 210 aa, Glycine max
  Coding DNA Sequence Number=SeqID_41238
MQEEEERPLIRKRKLPTTSTKSADQTEAGNSQAQMPKKKKKVKQVEPEPSVAVEDGEPAKKKKKKTKSSKEQGDNQPVDVQPPSTDIGGTEVEAAPSVAEMGNPIEQPNLPQEQPVVEVQQNVSAEEIPSWARTSPAPEADAVNVEEWGEGQGIGSSSPHGWAEVDDHHEPNQSDNTIPHESSQKSSSEGNFFDEDAIKEAEAGGSDIYP

SEQ ID NO: 158017 - protein, 402 aa, Glycine max
  Coding DNA Sequence Number=SeqID_41239
  Homolog annotation: Hit_ID=Q1T493; Match level="QueryCoverage=77%, HitCoverage=68%, E-value=4e-31, Identity=25%"; Hit description =Nucleic acid-binding, OB-fold, subgroup
  Pfam annotation: Domain name=DUF223; Domain location=99-194; Score= -6.7; E_value=0.012; Accession=PF02721.5; Description=Domain of unknown function DUF223
VSFVEKFVLEFAFASLLGLTVKRKVWFSSVVRLAVRRKVWFCCVAGLDCEKKRLCDYKVMARVPDKIKLIDGSREALKLSIRITDLWFIGIPEKSEQAEMVVVDSDGDEIHVVCKQDQLKPRKADLKENLTYVMHNFKVMKNDEKFRVCDHEYKLCFTGVTVVRQSDMEHLPFRKFRFVDFSNVIAGHFQTRLLVDVTGVVDEVVLSCTLWENYCLQFLSYLNEVEDERPIVILLTHARIKEAQGSYLLSVSNSFKASKLMINELVLEIQDFRERKSNVSFFKQEIVCVTVAKITTIVMDNYSWCYPACELIGQSTDEVKRLKIEDDDVDLNASPQALDRLLGCFLAFKVKVQPRFRNSVLKYLDESDLINVVLDMLPDSEVVFCQVYFSYCECMHIFHLFL

SEQ ID NO: 158018 - protein, 103 aa, Glycine max
  Coding DNA Sequence Number=SeqID_41240
MAIQSHKRCKDKMKITRNKRRTMGFVLYRNRKPSWKIPLRLKGSSRCEVSMKNNDGLWWLMTKYREDPTVNEGWAAFLPRQLHVASSRSFIKRLLQEASPWLL

SEQ ID NO: 158019 - protein, 115 aa, Glycine max
  Coding DNA Sequence Number=SeqID_41241
KDQGQGILGAAPSKPKDDKRDKEEKLEKQKKKKDSKALSSKAKGKEKVEKDSSKKIVKKENYFATKGDIKRTLLPKQSFYLILSRETSLSTIVPLELEIIPQVKELLDEVWFIRA

SEQ ID NO: 158020 - protein, 75 aa, Glycine max
  Coding DNA Sequence Number=SeqID_41242
MDNHEHANHRDTAQAKIKNKRIRQHKVNDQAQNIDFNIRDSSEDERSESTQVSSPENQNYMSSANDPAINREGND

SEQ ID NO: 158021 - protein, 96 aa, Glycine max
  Coding DNA Sequence Number=SeqID_41243
  Subcellular localization annotation: CTP_CleavageSite=55; ConfidenceScore=5.63e-01
MHKYTVVAVTVGVARSSASSLSCASCSSILCTLCVVRRVLACCRRRARECRVQVSCASPLPSRWRLLLVLPLKTVVLFCSWLRSCAPSFLLQEKLE

SEQ ID NO: 158022 - protein, 154 aa, Glycine max
  Coding DNA Sequence Number=SeqID_41244
  Homolog annotation: Hit_ID=Q9SMU7; Match level="QueryCoverage=30%, HitCoverage=45%, E-value=9e-17, Identity=78%"; Hit description =Signal recognition particle 9 kDa protein
  Pfam annotation: Domain name=SRP9; Domain location=89-144; Score =46.5; E_value=8.8e-11; Accession=PF05486.2; Description=Signal recognition particle 9 kDa protein (SRP9)
MTLGIELRNTQTAPTEGFLARTVVSCGDIGLNGRQVVMGSVPAVLCLVLKRQWVLIPHYAFSDTGRKLLKSLNCASLHPFPKSLSGAMVYITEWDKFVEQSIELFRADPDSTRYVMKYRHCDGKLVLKVTDNQQIYFGTACACLRVKIWIDMTS

SEQ ID NO: 158023 - protein, 136 aa, Glycine max
  Coding DNA Sequence Number=SeqID_41245
MGEWGCIVVQKIRAPLQLSPRLWGSIQQPLVDQEVVSIGGSSSEDTCHSASDNESSLLERLRVLCHIGGGTTRLHRRAQLSAASLGVIVPPAVAGFEWLRDDILKNKSSITFVASVVALRCQVKLANPKDSYKISV

SEQ ID NO: 158024 - protein, 130 aa, Glycine max
  Coding DNA Sequence Number=SeqID_41246
MEREMIIVMVDTLPVFYYEKMQRINVGPKRGKLNHPAWNNEKTGANEEGENEGETHVVTVIPIQPSFPPTQQCHYSVNNNPSPYPPPSYPQRSSLNQQQNPPTTQPMLNTTSSTNPKHQPRNEFCSKKSL

SEQ ID NO: 158025 - protein, 134 aa, Glycine max
  Coding DNA Sequence Number=SeqID_41247
MCLRGSPTSHKLMFQQTSGIDQGTKDPVLCFKEFKVNNLMLRKGGTTEGLRKGYYDYQNTPRVNRNMLKTQKRKHQRMRRDTILAMQHKNVPRSSVFDRISEGPSPRFEKKFSIKDHEEKEMIMDSFKSSFKDS

SEQ ID NO: 158026 - protein, 273 aa, Glycine max
  Coding DNA Sequence Number=SeqID_41248
MAHGGQRWSWVVKEEFLRWFRRSFEKEAVDEAMLEQLLALLDVQAILYLPSTSDPLAALDGIMGDFPWWPLVKQVGLTGETVPLSAIVYPIGEGVGPIVGIVEVVLGASSFILAKRKRNDGVGKAVRLPPSSVHPSSLQDLPLAPSAVDPPAPVVVVVVIPAPPPPPVAPFQKIAQTVEVDAPTASAGLVVVPLSTFVAPLLSAGVATMSTLVMPPPPSSVPRPKQKTLIGIVLAFDKNLIQSARIQHPMNSAKAFLQRSLAILKENGQRHQE

SEQ ID NO: 158027 - protein, 212 aa, Glycine max
  Coding DNA Sequence Number=SeqID_41249
MATTAIEENMMDADAINKEKGMMDIDAIRKEKEMMDTDAIKKEMGMMDTNAIRVKEKSKDVSQQKVGRELVEHRMPICEGKKLVKQAPRRYAPNVLKAIKAKIKRLLKAKFIRTTRKVGSNTLHLASQVLFLSLQILVALKEFITVQPGVQQLGFNKSDGGTSYLRALHSPNRASSSPPFGNLRSKDANLLSASLMEACLWGFYGGWIFELQ

SEQ ID NO: 158028 - protein, 213 aa, Glycine max
  Coding DNA Sequence Number=SeqID_41250
  Gene Ontology: Mol. function=enoyl-[acyl-carrier-protein] reductase (NADH) activity; Cellular component=chloroplast; Biological process =metabolic process
  Homolog annotation: Hit_ID=O24258; Match level="QueryCoverage=82%, HitCoverage=49%, E-value=8e-77, Identity=78%"; Hit description=Enoyl- ACP reductase precursor
MEMNSRQFMFETQDALFSSIYFVICVSVCVEVAESVKKDFGTIDILVHSLANGPEVSKPLSETSRKGYLAALSASNGSAISLTYIASERIIPGYGGGMSSAKAALESDTRVLAFEAGRKKRIRVNTISAGPLGSRAAKAIGFIDMMIDYSFTNAPLQKELHAEEVGNTAAFLSSPLASAITGAVIYVDNGLNAMGVGVDSPIFKELDIPKEHH

SEQ ID NO: 158029 - protein, 92 aa, Glycine max
  Coding DNA Sequence Number=SeqID_41251
MFVFSSALKGLDNTPQSKSKAAARWIVVKCNRQKGSTECGYYIMHWMSTIILGSFKNNWETYFNDVRPLEPKRLKVFRIQWAKYYLKVKNET

SEQ ID NO: 158030 - protein, 248 aa, Glycine max
  Coding DNA Sequence Number=SeqID_41252
MGHKRFNMVAGFDVVGERFVTKPEFFSKSRSEPLKDAFPELFAMSSQQLVSVGNAGSWRRDQWTWGLTWKRQLNSNEEESLHSLETILVDVHLVAESHDRWKWSLHNSKLFTVRNNSIFKEEEKDIPKTINQIKHICWAWFMGKVGGYVLPMLGAGCIAIAFDFDSSKVLNYSNLRHIKPKKHCFHRPSSKASTSTAPIIYPQSNTEGQVLPFAFPLQTLSLQGCVYACFWHFLMDLPLVFCMWYLIK

SEQ ID NO: 158031 - protein, 106 aa, Glycine max
  Coding DNA Sequence Number=SeqID_41253
MARHIPTPEMAVRTHDVDLKSTVSRTQTKPEYPNANKNACREGHGCCGKYSNGASVEGSRHEGRGFRRRQVVQIFPPRIRGYPKSSLQSPPRRKSLADLVSFFVLS

SEQ ID NO: 158032 - protein, 79 aa, Glycine max
  Coding DNA Sequence Number=SeqID_41254
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q6K3D4; Match level="QueryCoverage=68%, HitCoverage=5%, E-value=5e-10, Identity=54%"; Hit description =Putative PKG-Ib
EERARSPVIVACSCSFPQLHFGLHFCQSAGVLPCSPDKENQDSFSITTQLQSNPNVHFFGVYDGHGQSGSQCSNFVKDR

SEQ ID NO: 158033 - protein, 115 aa, Glycine max
  Coding DNA Sequence Number=SeqID_41255
  Gene Ontology: Mol. function=DNA binding
  Homolog annotation: Hit_ID=Q1SFS3; Match level="QueryCoverage=93%, HitCoverage=21%, E-value=3e-10, Identity=31%"; Hit description =Lambda repressor-like, DNA-binding
MIEVSIEAIASLTQYYDQALRCFTFGDFQLVPTVEEFEEILGCPIGGRKPYLFFGFYPSMARIAKVVKISTQELDQVKQNRNGVIGIPRKHLEEKAKALADQGEWASFIDVLALL

SEQ ID NO: 158034 - protein, 242 aa, Glycine max
  Coding DNA Sequence Number=SeqID_41256
  Gene Ontology: Mol. function=RNA-directed DNA polymerase activity; Biological process=RNA-dependent DNA replication
MNDHDMEKYYALIRQIEQLIRDRPLVKYVCPKVYREGISAKVKAYQRDPIPPFTNSSSTQPRHQHPENATETVLKPKERGQPLQNDVNILEVNPHRDFLTRQSSLEKEFKEAKISKGDKVKIGSMLEPQFEAKLVDVLRRNIGAFSWSSADMLANHVRKIQYLTWLVNVVMVKKSSGKWIIYGDVTNLNKACFKDSYPLPNINRLVNGASCCKLLSFMDVYLGYNQIKMHPMDEDKTTFIVG

SEQ ID NO: 158035 - protein, 90 aa, Glycine max
  Coding DNA Sequence Number=SeqID_41257
MFTKSFSRLYGSILSFHDMGVSYPNFVRGPLFGGMQPSLDRLEFRDIPEVKKKHCCAIRKVPQHFGCQEEPCCVIRKVSQHSEKEMGVVT

SEQ ID NO: 158036 - protein, 51 aa, Glycine max
  Coding DNA Sequence Number=SeqID_41258
MSSSSLVVVKALEAGELCIPPDGMSGDMNDNSSSRTSIVPTMLESLMVETT

SEQ ID NO: 158037 - protein, 158 aa, Glycine max
  Coding DNA Sequence Number=SeqID_41259
MESWMGPIICYLESGDLLLDKVESAKYIKLVAWYVIIGNKLYKRGFNTPLLRCLTPYQVIGKSAYQLSYPNFVQELSLVDLLILASRLTVLNASYSAKKKTIQCFDQEYKRIPSLPSLASGSPGPPNSFMVKKLAHLGELTALGLSSNSLGRAATAPK

SEQ ID NO: 158038 - protein, 71 aa, Glycine max
  Coding DNA Sequence Number=SeqID_41260
MTMGADKAVSFFKRRKKSCDFGSGNEEKTNCIAFYQVNGSKIFKQNLEQKRHKETSAISVRLAQRGFMLAQ

SEQ ID NO: 158039 - protein, 141 aa, Glycine max
  Coding DNA Sequence Number=SeqID_41261
MHKALRANAPLPYPQLVTLFLRHFQIPLDDEPFVQVKRSFAIGAGAVTSFGYHKDRNGQWLKKDALPPQDEHTPSPPPQQDDSALMTEVLSELRGLRTYVGERFDSLDNRFARMDIRLTQLEEDVGYIRQSFNLPPPPPPS

SEQ ID NO: 158040 - protein, 115 aa, Glycine max
  Coding DNA Sequence Number=SeqID_41262
MRKKNKIKRRSTPIFILVHSCRNLPFGERATRGLTGASSKKGKCTELPPTFIRGKHQKNRKKMWSTNFKCERFESCIYARGRVMGILRKHYGGPGSSGSHFLTKWGRWLPPSLPR

SEQ ID NO: 158041 - protein, 329 aa, Glycine max
  Coding DNA Sequence Number=SeqID_41263
  Homolog annotation: Hit_ID=UPI0000E478AA; Match level="QueryCoverage =44%, HitCoverage=26%, E-value=9e-15, Identity=33%"; Hit description =PREDICTED: similar to cortical granule protein with LDL-receptor -like repeats
MVAITPAKVPQPPFFRGYDSSATCAYHGGAPGHSIEHCRTLKHKVQGLHVLASKRLYFLAFRGLHVLASRGLYVLAFKGLHALASRGLYILAFRGLHVLAFRGLYVLAFRGLHVLAFKGLYVLAFRGLHVLASRGLYVLAFRGLHVLAFRGATRPHIQRAARPRLQRIARPHLQRALGPHLQRDTGPRFQRAHIHAFGELKHSQRRRQVYSFDEEAITQLLCKPGQDFAQTAVGRRVRIMRTNTWMMLLLSSILPKFPSPLIEACLWGFYGGWIFELQWGPLMVIFHHGDAAEDRGEELGEDASMEEKKERRGEHEIEGIKEGEKWNFE

SEQ ID NO: 158042 - protein, 289 aa, Glycine max
  Coding DNA Sequence Number=SeqID_41264
  Homolog annotation: Hit_ID=Q8P368; Match level="QueryCoverage=50%, HitCoverage=79%, E-value=2e-50, Identity=68%"; Hit description =Toluene tolerance protein
  Pfam annotation: Domain name=Tol_Tol_Ttg2; Domain location=28-222; Score=78.4; E_value=2.3e-20; Accession=PF05494.2; Description =Toluene tolerance, Ttg2
  Subcellular localization annotation: CTP_CleavageSite=51; ConfidenceScore=5.25e-01
MKLIPALLASALLAATPFLAQAQAAAPAAAATQSQAGKVVIDASSRILSTLQQRKSEFTSNPASLRSYIDSELTRTFDRDYAARLVLGPHARGASDADIKLFADAMADSLMQRYGSTLLNIQGKPSFRLKGESPLPGNRGVRVSTELVRAGNEPTPVDSIPRCARRASSRWPTNCTAAACRPGPRAMASNALALLEGDTLRLRGVLDRAAVIALWPQLQALPAKLSRLELGEVERVDSAGLALLAELASRARKSGHPLAVSGAPAGYNELSAAYRLSPDLDFNATSAAS

SEQ ID NO: 158043 - protein, 78 aa, Glycine max
  Coding DNA Sequence Number=SeqID_41265
  Homolog annotation: Hit_ID=Q7N1U2; Match level="QueryCoverage=100%, HitCoverage=54%, E-value=8e-29, Identity=80%"; Hit description =Similar to unknown protein YfjG of Escherichia coli
  Pfam annotation: Domain name=Polyketide_cyc; Domain location=10-78; Score=30.5; E_value=5.8e-06; Accession=PF03364.10; Description =Streptomyces cyclasedehydrase
MAQISRSALVPYSAEQMYRLVNDVDAYPEFLPGCTGSRVLDNSGNQMTAAVDVSKAGISKTFTTRNTLTDNQSIHMQL

SEQ ID NO: 158044 - protein, 287 aa, Glycine max
  Coding DNA Sequence Number=SeqID_41266
  Pfam annotation: Domain name=RES; Domain location=108-265; Score =35.7; E_value=1.6e-07; Accession=PF08808.1; Description=RES domain
MQRLYSIVGLQMTISENALNCKPEFAHWDSYSRFARYVSTVNRYILNEEQRTFLDTVLATIKGRDGELKEGHVFYRAQRGIDLCDRTDRDGNWIGEDIWGYGASRMKPLTDRAREGRANSLGIPVLYVGTTVKTAISEVRPWIGADVSVAVCKLLRPLRTLDLSLGHGQSSLSGAILSHVLGGQEPTAQEKEKAVWIEIDNAFSTPVTQSDDRADYAPTQILAELFHSVGYDAIAYKSHFGDSDEQLGYNIAIFDLSAVEIVTCAPYQVKTIQIESEQIGNAWYKTS

SEQ ID NO: 158045 - protein, 244 aa, Glycine max
  Coding DNA Sequence Number=SeqID_41267
  Gene Ontology: Mol. function=transporter activity; Cellular component= integral to membrane; Biological process=transport
  Homolog annotation: Hit_ID=Q66C87; Match level="QueryCoverage=71%, HitCoverage=45%, E-value=5e-40, Identity=54%"; Hit description =Possible MFS Superfamily transporter precursor
MAFPGHVPAVLREPGRLPDLRSAPAGEILSAYCETQRALNPAINPIGDESVSGGRSPHHQRPRQQQTASGHPQRRIEPVPQQAGNPGQQRSTELSDGITGSKQAGEIARVVRRQLPAVLQRQLHHAEKAAANQQRRQQQTVDARQYDGRDYAQRLRPQHQRQPPMAAAPVARHDPQHDADHRRPAKHRPDKLRKSAIRKARRRHLRQEGGGQNIAKAGVAVDEDQGFQVTRQQQRCGGFLRTMQ

SEQ ID NO: 158046 - protein, 92 aa, Glycine max
  Coding DNA Sequence Number=SeqID_41268
  Gene Ontology: Mol. function=peroxidase activity; Cellular component =vacuole; Biological process=response to oxidative stress
  Homolog annotation: Hit_ID=Q1T3U5; Match level="QueryCoverage=79%, HitCoverage=25%, E-value=2e-21, Identity=67%"; Hit description=Haem peroxidase, plant/fungal/bacterial
MASFHIQYSFLVLVLAMVITLMNPTNATLSPHFYDKVCPQALPVIKSVVQRAIIRERRIGASLLRLHFHDCFVNMQYSFDCIEYEISHSKSI

SEQ ID NO: 158047 - protein, 499 aa, Glycine max
  Coding DNA Sequence Number=SeqID_41269
  Gene Ontology: Mol. function=oxidoreductase activity; Cellular component=vacuole; Biological process=response to oxidative stress
  Homolog annotation: Hit_ID=Q40372; Match level="QueryCoverage=96%, HitCoverage=76%, E-value=1e-114, Identity=70%"; Hit description =Peroxidase precursor
  Pfam annotation: Domain name=peroxidase; Domain location=1-217; Score= 322.7; E_value=6.6e-94; Accession=PF00141.13; Description=Peroxidase
  Pfam annotation: Domain name=peroxidase; Domain location=241-454; Score=220.5; E_value=3.8e-63; Accession=PF00141.13; Description =Peroxidase
  Pfam module annotation: Pfam domain module=peroxidase::peroxidase; Domain location=1-217::241-454
GCDGSILLDDTRNFTGEKTALPNLNSVRGFSVVDEIKAAVDKACKRHVVSCADILAIAARDSIAIYGGPHYWYQVLLGRRDARTASKAAANSNLPPPTFSFSQLVSNFKSHGLNVRDLVALSGGHTIGFARCTTFRNRIYNVSNNIIDPTFAASVRKTCPKSGGDNNLHPLDATPTRVDTTYYTDLLHKKGLLHSDQELFKGKGTESDKLVQLYSRIPLAFARDFKASMIKMGNMKPLTGRQGEIRCNCRRGCDGSVLLDDTPSFSGEKTALPNLNSIRGFEVVNEIKAAVDKACNRPVISCADNLAVAARDSVAIVSAIQIKFSSRDARYASKDAANASLPPPFFNFPQLLASFQSHGLVLSGGHTIGLAKCIIFRDRIFNDTNIDPNFAATLRHFCGGDTNLSPFDASSPSQFDTTYYKALLHKKGLLHSDQELFKVDGGESDRLVQLYTYDPYAFARDFGVSMIKMGNLKPLTGYEGEIKCTIAEKSTTSTACHEY

SEQ ID NO: 158048 - protein, 162 aa, Glycine max
  Coding DNA Sequence Number=SeqID_41270
  Gene Ontology: Mol. function=oxidoreductase activity; Cellular component=vacuole; Biological process=response to oxidative stress
  Homolog annotation: Hit_ID=Q8VWP7; Match level="QueryCoverage=89%, HitCoverage=63%, E-value=5e-44, Identity=63%"; Hit description =Peroxidase
  Pfam annotation: Domain name=peroxidase; Domain location=1-143; Score= 110.0; E_value=6.9e-30; Accession=PF00141.13; Description=Peroxidase
GCDASVLLDNTSTFTGEKSAGANVNSLRGFEVIDDIKTKVEAACPGVVSCADILAIAARDSVVALGGPSWNVGLGRRDSTTASKDSATTDIPSPLMDLSALISSFSKKGFNTKEMEHIQRGKPGVSYSEAGFTMKAALSQTLQHHFKSNCPSTWWRQQPFPA

SEQ ID NO: 158049 - protein, 128 aa, Glycine max
  Coding DNA Sequence Number=SeqID_41271
  Gene Ontology: Mol. function=oxidoreductase activity; Cellular component=vacuole; Biological process=hydrogen peroxide catabolic process
  Homolog annotation: Hit_ID=P22195; Match level="QueryCoverage=97%, HitCoverage=40%, E-value=2e-39, Identity=65%"; Hit description =Cationic peroxidase 1 precursor
  Pfam annotation: Domain name=peroxidase; Domain location=1-128; Score= 117.2; E_value=4.8e-32; Accession=PF00141.13; Description=Peroxidase
MHAHPVLGCDASVLLDNTSTFTGEKSAGANVNSLRGFEVIDDIKTKVEAACPGVVSCADILAIAARDSVVALGGPSWNVGLGRRDSTTASKDSATTDIPSPLMDLSALISSFSKKGFNTKEMVALSRK

SEQ ID NO: 158050 - protein, 227 aa, Glycine max
  Coding DNA Sequence Number=SeqID_41272
  Homolog annotation: Hit_ID=Q4ZP52; Match level="QueryCoverage=47%, HitCoverage=65%, E-value=5e-27, Identity=59%"; Hit description =Putative cytoplasmic protein precursor
  Pfam annotation: Domain name=DUF796; Domain location=1-97; Score =26.8; E_value=5.2e-06; Accession=PF05638.2; Description=Protein of unknown function (DUF796)
MGVGGGGGAGKVCFNDLHVNALVDKSTPALLKHCSSGKHLTKVELSVCKAGGTQVEYVKITLDDVLVTAVQYTGAGGEDTVGVTYSFQAAKVKQQYWEQSDKGGKGAESSAAAWAASTKIYNAQYSAQNVAEIIGGRVAMNIAPNGKWENTCAVRMSYILNKSGFPIPYVKDQTVSGADRQWYFFRVKDLIAYLTKIWGKPDLRVKFPPPGGGELAGKKGIILFEIA

SEQ ID NO: 158051 - protein, 610 aa, Glycine max
  Coding DNA Sequence Number=SeqID_41273
  Gene Ontology: Mol. function=protein binding; Cellular component =viral envelope; Biological process=chloroplast organization and biogenesis
  Homolog annotation: Hit_ID=Q1T3W0; Match level="QueryCoverage=92%, HitCoverage=57%, E-value=0.0, Identity=81%"; Hit description=Helix -hairpin-helix motif
MNGAILAALNQLRNIFGLGKREAEAISLDVTSKVYRKRLAQAVADGELEMADSKAAFLQNLCDELHFDPQKASELHEEIYRQKLQKCVADGELNEEDVAALLRLRVMLCIPQQIVETAHSDICGSLFEKVVKEAIASGVDGYDAEIQKSVRKAAHGLRLTREVAISIASKAVRKIFINYIKRARAAGNRTESAKELKKMIAFNTLVVTNLVEDIKGESADISTEEPVKEDITQTDDEEWESLQTLKKIRPNKELTEKLGKPGQTEITLKDDLPERDRTDLYKTYLLYCLTGEVTRVPFGAQITTKKDDSEYLLLNQLGGILGLSSQEIVEVHRGLAEQAFRQQAEVILADGQLTKARVEQLNNLQKQVGLPQEYAQKIIKSITTTKMAAAIETAVTQGRLNMKQIRELKEANVDLDSMVSENLRETLFKKTVDDIFSSGTGEFDNEEVYEKIPSDLNINKEKARGVVHELAKSRLSNSLVQAVSLLRQRNHKGVVSSLNDLLACDKAVPSQPVSWEVPEELADLYTIYLKSDPTPENLSRLQYLLGINDSTAAALREMGDRLLNTTAEEEKKALGVFKEIRQRMAGEGGSSQRQQTVVVRELVGGVTGRE

SEQ ID NO: 158052 - protein, 435 aa, Glycine max
  Coding DNA Sequence Number=SeqID_41274
  Gene Ontology: Mol. function=protein binding; Cellular component =viral envelope; Biological process=chloroplast organization and biogenesis
  Homolog annotation: Hit_ID=Q1T3W0; Match level="QueryCoverage=100%, HitCoverage=45%, E-value=1e-141, Identity=61%"; Hit description =Helix-hairpin-helix motif
  Subcellular localization annotation: CTP_CleavageSite=34; ConfidenceScore=5.61e-01
MNPSTLTPSHTHRPLLLPSPFYSRRRRFRVSLPRCSSDAAAAAAPSPPPPTPPQRPPKDLKGIELLVDKLSPPARLATSAVIVAGAAAAGYGLGSRFGGSRYAALGGAVALGAAGGAAAYALNAAAPQVAAVNLHNYVAAFDDPSKLKKEEIEAIASKYGVSKQDEAFKAEICDIYSEFVSSVLPPGGEELKGDEVDRIVSFKNSLGIDDPDAASMHMEIGRKIFRQRLEVGDRDADVEQRRAFQKLIYVSNLVFGDASSFLLPWKRVFKVTDSQIEVAVRDNAQRLFASKLKSVGRDIDAEQLVALRKEQQLCRLSDENLPCLIICEFFSPGVSQAIAELDRVLAFNNLLISFKTHPDVDRFARGVGPVSLVGGEYDGDRKIEDLKLLYRAYVSDALSGGRMEDDKLAALNQLRNIFGLGKREAEAISLDVTSK

SEQ ID NO: 158053 - protein, 147 aa, Glycine max
  Coding DNA Sequence Number=SeqID_41275
  Gene Ontology: Mol. function=transferase activity
  Homolog annotation: Hit_ID=Q2HS46; Match level="QueryCoverage=76%, HitCoverage=84%, E-value=3e-12, Identity=33%"; Hit description =Polynucleotidyl transferase, Ribonuclease H fold
MMMEMKTNEDSEKSASSLCRIVHKAQTILQDWTEAQLSPQEGEAQALLFAMKWVKQLSIQRVILETDCKSVVDQTYSQHNSITEGGVLIQKIRNTLKADVDYRVSFVSRKCYMAADAMARSSIENPVSHIFQFIPTNVNQIIEMEIY

SEQ ID NO: 158054 - protein, 159 aa, Glycine max
  Coding DNA Sequence Number=SeqID_41276
  Gene Ontology: Mol. function=transcription regulator activity; Cellular component=nucleus; Biological process=regulation of transcription
  Homolog annotation: Hit_ID=Q10LR1; Match level="QueryCoverage=93%, HitCoverage=87%, E-value=8e-25, Identity=48%"; Hit description=BHLH transcription factor bHLH033, putative, expressed
MVSRVHKRTALYRSIQQLRSITNSHARRKTSVILDASKYIRGLKQKLQELNQLAVAAAQKDIEYGPVMPVLKVEPQEEGFMIKVLSQRSCLGLLAFILEAFERLGLEVLQARASCVESFSLEAFGIKEKNDDTHRVDAQVVEQVVSQAINDWRKVTKQC

SEQ ID NO: 158055 - protein, 68 aa, Glycine max
  Coding DNA Sequence Number=SeqID_41277
MTVVSRLIRQALKSVVFHLLAKPICKLSESPLSATHGLSARKTLEEDELYRFAKRTTSVHSLSEKGTR

SEQ ID NO: 158056 - protein, 38 aa, Glycine max
  Coding DNA Sequence Number=SeqID_41278
MGVDMKPTKTSTDASKSGSGGTITWVCHPLPLDPRHPI

SEQ ID NO: 158057 - protein, 87 aa, Glycine max
  Coding DNA Sequence Number=SeqID_41279
  Subcellular localization annotation: CTP_CleavageSite=56; ConfidenceScore=5.65e-01
MRRNSLASSSDTYFLPQPSFFSEKPFTGIFSFGVGITLSLCSSAIFAFPLTFAGCVDRSGGANTRPLRVTPLSPLILVTLADNELMS

SEQ ID NO: 158058 - protein, 152 aa, Glycine max
  Coding DNA Sequence Number=SeqID_41280
MLTSSKRVQMTTLASACQSNLGSPNDEVRITERCLRMLPDSWVMIAKGGVVDKSEAFAPTYPPFVMKNSDLRSSFYSFIPKRPFRGNTGPDRIEEYHSKCTNLTQGRVCGKLGFWLKACRTVGHDICQDVGLASGSGKKEKSHIISMIHMQH

SEQ ID NO: 158059 - protein, 224 aa, Glycine max
  Coding DNA Sequence Number=SeqID_41281
MQTPLSLFLGDPLVLEEGQECEYSQRRNRADGFEEEVIAQLLCIPGQDFSRTAAGRRVWIMRTSMTTLTQMWMTLLLSNVLPSDHNSDLPLPKCQLVYAILTRMSVHVAQLIADAIYLFAGMPPTRHPLDPDKSNRALGFPALITGLCQSFGVPVTPSKVIRPPITRAFIENMYSTWFASSRPTTGGRCKPMSVSTSSASVSISSGQRLHGLEIGLRPRQGRRL

SEQ ID NO: 158060 - protein, 311 aa, Glycine max
  Coding DNA Sequence Number=SeqID_41282
  Homolog annotation: Hit_ID=Q3BQP0; Match level="QueryCoverage=53%, HitCoverage=42%, E-value=5e-51, Identity=57%"; Hit description =Putative membrane protein
VAALAGDHGGVRCGRGHPAVQPAGQHRACGVQRCRRCHGLLLAHRPGGERTGAADAAGPDPLAAVAPRHRAGPVDPWLCDPDRLLGACRFTHAVDGGRGAVALQGRRGHRYGGVPRRGPELCVGAQGLVAVWFTCGVHRWRGGCRVHDRRRVWCTARRKKAATRPLIPSSHFEERNHVADRAAADRAGRGTAPVLPGAGDVPVDPSAGLEDVPQHAGEGGDHARAGGQPGPVQRLPGGGHRGGAGDQSAGAGDVLAGLRGGGRVLWRLQREPPHFHDPGGACDPGVGVSRGSVVSSQRRSPSWVARVELVM

SEQ ID NO: 158061 - protein, 159 aa, Glycine max
  Coding DNA Sequence Number=SeqID_41283
  Gene Ontology: Mol. function=RNA-directed DNA polymerase activity; Cellular component=intracellular; Biological process=RNA-dependent DNA replication
MKEKVRQEVLKLLEAGMIYHISDNSWVSLVQVVPKKDDMIVVKNDKNEIIPTTTVRGWRICVNYRRFNNAIRKDKFPFPFTDKMLERVFDRAFYSFLDGYSGYNQIAVNTLVATYPSAGGRRGTHRSIFQGRKTRGVATNVYLSKTSEKPEKRWSTNFK

SEQ ID NO: 158062 - protein, 265 aa, Glycine max
  Coding DNA Sequence Number=SeqID_41284
  Gene Ontology: Mol. function=sequence-specific DNA binding; Cellular component=nucleus; Biological process=regulation of transcription
  Homolog annotation: Hit_ID=Q9FXS1; Match level="QueryCoverage=96%, HitCoverage=78%, E-value=7e-48, Identity=44%"; Hit description=WRKY transcription factor NtEIG-D48
  Pfam annotation: Domain name=WRKY; Domain location=245-265; Score= -14.7; E_value=0.044; Accession=PF03106.6; Description=WRKY DNA -binding domain
MAVSDGNTIAVKEAASAGIHNVEKLVNMILNQHNEGGSELEAVADVAVNRFREVISLLEKPITRTTGHARFRRAPTTVPPVPVVQLQQMVDDDSKHKLQNKTEQKQKQSTSAFKVYCPPPSPPLPQNQNHHHQQQPFILPLHKNEANGSTTNSHFSTLSGDTESLQRSCLSSGFQISHVSMQGGSFKRKPPLSTNSVKRKCNSTGFPDTKCGSSSVQCHCSKKRKLRLKNVIRVPAISSKTADIPPDEYSWRKYGQKPIKGSPHP

SEQ ID NO: 158063 - protein, 146 aa, Glycine max
  Coding DNA Sequence Number=SeqID_41285
  Gene Ontology: Mol. function=sequence-specific DNA binding; Cellular component=nucleus; Biological process=regulation of transcription
  Homolog annotation: Hit_ID=Q1SEU4; Match level="QueryCoverage=90%, HitCoverage=19%, E-value=2e-32, Identity=48%"; Hit description=Exo70 exocyst complex subunit
LAATQPQLNPIFGDYGFKKSTTKVQQNLELYQRSSWNKIVDILKVDIDEVEPNVAAEVMKDKLHSFNEHLDEICNVQSAWFVFDEQLREQLIKSIENMVLPAYGNFLGRLQDFLGKHAYEYIKYGMFDVQYRLNNNLFLVWEKELE

SEQ ID NO: 158064 - protein, 433 aa, Glycine max
  Coding DNA Sequence Number=SeqID_41286
  Gene Ontology: Mol. function=sequence-specific DNA binding; Cellular component=nucleus; Biological process=regulation of transcription
  Homolog annotation: Hit_ID=Q1SEX1; Match level="QueryCoverage=90%, HitCoverage=55%, E-value=3e-71, Identity=39%"; Hit description=Exo70 exocyst complex subunit
MLIIKIRSWLLEPKVWSFVCFVSSVVGLLCYALSTSFNHLFGKWTWWKTLLYIVFSFIVCLAVLFAKAWERSTSTWLEAHMAFLILFFTSVYSFFFDKEVKGKPDAYSLFSCAAFAIMSLSMSRLSHFGFEVDLLYFFSGVLTIQLMKIKIWLVVVGGSFSYSLILLRSTLGASPTRIEYRGLQLRDDLVIEIDSQGTSHSTSQLHPDVMIITQQDAHVPLEFPVNSLSQQGNSFSDNNIMERFMGCIEALKKENENLMDTISKHVSKYLKANVVNEDQIHVCEIDADDNLVVDALLSSGIIINDLRETVRLMVAAGLKVECCRAYRSCRRKFLRKSVSNFWLRMQDLNVEEDIDKLMIEIQCWIKVLNVAVMILFPNERTLCDRVFEGSISSVEKYHVSLGNDALWGDKSLNILMNLVYFSYADKEQATVTP

SEQ ID NO: 158065 - protein, 145 aa, Glycine max
  Coding DNA Sequence Number=SeqID_41287
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=4e-15, Identity=35%"; Hit description= UPI00006A17C9 related cluster
MSLASLARKRVGCDRGLHILAFRGLPSLAFKGLHVLVFRGLHVLSVRGLHVHTLRGLHVLGFRGLHALAFRGLHVYTSSPSEGYTSSPSENYTSSPSEDYMSSPSEGYMTSPSEDYTSFPLEGYTPSPSEDYTSSPSEGCTSSPS

SEQ ID NO: 158066 - protein, 59 aa, Glycine max
  Coding DNA Sequence Number=SeqID_41288
MDFPLAPAPQLLHWEWANGGSGTVELTVILLFPKPSIRRHVLQESLGEEDQTPTLKSQD

SEQ ID NO: 158067 - protein, 417 aa, Glycine max
  Coding DNA Sequence Number=SeqID_41289
  Gene Ontology: Mol. function=protein binding; Cellular component =cellulose and pectin-containing cell wall; Biological process =multicellular organismal development
  Homolog annotation: Hit_ID=Q2HTP6; Match level="QueryCoverage=77%, HitCoverage=92%, E-value=1e-146, Identity=72%"; Hit description =Leucine-rich repeat, plant specific
  Pfam annotation: Domain name=LRR_1; Domain location=198-218; Score =6.0; E_value=21; Accession=PF00560.23; Description=Leucine Rich Repeat
  Pfam annotation: Domain name=LRR_1; Domain location=219-238; Score =10.3; E_value=3.4; Accession=PF00560.23; Description=Leucine Rich Repeat
  Pfam annotation: Domain name=LRR_1; Domain location=242-264; Score =5.0; E_value=33; Accession=PF00560.23; Description=Leucine Rich Repeat
  Pfam annotation: Domain name=LRR_1; Domain location=267-289; Score =5.0; E_value=33; Accession=PF00560.23; Description=Leucine Rich Repeat
  Pfam annotation: Domain name=LRR_1; Domain location=291-313; Score =8.4; E_value=7.7; Accession=PF00560.23; Description=Leucine Rich Repeat
  Pfam annotation: Domain name=LRR_1; Domain location=315-338; Score =5.5; E_value=27; Accession=PF00560.23; Description=Leucine Rich Repeat
  Pfam annotation: Domain name=LRR_1; Domain location=340-360; Score =8.8; E_value=6.3; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=198-218::219-238::242 -264::267-289::291-313::315-338::340-360
MSSNMPAKLLLTTLYILLVFLPIHMSPHDVNIDTHSFKSSSSTSGHRSKIGGGGSAKGCNNNNSNSNQLDTNTTPCQKSTTIQAVPAASSPPLVFADQRLEVVYPTVQKFKSTITSDPLGVTKTWVGSDICSYKGFYCDTPPDNSSATALASIDLNGFQLSASTLDGFIDNLPDIALFHANSNNFGGTISPQIAKLSYLYELDVSNNQLSVPPQIFTQNLQVLFINNNILTQGLPDNLASTHILLLTLANNKFMGPIPRSLPKALSTLSEVLLLNNQLTGCLPYEIGFLEEATVFDAGNNQLTGPLPLSLSCLEKVEVLNFGGNLLYGMVPEVVCVGLVNLVNFSLSDNYFTHVGPFCRMLIQRGVLDVRNNCIPDLPFQRSVMECAEFFATPRMCPFMWFHGLIPCKLPFQHSIHN

SEQ ID NO: 158068 - protein, 386 aa, Glycine max
  Coding DNA Sequence Number=SeqID_41290
  Gene Ontology: Mol. function=microtubule motor activity; Cellular component=microtubule associated complex; Biological process =microtubule-based movement
  Homolog annotation: Hit_ID=Q8GS71; Match level="QueryCoverage=96%, HitCoverage=32%, E-value=1e-142, Identity=71%"; Hit description =Kinesin-like protein
  Pfam annotation: Domain name=Kinesin; Domain location=15-386; Score =343.7; E_value=3e-100; Accession=PF00225.13; Description=Kinesin motor domain
MVEAGEDCCVKVAVHVRPLIGEEKVQGCKDCVTVVSGKPQMQSVNTLIKMGKDYGSLAFDISWISLAFLLPNYVNILLQNLVQIGAHSFTFDHVYGSTGSPSSAMFDECVVSLVDGLFQGYNATVLAYGQTGSGKTYTMGTGFKDGCQEGIIPLVMSSLFNKIDTLKHQIEFQLHVSFIEILKEEVRDLLDPSSMNKPETANGHAGKVTIPGKPPIQIRESSNGVITLAGCTEVSVTTLKEMAACLEQGSLSRATGSTNMNNQSSRSHAIFTITLEQMRKLNSPGEISLNDTMNEEYLCAKLHLVDLAGSERAKRTGSDGLRFKEGVHINKGLLALGNVISALGDEKKRKEGVHVPYRDSKLTRLLQGDSRGSGNQTHTYTSNNLA

SEQ ID NO: 158069 - protein, 202 aa, Glycine max
  Coding DNA Sequence Number=SeqID_41291
  Homolog annotation: Hit_ID=Q9FIJ8; Match level="QueryCoverage=87%, HitCoverage=83%, E-value=1e-36, Identity=48%"; Hit description =Arabidopsis thaliana genomic DNA, chromosome 5, P1 clone:MCA23
  Subcellular localization annotation: CTP_CleavageSite=84; ConfidenceScore=5.05e-01
MVEAEASSSQPQPQASSSGQNGVVRDLLTLARQLITQGKPSQALQACLRILKFDTGTSHLSCVANSLENFALGKTLKKVAKVVVAMKTKGGDEAVFHSLHRAREVYRSRLQENAAVDQLASLFAECAIAEAEPVVIEPPANNITTPSISPEPDAHGTSILAESGRMQVVLDAVSDGSSFICLKCGGLVSNHRKDEHYAYWCC

SEQ ID NO: 158070 - protein, 706 aa, Glycine max
  Coding DNA Sequence Number=SeqID_41292
  Gene Ontology: Mol. function=microtubule motor activity; Cellular component=microtubule associated complex; Biological process =microtubule-based movement
  Homolog annotation: Hit_ID=Q8GS71; Match level="QueryCoverage=99%, HitCoverage=67%, E-value=0.0, Identity=76%"; Hit description=Kinesin- like protein
MDSLGGNSRTVMIACISPADINAEETLNTLKYANRARNIQNKPVVNRDPMSNEMLKMRQQLEYLQAELFARSGGSPEEVQVLKERIAWLEAVNEDLRCELHEYRSRCSTVEQCEKDVYENSSCNVKTDGLKRGLPITTSDYPMSETTAGDSREIEEVEKEWEHTLLQNSMDRELHELNKRLEQKEVSEMKLFGISDAEALKQHFGRKIMELEDEKRTVQRDRDRLLAEVENLAANSDGQIQKSEDIHAQKLKTLEAQILDLKKKQESQVQLMKQKQKSDEAAKRLQDEIQSIKAQKVQLQHRIKQEAEQFRQWKASREKELLQLKKEGRRNEFERHKLQALNQRQKMVLQRKTEEAAMATKRLKELLEARKSSSRDTSVAMNGSGMNGQSNEKSLQRWLDHELEVMVKEHEVRFEYEKQSQVRAALAEELAMLKQVNGFAAKGLTPPRGKNGFARASSMSPNARMARIASLESMLNISSNSLVAMASQLSEAEERERAFTNRGRWNQLRSMGEAKNLLQYLFNSVGDARCQLWEKDTEIREMKDQIKELVGLLRQSEMKRKEAEKELKVREQDVATTLATPTSGNSPNSLKHYAEDIKEPLSPESLPVQKQRKYMPGITNSQVRESAAFIDQSRRMIPIGQLSMKKLAVVGQASGKLWRWKRSHHQWLVQFKWKWQKPWRLSEWIRHSDETIMRARPRSQALPRIM

SEQ ID NO: 158071 - protein, 340 aa, Glycine max
  Coding DNA Sequence Number=SeqID_41293
  Gene Ontology: Mol. function=drug transporter activity; Cellular component=membrane; Biological process=multidrug transport
  Homolog annotation: Hit_ID=Q1SP70; Match level="QueryCoverage=97%, HitCoverage=59%, E-value=1e-145, Identity=74%"; Hit description =Tetratricopeptide-like helical
MVESGIVAEEPELSALLEVSVNANKEDKVYEVLHRLRATLRQVSESTLGIVENWFNSEYAAKIGKEKWDVKKVREGIARGGGGWHGQGWLGSGRWKVVNTQVNEDGVCLSCGEKLASIDIDPKETENFAASLSKLACQKEAKANFVHFQTWLERHGPFDAVVDGANVGLANGHNFSFSQLNTVVEQLRQISPSKRLPLIILHISRVHGGPAQNPKNKRLIENWKKNGVLYATPQGSNDDWYWLYAAVSCKCLLLTNDEMRDHLFQLLGSNFFPRWKEKHQVRTSASTCGRSLIMPPRYSIVIQESASGCWHVPTVTTDDHEIPRKWLCATRSRKDSLHNL

SEQ ID NO: 158072 - protein, 469 aa, Glycine max
  Coding DNA Sequence Number=SeqID_41294
  Gene Ontology: Mol. function=receptor activity
  Homolog annotation: Hit_ID=Q1SQZ7; Match level="QueryCoverage=98%, HitCoverage=98%, E-value=1e-167, Identity=67%"; Hit description =SPla/RYanodine receptor SPRY
  Pfam annotation: Domain name=SPRY; Domain location=269-381; Score =15.9; E_value=0.0011; Accession=PF00622.18; Description=SPRY domain
MGQVIHVAVVAASLGCVSTLLMVFIWRLCHHKKEHRNFVQPNSLARMESLQAGIARLHQQPTIYHQFADHKNKNKGNFYVFHNGVSRRGHLFNWDDHPYLLVDAVENGWSRFAFTNYKSNMPSPSKRSTSTLLGACAAGEYGRETEAEISWEVCNGSAEYMQKIRLNPGLKFKNVLHTNNFSNMTVASVIRTALPLPGPPLGNYAFPQEAYFEITILCSCVDDDHESVVAKREGEKTKLLIEDGSNGTGELDSVEEMKLGQKEGGGKSGGSVMFSLGLTAGGGVPLRVPGSYLRSIGFNSSGSVFLEGMKLVMESEKAQWVGTDRVIGCGFDPRQKKVFFTLDSELVHVIHCQSEEFGTPLCPTLAANIDIQVLVNFGQSAFKYAPANAQRTPNPCFIAPLVNSPGATLGYDDSKELFSMGRIDSQWLNRSANKGNIPNGNNTQILDFDEADLFEIVLDGSEKSQNTVS

SEQ ID NO: 158073 - protein, 363 aa, Glycine max
  Coding DNA Sequence Number=SeqID_41295
  Gene Ontology: Mol. function=nucleic acid binding; Cellular component= intracellular; Biological process=regulation of transcription
  Homolog annotation: Hit_ID=Q1RV65; Match level="QueryCoverage=72%, HitCoverage=73%, E-value=1e-125, Identity=80%"; Hit description=Zinc finger, C2H2-type
  Pfam annotation: Domain name=zf-C2H2; Domain location=137-160; Score =17.3; E_value=0.054; Accession=PF00096.16; Description=Zinc finger, C2H2 type
MVGFVCNCTKEHGGGGGGSGDDGVVFGARVMVANNNNNNNSIEIDMVKNSQGIYAPKASKVVVLWDLDNKPPRGPPYDVAISLKTLAARFGDLVDFSAYANRHAFVHLPQWVLQQRRDRKNLDILERKGIITPPEPYTCGVCGRKCKTHLDLKKHFKQLHQRERQKKLNRLKSLKGKKRHRFKERFLRGNHKYDDAARTLVVPKVGYGLAAELRRAGVFVKTVQDKPQAADWALKRQMVHSMSRGIDWLFLVSDDSDFSEMLRRAREADLGTVVVGDWDRALGRHADLWVPWSGVENGEVGDLVPKRRRENSRRREQGEEHGFGLEDDDDDDGEDEELGQEYMLLYDDDDDDEGEEEDGLYIF

SEQ ID NO: 158074 - protein, 169 aa, Glycine max
  Coding DNA Sequence Number=SeqID_41296
  Gene Ontology: Mol. function=transcription factor activity; Cellular component=nucleus; Biological process=regulation of transcription, DNA-dependent
  Homolog annotation: Hit_ID=Q7Y0Y9; Match level="QueryCoverage=86%, HitCoverage=83%, E-value=6e-59, Identity=79%"; Hit description =Dehydration responsive element binding protein
  Pfam annotation: Domain name=AP2; Domain location=43-107; Score =135.6; E_value=1.4e-37; Accession=PF00847.10; Description=AP2 domain
MEERDHRCSNNSTMITTTKKKTSRRSPTSDKLKNQHPCEKQAMKPYRGIRMRKWGKWVAEIREPNKRSRIWLGSYTTPMAAARAYDTAVFYLRGPTARLNFPELLFQDDQEEGNDSVQHGAAAGNMSADSIRRKATQVGARVDALQTALHHHASSDDDDDASELGLETN

SEQ ID NO: 158075 - protein, 33 aa, Glycine max
  Coding DNA Sequence Number=SeqID_41297
MALSMTSRGFSIERCIVSLELDRAGLVLVVLYD

SEQ ID NO: 158076 - protein, 671 aa, Glycine max
  Coding DNA Sequence Number=SeqID_41298
  Gene Ontology: Mol. function=nucleic acid binding; Cellular component= chromatin; Biological process=DNA integration
  Pfam annotation: Domain name=zf-CCHC; Domain location=388-405; Score =22.1; E_value=0.00022; Accession=PF00098.13; Description=Zinc knuckle
  Pfam module annotation: Pfam domain module=RVT_2::zf-CCHC; Domain location=1-138::388-405
MDEEIQALELNNTWIERYKARLVAKGYTQVEGHDYLDTFSPVAKLITMRLLLSLAATNQWYLNQLDVNNAFLHGDLNEEVYMIIPQGMQDLSDLRYFVGFEVARKTAGINLCQRKYALDILSDACMLGNPTGIFLSAISNIRLKDFNDSDWADCIDTRRSITEVEYRALASATCELQWLTYLLEETKHIKIDCHLVREKMLNGLVKLLPIPPVNQLADIYTKALLHGAFQELPLKLRLRETLTTIDHHCYNHDVLEIVQAGFLELENNPTNAQKVAYKDAIKCDSKALFLILQSVDASVASIIAKVVQATSNGRRRADVIIMEKVMHAVTQSFDHIVVAIEEYIEVENMKFEELQGKPKAEDKLESSHRGEAGPSNQGYKKKKDRRKIQCFNCEKRGHYEAECWHVVMKNDKLELFDPSQRLLLRSPISKNRILQANIRTTKVQCLSTTVTDQENWLWHFRFKAMAERQSGRIIKILRTDGDGENMIVLNMAKSTIKQKNLPHNFWGEAVITTTYLWNRCSTKRLKEKVLEESWSSRKPTVGNLRVFGSLCFKHVPDERRKKLQDKSEAMILSWDKKNQRNGHDSTIPIQLDEVHIDDEGNTEELNETKKDTIPQGVQIQRPVRERQPPSRYADFEMLHDNEVITEGDMAHFALPTDVEPINHEDALKEDA

SEQ ID NO: 158077 - protein, 165 aa, Glycine max
  Coding DNA Sequence Number=SeqID_41299
MAFEPGSAVEVSIDGGAGALGRSWFSDRFLVLYPNVAEKSTVSFHQLRLLPPPETRWIFHYGEKVEVSFGDSERVPFQTVIGKAITAWLQVLANVNILALCVHAIRILHLELSNPISMKAQPPNFARLELLIVKQQFPFDSFILANDLPPQDQSLNVHSPYYLHP

SEQ ID NO: 158078 - protein, 240 aa, Glycine max
  Coding DNA Sequence Number=SeqID_41300
MASTAEPLPYSSRRRDESEFNLREWAVKARIRRENTNSRRYSGSYMRSFREDTRSFRSNITISSTASSPGYPLKDDIDPSTYSFTTALKALQARAGYNRWGCLSPDGFALNSKWNEAERYICNPLSGEVPLECLSAKTLSGRSFRNSINRIAMSAPLVYSSKHIPTKPATYIQEEVALQFPNPEKKKEGITRDVGTQSTPPYLSSTSPSPASTPSITERSKPRISDSLNLNAKTTNSDEE

SEQ ID NO: 158079 - protein, 87 aa, Glycine max
  Coding DNA Sequence Number=SeqID_41301
  Gene Ontology: Mol. function=DNA binding; Biological process=DNA integration
  Homolog annotation: Hit_ID=Q1T010; Match level="QueryCoverage=67%, HitCoverage=4%, E-value=7e-14, Identity=62%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDVLKRFNMTDCNPSITPLEVVLKLDNTSNDDEPVDPTLFKQLIGSLRYLCNDRLDINFAEIKFHGCQENTEMPKGNYEVLFLCESN

SEQ ID NO: 158080 - protein, 186 aa, Glycine max
  Coding DNA Sequence Number=SeqID_41302
  Gene Ontology: Mol. function=N-acetyltransferase activity; Cellular component=cytosol; Biological process=metabolic process
  Homolog annotation: Hit_ID=Q2R3D8; Match level="QueryCoverage=90%, HitCoverage=89%, E-value=3e-52, Identity=62%"; Hit description =Acetyltransferase, GNAT family protein, expressed
MDENVELDAWEIEYVSYGGEQHLPLVMNLVDQELSEPYSIFTYRYFVYLWPQLSFLVLPQLFHFQMVCKMGNTVTLSEATLSCWLSSSPTEEEALLVTRSIKVIMESGCEEVTLEAEVTNKGALALYGRLGFIRAKRLFHYYLNGVDAFRLKLLFPRSELHPSLPMMSDKYESHMQSDHGDAPFKE

SEQ ID NO: 158081 - protein, 369 aa, Glycine max
  Coding DNA Sequence Number=SeqID_41303
  Homolog annotation: Hit_ID=Q9SLE2; Match level="QueryCoverage=67%, HitCoverage=76%, E-value=5e-18, Identity=30%"; Hit description =Expressed protein
  Pfam annotation: Domain name=SGL; Domain location=36-308; Score= -77.8; E_value=0.00019; Accession=PF08450.2; Description=SMP -30GluconolaconaseLRE-like region
MLISSPKQPFLLVTILITILLLGPGPILARNAHVINFRSPNLYPESLTWDPRAQHFLLGSLRQRIIAAVSDAGVVETFISDTDLPADVAFLGLAVDSPRNRLLAVVHSSYSLPPFNALAAYDLRSRRRLFLSSLPSEEIDAANDVAVDHRGNAFVTNSGGNFIWKVTADGSASIFSTSPMYKTATEIPANDNDTAPHGSLGLNGIAYVSKGYLLVVQSSTGKVFKVDAVDGTARKVLLNEDLVGADDIAVRKDGAAAVVSPLKELWLVKSIDSWAEGTVYDNVEVNVRRFPTSVVVGDKERVYVLYGHLDEGRMGDSGRESFGIAELRSKKEGQDESIWIFVLIGIGLAYFCFWRFQMGQLVKKMDKIN

SEQ ID NO: 158082 - protein, 115 aa, Glycine max
  Coding DNA Sequence Number=SeqID_41304
  Homolog annotation: Hit_ID=Q9FXS6; Match level="QueryCoverage=91%, HitCoverage=60%, E-value=1e-40, Identity=71%"; Hit description=NtEIG- E80 protein
  Pfam annotation: Domain name=PAR1; Domain location=1-114; Score =153.2; E_value=7e-43; Accession=PF06521.2; Description=PAR1 protein
MAAEMVCEDLPKEVCAFSLASSGKRCLLETEKVADGCVEYQCRTSEVVVERMAEYIETDQCVEACGVDRNSVGISSDAFFEPQFTGKLCSPACYQKCPNIIDLFFNLAAGEELTH

SEQ ID NO: 158083 - protein, 277 aa, Glycine max
  Coding DNA Sequence Number=SeqID_41305
  Gene Ontology: Mol. function=transcription factor activity; Cellular component=nucleus; Biological process=regulation of transcription, DNA-dependent
  Homolog annotation: Hit_ID=Q9FH54; Match level="QueryCoverage=58%, HitCoverage=64%, E-value=1e-25, Identity=45%"; Hit description=AP2 domain transcription factor-like
  Pfam annotation: Domain name=AP2; Domain location=91-155; Score =154.7; E_value=2.4e-43; Accession=PF00847.10; Description=AP2 domain
MQYGKLPLSSQASEEKEGTVEDFDAYNNYASWSSETDMSEMVSALSQVMGTTNRNPHMPQSNSFPSSTSVVKDQPQPYPSQPPPDQEVTKKPHYRGVRQRPWGKWAAEIRDPKKAARVWLGTFETAEDAALAYDKAALKFKGTKAKLNFPERLHQNVPYMQQHQQGSSNRNVFPFHATSSTSSSATGSVSSLDAVAPPSLSTHDHQVFPNLYQYAQILSSGDEEFPYYTSHLFNQQQQHQPFSSQFSTTFSSSSSPSSYFYNQQQQYDQQGHDHSNH

SEQ ID NO: 158084 - protein, 423 aa, Glycine max
  Coding DNA Sequence Number=SeqID_41306
MTSRKRKSSTSRPQEPYDTTRFVSEVAWERYEQNVHARNILPERNVDLYVMQYDEFRKELERRRWHKALIRQPDGHIDVALVKEFYANLYDLEDRSPRQGSDTQPTLGAPWKLLRKDLTTLAQTWTVLSYSNLAPTSHTSDLNMDRARLVYGLVMKMDMDVGSFIFGQISQMAQPNSSRLGFPALIIALCIARGVVSNSLTFESLSPAINLAYIKKNCWKPDDPTITFPGTCKTRARGPSYTSTSAPASTSAPAPPPALVPTPPALTAPSGPSAQSLDVPVPMLQSLHHGLFLVMQSIHNLAQHRPIISMEDFMAQVPWPGVQPSPAGGGEAPTTQEPQPESEATSEETPEVTPATTPLEATEEGDGATDTNYAVDMAAAWGTWDPWPTSTQDSIPTPSPHLRMIQHWHKRIDDRTLIYISVI

SEQ ID NO: 158085 - protein, 61 aa, Glycine max
  Coding DNA Sequence Number=SeqID_41307
  Subcellular localization annotation: CTP_CleavageSite=24; ConfidenceScore=5.30e-01
MKDAPASKSNNSRSVNQLSDLYTRSDGRTPNFNSDFSLTVTHKFAFNLFGLVHSKGATQNY

SEQ ID NO: 158086 - protein, 35 aa, Glycine max
  Coding DNA Sequence Number=SeqID_41308
MYNSYKKNHKLEVEISDRFYPSFLETVAQTLFMQQ

SEQ ID NO: 158087 - protein, 112 aa, Glycine max
  Coding DNA Sequence Number=SeqID_41309
MLNPTQFQVKEENVQVVDDSLSEANPLSEWHLLSEAYNSLSGLRNPKRGSVRDVLAQCAASPPSGLKGPRAFKTLKLAEIKHRVRERAPEEAEKIERKQLRELRLEGVKSRV

SEQ ID NO: 158088 - protein, 98 aa, Glycine max
  Coding DNA Sequence Number=SeqID_41310
MGESNKREWYVDDNPSRLVALGKVYEGSTTIHKVPLGNNQVKVGVERVRDVDACLPIPTQEDKHGVEGPVKPVDRAQHDDDPLYQMTLTISQLFLKPL

SEQ ID NO: 158089 - protein, 128 aa, Glycine max
  Coding DNA Sequence Number=SeqID_41311
MLNPTQFQAKEEMVQVVDDSLSEADLLSEWHSLSEAYNSLSGLRNPRRRSVRDVLAQRPASPPSGLAKPKFTYSRLASLRKLKGPRAFKTLKLAKIKHRVRDSAPEEAKKTERKQLREHMLEGVKSRV

SEQ ID NO: 158090 - protein, 742 aa, Glycine max
  Coding DNA Sequence Number=SeqID_41312
  Gene Ontology: Mol. function=nucleic acid binding; Cellular component= nucleus; Biological process=meristem development
  Homolog annotation: Hit_ID=Q6J732; Match level="QueryCoverage=93%, HitCoverage=88%, E-value=1e-144, Identity=46%"; Hit description=AML1
  Pfam annotation: Domain name=RRM_2; Domain location=556-665; Score =205.0; E_value=1.7e-58; Accession=PF04059.3; Description=RNA recognition motif 2
MLAVSVLFIPVFTFSWQRQASLWKSDNMPNCYDFDQGIKTSLNVQSLSHLSDSSKVNVVATQHESSLFSSSLSELFSRKLRLSANNALYGHSVDTVASHYEEERLFDSLEELEAQIIGNLLPSDDDLLSGVTNGLDHIIQDSSGDDTDELDLFSSVGGMDLGHDNCSSSEQKNSEILDEACNSQLGLRSASIAGEQPYSEHPSRTIVVRNINSQHKESNVYLHQNSLPLKSPTSFPGLHGISKSGKLDGGRVLGVEPAICTPSPETAFFHGVSSSVPNSLPSLVRVKSADNRCEVTESGSPGQLNFDSQAAPAFHPHSLPEFHDGLANSVHHIPPEVAANINLKTQERIDNMQFCQVNSNGRFMEFNECVFKSSGNGSCPLPGHHYKWGNSYQPPGMMWPNSPSYIDGVCAATNLPRLHGLPRSPSHMMATVLPINGQHVPSAPFWDRRHTYAGESLGNMQFSGNTAAHCVDFVSYNIFPHFGGNCVDLRVLPKNLGVHFHNQGDLMFPRRNHMINSFETHKQRTRSRRNEGLPNLDDKKQYELDIDRIKKGEDNRTTLMIKNIPNKYTSKMLLAAIDERHRGTYDFVYLPIDFRASAFLFLKYLEFMNKCNVGYAFINMINPGLIIPFYQVFDGKKWEKFNSEKVASLAYARIQGKAALIAHFQNSSLMNEDKRCRPILFNTDGPNAGDQVPFPVGINIRNKAGRVRNNTQEDNLQGSRSLPNLGISKLSSDGDSHSLESD

SEQ ID NO: 158091 - protein, 50 aa, Glycine max
  Coding DNA Sequence Number=SeqID_41313
MTPETTSEEDTETVRESTSASSENAREETETTNVAKAWKVVNVLGPFLLE

SEQ ID NO: 158092 - protein, 58 aa, Glycine max
  Coding DNA Sequence Number=SeqID_41314
MANQRGQVQLNENFYRATVAWPGDEPDLQTRAGPVRAPRDEVGAQEDDDMADVLDYFL

SEQ ID NO: 158093 - protein, 80 aa, Glycine max
  Coding DNA Sequence Number=SeqID_41315
  Subcellular localization annotation: CTP_CleavageSite=52; ConfidenceScore=5.18e-01
YLQGRSNKGFSFSYPGSILYNKEKNKMKDVKNTSGEDVSFTSRISQSLTNSSQALKSAPTSSSSLCKSSHSKIYQNSLEL

SEQ ID NO: 158094 - protein, 186 aa, Glycine max
  Coding DNA Sequence Number=SeqID_41316
  Gene Ontology: Mol. function=DNA binding; Cellular component=nucleus; Biological process=regulation of transcription
  Homolog annotation: Hit_ID=Q67UM4; Match level="QueryCoverage=45%, HitCoverage=24%, E-value=1e-13, Identity=45%"; Hit description=Gt-2 -related-like
MALQKNYVAETDGRNWFYDWATGVYVENLLMFNKFSSVEKDLVDIIVVVGNVWCFLVYTNAVVFLVSREVGKCIEKQYQPHLQGCEGEGNPQGTTNEKRANPNPEMGSTSQGERKRKWLATDGEEETLQSQLIDVLEKNGKMLRDQLEAQKLNFQLDRQQQKDTASNIVAVLDKLADALGRIADKL

SEQ ID NO: 158095 - protein, 64 aa, Glycine max
  Coding DNA Sequence Number=SeqID_41317
MDMYFVNENAFQNYSIQNYTKEVSGYGDTTRKVRCERLRQQDEIVAETQERRDNVHVEESGGSE

SEQ ID NO: 158096 - protein, 148 aa, Glycine max
  Coding DNA Sequence Number=SeqID_41318
  Gene Ontology: Cellular component=endoplasmic reticulum; Biological process=protein transport
  Homolog annotation: Hit_ID=Q156E3; Match level="QueryCoverage=68%, HitCoverage=92%, E-value=4e-22, Identity=64%"; Hit description =Putative transport protein
  Pfam annotation: Domain name=Sec61_beta; Domain location=53-97; Score= 66.5; E_value=8.5e-17; Accession=PF03911.7; Description=Sec61beta family
  Subcellular localization annotation: CTP_CleavageSite=31; ConfidenceScore=5.36e-01
VLNPPLQQPRDQDQQAWLPAVSPPPLPACAVATTGMHRRRLDNRNSSTSTVIRGGGSNMLRFYTDDAPGLKISPTMVLVMSFCFIGFTTLHVFDKLYRSKSGGVPDLKSIRFNVVADINNVFEDWSEVYNDVAFKDRPAPSLNADKDR

SEQ ID NO: 158097 - protein, 734 aa, Glycine max
  Coding DNA Sequence Number=SeqID_41319
  Gene Ontology: Mol. function=protein binding; Cellular component =cytoplasm; Biological process=regulation of GTPase activity
  Homolog annotation: Hit_ID=Q5W7F2; Match level="QueryCoverage=83%, HitCoverage=76%, E-value=0.0, Identity=68%"; Hit description=ARF-GAP
  Pfam annotation: Domain name=ArfGap; Domain location=560-705; Score =159.6; E_value=8.3e-45; Accession=PF01412.9; Description=Putative GTPase activating protein for Arf
  Pfam annotation: Domain name=PH; Domain location=353-488; Score=70.1; E_value=7e-18; Accession=PF00169.19; Description=PH domain
  Pfam module annotation: Pfam domain module=ArfGap::PH; Domain location=560-705::353-488
ELEGPANGRVAVRDFDSEIEYSWCDNAKPYLLLDQHQHEQQRANPSNGLWPGDCDSLHRFMVCTTAIHGEGRFQNLEENLSELIYGLLVFEVSQGWLAHLIRHQGWDLGRAVRVREASRLGEAYDGDIAFASALETFGGGHNDPISVAFGGMLPFYINIMMVDERFSVPPGPVMTKFTIALREIGTYKEVLRSQTRERFLSLRKGTKTGVATALEEELHSARSTFEQARFNLVTALSNVEAKKRFEFLEAVSGTMDAHLRYFKQGYELLHQMEPYINQVLTYAQQSRERSNYEQAALNERMQEYKRQIDRESRWASNGSNGSPNGDGIQAIGRSSHKMIEAVMQSAAKGKVQTIRQGYLSKRSSNLRGDWKRRFFVLDSRGMLYYYRKQCSKSSGSSSQHSGQRNSSELGSGLLSRWLSSHHHGGVHDEKSVAHHTVNLLTSTIKVDADQSDLRFCFRIISPTKNYTLQAESALDQMDWIEKITGVIASLLSSQIPERMLPASPMGSGHHRSTSESSSFESSDFDHYAVEECAADRSFTSAHLERPSRSLQQQRSCTKSEKPIDVLRRVCGNDKCADCGAPEPDWASLNLGVLVCIECSGVHRNLGVHISKVRSLTLDVKVWEPSVISLFQSLGNTFANSVWEELLQSRSAFQVDLVPTGLSTSDKPMMFFITKPCQSDSLSVKEKFIHAKYAEKLFVRKPKDNQYCLLVAQQIWEAVHANDKKAVYRYIVNSD

SEQ ID NO: 158098 - protein, 124 aa, Glycine max
  Coding DNA Sequence Number=SeqID_41320
MERVLVEVLRDQRNLGNKSDRAWKRVAYNTTLAMLSVNFKVQVTWENAKTWVKLWRSWYGVVSDILSQSGFEWDDTKYMITVGDENAWNKQFQNWDDIVYLRAKNGVIGRGVEIAMDVDEVMCT

SEQ ID NO: 158099 - protein, 49 aa, Glycine max
  Coding DNA Sequence Number=SeqID_41321
MANHGIFISFCYWDAFVGRSISMLCVEQCTNKGVKLHKRNEVDDFNQPF

SEQ ID NO: 158100 - protein, 187 aa, Glycine max
  Coding DNA Sequence Number=SeqID_41322
RVLSYPNLVRGSSVVGMRPSLDHFEAVASRGSNLARLGELGGKHLLPFPINKGRREEQKGSTLLIFNHSSTFFVVLRSSTVNFSVNNYSASIKILNESNASHKYQGFGKPGKGHHQDVGGPESVIFKKENKQKSGGNNLAFVCLESNIVYVPIDSWWLDSGSPTRIDVSFQGIINLREPSLREDKLR

SEQ ID NO: 158101 - protein, 429 aa, Glycine max
  Coding DNA Sequence Number=SeqID_41323
  Gene Ontology: Mol. function=serine carboxypeptidase activity; Cellular component=cellulose and pectin-containing cell wall; Biological process=proteolysis
  Homolog annotation: Hit_ID=Q93Y09; Match level="QueryCoverage=99%, HitCoverage=100%, E-value=0.0, Identity=70%"; Hit description=Serine carboxypeptidase II, putative
  Pfam annotation: Domain name=Peptidase_S10; Domain location=36-422; Score=520.9; E_value=1.4e-153; Accession=PF00450.12; Description =Serine carboxypeptidase
MCSLLWSSIALCVAFLLLELGVVHPSPSHHRITRLPGQPHVQFHQFSGYVTVDDKNQRALFFYFAEAEKDALSKPLVLWLNGGPGCSSLGVGAFSENGPFRPKGKGLVRNQFSWNRARDNLVFLQSWFIKFPEYRNRSLFIVGESYAGHYVPQLAELMLQFNKKEKLFNLKGIALGNPVLEFATDFNSRAEFFWSHGLISDTTYKMFTSVCNYSTYVREYYNGAVSPICSSVMSQVTTETSRFVDKYDVTLDVCLSSVFSQTKVLNPQQVTETIDVCVEDETVNYLNRKDVQSAMHAHLVGVQRWSACSNVLDYELRDLEIPTITVVGKLVKEGIPVLVYSGDQDSVIPLTGSRTLVHKLAKELGLNTTVPYRVWFEKQQVGGWTQVYGNILSFATIRGASHEAPFSQPERSLVLFKSFLEGGPLPQEF

SEQ ID NO: 158102 - protein, 72 aa, Glycine max
  Coding DNA Sequence Number=SeqID_41324
MDQVVIQGGSLKVSGSRLRERGLLLFDLSVKETGLPTENYAFMAMHGTSTIKAKANICFRPHISYLSINSLN

SEQ ID NO: 158103 - protein, 1215 aa, Glycine max
  Coding DNA Sequence Number=SeqID_41325
  Gene Ontology: Mol. function=phosphoprotein phosphatase activity; Cellular component=intracellular
  Homolog annotation: Hit_ID=Q8LL04; Match level="QueryCoverage=98%, HitCoverage=95%, E-value=0.0, Identity=42%"; Hit description=CTD phosphatase-like 3
  Pfam annotation: Domain name=NIF; Domain location=916-1142; Score =40.5; E_value=6.6e-11; Accession=PF03031.8; Description=NLI interacting factor-like phosphatase
MGKEAEDVEEGEISDTASVEEISAEDFNKQDVKLLNNNNKPNGSDARVWAVHDLYSKYPTICRGYASGLYNLAWAQAVQNKPLNDIFVMEVDSDANANSNRNSSHRLASVAVNPKDVVVVDVDKEEGELEEGEIDADAEPEGEAESVVVAVSDSEKLDDVKMDVSDSEQLGARGVLEGVTVANVVESFAQTCSKLQNTLPEVLSRPAGSEKDDLVRLSFNATEVVFCSMDSSEKEQNKDSILRLLSFVKDQQQAQLFSPEHIQGMMTAIDSVGALVNSEAIGKEKELQTTEIKTQENSAVEVQIHEIKTQENQAVEAAELISYSKPLHRDITGTSQALKFGQNSIKGRGVLLPLLDLHKDHDADSLPSPTREAPSCFPVNKLLSVGESMVRSGSASAKMELDSEGSKFHLYETDALKAVSTYQQKFGRSSLFTNDKFPSPTPSGDCEDEVVDTNEEVSSASTGDFLTSTKPTLLDQPPVSATSMDRSSMHGFISSRVDATGPGSFPVKSSAKNRDPRLRFINSDASAVDNLSTLINNMSKVEYSGTTISRKQKAAEEPSLDVTVSKRLKSSLENTEHNMSEVRTGSGGWLEENTGPGAQLIERNHLMDKFGPEAKKTLNTVSSSCTGSDNFNATSIRNEQAPITASNVLASLPALLKEASVNPIMLVNILRLAEAQKKSADSAAIMLLHPTSSNPAMGTDSTASIGSSMATGLLQSSVGMLPVSSQSTSTAQTLQDDSGKIRMKPRDPRRILHTNNTIQKSGDLGNEQFKAIVSPVSNNQRTGDNVNAPKLEGRVDNKLVPTQSSAQPDIARQFTRNLKNIADIMSVSQESSTHTPVSQNFSSASVPLTSDRGEQKSVVSSSQNLQADMASAHETAASVTSRSQSTWGDVEHLFEGYDEQQKAAIQRERARRIEEQNKMFAARKLCLVLDLDHTLLNSAKFVEVDPLHDEILRKKEEQDREKPHRHLFRFPHMGMWTKLRPGIWNFLEKASKLYELHLYTMGNKLYATEMAKVLDPKGVLFAGRVISRGDDTDSVDGEERVPKSKDLEGVLGMESSVVIIDDSVRVWPHNKLNLIVVERYTYFPCSRRQFGLPGPSLLEIDHDERPEAGTLASSLAVIEKIHQIFFASQSLEEVDVRNILASEQRKILAGCRIVFSRVFPVGEANPHLHPLWQTAEQFGAVCTNQIDEQVTHVVANSPGTDKIPALLTGLHDRVI

SEQ ID NO: 158104 - protein, 404 aa, Glycine max
  Coding DNA Sequence Number=SeqID_41326
  Pfam annotation: Domain name=DUF793; Domain location=1-397; Score =783.2; E_value=1.5e-232; Accession=PF05633.2; Description=Protein of unknown function (DUF793)
MPATDYQGSSSPSSLTHFGRSILSLRQEQVHSISMEGSSLEAELESFQQHVTDRFLELTSVVHDDLLSLSWVGKLLHCFLCCQEEFKAILHSHRAQVLRPPLDRMVSEYFERSVKALDVCNAIRDGIEQIRQWQKLLEIVLYALGHQRSIGEGQFRRAKKALIDLHIGMLDDQDSNASIAHRNRSFGRSTGSRDSHSHGNNHSNNNTYHHRSLGHFRSLSWSVSRTWSAARQLQAIGNNIYPPKANELMASGGLAMPVFIMNSILLFVMLALVAAIPCQDRGLHVHFTIPRNYSWAAAILSLHERIVEESKKRERKNSCGLLKEIHQIEKCARVMNDLADSVHFPLTEGKEREVRQIVQEVSQVCDALKGGLDPLERQVRDVFHRIVRSRTEGLDSLGRPSNAE

SEQ ID NO: 158105 - protein, 96 aa, Glycine max
  Coding DNA Sequence Number=SeqID_41327
MKAESVVLVTRGRNRGRDGAGARGVLIRRRRVHDGNCRKDCLAEEDAEASEGGKRVESSEFKEAIAEDAETETAMGTKRNERVSSVLLVKKKCRDE

SEQ ID NO: 158106 - protein, 120 aa, Glycine max
  Coding DNA Sequence Number=SeqID_41328
  Gene Ontology: Mol. function=protein disulfide oxidoreductase activity; Cellular component=chloroplast; Biological process =glycerol ether metabolic process
  Homolog annotation: Hit_ID=Q1T0K3; Match level="QueryCoverage=90%, HitCoverage=65%, E-value=1e-48, Identity=82%"; Hit description =Thioredoxin domain 2
  Pfam annotation: Domain name=Thioredoxin; Domain location=12-115; Score=126.9; E_value=5.5e-35; Accession=PF00085.10; Description =Thioredoxin
MEITFDVPKYVQAKKQTYNSFDDLLANSEKPVLVDFYATWCGPCQFMVPILNEVSTRLKDKIQVVKIDTEKYPSIADKYRIEALPTFIMFKDGEPYDRFEGALTADQLIERIEAGLKVKQ

SEQ ID NO: 158107 - protein, 212 aa, Glycine max
  Coding DNA Sequence Number=SeqID_41329
  Gene Ontology: Mol. function=structural constituent of ribosome; Cellular component=ribonucleoprotein complex; Biological process =translation
  Homolog annotation: Hit_ID=P34788; Match level="QueryCoverage=81%, HitCoverage=100%, E-value=9e-66, Identity=74%"; Hit description=40S ribosomal protein S18
  Pfam annotation: Domain name=Ribosomal_S13; Domain location=52-202; Score=246.8; E_value=4.4e-71; Accession=PF00416.12; Description =Ribosomal protein S13S18
MEHRMSHMTGRNISFSLGTVFIYSEPHNFPESCIPTFNMSLVANEDFQHILRVLNTNVDGKQKIMFALTSIKGIGRRFSNICCKKADVDMNKRAGELSAAELDSVMTVVANPRQFKIPDWFLNRKKDYKDGKYSQVVSNALDMKLRDDLERLKKIRSIPYEFDLYGFNTLVFMSSSVWNHRGLRHYWGLRVRGQHTKTTGRRGKTVGVSKKR

SEQ ID NO: 158108 - protein, 36 aa, Glycine max
  Coding DNA Sequence Number=SeqID_41330
MFASAPDCGTKEYPEPTPEVLTAILKYRRTEQNGIR

SEQ ID NO: 158109 - protein, 82 aa, Glycine max
  Coding DNA Sequence Number=SeqID_41331
MELEFLKMFLMWNIVLNFVCLLMLGDSVKDDPKGGGGHWGDLRHGWIGDSDNDDDRSTLRLSYVYLKGKENEQYTTIFGVLM

SEQ ID NO: 158110 - protein, 159 aa, Glycine max
  Coding DNA Sequence Number=SeqID_41332
MYLAPNPRPGALTESNSTEKASIINNIKKWCSPMIRALSISTIGVGSFSFNAKSNHCPVSGRGVEAEDGGDGADGDHFAEEGGEHEEHGGDERNRRPELGRPVPVGGDAENGGEGEEGPQRRLQTRVPRRGKVAEVVDGDIGHGGYAQPGVRRRRRPPH

SEQ ID NO: 158111 - protein, 434 aa, Glycine max
  Coding DNA Sequence Number=SeqID_41333
  Subcellular localization annotation: CTP_CleavageSite=43; ConfidenceScore=5.04e-01
MSYITVDYLRHLSPAWHSRLQPALWSLLALTAVFRVPSYRHWSAEFRSAIPFIASMLFMLAALLCEMISVRSVTAVLGLDWHLNTPPLPDTGQWLLLALNEKLPTPIVEILRARIIGLHHFLMLFMMLAFSVLFDSVKAPGLGLGARYMFTMAVGRLLRAITFASTILPSARPWCAGSRFRVPGYPHRWAQKYYVPYATDHDAISRVIKLDTAYGMHYAEYLFAGFWSCKVTYSSFLVDIGKPVGDYQPDWGSMSFLIDFLRPTVSEGPSWYSLLKKAGGGCNDLLYSGHMLVAVLTAMAWTEAYGGFSSALVWLLVMHSAQREIRERHHYTVDCVVAIYVGILLWKMTGFIWSHEATSSNRRLTKFEKIQSRLIQASKDSDIDEVRELLKEIELSNEESKNQTGIKYSRLFRSATIVFALVIVVLAFTLTSDG

SEQ ID NO: 158112 - protein, 99 aa, Glycine max
  Coding DNA Sequence Number=SeqID_41334
  Homolog annotation: Hit_ID=Q9LKZ6; Match level="QueryCoverage=46%, HitCoverage=4%, E-value=2e-15, Identity=82%"; Hit description =Receptor-like protein kinase 1
  Subcellular localization annotation: CTP_CleavageSite=42; ConfidenceScore=5.29e-01
MAKASCSRNYYSFSSTAMTMLSPVSSPSSPTLDSIQIQTKLVADELVAGEGEVLEVLPGAVLGRDLAGEEVAAEVKVAEEGYDSDGEKNFQIHSLKDRI

SEQ ID NO: 158113 - protein, 68 aa, Glycine max
  Coding DNA Sequence Number=SeqID_41335
NYLRLNLFDDNNASGSSHLSRLDENAAAVATPDDRRNIELTIDLLRHDELPPLPYLTLDFDNGKKPLL

SEQ ID NO: 158114 - protein, 89 aa, Glycine max
  Coding DNA Sequence Number=SeqID_41336
MIPPHSPGSRLCLEDIDDKWMHFSDYLALPGETYVKPYMPRYPMAATTTEEALAHAPSDMEQPRRAVACQSIVERLERLLNLRIVTEGT

SEQ ID NO: 158115 - protein, 247 aa, Glycine max
  Coding DNA Sequence Number=SeqID_41337
  Gene Ontology: Mol. function=transferase activity, transferring hexosyl groups; Cellular component=membrane; Biological process =carbohydrate metabolic process
  Homolog annotation: Hit_ID=Q1T0K1; Match level="QueryCoverage=97%, HitCoverage=61%, E-value=1e-103, Identity=74%"; Hit description =Probable UDP-glucose,sterol glucosyltransferase [imported] -Arabidopsis thaliana-related
MTFYKFADWGPLVDVVGYCFLSLASKYQPREDFVQWIKKGPPPLYFGFGSMPLEDPKGTTDVILEALKDTEQRGIIDRGWGNLGNLAELSDNVFLLEECPHDWLFPQCSAVVHHGGAGTTATGLKAGCPTTIVPFFGDQFFWGDRIYEKELGPAPIPISQLNVENLSNAIRFMLQPEVKSRAMEIAKLIENEDGVAAAVDAFHRHLPDELPLPTPTPTPVEEEDHLNPLQWFFLRLGRFCCAPCGGV

SEQ ID NO: 158116 - protein, 207 aa, Glycine max
  Coding DNA Sequence Number=SeqID_41338
  Subcellular localization annotation: CTP_CleavageSite=52; ConfidenceScore=5.65e-01
MSSSMMSMASGPITSSTFGHHEMMNRAFGPLLPHSMPIMPSSSSFTPLPIPSSSSSSQTCYSSLRPHPLGSYFPTVPFHHFPSSTSSSGFDQYDVAAAGAGPSSDNVTVRVVDPPRRPHSGIWFMLLVSPNQAREPFLSQIPKNYLRIKDGRMTVRLLLKYLVSKLRLESESERDEENEHRGLHRSVRKGNGTTFSSKVPKYIKIET

SEQ ID NO: 158117 - protein, 247 aa, Glycine max
  Coding DNA Sequence Number=SeqID_41339
  Pfam annotation: Domain name=DUF677; Domain location=13-247; Score= -187.2; E_value=0.096; Accession=PF05055.3; Description=Protein of unknown function (DUF677)
MCTDAEERRDAPKSINFHEEYNSALRTKSYVDFFNKVQLLVNHPSIDYNHNNFSEILLEPCQETIASIVDSTTLSKIPELRNFIAQALAIKDGDYLETFELIIFELNSFNYSNNPFSNLKSHDFKIINDKHSSVLHHLKSMRKKVGRKIKLMKYLKKTSEVCVTAACGIVAITAMQRGLILNRDFDTMGRLVVVARLHDKIEHSRAMVQFCLDRKEDKFSLQVVKELKKSDVGFMKHVEELEEHVCL

SEQ ID NO: 158118 - protein, 209 aa, Glycine max
  Coding DNA Sequence Number=SeqID_41340
  Gene Ontology: Mol. function=transferase activity, transferring hexosyl groups; Biological process=carbohydrate metabolic process
  Homolog annotation: Hit_ID=Q1T0K0; Match level="QueryCoverage=91%, HitCoverage=79%, E-value=1e-45, Identity=56%"; Hit description =Glycosyl transferase, family 28
MGSNEIEHLSEDVLDRGFEFDSQQKKDLKQMEIESQGEKFYGASSEEDEDVNKSLPQVASSSRRGLEHCITAPVGTERNPLIVDDDIFLSRSTTGKWEFPRQDTILDRLSEKVKQLITNLVKIQNDGTVEVDIEMSASVAPELLELQSFAKSTMRESLSSESKKSVPRLQIVILVVGTRGDVQPFLAIAKRLQACFDIFIQFILMHIST

SEQ ID NO: 158119 - protein, 132 aa, Glycine max
  Coding DNA Sequence Number=SeqID_41341
MEEVLPYKERISCGRSSSVKNLRKKFFRKKLLRKISYGRTSSQHPIGCGFLLPAFLFDFLHHQKASNGQKYPRTLEPPLPCKFLHHPSTPKSIWFGGWGEGKVVEFEGVIGNDDGVMGLGPKRDSIMLISES

SEQ ID NO: 158120 - protein, 369 aa, Glycine max
  Coding DNA Sequence Number=SeqID_41342
  Homolog annotation: Hit_ID=O80630; Match level="QueryCoverage=95%, HitCoverage=97%, E-value=7e-83, Identity=50%"; Hit description =Putative disease resistance response protein
  Pfam annotation: Domain name=Dirigent; Domain location=176-369; Score= 171.5; E_value=2.2e-48; Accession=PF03018.5; Description=Dirigent -like protein
MANIFLHNWGNTCKAILCLLFLTPTLFIANSARILDEVESQPQAIGILPAPGAVNPSLTTGPVTTTLPPGQTPATTTTSQVGPATTSASGQTPAAASTVNPGGTTEDSGDEDDNEVEPPVPDNAAPVTPNPVAKEASFSFFMHDILGGSRPSARVVAGIVANTDVTGLPFSKLNNNLFPITGGIPLVNPKLNGIITNNNLPNLVGLSGAQSSTVFKNSGTSNTVTGSNNQPFVSAGNLPAGFTIQKLMFGSVTVIDDQLTEGHELDSAVIGKAQGFYLASSLDGTSQTILLTVLVHGGEHEHHDLVDDSINLFGIHRTASSESEVAVIGGTGKYENARGYASLETLLKEDQHTTDGVDTILHFNVYLTE

SEQ ID NO: 158121 - protein, 106 aa, Glycine max
  Coding DNA Sequence Number=SeqID_41343
  Gene Ontology: Mol. function=protein serine/threonine kinase activity; Biological process=protein amino acid phosphorylation
  Homolog annotation: Hit_ID=Q39886; Match level="QueryCoverage=78%, HitCoverage=17%, E-value=2e-13, Identity=52%"; Hit description =Protein kinase
  Subcellular localization annotation: CTP_CleavageSite=50; ConfidenceScore=5.42e-01
MDEDSSNSWIRRAKFSHTVCHSIQPRAQHSSSSQKSRPEVAFASNKAQKKAKMKKQRSLSPLPRTSLFETFKEARCEQKRFSTPFHCILYFESHNLVDLTYSHFVV

SEQ ID NO: 158122 - protein, 193 aa, Glycine max
  Coding DNA Sequence Number=SeqID_41344
  Homolog annotation: Hit_ID=Q5DMV7; Match level="QueryCoverage=73%, HitCoverage=29%, E-value=3e-23, Identity=42%"; Hit description =Pentatricopeptide (PPR) repeat protein-like
  Subcellular localization annotation: CTP_CleavageSite=55; ConfidenceScore=5.48e-01
MSTPKRFPGKACISFTCTLSRLLSPSTSYLHLSPLTSQLYTGISQAPWFTWNSTTAAELTALLHSLGRHSQSESLIFDASSKLQPCQCDLVLFYGKLIDSHSKRNSHTAFDAAFGYLHNLVRTSSSLHVKRMAYQYMVSGLCLMDRPYEAEDLVLGLQPLGFIVRVWGIRVRLLVGIRIRVASEIGEGGCGVC

SEQ ID NO: 158123 - protein, 51 aa, Glycine max
  Coding DNA Sequence Number=SeqID_41345
MVHVAIPEKELPNAQMWLHYLIYTNATMPGTEVNHICHYPIIKDVWKSLMT

SEQ ID NO: 158124 - protein, 171 aa, Glycine max
  Coding DNA Sequence Number=SeqID_41346
MSHDRSRFTSLEAWERYTDIVVPRKILLERNVVIYHTKFDDFKEELKRRNWHEELTSFEEGSIDVAIVREFYANLYDPEDKSPKQVKVRGHLVKFDEDALNTFLKTPVIIEEGETLSAYSRFALLRPDPQELAAKLYIPGKGFELNVDGLPLKILIKNLTTIAKTWSVLSF

SEQ ID NO: 158125 - protein, 139 aa, Glycine max
  Coding DNA Sequence Number=SeqID_41347
  Subcellular localization annotation: CTP_CleavageSite=70; ConfidenceScore=5.11e-01
TGSGVYRDLSSFIGSGVYPDLSSVTGSGVYPDVSSFTGSGVIQISVTCIKRSAPTQTYQGNPCGVYPDLSSFTGSGVYPDLSSFIGSGVYPDLSSFTGSGVYPDLSSFTGSGVIQISVTCIKRFAPTQVHIIWYQSFSS

SEQ ID NO: 158126 - protein, 867 aa, Glycine max
  Coding DNA Sequence Number=SeqID_41348
  Gene Ontology: Mol. function=histone-lysine N-methyltransferase activity; Cellular component=nucleus; Biological process =intracellular signaling cascade
  Homolog annotation: Hit_ID=Q9C5X4; Match level="QueryCoverage=95%, HitCoverage=76%, E-value=0.0, Identity=49%"; Hit description=Histone- lysine N-methyltransferase, H3 lysine-4 specific ATX1
  Pfam annotation: Domain name=C1_1; Domain location=613-659; Score= -2.7; E_value=0.055; Accession=PF00130.12; Description=Phorbol estersdiacylglycerol binding
  Pfam annotation: Domain name=C1_3; Domain location=621-652; Score =7.9; E_value=0.06; Accession=PF07649.3; Description=C1-like domain
  Pfam annotation: Domain name=FYRC; Domain location=510-601; Score =65.6; E_value=1.6e-16; Accession=PF05965.4; Description=FY rich C -terminus
  Pfam annotation: Domain name=FYRN; Domain location=453-505; Score =49.9; E_value=8.4e-12; Accession=PF05964.4; Description=FY-rich N -terminus
  Pfam annotation: Domain name=PHD; Domain location=622-671; Score =35.3; E_value=2.1e-07; Accession=PF00628.19; Description=PHD-finger
  Pfam annotation: Domain name=PHD; Domain location=745-782; Score=5.1; E_value=0.017; Accession=PF00628.19; Description=PHD-finger
  Pfam annotation: Domain name=PWWP; Domain location=304-383; Score =38.1; E_value=2.9e-08; Accession=PF00855.8; Description=PWWP domain
  Pfam module annotation: Pfam domain module=C1_1::C1_3::FYRC::FYRN::PHD ::PHD::PWWP; Domain location=613-659::621-652::510-601::453-505::622 -671::745-782::304-383
MAAAFQEGSGGGRGGDEDATIDVHTTRGTPIRYLPLDHLYSATSPCRVTASGSSNVMSKKIKARKLTLTHNNNNNNNNHYNNHEHKKTTSSSSSSLALPPKPPLLFVYSRRRKRHSPAAATTENDESEKRLLKKRKIGSTELERLGVDLNTAIGDVDGPRLRECRNQFGNSGAAGNAKYGSLENLPKVLPESRNVKKWVGLSFDNADPEAFVGLRCKVYWPMDLKAYIGYVRSYDKETKIHHVKYDDGDEENLIIANENIRFHVSRDELKHLKLNFAKVRDNNVSDYNVEEMLALAASLDDCQDFEPGDIIWAKLTGHAMWPAVVLDESLASNCKGLKMFLGGSSVPVQFFGTHDFARVRLQQVKSFLSGLLTDLHSKCKKHSFIEGLEEAKRYLSEQKLPLEMLELQKRCTADGCNNVSGEDGGCSDSGDDCLNGKGTLMALETVENFPYEVGDLQILSLGKIVKDSAFRDGRFIWPEGYTAVRKFTSVTDPKVSAPYKMEVLRDPESKLRPLFRVTVEGGEQFNGYTPSASWNEVYEKIKKMEKDASEGTVAEGGEEKGYESGSDMFGFSNPKVLKLIQGLSKSKISSKNSICKLGSRRCNNNLPLGYRQVHINWFDLDKCNVCHMDEEYENNLFLQCDKCRMMVHARCYGELEPVNGVLWLCNLCRSGAPPPPCCLCPLIELYVFGYLMEFLLGGAMKPTTDGRWAHLACAMWIPETCLADVKRMEPIDGMSRISKDRWRLLCSICGVSYGACIQCSNNSCRVAYHPLCARAAGLCVELENEDRLYLLSVDDDEDQCIRLLSFCKKHRQPSNEHSVADDRIVRVSGLCSDYEPPPNPSGCARSVFLVPSGKGNSSVLGAGWQSS

SEQ ID NO: 158127 - protein, 91 aa, Glycine max
  Coding DNA Sequence Number=SeqID_41349
MGFLGLRSEIEDEVDLKQTLTSHKNLARLPIISPKTPYPRKSKEKEVHPNLKFRSPTRRDALHDSENALLSRFGAEIMAKGWSFVWSFNGE

SEQ ID NO: 158128 - protein, 171 aa, Glycine max
  Coding DNA Sequence Number=SeqID_41350
  Gene Ontology: Mol. function=nucleic acid binding
MEDVVPMDRLKDNGVLEEVPKERLSTMDKKPGTYDSIIDLHEGFYQVAFSNKKDYNFALFEGPWMVADHYLIVQRWRPFFLMNAKITNKVAMWIKIQHLPIELYNNIFLDRIGMSLKKFLKVNRLTSIHSRGKFVRICMEQDLKKPLETHIYVCGFKLNLEYEGLHSICFC

SEQ ID NO: 158129 - protein, 121 aa, Glycine max
  Coding DNA Sequence Number=SeqID_41351
MGEGITMTHVPRSLLASVTLETIFLCPMENMVVWFCSLRKKPDVHIKAAIDRCNEDNNHFFRRGFECGYYVMHWMWCIVTGGLKDEWNKWFCDGSELDMKAMTDLRKKWATYFLSIRKSAC

SEQ ID NO: 158130 - protein, 444 aa, Glycine max
  Coding DNA Sequence Number=SeqID_41352
  Gene Ontology: Mol. function=small GTPase regulator activity
  Homolog annotation: Hit_ID=Q1S4E1; Match level="QueryCoverage=59%, HitCoverage=30%, E-value=3e-86, Identity=59%"; Hit description =Citron-like; WD40-like
MEKKNKDFLNRLECEQSSSLRVNGICLENVGRRHNCNEFNFLQFSIKLADKQAALEKIQWEAMTSNKKVDKLQDEVGSMQVDITSFTLLLEGLSKTDTAKYTDDYDVKPYDFSHLPSIPLCGTNPIIVLKFSMLVLESCPSQTIDLFLSGNIPTDMVSSYLKKHSPNMQARYLELMLAMNENAVFRNLHNEMSIARYNPEALLKHLPLDALYEECAILLGKMNQHDLALSLYVHKLNALELALSYCDRVYECMHQPSSKNSNNIYLVLLQIYLNPRRTIAGFENIIKNLLSPQNKTIPKLTPTPSIKSRGQGLKKIVAIEGAKDTKVSLSSTDNGRSHGDADEYNEGGSTIMLDEVVDLLSHRWDRINGAQALKLLPKETKLQGAFVELRLLWRLKNLSLLSGFIVHHHDSVPSSTCTVGCNMAEPMSHTFAYSDTSVLLESTL

SEQ ID NO: 158131 - protein, 66 aa, Glycine max
  Coding DNA Sequence Number=SeqID_41353
MCSSLRRHVGQGGCVVADMWAQICRHVSKSFLVGEPQGHSVVGCVEKEEKERDTELRSHHKGHHSK

SEQ ID NO: 158132 - protein, 79 aa, Glycine max
  Coding DNA Sequence Number=SeqID_41354
MDKFLHLSSRLKIVVVATFNTCIKCTYSFMLKNHSYHRRNYSIVQDHHVSCGLDQLKCDMWTTWLYILIAYILHGGITT

SEQ ID NO: 158133 - protein, 202 aa, Glycine max
  Coding DNA Sequence Number=SeqID_41355
MKKHVNRVEDDSHTELGKQMQALTLKIETLMRAQAQVPITTPSFPTHDRCGIVHRPREYNVDDKLVAGMDEINFVGRENNSYNQYPKNFNQGQCFRQSQGMKIEIPTDGNLVPNKEGEKEYEMNTVAMRDNVQWQRPTSTTSTEMKKRQCDGVVAESDRVAMMWWRIGIECGPREKEIKRMKKDSLIQEALENFNLKGQHRF

SEQ ID NO: 158134 - protein, 127 aa, Glycine max
  Coding DNA Sequence Number=SeqID_41356
  Gene Ontology: Mol. function=protein phosphatase type 2C activity; Cellular component=nucleus
  Homolog annotation: Hit_ID=Q1SK22; Match level="QueryCoverage=27%, HitCoverage=8%, E-value=4e-10, Identity=82%"; Hit description =Protein phosphatase 2C-like
MTQAVEVLNRYGTDLVGEPRDSDSECLAGFECFLNIVRALGMGSCISEVGAGGNSPPLLPYSPESNMDGGKRRRLRGSSSFDFKVPGRMFLNGSSEVASMYCKQGRKGINQDAMLVWEVSPFSLSIH

SEQ ID NO: 158135 - protein, 987 aa, Glycine max
  Coding DNA Sequence Number=SeqID_41357
  Gene Ontology: Mol. function=nucleic acid binding; Cellular component= intracellular; Biological process=DNA integration
  Homolog annotation: Hit_ID=Q1T010; Match level="QueryCoverage=95%, HitCoverage=81%, E-value=0.0, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=422-574; Score =73.9; E_value=5e-19; Accession=PF00665.16; Description=Integrase core domain
  Pfam module annotation: Pfam domain module=RVT_2::rve; Domain location=727-953::422-574
MAMLKNNDQIPAKLPIFDGTNYERWTAQMKVVFRYQGVLDIISTGITPLETNPIKAYRATHREQMKKDDKVIFLIHQCVDSNVLEKIIDYETTKETWDVLSTTYVGDKQTKKVRLMALRRQLGLLQMVSNETVAKFVNRLVILANQMKSCGEVVTDSMKVEKVLTGLTPNFDHIVSAIEQSKDLEMLKLDQLLGSLEAHKLKMKNREGIKKEEKDFEKALFAKNQKKGGGDSWKNKKGKGKWKYNKQESSGSKNECSNPKVSRKRGEEAQLARGSDDEEAVMLMAIVNSETGIEEEWWYLDTGCSNHMTGHKDWFCEIDETLKRNIKFGDDSDVLYVPNMESNLLSLGQLLEKGFSMHMEGEHMEVADSNGKCVLKVPVSKNRTFKVGVSTIEQKCLTAQSNDSVWKWHRRLGHLNFNCLNELQKKNMVVGLPLIEVPRQVCGRCCEGKQPRKAYNVAVPTRAKEKLAVIHSDQSGCSIKMLRTDGGGEYTSLEFENFYKEEGIIHEVMAPYTPQHNGTAERRNRIVQNMVRCMLRKKHLPYDFWAKAVSTASHILNRCPTKRLDSLTPEEAWSGLKPSVKHFKVFGLLCYRHVPEQNRRKLDSMAQTLILVGYHSIAYKLFDPLSKKIVISFDVIVDETKEWDWNIGMERQTNETVEVELEGEEIQDEVQIDSEQYVNDGPDVIRVVPLRRSLRQITPPVMNLVLLAEAEPISLEEALARPHWRKAMEEELRSIQKNNTWEMVSLPSNKKAIEVKWVFKTKVKPFGEIAKYKARLVAKGFLQKPGLDFNESAFLNGPLEEEVYTRQPPGYEKIGMEDRVMKLNKALYGLKQAPRAWNKRIDGFLQMQKFLECTTEHEVYLKDYGVTGVVMLCLYVDDLLVTGDSKQEIDRFKKKMMDEFEMSDIGRIAYFLGMEFVTTKSAIFLHQKKYATDILKRFNILDCNSASTPCEPGVKLSTAKENSKIEIVGYTDANWSGDVGDRKEHIW

SEQ ID NO: 158136 - protein, 48 aa, Glycine max
  Coding DNA Sequence Number=SeqID_41358
MYSFRGGGKGNGQGGSGANGTITGKAYPKGLYGTLSDPTIQLEQDCIH

SEQ ID NO: 158137 - protein, 237 aa, Glycine max
  Coding DNA Sequence Number=SeqID_41359
MVTISTSKLINVINEDSDQNSDNTTEIGSVSEKNINPINSKHWKTPSKLYYQRPTAPDLLLEERGENNFKSFSANNIYEWNIDAQTEYNIMNTLQHMTMVATAYQTSHECSEETIIDILVAGFSGQLKGWWDNYLTNEEKLKKKLRNLNLEPAIEEQINNLLIETSEEETETSSSVPSDENLNLIQQDDQLSSTDDDDGQINTLTREQDLLFEAINSITDPQEKKVFLEKLKKSGIL

SEQ ID NO: 158138 - protein, 270 aa, Glycine max
  Coding DNA Sequence Number=SeqID_41360
  Homolog annotation: Hit_ID=Q5XM22; Match level="QueryCoverage=26%, HitCoverage=40%, E-value=8e-18, Identity=60%"; Hit description =Resistance-like protein HAAS-2
  Pfam annotation: Domain name=DUF1723; Domain location=125-174; Score =42.4; E_value=1.6e-09; Accession=PF08330.1; Description=Protein of unknown function (DUF1723)
DADEGPQRRRPTTSARRQWEVTPIAEDVKHVDHATKEVHEQPQEAPAADVVSDVEGFPDRPHNTSVLMDYVHHVTVIVWNEEERFELKLFSHGRKVEKFGRSAPKIESLVVVTGLSPLIACSLDNGDRGLVSTFAERWHKETSSFHLLVGGVSITLDDMASLLHLTITGTFNSFEVLHVNDVVFLLVELLEVSSEEARAETIQCHGAYVRLSWLRDIYRSKCDVAKWTMAAPTYLLHLLGCTLFANKSATHVHVVFLDAFRDLMQSGSYA

SEQ ID NO: 158139 - protein, 257 aa, Glycine max
  Coding DNA Sequence Number=SeqID_41361
  Subcellular localization annotation: CTP_CleavageSite=37; ConfidenceScore=5.26e-01
MAIPSKTSSPRVRYSVFTYRFILLAQSDALVGRRTMFCMHRSPTNNLVPMDLEIEATLRRNRAERRRKLLQGWRQELNPYNQYEEERTPDLESVFSEFMAYHASSKANYNSLQNQEIHFGKSYSLEDYQGELELQLYYQNEAGRSSNLDTLLMQFKDTIGSIERAFKSVEAQEGSPVNEHDLEEEEEEKVQQREQCSQVHTQQENNLQVNTFPRQLIVKEERHEDHEVPIILGQPCLSIASCVLGMGKGKLELSVED

SEQ ID NO: 158140 - protein, 51 aa, Glycine max
  Coding DNA Sequence Number=SeqID_41362
MTVVAQCSRQAAADTVVDSGWYSGRNSRQGFSRRNGGIEKWTVSRDRDFDV

SEQ ID NO: 158141 - protein, 84 aa, Glycine max
  Coding DNA Sequence Number=SeqID_41363
MAIATICSILLFWNFLSLFRSDEEDTASVPCNLKGHQQPNISNGVAASYSQLSPRSLIDYEDDKDYKPPPRKQPETSEEDDGVS

SEQ ID NO: 158142 - protein, 94 aa, Glycine max
  Coding DNA Sequence Number=SeqID_41364
  Subcellular localization annotation: CTP_CleavageSite=70; ConfidenceScore=5.56e-01
MKMSDNDEDKLLQSVSKMSMLPFPKPQVGSSSSCSRFHSFSLFLSISNHNYDLFSRNKEPLTLEKKMRVSLSSRKEAKWDPKSFQNGEALPNGN

SEQ ID NO: 158143 - protein, 124 aa, Glycine max
  Coding DNA Sequence Number=SeqID_41365
  Gene Ontology: Mol. function=transferase activity, transferring glycosyl groups; Cellular component=membrane
  Homolog annotation: Hit_ID=Q7XJ98; Match level="QueryCoverage=69%, HitCoverage=13%, E-value=3e-19, Identity=51%"; Hit description =Xyloglucan galactosyltransferase KATAMARI1
MDKPPSRKYFDKIRFNEDLLKGCHSLMKWDDMCHYMSNLGLGHKVIEKSKEKVLLKESWYATNQFSLEVIFHNTMKHYKCLTNDSSLASAIYGPYYAGLDTLEIVDSGMPRRLRYEFFQSSNQS

SEQ ID NO: 158144 - protein, 166 aa, Glycine max
  Coding DNA Sequence Number=SeqID_41366
  Gene Ontology: Mol. function=DNA photolyase activity; Biological process=DNA repair
  Homolog annotation: Hit_ID=Q1RUS6; Match level="QueryCoverage=54%, HitCoverage=19%, E-value=3e-18, Identity=52%"; Hit description =Deoxyribodipyrimidine photolyase, class 1
MKSAMMLDGILVLLEFNMLSSATRSFLPNPIPLNTALAQLGVIKPIFRLPHVPLPVEKRMEQIGREHFVGEKDVQEDSAIGAGLVEAGCRLAVVGGVEAIDGEDREGVVVSGSETLIVEETEVVAEPNEIAGLVDLKEVLEGGGVVVERERCVRDEAWVGALSLLG

SEQ ID NO: 158145 - protein, 75 aa, Glycine max
  Coding DNA Sequence Number=SeqID_41367
MSAFEQVYTQVLNKVIEDAQRKANTHTVLEFDRRDTGFLVLETIKLREHAHHEYKKLHTFFAYRALFGRLHNEAY

SEQ ID NO: 158146 - protein, 416 aa, Glycine max
  Coding DNA Sequence Number=SeqID_41368
  Gene Ontology: Mol. function=microtubule motor activity; Cellular component=microtubule associated complex; Biological process =microtubule-based movement
  Homolog annotation: Hit_ID=Q5VQ09; Match level="QueryCoverage=87%, HitCoverage=94%, E-value=4e-51, Identity=58%"; Hit description =Putative kinesin
  Pfam annotation: Domain name=Kinesin; Domain location=64-309; Score= -41.2; E_value=1.3e-11; Accession=PF00225.13; Description=Kinesin motor domain
  Subcellular localization annotation: CTP_CleavageSite=46; ConfidenceScore=5.58e-01
MAYRNGVALAQRGSAVKFERPNHLRTTASPKPRLPHSPGSAVRRSPAAARSGDGVPGRVRVAVRLRPRNTEEMVADADFADWVELQPELKRLKLRRNNWDSDTYEFDEVLTEFASQKRVYEVVAKPVIEVCSNDNIPIVEDPKTGDVSLSGATLVEIKDQPSFLELLRVGETHRIAANTKLNTESSRSHAILMVHVKRSVVDSEDVVYTENNDVSHLTKPSKPLVQKSKLVVVDLAGSERIHKAMKVENMLKIKEEFDYKSLSWRHENKFGGEVERKFADALEGGIKALLGVVRCDQPDVLSQVARGIANFAKCESRASSQGIKSGTSFLIEDGALPWIVQNANNEAAAIRRHIELALFHMAQQEVNAKDMISGGALWELVRISRDCMREDIRNLGRRTLTSIPPFKSEFRRLHID

SEQ ID NO: 158147 - protein, 53 aa, Glycine max
  Coding DNA Sequence Number=SeqID_41369
MDKVVVDCTVEKVVQVVARRVVALIGLDLSKPSFRLKTTHFNLMRVKNIPKIL

SEQ ID NO: 158148 - protein, 304 aa, Glycine max
  Coding DNA Sequence Number=SeqID_41370
  Homolog annotation: Hit_ID=Q0GPH8; Match level="QueryCoverage=95%, HitCoverage=90%, E-value=4e-70, Identity=80%"; Hit description=BZIP transcription factor bZIP56
  Pfam annotation: Domain name=DUF1664; Domain location=70-193; Score =202.3; E_value=1.1e-57; Accession=PF07889.3; Description=Protein of unknown function (DUF1664)
MEIDENGIHIGLLLRGLFWVVLRQLKSDDPAPTVKKQPHNDALLAQVNSLRQELQLLARDRSITIVNASGTGGRKYITVIVIVVVGYGYVWWKGWKLPDLMFATRRGLSDACTSIGNQMGKLYESIGDTKKKLSARINGLDKNLEECAAITESTREDISVIQRKADTISEDSKSFHVAVHVLESKIKEIEEKQASSSSSSRPALEPPPVSPSSSSRGSQSGSARLSLEPPSLTPSSRTASLPPTLPTDPPSPSNSGGSFQGPKVDKSNGSSSGLFGLISGVYGPLLTRTRSATDAVVQKTRSAS

SEQ ID NO: 158149 - protein, 160 aa, Glycine max
  Coding DNA Sequence Number=SeqID_41371
  Gene Ontology: Mol. function=oxidoreductase activity; Cellular component=intracellular; Biological process=auxin mediated signaling pathway
  Homolog annotation: Hit_ID=P49249; Match level="QueryCoverage=86%, HitCoverage=45%, E-value=2e-62, Identity=79%"; Hit description=IN2-2 protein
MARVGRMKLGSQGMEVSLQGLGCMGMSAFYGPPKPDPDMIALIHHAVQTGVTFLDTSDVYGPHTNELLLGKALKGGVRDEVELATKFGINVAEGKREIRGDPAYVRAACEGSLKRLGIDCIDLYYQHRIDTRVPIEITVPLLIYAFVLISVVFFYVVGTV

SEQ ID NO: 158150 - protein, 623 aa, Glycine max
  Coding DNA Sequence Number=SeqID_41372
  Gene Ontology: Mol. function=DNA binding; Biological process=DNA repair
  Homolog annotation: Hit_ID=Q4S1C9; Match level="QueryCoverage=48%, HitCoverage=35%, E-value=2e-18, Identity=25%"; Hit description =Chromosome 13 SCAF14769, whole genome shotgun sequence
  Pfam annotation: Domain name=HIRAN; Domain location=142-243; Score =48.5; E_value=2.2e-11; Accession=PF08797.1; Description=HIRAN domain
MTRYKSDLCKPYLGQLTDTSSSFFRLLNNHCNDVQCPVCGRNLPGDNHHINSHLDACLSQSTPATKRKFSQRTLLQLNFTLSNSKPKFHNLTHDSNTSPVPPPQHNESEEEEQVPEAHETDLDSTISTTSSSSLPSNNGVPGITLETFIVGRKYTDNPEEICAGTAISLLRDPQNVKDLNAIKVVSVDAVCYKSLGFIPHELAQCLSPLIDNYGLGFQGHVTSVPKHSLDIVPIQITCHRTSDGESKYADETFKCLWKNAQCVVEFASRSPPSSVKYFKQCLIYGFDWTESFTLLSNDCQRLFIQLHTRKENEYIHSIEDANQPCESNVNDILNVLSVSELHEIWCILLKKSGGHQMKKQHLISSILFTGASVLWPQLSTMILDRTVFCIRISSKAESLMWRIERLFFLNGEQDLSSFLLVDMGKIVYPAYNCIISEPIFSNRNNLLSYEEAIEVAQIMDEALDANKTDVVLRCIKIAESCVSTDFPIQCSTSESVSSIRRVFTASWVYSKVVTVGISFLERERRYIDAINLLKWLLNVFTCDVKRGYWTLRLSVDLEYLGCTNESLQIAENGLLDPWIRAGSRMALQRRVLHLGKQPRHWNVPSFSRSALRKIPEANYFIVL

SEQ ID NO: 158151 - protein, 202 aa, Glycine max
  Coding DNA Sequence Number=SeqID_41373
  Gene Ontology: Mol. function=DNA binding; Cellular component=nucleus; Biological process=DNA repair
  Homolog annotation: Hit_ID=Q2USW4; Match level="QueryCoverage=84%, HitCoverage=23%, E-value=1e-24, Identity=37%"; Hit description =Uncharacterized conserved protein
  Pfam annotation: Domain name=VRR_NUC; Domain location=91-202; Score =101.2; E_value=3.1e-27; Accession=PF08774.1; Description=VRR-NUC domain
MAISLWLVMIPVFVQGRPLNSELGEKNRYYNEEGKQCGVEELALHYYARDGGGWLGVHAESGIWLTIFGLLMWDVIYADVPNVFYTRFQQICDGMAEEFLIKSWETHIGTACRGVNWDCHPLDELHAIVTCVGGICLASLCKLLAQDYRSWSSGMPDLLLWRFHGEYSGEAKLVEVKGPKDRLSEQQRAWLLLLMDSGFTIE

SEQ ID NO: 158152 - protein, 183 aa, Glycine max
  Coding DNA Sequence Number=SeqID_41374
  Pfam annotation: Domain name=F-box; Domain location=3-50; Score=34.2; E_value=4.5e-07; Accession=PF00646.23; Description=F-box domain
MKKVDRFLNSDILIEILSHVPAKDLLSLKLVSKEWHRLISSRCFMEAQVQRTKEEALTGFIFQEKFMWCNEDIKTISYISVEENTKGGGGSKVKQKVFDFLPEDVVMMASCKGLVCSRSCFPSEEPFIYVCNPSNKEWVKLEWPWPITHYDCLRSMTIALAFDYDPSKGFVEKFKLVRVKLVE

SEQ ID NO: 158153 - protein, 164 aa, Glycine max
  Coding DNA Sequence Number=SeqID_41375
MHWLNGDRVLTFNVQNELSWLVPAPVPASEFMAVPEACIGESEGRLSYVFVSEQGVHVWCLEDYYDYKWAIVYCKPLEEIEGEWPQFFMNLRSHVLERVNGPWVNPLAFKDGILLMKVCVSLYLFDVKNNSMTEVCSIQDLKSQCMLNPTVIAHSLSLVHLSPA

SEQ ID NO: 158154 - protein, 820 aa, Glycine max
  Coding DNA Sequence Number=SeqID_41376
  Gene Ontology: Mol. function=binding; Cellular component =intracellular; Biological process=metabolic process
  Homolog annotation: Hit_ID=Q8GSH3; Match level="QueryCoverage=89%, HitCoverage=97%, E-value=1e-167, Identity=43%"; Hit description =Selenium-binding protein-like protein
  Pfam annotation: Domain name=PPR; Domain location=165-199; Score=8.7; E_value=0.69; Accession=PF01535.11; Description=PPR repeat
  Pfam annotation: Domain name=PPR; Domain location=263-297; Score =19.2; E_value=0.015; Accession=PF01535.11; Description=PPR repeat
  Pfam annotation: Domain name=PPR; Domain location=366-400; Score=8.5; E_value=0.73; Accession=PF01535.11; Description=PPR repeat
  Pfam annotation: Domain name=PPR; Domain location=493-526; Score =23.2; E_value=0.0009; Accession=PF01535.11; Description=PPR repeat
  Pfam annotation: Domain name=PPR; Domain location=595-629; Score =47.4; E_value=4.7e-11; Accession=PF01535.11; Description=PPR repeat
  Pfam annotation: Domain name=PPR; Domain location=630-664; Score =20.0; E_value=0.0088; Accession=PF01535.11; Description=PPR repeat
  Pfam annotation: Domain name=PPR; Domain location=666-699; Score =11.4; E_value=0.33; Accession=PF01535.11; Description=PPR repeat
  Pfam annotation: Domain name=PPR; Domain location=732-766; Score =12.2; E_value=0.27; Accession=PF01535.11; Description=PPR repeat
  Pfam module annotation: Pfam domain module=PPR::PPR::PPR::PPR::PPR::PP R::PPR::PPR; Domain location=165-199::263-297::366-400::493-526::595 -629::630-664::666-699::732-766
  Subcellular localization annotation: CTP_CleavageSite=40; ConfidenceScore=5.52e-01
MVSCITHSILFTLTHFATSNAKSSATRSPNPPRPNSFGHSGDHYDSLFSSIVMLCPLKTRHRVPLQLSFRLCSKFFHALKHDHHQFDFIPHPNAASVNHSMLNCLHSRLPFQALTAFKNHFQLHSLENVDEVTVALSLKACQGESKLGCQIHGFAVCSGFVSFVTVSNSLMKMYCKSGNFGKALIVFENLSHPDIVSWNTVLSGFEESVDALNFARSMHYCGIAFDPVTYTSALAFCWGDHGFLFGWQLHSLVVKCGLGCEVFIGNALVTMYSRWGMLDEARRVFDEMPERDLVSWNAMISGYAQEGKCYGLEAVLLFVNMVRHGMLIDHVSLTGAVSACGHMKNLELGRQIHGLTQKVGYGTHVSVCNVLMSTYSKCEVPKDAKAVFESISNRNVVSWTTMISIDEEDAVSLFNAMRVNGVYPNDVTFIGLIHAVTIRNLVTEGLTIHGLCIKSCFLSEQTVSNSFITMYAKFECIQESTKIFEELNCRETVSWNALISGYAQNGSYKEALLTYLSAVKEIKPNQYTFGSVLNAIAAAEDISLNHGKSCHSHLLKLGLGTDPIVSGALLDMYGKRGDIIESQRVFNETLERTQFAWTAIISAYARHGDFESVMSLYTEMEREGINPDSITFLSVLAACCRKGMVDAGHRVFDSMVKKHSIEPTSEHYSIMVDMLGRVGRLDEAEELMHQIPGGPGLSVLQSLLGSCRLHGNMEMAEKVVGRLIEMDPASSGPYVLMANLYAEKGKWEKVAEVRRGMRGRGVKKEVGFSWVDVSNVDSLYLHGFSSGDKSHPESENICKIAEFLGLQMKILKENREREGE

SEQ ID NO: 158155 - protein, 47 aa, Glycine max
  Coding DNA Sequence Number=SeqID_41377
MPLSLSEYTREPVRDEFIAIEVKCIRFMRCDSMLNWDYTIVIETECM

SEQ ID NO: 158156 - protein, 611 aa, Glycine max
  Coding DNA Sequence Number=SeqID_41378
  Gene Ontology: Mol. function=catalytic activity; Cellular component =intracellular; Biological process=metabolic process
  Homolog annotation: Hit_ID=Q8GSH3; Match level="QueryCoverage=91%, HitCoverage=97%, E-value=5e-85, Identity=33%"; Hit description =Selenium-binding protein-like protein
  Pfam annotation: Domain name=PPR; Domain location=196-230; Score =14.4; E_value=0.15; Accession=PF01535.11; Description=PPR repeat
  Pfam annotation: Domain name=PPR; Domain location=299-333; Score=7.4; E_value=1; Accession=PF01535.11; Description=PPR repeat
  Pfam annotation: Domain name=PPR; Domain location=382-416; Score =18.9; E_value=0.018; Accession=PF01535.11; Description=PPR repeat
  Pfam annotation: Domain name=PPR; Domain location=417-451; Score =18.0; E_value=0.034; Accession=PF01535.11; Description=PPR repeat
  Pfam annotation: Domain name=PPR; Domain location=453-486; Score =11.4; E_value=0.33; Accession=PF01535.11; Description=PPR repeat
  Pfam annotation: Domain name=PPR; Domain location=519-553; Score =12.2; E_value=0.27; Accession=PF01535.11; Description=PPR repeat
  Pfam module annotation: Pfam domain module=PPR::PPR::PPR::PPR::PPR::PP R; Domain location=196-230::299-333::382-416::417-451::453-486::519 -553
GDHYDSLFSSIVMLCPLKTLHRVPLQLSFRLGSKFFHALKHDHHLFDIIPHPNAASVNHSMLNCLHSRLPFQALTAFKNHFQLHSLENVDEVTVALSLKACQGESKLGCQIHGFAALIVFENLSHPDIVSWNTVLSGFEESVDALNFARSMHFRGIAFDLVTYTSALAFCWGDHGFLFGWQLHSLVVKCGFGCEVFIGNALVTMYSRRGMLDEVRRVFAEMPERDLVSWNAMILGYAQEGKCYGLEAVLLFVNMVRHGMLIDHVSLTGAVSACGHMNNLELGRQIHGLTQKVGYGTHVSVCNVLMSTYSKCEVPKDAKAVFECISNRNVVSWTTMISIQEEDAVSLFNAMRINGALLDMCGKRGDIIESQRVFNETPERTQFARTAIISPYARHGVFESVMSLYTEMEREGINPASITFLSVLAACCRKGMIDVGHRVFDSMVKKHSIEPTSEHYSIMVDMLGRVGRLDEAEELMHQIPGGPGLSVLQSLLGSCRLHGNMEMAEKVVGRLIEMDPASSGPYVLMANLYAEKGKWEKVAEVRRGMRGRGVKKEVGFSWVDVSNVDSLYLHGFSSGDKSHPESENICKIAEFLGLQMKILKENRETEGEWYHE

SEQ ID NO: 158157 - protein, 108 aa, Glycine max
  Coding DNA Sequence Number=SeqID_41379
  Subcellular localization annotation: CTP_CleavageSite=58; ConfidenceScore=5.56e-01
MLFFFPFSSLPSLLTFLLPFIFFFFPATPPPLHLLPSPPFLLHPAQPSAATVCVPQPRLFAVTSKYVRDLQGVVLFWGVGKGLIKGVCGGVYSPRELSRKKARVGGDY

SEQ ID NO: 158158 - protein, 300 aa, Glycine max
  Coding DNA Sequence Number=SeqID_41380
  Homolog annotation: Hit_ID=Q1T493; Match level="QueryCoverage=99%, HitCoverage=53%, E-value=4e-29, Identity=29%"; Hit description =Nucleic acid-binding, OB-fold, subgroup
MARSPNKIKNIDGSKETLKLAVRITDLWFIGTPNKSEQAEMIYYILFRPLCCNFNGIQGDEIHVVCKQDQLKSWKMDLKENCTYVMHNFKVLKNNGQYRVCDHQFKLVFIGVTVVRKCVLDDLPFRKYRFAGFANVVASQFEPGLLVDVIGVVEEVVFGHVSGKGRRVVFKLKDLSQQLLSCTLWDDYCLQFLKFLDDYEGDGPITVLLTHGRIKEAQGSYPPSVSNFFKVSKLIINQPVMEIQEFNEWLAELGIEARSGFKSHGEGSTQLSGSIQLSSKEPFFGKTEAKTIDDINTISE

SEQ ID NO: 158159 - protein, 143 aa, Glycine max
  Coding DNA Sequence Number=SeqID_41381
  Subcellular localization annotation: CTP_CleavageSite=52; ConfidenceScore=5.66e-01
MSLPSVVHVSSTFESGAPRMSLPSAVHVSSTFDTVHVSSTFESGAPRMSLHSAVHVSSTFEFGAMLHDCLSVDPLSGAPRMSLPSAVPQFTILHIFSDPHECHCLALIMHPPPKEFGAMLHDCLSVDPLVQSSILLFFPSPKN

SEQ ID NO: 158160 - protein, 68 aa, Glycine max
  Coding DNA Sequence Number=SeqID_41382
  Subcellular localization annotation: CTP_CleavageSite=49; ConfidenceScore=5.03e-01
MTLLFSNILPSDHNANLPLQMYRLGSRPQDAQWVRRSLTGPWGFQLWLRASVSPTGCLFPERGHAIVT

SEQ ID NO: 158161 - protein, 71 aa, Glycine max
  Coding DNA Sequence Number=SeqID_41383
MKGSELRVEGPRRTGAASGEGRAEVDGADVGGVGAAEEDGALDLLSLDFWVPGKVTEGLAQGSDEGWKSKP

SEQ ID NO: 158162 - protein, 83 aa, Glycine max
  Coding DNA Sequence Number=SeqID_41384
MSIGCLKSLKAEVENQCGKQIKIVRSDRGGDTMAGILDKQAPGPLQSSFKTWIVAQYTMPGSPIRMVWQKKEPNIIRHGTEYA

SEQ ID NO: 158163 - protein, 131 aa, Glycine max
  Coding DNA Sequence Number=SeqID_41385
MEMNSDPSVIMSEAEYEEDTFYADIRRQILLLTSEDNEDLLETRSFSPINVTNGGSNGSVYSFNCASPPASNFCLWERHSSGSPPLWLVNLWKNGKGTGVFIPQVACKKNQRPGRINNSRKKIYKPVVNKD

SEQ ID NO: 158164 - protein, 472 aa, Glycine max
  Coding DNA Sequence Number=SeqID_41386
  Gene Ontology: Mol. function=protein dimerization activity; Cellular component=nucleus; Biological process=regulation of transcription, DNA-dependent
  Homolog annotation: Hit_ID=Q9ZPJ6; Match level="QueryCoverage=66%, HitCoverage=68%, E-value=2e-93, Identity=56%"; Hit description =Transcription factor PERIANTHIA
  Pfam annotation: Domain name=bZIP_1; Domain location=181-234; Score =21.2; E_value=0.00073; Accession=PF00170.11; Description=bZIP transcription factor
  Pfam annotation: Domain name=bZIP_2; Domain location=181-231; Score =21.1; E_value=0.0039; Accession=PF07716.5; Description=Basic region leucine zipper
  Pfam module annotation: Pfam domain module=bZIP_1::bZIP_2; Domain location=181-234::181-231
  Subcellular localization annotation: CTP_CleavageSite=25; ConfidenceScore=5.40e-01
MQSFNTTTESESISPLYCHSPFFHRVSLFFSGVSNRGNDTSRNPSRFSDLQHSFRQHDAVDLSSSSVFGGKSSNVAVVASNLQCGTFNTVLVLSLSFSFLEFGSTEQGPMFQRGTTVSMATGNQHVENWADDSHPTEDTCTDIDTDDKNQCFSTVSWCHGVGDGALVVVDSHDQSKTKVKAEDQKTVRRLAQNREAAKKSRLRKKAYVQQLENSRVRLAQLEQELQRARQQGAFIATGIPGDRGHSSVANGALAFDMDYARWVDEHQRLIIDIRSAINSQMGENELHLLVDGAMAHYDELFRLKSIGAKVDVFHILSGMWKTPAERCFIWLGGFRSSELLKIVRNQLEPLTEQQLMGIYNLQQSSQQAEDALSQGMEALQQSLSETLSSSSLGPSGSENVAEYMGQMAIALGKLATLENFLHQADLLRQQTLQQMRRILTTCQAARALLVINDYVTRLRALNSLWLACPREY

SEQ ID NO: 158165 - protein, 123 aa, Glycine max
  Coding DNA Sequence Number=SeqID_41387
  Subcellular localization annotation: CTP_CleavageSite=51; ConfidenceScore=5.14e-01
MITNKVISQSKNPDTLAHRNRPVNLVQPITRSTNELEKRVETNRSCKKSFVADLRENGHGQRLGETLIKHQYKKGGIEKQIQNQESKSLMRTKGSTPERLSSCWLGEEEGLRERERELKANNM

SEQ ID NO: 158166 - protein, 226 aa, Glycine max
  Coding DNA Sequence Number=SeqID_41388
  Gene Ontology: Cellular component=integral to membrane
  Homolog annotation: Hit_ID=Q8LA33; Match level="QueryCoverage=53%, HitCoverage=53%, E-value=3e-45, Identity=73%"; Hit description =Transmembrane protein, putative
  Pfam annotation: Domain name=UPF0016; Domain location=141-216; Score =114.5; E_value=3e-31; Accession=PF01169.9; Description =Uncharacterized protein family UPF0016
MSEAMFGGMNTGYATPKTPSLIRLLIGFDFFPILPPFELHNPLYLGDDHSLCSCWLGCSKSGEHSLLLVSPHSSPPYLFILIDTWVAILPSNNMLYALRLDIWHDKDWKASNGATKNSNKDDDATKKHKRSFLSQFFSPIFLQAFSITFFGEWGDKSQLATIGLAADENPFGVVLGGILGQALCTAAAVVGGKSLASQISEKIVALSGGILFIVFGIQSFLSPVES

SEQ ID NO: 158167 - protein, 82 aa, Glycine max
  Coding DNA Sequence Number=SeqID_41389
  Homolog annotation: Hit_ID=O22703; Match level="QueryCoverage=43%, HitCoverage=12%, E-value=3e-08, Identity=75%"; Hit description =Putative RNA-binding protein
  Pfam annotation: Domain name=RRM_1; Domain location=9-75; Score=8.8; E_value=0.022; Accession=PF00076.12; Description=RNA recognition motif. (a.k.a. RRM, R
MAGKEENRIFVGGLSWEVTERQLEHAFARYGKILECQMFYQNNFFMAEAHFQFSDKMIACGNFRARAGDHCGLDMWNLVQGR

SEQ ID NO: 158168 - protein, 87 aa, Glycine max
  Coding DNA Sequence Number=SeqID_41390
MTPTHDALLYYNGRWNLPRQNEFVGYSFIGKNPKKFGIPSGCVINELKDLIKQVAPHGIPPYDIHQSQTVMEMEDDVSRSQHDSMQN

SEQ ID NO: 158169 - protein, 70 aa, Glycine max
  Coding DNA Sequence Number=SeqID_41391
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=30%, E-value=6e-29, Identity=72%"; Hit description =Apocytochrome f precursor
  Pfam annotation: Domain name=Apocytochr_F_C; Domain location=11-70; Score=53.7; E_value=2.5e-14; Accession=PF01333.10; Description =Apocytochrome F, C-terminal
GQIYLDGSKSNNNVYNATAAVIDIIPPGPELLVSEGESIKLDQPLTSNPNVGGFGQGDAEIVLQDPLRVQ

SEQ ID NO: 158170 - protein, 65 aa, Glycine max
  Coding DNA Sequence Number=SeqID_41392
MITSFSSEGNDEEDHHEHWNGSMSRSQSKHPNQQASPLPTKLPAGAHIPSCAWPGMMPIADCMNK

SEQ ID NO: 158171 - protein, 70 aa, Glycine max
  Coding DNA Sequence Number=SeqID_41393
MGNSAKVVIQQDMKGRRHKYGFNNNEREKAQKKRVVDDETADKHQLDEHQERLRKKFALEEGRIFAANEQ

SEQ ID NO: 158172 - protein, 303 aa, Glycine max
  Coding DNA Sequence Number=SeqID_41394
  Gene Ontology: Mol. function=transporter activity; Cellular component= integral to membrane; Biological process=transport
  Homolog annotation: Hit_ID=Q535K6; Match level="QueryCoverage=98%, HitCoverage=56%, E-value=1e-145, Identity=80%"; Hit description =Nitrate and chloride transporter
  Pfam annotation: Domain name=Nodulin-like; Domain location=23-245; Score=428.3; E_value=1.1e-125; Accession=PF06813.4; Description =Nodulin-like
MAIRGVDGWRDMKSLTVNVITGRWFVVFASFLIMAAAGATYMFGLYSSDIKTTLGYDQSTLNLLSFFKDLGSNVGILSGLINELTPPWVVLAIGAILNFFGYFMIWLSVTKKIAKPKVWQMCLYICIGANSQSFANTGSLVTCVKNFPESRGAVLGILKGYVGLSGAIITQLYHAIYYDDTRSLILLIGWLPAAISFAFLRTIRYMKPVRKPNELKNKVDFTQSEFGVSAAIMLFLLFLPLTIVSVEEYKVWLSKRLALVDPSPVKIVTDQFPMTQSGGKMSLAHQQEVRTIQYFRRYSASTC

SEQ ID NO: 158173 - protein, 46 aa, Glycine max
  Coding DNA Sequence Number=SeqID_41395
MDEGAFEEVPSGVQEYDIGASAVGVVDDGNLVGMIEIDEEVLVTNL

SEQ ID NO: 158174 - protein, 455 aa, Glycine max
  Coding DNA Sequence Number=SeqID_41396
  Homolog annotation: Hit_ID=Q535K6; Match level="QueryCoverage=99%, HitCoverage=77%, E-value=0.0, Identity=75%"; Hit description=Nitrate and chloride transporter
  Pfam annotation: Domain name=MFS_1; Domain location=7-358; Score= -10.6; E_value=0.00097; Accession=PF07690.6; Description=Major Facilitator Superfamily
  Pfam annotation: Domain name=Nodulin-like; Domain location=1-140; Score=81.0; E_value=3.8e-21; Accession=PF06813.4; Description =Nodulin-like
  Pfam module annotation: Pfam domain module=MFS_1::Nodulin-like; Domain location=7-358::1-140
ANSQTFANTGSLVTCIKNFPERNGVVLGILKGYLGLSGAIITQLYSAIYYDDTRALILLIAWLPAAISFASLRTVRYMKPVRQHNELNVFYRFLYISLGLAGFLLFMITIQKRVNFTQSEFGVSAAIVLFLLLLPLSVVSIEEYKVWQSKRLALVDPTPVKIVTDEGEKVMKPIEATNGCKNSVSSKWWENVFSPPERGEDYTILQALFSLDMLILFICSICGIGGTLTAIDNLGQIGKSLRYPKKSISTFVSLVSIWNYLGRVFSGFVSEHYLQKYKFPRPLMLTLTLLLSCVGHLLIAFDVPNGLYVASVIIGFCFGAQWPLLFAIISELFGLKYYATLYNFGSAASPLGLYVLNVKMTGYLYDKEAKKQLAALGLKRIEGQELNCVGVHCFKLSFIIITAATFFGAIVSLILVARTRTFYKSDIYKRYRNAATESETEMAEKDSKHVVPAQK

SEQ ID NO: 158175 - protein, 137 aa, Glycine max
  Coding DNA Sequence Number=SeqID_41397
  Homolog annotation: Hit_ID=Q535K6; Match level="QueryCoverage=96%, HitCoverage=22%, E-value=7e-70, Identity=95%"; Hit description =Nitrate and chloride transporter
  Pfam annotation: Domain name=Nodulin-like; Domain location=23-137; Score=70.1; E_value=7.3e-18; Accession=PF06813.4; Description =Nodulin-like
MAIRGVDGWRDMKSLAVQVITGRWFVVFASFLIMAAAGATYMFGLYSSDIKTTLGYDQTTLNLLSFFKDLGTNVGVISGLINELAPPWVVLAIGAVLNFFGYFMIWLSVTQRIAKPKVWQMCLYICIGANSQTFANT

SEQ ID NO: 158176 - protein, 178 aa, Glycine max
  Coding DNA Sequence Number=SeqID_41398
MHSPKRWLKDAKSSFLTCFVPSEIDPDMMKIGHFGDLSGCYNKLCELGLKDVHNFKFVKDELLKLIESLQKCLHLGGDLVGHPSSMTNDMKNPNVVKTKGALRKKKQKKTRQCSNCDGIGHYMEDDLSCGEDFNFNDPFFNNTEGASVIFSQDAALVDRNETPNAVPKNVDKDTKKQK

SEQ ID NO: 158177 - protein, 584 aa, Glycine max
  Coding DNA Sequence Number=SeqID_41399
  Homolog annotation: Hit_ID=Q535K6; Match level="QueryCoverage=99%, HitCoverage=97%, E-value=0.0, Identity=71%"; Hit description=Nitrate and chloride transporter
  Pfam annotation: Domain name=MFS_1; Domain location=21-476; Score =5.9; E_value=0.00017; Accession=PF07690.6; Description=Major Facilitator Superfamily
  Pfam annotation: Domain name=Nodulin-like; Domain location=15-260; Score=494.5; E_value=1.3e-145; Accession=PF06813.4; Description =Nodulin-like
  Pfam module annotation: Pfam domain module=MFS_1::Nodulin-like; Domain location=21-476::15-260
MVDTNGLMVQVITGRWFVVFASFLIMAAAGATYMFSLYSGDIKSALAYDQTTLNLLSFFKDLGGNVGVLSGLINEITPPWVVLAMGSVLNFFGYFMIWLAVTKKIPKPHVWHMCLYICIGSNSQSFANTGSLVTCVKNFPESRGVVLGILKGYVGLSGAIITQLYFAFYYDDSRSLILLIGWLPAAISFLFLRTIRYMKPVRQPNELSVFYKFLYISLGLAGFLLVMIIVQKQVHFSQSEYGVSAGVVLFLLFLPLAVVFVEQYKIRESQKLAFIDPSPVKIVAEGESANGNTSNTPISTEIEETRWWQKVLSPPPRGEDYTILQALFSLDMILLFFAGTCGVGGTLTAIDNLGQIGTSLGYPKASISTFVSLVSIWNYLGRVFSGFVSEHFLQKYKFPRPLMLTLTLLLSCAGHLLIAFDVPNGLYVASVIIGFCFGAQWPLVFAIISELFGLKYYSTLYNFGGAASPIGLYVLNVRVTGHLYDKEALKQLAVAGIPRNDAKELTCIGSSCFKLSFIIITAATFFGALISLILVARTIKFYKGDIYKRYREQAEEATTAATEMAVVQNRGQKLEQEANKVIGT

SEQ ID NO: 158178 - protein, 1751 aa, Glycine max
  Coding DNA Sequence Number=SeqID_41400
  Homolog annotation: Hit_ID=O04376; Match level="QueryCoverage=11%, HitCoverage=52%, E-value=9e-70, Identity=55%"; Hit description =Serine/threonine protein phosphatase 2A 57 kDa regulatory subunit B' beta isoform
  Pfam annotation: Domain name=B56; Domain location=1464-1740; Score =196.1; E_value=8.1e-56; Accession=PF01603.10; Description=Protein phosphatase 2A regulatory B subunit (B56 family)
  Pfam annotation: Domain name=Collagen; Domain location=1251-1310; Score=-27.5; E_value=0.0079; Accession=PF01391.8; Description =Collagen triple helix repeat (20 copies)
  Pfam annotation: Domain name=KOW; Domain location=241-274; Score =24.2; E_value=0.00046; Accession=PF00467.19; Description=KOW motif
  Pfam annotation: Domain name=KOW; Domain location=483-515; Score =21.3; E_value=0.0034; Accession=PF00467.19; Description=KOW motif
  Pfam annotation: Domain name=KOW; Domain location=589-622; Score =10.4; E_value=1.1; Accession=PF00467.19; Description=KOW motif
  Pfam annotation: Domain name=Supt5; Domain location=108-158; Score =4.4; E_value=1; Accession=PF03439.4; Description=Supt5 repeat
  Pfam annotation: Domain name=Supt5; Domain location=194-240; Score =11.3; E_value=0.18; Accession=PF03439.4; Description=Supt5 repeat
  Pfam module annotation: Pfam domain module=B56::Collagen::KOW::KOW::KO W::Supt5::Supt5; Domain location=1464-1740::1251-1310::241-274::483 -515::589-622::108-158::194-240
MTNKGKGKGKEVAGKGSAGKRKGVFQDDKTGSGCKRNNRSVLQFFEDAADVEESDFSDFSDDDDSDFDFSDDELNAAPRRMDMPDKGQSSLPRVVPKEEMLDEEEWDRILEERYKDPSRFIRFSDEFGDDKGMDPSSIHEGVDELTPSIWKVKCTVGRERLSALCLMQKFADLYSLGTKLKIKSAFSVDHMKGFVYIEAEKQYDINEACQGIPGIYVTRVAPVPNSEVYNLFSVRSRTPEISEGMWARIKGGNYKGDLAQVVSVNNTRKKVTVKLIPRIDLQALAAKFVMRPGGGYSRQKMAVPAPRLISSSELEEFRPLIQIKRDRDTGKVFEVLDGLMLKDGYVYKKISPDSLSLWGVVPTEDELLKFGPSENNESNDLEWLSQLYGDKKKKRVIRPEKGGGGKGESSSGSGVGNGFELYDLVCFGKKDFGVIVGMDKDDIYKILKEGSDGPDAVTVDRHEIKSGLFDLKLTALDQHSKTILVNDTVRVLEGPTKGKQGIVKHIYRGIVFLYDGNEEENGGYLTCKSNKCEKVKLAVGDCSGKDSEPGPLVFEDQPSSPRSPLSPKKPWQARENNREFNRGDNNNMFTIGQTLRIRIGPLKGYICRVIALRRADVTVKLDSQQKVLTVKCEHLSEVQGKSTAISSSGDPDSSSSKPFDMLGTEGSSGGWLNGVGTSTGAGGWNAGGASSTGGSGWNAGGASSTGGGGWNAGGASSTGGGGWNVGGASSTGGGGWNAGGASSTGGGGWNAGGPSSKRDAGSNHSAPSLLNTESTSNPFSSKGAEDSAWETKSNSNKTSSWGAAVDKTGIASDADQSGGWGSGGGSWGQAEHKTGSVGDGNQNSNWNTTKASEGESSGWNSIQKSNETSSAGWGGGNGFKSGSDEGNLNSTWSGWKSGSSGVKQAGNTAGTSDIDANQDAGWKNKPNKDGSESSGWETKNNWNAPVSSSNDKVEKGNDQGRWNAGKASGGLAADFSQASGWKGGLSEHTQEGSNWGDKKFGSCDVSGDSSGNQGSNGWGQKSNWNSGSRSGNENQNSHWSSGRNEPGNQDSNLDKKSNWNSGNSGNLASDPKSSNWNSGSGNSNENSNWGTNVNNKSSWGTGNENKNSSWSSGHSDPGNQDANQGKKSNWNSGNSGNQPSDPNSNWNSNKSSWSAGNENKKSNWSSGDPGNTDSNWGNKNNCISGSGDANQNTSWRSNSSWNTANASSDDGNEGSNENSDGVGGGNWRGGYRGRGGSDRGGFRGRGFRGRGERGGFGGRGEHGGFGGRGERGGFGGRGRSDREGFGGRWGSEGGRGGRGRGRNDQSGGWNNRRDSGEDGPSDWKKGADNGGWKNSNGSQAWNQDTGDKDRQSWSQGNADKEHPSWNQGSGRNQSWSSASGANDNGSQAWNQGNADKEHPSWNQAGNKQSWSSASGGGNNNWNNNGSSQTAEASWKKSTTEGTNIQGGGWNKGSSSNTTSKDWGQSSAADKGQASSWKEAADGASGSWGKKNDGGDKGGWVLRISFIYVGMEIVIKLQEQSTMLVYEILLRHIVSPETDIKTFKRYIDHIFVLKLIELFDSKDQPEREYLKIILHRIYGKSMLHRPFIRTAINNVLYGFILETQRHNGIAELLEILGSIINGFALPMKEKHKLLANPVIKGMLKYWPVTNCHKEVLFLGELEEVIEAIQYPEFIRLLNEHLWNNEQIISIVAQNRNFILPVIFEALENNMKSHWNRAVHWLTANLEEKRELTVKKLEAVAAQAVRDDMVLVN

SEQ ID NO: 158179 - protein, 83 aa, Glycine max
  Coding DNA Sequence Number=SeqID_41401
MPLQDRIASINSPMVNILTHTAERELEHATKQIANLEKERVKLKKERDKKEDQLKSISSRNEEENACTKCSKSEFRHVGYVKL

SEQ ID NO: 158180 - protein, 320 aa, Glycine max
  Coding DNA Sequence Number=SeqID_41402
MELFESSVESIDSHFAKVEYQYQLVPILAKKDFALAESLYETALVMNRSETLGKRAVADVVAHCLALMSRTLRPLMKHGRVAKSDLERLYRLCDAIPCPSTRVNIYTDLATKFWCERRVDECKSIVREKIRPLISASEFGNEADRAALIYLSAPALYVAHAVTALNDFGKLSPQQRTSAFYRVGKMILIRKSSGEPNQDLDEARIVPDHEDLLDVLALLENINDDWVIWALLRAACRAISSKENRARLTGQQKRDFAIKAQELSQRKLPDQKNIKHDGYLIVCLAQTMRILESKKQEWDALIDRARTVENMADRAYVLVE

SEQ ID NO: 158181 - protein, 119 aa, Glycine max
  Coding DNA Sequence Number=SeqID_41403
MDNHLGISAYHLTHGSRSTDVVRPKESQPEEADISGKGTHDQIGLRLSIRLGVSKLRGANNRKASPHATELVATCPFVGVRGEAHGCAFQRRKDARSRHQRLFVENVGKTEGNRSKRKF

SEQ ID NO: 158182 - protein, 229 aa, Glycine max
  Coding DNA Sequence Number=SeqID_41404
  Subcellular localization annotation: CTP_CleavageSite=46; ConfidenceScore=5.41e-01
MAPPLTSSPLSSAASPWRNTITKRALRHLYRTRSKSRTTGDQEETQEQMKADMSALIEQMASMMEAMLGMRQLMEKNVATAAAVSSAAEEHPTLLATAHHPPPNAVGRERSTLGHNRNPHLGYNRVAYPYGLPPNYTPPVMHDDAGHVTSPILEGEPPRQPDEVHEDHREYAQGDVDFYTPDPRQGAGTQHIASAQPHSTTNILVHRRTTPGGGRKKKTRSPRGEIESC

SEQ ID NO: 158183 - protein, 165 aa, Glycine max
  Coding DNA Sequence Number=SeqID_41405
  Gene Ontology: Mol. function=nucleobase transporter activity; Cellular component=membrane; Biological process=nucleobase, nucleoside, nucleotide and nucleic acid transport
  Homolog annotation: Hit_ID=Q74S68; Match level="QueryCoverage=99%, HitCoverage=32%, E-value=2e-65, Identity=73%"; Hit description =Putative permease
MGGYVVAASFFTLGLASWQVLLCLLVGICIVQLCANLVAKPSQMAGVPYAVISRQAFGVFGANIPAVIRGLIAFAWYGIQTYLAANALMLVLLKFYPSLSSMTQSSWLGLSQLGWCCFGVMWLLQAMVFWHGMSAIKRFIDIAGPAVYVVMVALAGWIVYKTGFD

SEQ ID NO: 158184 - protein, 128 aa, Glycine max
  Coding DNA Sequence Number=SeqID_41406
ISAYHGCRMTKLGLCVPSDTTVSEWQRGADNRKVSPRISAYHGCRMTKLGLCVPSDTTVSEWQRGADNRKVSPRIMGISAYHGCRMTKLGLCVPSDTTVSEWQRGADNRKGADNRKVSLRVIGPAASG

SEQ ID NO: 158185 - protein, 53 aa, Glycine max
  Coding DNA Sequence Number=SeqID_41407
  Homolog annotation: Hit_ID=Q84VH5; Match level="QueryCoverage=98%, HitCoverage=28%, E-value=2e-07, Identity=65%"; Hit description =Envelope-like protein
MPGANLLAMGSSSDSTSSRSMRSPGAEGEPGDEVSFGEVAMEKQSLWSGFVNL

SEQ ID NO: 158186 - protein, 67 aa, Glycine max
  Coding DNA Sequence Number=SeqID_41408
MTHSQQHDAPIATPNAPLGMQWNVPGAIPYMGDLLGVDLRHRFSVEVDEVEAGRHRGRRNPNHQARR

SEQ ID NO: 158187 - protein, 154 aa, Glycine max
  Coding DNA Sequence Number=SeqID_41409
MSSRKRKSVGLRPTTQYDTQRFHSFEAWTRYTDNVLGRHMLAEKKMEIYHTELDEFKGELERCNFHKRLTNLVDCSIDLALVKEFYTDLYSPKGPSPKQVRIQGHLIRIDADSLNAFLETPVVLAEGESLPAYSRYYKMPTDIREIEVALCIPG

SEQ ID NO: 158188 - protein, 91 aa, Glycine max
  Coding DNA Sequence Number=SeqID_41410
MRGSGEFVPFLDTTSRGSEMPQRTFLRRRHGPSVGLFTVGIKTEPICNAYAKDTMRECAQGIIPFEEHIVAVGTTSNNRFSKRKALDEGSL

SEQ ID NO: 158189 - protein, 60 aa, Glycine max
  Coding DNA Sequence Number=SeqID_41411
MWVQAIGLFAQATCAPEFGLPIPFNQRLLVLHVGGERSELSRIGCWINGLSYLKKKRGLN

SEQ ID NO: 158190 - protein, 153 aa, Glycine max
  Coding DNA Sequence Number=SeqID_41412
MAGRGRDQNCDVLDRITDVLETLVQECDVEPAEYQGLMAFRKNHPPKFSGDATDGPDVGALIGPWSLALAFGRDHRSYETRNRVTVAKCTRGLSPGREHLWAPRLITYGRRAVTCTIGWSRKTQHNSLSESVVWTRLGYFLRFGCCWYVPRCI

SEQ ID NO: 158191 - protein, 110 aa, Glycine max
  Coding DNA Sequence Number=SeqID_41413
MTLTIPQLFIKPLQVSWDASVFEVYNDNFPLYVKHEDLAEIAHGGQCISISVIQFWILAHWQMVVILPEDNVVIWLCSLHNWPNNYLKGIINRDSVTVKEVNPWMLLDGS

SEQ ID NO: 158192 - protein, 218 aa, Glycine max
  Coding DNA Sequence Number=SeqID_41414
MAIDVQTKRFHDADGREGIILGYPDLVRDTGTEVSHWTNLHWDGFQITALKCQYSSIRHLRIQPDSFDKLVYLNKHQNSPKRLNVASVVGGHLVNQTKQIGLHVSWSEVKQPNVEIEDPDLSGSVSRYRLFASWTVGTISGNPTAKGDSSLTPTGCKTPVDATPFLIISRPHGSKKKKAILCYTPVISFLPRHANPHRVPDHIPYIERGSLLIHQLLS

SEQ ID NO: 158193 - protein, 160 aa, Glycine max
  Coding DNA Sequence Number=SeqID_41415
  Gene Ontology: Mol. function=nucleic acid binding; Biological process= transport
  Homolog annotation: Hit_ID=Q8H6Q8; Match level="QueryCoverage=98%, HitCoverage=5%, E-value=1e-19, Identity=35%"; Hit description=CTV.20
MVSLMDRNILDSLFLNIHFHGLDMKEGSIPTALIYMIQYKVMNTCASRVLLKSQRGETTLIITDMTKANVSLPRTIKWDDVTLPEKWVMDKATLSVPRPTPTIEQIKKDNSGKVEITFNRRNSLSSRIKASRSENESAKRSFSVRTRSIPVGLSRSESQN

SEQ ID NO: 158194 - protein, 157 aa, Glycine max
  Coding DNA Sequence Number=SeqID_41416
MVCNENADMTGQLFTGSFTFECRIMHYILCRILLPRSTNIAQASEKDLILLWALQTGCQIDWAHLVCYHMHKALRANAPLPYPQLVTIFLQHFNVPLDDKPFLKVKCSFAIGATAVASFGYRKDMDGDRFYAMDSRITSLEDDMSFILRCFDPPANP

SEQ ID NO: 158195 - protein, 75 aa, Glycine max
  Coding DNA Sequence Number=SeqID_41417
  Homolog annotation: Hit_ID=Q9SD67; Match level="QueryCoverage=56%, HitCoverage=5%, E-value=2e-10, Identity=74%"; Hit description=FtsH metalloprotease-like protein
MHVCVHYGKILPTPYVGGNVLKIMNRPCLRGIEEKTAKLKGSEKALVARHEARYAVVGTAVANLLAGQPHVVICG

SEQ ID NO: 158196 - protein, 67 aa, Glycine max
  Coding DNA Sequence Number=SeqID_41418
MAYPIIFLPHSAAIKLQDAWDSIDEEDLSPTSSTRSYIMWYQEHLRLVSYMMPMMKLSCGAELWLDL

SEQ ID NO: 158197 - protein, 243 aa, Glycine max
  Coding DNA Sequence Number=SeqID_41419
  Gene Ontology: Mol. function=nucleic acid binding; Biological process= RNA-dependent DNA replication
MAQPPPRERTLREMAAPDFTYESLCIQYPDEDVPYVLKTGLIHLLPKFHGLAGEDPHKHLKEFHIVCSTMKPPDVQEDHIFLKAFPQSLEGVAKDWLYYLAPRSITSWDDLKRVFLEKVFPCFQDHNHQERYLSNMERSMIDAASGGALGDMTPAEARNLVEKMASNSQQFSARNDAIVIRGVHEIATNSAASSETKKLEGKLDALVNLVTQVALNHKFVPVARVCGLCSFTDHHTDLCPSMQ

SEQ ID NO: 158198 - protein, 252 aa, Glycine max
  Coding DNA Sequence Number=SeqID_41420
  Gene Ontology: Mol. function=transporter activity; Cellular component= integral to membrane; Biological process=transport
  Homolog annotation: Hit_ID=Q7N8F5; Match level="QueryCoverage=99%, HitCoverage=29%, E-value=1e-106, Identity=73%"; Hit description =Outer membrane usher protein MrfC
  Pfam annotation: Domain name=Usher; Domain location=1-252; Score= -378.0; E_value=5.6e-07; Accession=PF00577.10; Description=Fimbrial Usher protein
  Subcellular localization annotation: CTP_CleavageSite=76; ConfidenceScore=5.14e-01
LFDYNVNAQTQKHQKGGSSYSLSGNGTGGANLGARRLRADWQANLNHQTGSSQPTDKQFDWSRYYAYRAIPALRSRLTMGEDYLNSDIFDSLRFTGVSLRSDDSMLPPNLRGYAPEVTGVAKTNAKVVVSQQGRVLYETQVAAGPFRIQDINDAVSGELDVRVEEQDGSVQEFKMNTANIPYLTRPGTVRYKLATGKPSEWGHHLRGPMFGTGEFSWGISNGWSLYGGGIAGGDYNALSLGIGRDLMALGAL

SEQ ID NO: 158199 - protein, 645 aa, Glycine max
  Coding DNA Sequence Number=SeqID_41421
  Homolog annotation: Hit_ID=Q6KA74; Match level="QueryCoverage=94%, HitCoverage=93%, E-value=0.0, Identity=67%"; Hit description=Ankyrin repeat protein-like
  Pfam annotation: Domain name=Ank; Domain location=67-99; Score=18.0; E_value=0.034; Accession=PF00023.20; Description=Ankyrin repeat
MEDISKYAHSPAHVAVARRDHAALRRLVSTIPRLAKAGEVNTEAESLAAELKADEVSAVIDRRDVPGRETPLHLAVRLRDPVSAEILMCGGADWSLQNEHGWSALQEAVCTREEAIAVIIARHYQPLAWAKWCRRLPRIVASAARIRDFYMEISFHFESSVIPFIGRIAPSDTYRIWKRGSNLRADMTLAGFDGFRIQRSDQTFLFLGEGYASENGNLNFPPGSLLALAHKEKEVTNALEGAGTQPTEAEVNHEVSLMSQTNMYRPGIDVTQAELVPHLNWRRQEKTEMVGNWKAMVYDMLHVMVSVKSRRVPGAMTDEELFAVDDGESMVNRENNDEYDDVLTAEEKMQLDSALRMGNSDGICQDGEPGFDGHENGSAASNCEANGGGVKEKKGWFGWNKKNIKGGDEPGDLKTAKKFSGDQQKPQPEFVKEDPGETKKGKDKNLRRKKKKGGINESKNESEYKKGLRPVLWLTPDFPLRTDELLPLLDILANKVKAIRRLRELLTTKLPLGTFPVKVAIPIVPTIRVLVTFTKFEELQPAEEFSTPLSSPAYFQDAKSKESEGSTSWISWMKGSHGTQSIDSDSHRFKDEIDPFNIPLDYKWVDANERKRRMKAKRAKNMKHKKQTAKGGDGVQLGSEDVEEY

SEQ ID NO: 158200 - protein, 1062 aa, Glycine max
  Coding DNA Sequence Number=SeqID_41422
  Gene Ontology: Mol. function=DNA binding; Cellular component=nucleus; Biological process=regulation of transcription, DNA-dependent
  Homolog annotation: Hit_ID=P92948; Match level="QueryCoverage=68%, HitCoverage=86%, E-value=0.0, Identity=73%"; Hit description=Myb -like DNA binding protein
  Pfam annotation: Domain name=Myb_DNA-binding; Domain location=145 -191; Score=52.4; E_value=1.6e-12; Accession=PF00249.21; Description =Myb-like DNA-binding domain
  Pfam annotation: Domain name=Myb_DNA-binding; Domain location=197 -241; Score=41.7; E_value=2.5e-09; Accession=PF00249.21; Description =Myb-like DNA-binding domain
  Pfam module annotation: Pfam domain module=Myb_DNA-binding::Myb_DNA -binding; Domain location=145-191::197-241
MESIATSETVTCNTGREEEVLGLRASTHRVVATKSQRHRDHCNHHNGDIEGSQLGQRQWGSKWNCNNDDDAKPPRGSKSKGSPPMISVRVALLADTHGLGLGRCPKRRGGEGLKGVGAISFPIKKRGRKRKRLKVEAKMRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDAACVKDENYEPGDDPRKLRPGEIDPNPESKPARPDPVDMDEDEKEMLSEARARLANTKGKKAKRKAREKQLEEARRLASLQKKRELKAAGIDIRQRKRKRKGIDYNAEIPFEKRPPPGFFDVTDEDRPVEQPQFPTTIEELEGKRRVDVEAQLRKQDIAKNKIAQRQDAPSAILHANKLNDPETVRKRSKLMLPPPQISDQELDEIAKLGYASDLAGSQELAEGSGATRALLADYAQTPGQGMTPLRTPQRTPAGKGDAIMMEAENLARLRESQTPLLGGENPELHPSDFNGVTPKKKEIQTPNPMLTPSATPGGAGLTPRIGMTPTRDGFSFSMTPKGTPLRDALHINEDMNMHDSTKLELQRQADMRRSLRSGLGSLPQPKNEYQIVMQPVPEDAEEPEEKIEEDMSDRIAREKAEEEARQQALLRKRSKVLQRELPRPPTASLELIRNSLMRTDVDKSSFVPPTSIEQADEMIRRELLSLLEHDNAKYPLDEKVIKEKKKGAKRAVNGSAVPVIEDFEEDEMKEADKLIKEEALYLCAAMGHEDEPLDEFIEAHRTCLNDLMYFPTRNAYGLSSVAGNMEKLTALQNEFENVRSKLDDDKEKTVRLEKKVMVLTQGYESNYGWLTLVRHFFFTASASNNPPPPPPPPPMNNAVPVNADAAMPVAATSSCTSGIAFTTCSQIHKFHRDMHLWRIAMLEMSHLSFCFGNNRINSFYRGFNPQFLAKFFLDPSVTLIDSLSSIGEFVPAYEHVDIILDGLPYEFESLVTLISCRFEPLTIDEVKTLLLAQETHVEKSCKKAIASINLIEISQPNFNPNSS

SEQ ID NO: 158201 - protein, 190 aa, Glycine max
  Coding DNA Sequence Number=SeqID_41423
  Homolog annotation: Hit_ID=O82268; Match level="QueryCoverage=65%, HitCoverage=57%, E-value=2e-49, Identity=76%"; Hit description =Expressed protein
  Pfam annotation: Domain name=DUF640; Domain location=32-164; Score =292.7; E_value=7.1e-85; Accession=PF04852.3; Description=Protein of unknown function (DUF640)
  Subcellular localization annotation: CTP_CleavageSite=79; ConfidenceScore=5.73e-01
MDLVSESTNAVSNPSSRYKMETPTTNPTTAAVSSPSSGSNNSGSTTTPSRYENQKRRDWNTFCQYLRNHRPPLSLSLCSGAHVLEFLHYLDQFGKTKVHNHPCPFFGLPNPPAPCPCPLRQAWGSLDALIGRLRAAYEENGGRPETNPFGARAVRTYLRDVRDFQAKARGVSYEKKRKRPKPKVTHPTPT

SEQ ID NO: 158202 - protein, 67 aa, Glycine max
  Coding DNA Sequence Number=SeqID_41424
MESAFPNSDVVERRLVVKGTDDLGLDGFAPGEHHLSIVKPFISCGPFREVIEIKENLPHKLCYALNS

SEQ ID NO: 158203 - protein, 75 aa, Glycine max
  Coding DNA Sequence Number=SeqID_41425
MKREMLDSTGNDGSTTPNHKLFTIVLYYTVTGVAKFVGEVFLDLYDLSEGATRYEWLLKEEAQSKQRKASFFPRH

SEQ ID NO: 158204 - protein, 189 aa, Glycine max
  Coding DNA Sequence Number=SeqID_41426
  Gene Ontology: Mol. function=nucleic acid binding
  Homolog annotation: Hit_ID=Q16SB6; Match level="QueryCoverage=42%, HitCoverage=26%, E-value=2e-16, Identity=48%"; Hit description =Poly(A)-binding protein, putative
  Subcellular localization annotation: CTP_CleavageSite=70; ConfidenceScore=5.67e-01
MTTPPSSSSASHSQFAYSNPSSSSYFPVPFHLQQPATTHYAAPYVAAPSVQIPAPPVVGPIAPAPVPGVYSAVPQYQAQQLFERDAQIITPEALENVKAAIASSDVEHKTDAKKKAVPRKAAGQAWEDPILAEWPEDDYRLFCGDLGNEVNDDVLSKAFSRFPSFNLARVSALLLLLIHKSRAIEIICR

SEQ ID NO: 158205 - protein, 173 aa, Glycine max
  Coding DNA Sequence Number=SeqID_41427
MGHIATLQHNIFSFHSLNGLHICNKQESCILGACSALDHSLRKKTPTLHRICFGDYFSTTKYSIPWKGLRCRSFQRSVLIDRANEVDHEDWCFGSDYVGERRNSRELLDSKKSVNSPTLSPEAPFVQNDEMTNNEILQRLCSRGKLTVAARLIDVMARKSQIPHFPSCTNLIR

SEQ ID NO: 158206 - protein, 576 aa, Glycine max
  Coding DNA Sequence Number=SeqID_41428
  Gene Ontology: Mol. function=calcium ion binding; Cellular component =mitochondrion; Biological process=embryonic development ending in seed dormancy
  Homolog annotation: Hit_ID=Q6Z7E0; Match level="QueryCoverage=83%, HitCoverage=85%, E-value=2e-98, Identity=39%"; Hit description =Putative pentatricopeptide (PPR) repeat-containing protein
  Pfam annotation: Domain name=PPR; Domain location=113-146; Score =11.0; E_value=0.38; Accession=PF01535.11; Description=PPR repeat
  Pfam annotation: Domain name=PPR; Domain location=147-181; Score =40.2; E_value=7e-09; Accession=PF01535.11; Description=PPR repeat
  Pfam annotation: Domain name=PPR; Domain location=182-216; Score =38.9; E_value=1.8e-08; Accession=PF01535.11; Description=PPR repeat
  Pfam annotation: Domain name=PPR; Domain location=217-251; Score =36.3; E_value=1.1e-07; Accession=PF01535.11; Description=PPR repeat
  Pfam annotation: Domain name=PPR; Domain location=284-318; Score =31.6; E_value=2.8e-06; Accession=PF01535.11; Description=PPR repeat
  Pfam annotation: Domain name=PPR; Domain location=319-353; Score =45.4; E_value=2e-10; Accession=PF01535.11; Description=PPR repeat
  Pfam annotation: Domain name=PPR; Domain location=354-388; Score =32.8; E_value=1.2e-06; Accession=PF01535.11; Description=PPR repeat
  Pfam annotation: Domain name=PPR; Domain location=389-423; Score =42.6; E_value=1.3e-09; Accession=PF01535.11; Description=PPR repeat
  Pfam annotation: Domain name=PPR; Domain location=424-458; Score =26.3; E_value=0.00011; Accession=PF01535.11; Description=PPR repeat
  Pfam annotation: Domain name=PPR; Domain location=459-493; Score =39.5; E_value=1.2e-08; Accession=PF01535.11; Description=PPR repeat
  Pfam annotation: Domain name=PPR; Domain location=494-528; Score =33.4; E_value=7.7e-07; Accession=PF01535.11; Description=PPR repeat
  Pfam annotation: Domain name=PPR; Domain location=78-112; Score=22.8; E_value=0.0012; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=113-146::147 -181::182-216::217-251::284-318::319-353::354-388::389-423::424 -458::459-493::494-528::78-112
  Subcellular localization annotation: CTP_CleavageSite=63; ConfidenceScore=5.03e-01
MATVSSEFLSHCLPLGTNSKRAWLPNPSNTVITCRIPLLNEDNPSKRRLNNNNNNKGHTRVTSSDTRPQQQHYDFRDTHHMKALNRLCKTGKYTEALYFLEQMVKRGYKPDVILCTKLIKGLFTSKRTEKAVRVMEILEQYGDPDSFAYNAVISGFCRSDRFDAANRVILRMKYRGFSPDVVTYNILIGSLCARGKLDLALKVMDQLLEDNCNPTVITYTILIEATIIHGSIDDAMRLLDEMMSRGLQPDMYTYNVIVRGMCKRGLVDRAFEFVSNLNTTPSLNLYNLLLKGLLNEGRWEAGERLMSDMIVKGCEPNIVTYSVLISSLCRDGKAGEAVDVLRVMKEKGLNPDAYCYDPLISAFCKEGKVDLAIGFVDDMISAGWLPDIVNYNTIMGSLCKKGRADEALNIFKKLEEVGCPPNASSYNTMFGALWSSGDKIRALTMILEMLSNGVDPDRITYNSLISSLCRDGMVDEAIGLLVDMERTEWQPTVISYNIVLLGLCKAHRIVDAIEVLAVMVDNGCQPNETTYTLLVEGVGYAGWRSYAVELAKSLVSMNAISQDLFRRLQKQNHFRA

SEQ ID NO: 158207 - protein, 385 aa, Glycine max
  Coding DNA Sequence Number=SeqID_41429
  Gene Ontology: Mol. function=protein serine/threonine kinase activity; Cellular component=mitochondrion; Biological process =protein amino acid phosphorylation
  Homolog annotation: Hit_ID=Q7XDD8; Match level="QueryCoverage=98%, HitCoverage=63%, E-value=2e-94, Identity=43%"; Hit description =Pentatricopeptide, putative, expressed
  Pfam annotation: Domain name=PPR; Domain location=102-136; Score =18.3; E_value=0.028; Accession=PF01535.11; Description=PPR repeat
  Pfam annotation: Domain name=PPR; Domain location=137-171; Score =28.5; E_value=2.4e-05; Accession=PF01535.11; Description=PPR repeat
  Pfam annotation: Domain name=PPR; Domain location=172-206; Score =45.9; E_value=1.4e-10; Accession=PF01535.11; Description=PPR repeat
  Pfam annotation: Domain name=PPR; Domain location=207-241; Score =33.0; E_value=1.1e-06; Accession=PF01535.11; Description=PPR repeat
  Pfam annotation: Domain name=PPR; Domain location=242-276; Score =53.6; E_value=6.7e-13; Accession=PF01535.11; Description=PPR repeat
  Pfam annotation: Domain name=PPR; Domain location=277-311; Score =20.6; E_value=0.0058; Accession=PF01535.11; Description=PPR repeat
  Pfam annotation: Domain name=PPR; Domain location=312-346; Score =26.5; E_value=9.1e-05; Accession=PF01535.11; Description=PPR repeat
  Pfam annotation: Domain name=PPR; Domain location=32-66; Score=21.8; E_value=0.0024; Accession=PF01535.11; Description=PPR repeat
  Pfam annotation: Domain name=PPR; Domain location=347-381; Score=9.1; E_value=0.62; Accession=PF01535.11; Description=PPR repeat
  Pfam annotation: Domain name=PPR; Domain location=67-101; Score=21.1; E_value=0.004; Accession=PF01535.11; Description=PPR repeat
  Pfam module annotation: Pfam domain module=PPR::PPR::PPR::PPR::PPR::PP R::PPR::PPR::PPR::PPR; Domain location=102-136::137-171::172-206::207- 241::242-276::277-311::312-346::32-66::347-381::67-101
MVIGGLCKNGRLRSALDLVEDMSLSGCSPDAITYNSIIRCLFDKGNFNQAVNFWRDQLRKGCPPYLITYTVLIELVCKYCGAARALEVLEDMAMEGCYPDIVTYNSLVNLTSKQGKYEDTALVILNLLSHGMQPNAVTYNTLIHSLINHGYWDEVDDILKIMNETSSPPTHVTYNILLNGLCKSGLLDRAISFYSTMVTENCSPDIITYNTLLSGLCKEGFIDEGIQLLNLLVGTSCSPGLVTYNIVIDGLARLGSMESAKELYDEMVDKGIIPDEITHSSLTWGFCRADQLEEATELLKEMSMKEQRIKNTAYRCVILGLCRQKKVDIAIQVLDLMVKGQCNPDERIYSALIKAVADGGMLKEANDLHQTLIKWKILKKEIMLN

SEQ ID NO: 158208 - protein, 165 aa, Glycine max
  Coding DNA Sequence Number=SeqID_41430
  Gene Ontology: Mol. function=calcium ion binding; Cellular component =mitochondrion; Biological process=protein amino acid dephosphorylatio n
  Homolog annotation: Hit_ID=Q5QIT3; Match level="QueryCoverage=99%, HitCoverage=30%, E-value=3e-86, Identity=90%"; Hit description =Protein phosphatase 2A beta
  Pfam annotation: Domain name=efhand; Domain location=24-52; Score =1.8; E_value=9.6; Accession=PF00036.22; Description=EF hand
  Pfam annotation: Domain name=efhand; Domain location=97-125; Score =20.9; E_value=0.0046; Accession=PF00036.22; Description=EF hand
  Pfam module annotation: Pfam domain module=efhand::efhand; Domain location=24-52::97-125
MQHADEEEDINKVLRYFSYEHFYVIYCKFWELDTDHDFFIDKENLIRYGNHALTYRIVDRIFSQVPRKFTSKVEGKMGYEDFVYFILSEEDKSSEPSLEYWFKCIDLDGNGVLTRNELQFFYEEQLHRMECMAQEPVLFEDILCQIIDMIKPEDESVITLHDLKG

SEQ ID NO: 158209 - protein, 167 aa, Glycine max
  Coding DNA Sequence Number=SeqID_41431
  Gene Ontology: Mol. function=protein kinase activity; Biological process=protein amino acid phosphorylation
  Homolog annotation: Hit_ID=Q6YTQ6; Match level="QueryCoverage=75%, HitCoverage=8%, E-value=2e-36, Identity=56%"; Hit description =Helicase-like protein
MTGLFIVLTCLAFFPPLCFALEFQAVIKTRTIFMPTDQQAKIYNQIIQAVNKNEGGMFFLYGYEGTGKTFIWKTLAASLRADNKIVIMTASSSIASLLLPRGKIAHSKLKIPVPIFEDSTCNIHQGSQLAELLNEASLISWDEAPMAHKFCFEALDRSLRDVIKAKS

SEQ ID NO: 158210 - protein, 117 aa, Glycine max
  Coding DNA Sequence Number=SeqID_41432
MVWCLQSPFLLLHSAVIDLQEAKDSIDEEDPRPTSSTWSYIKGQPLMVKEECKEVSVFFKRLAKKESHFVIKTNIKETYLLRQPPHLVLCKKTLVSTATPLRLEVIPHVNELLDEGL

SEQ ID NO: 158211 - protein, 251 aa, Glycine max
  Coding DNA Sequence Number=SeqID_41433
  Gene Ontology: Biological process=regulation of transcription
  Homolog annotation: Hit_ID=Q1SCJ0; Match level="QueryCoverage=55%, HitCoverage=32%, E-value=6e-44, Identity=70%"; Hit description=TCP -domain protein
  Pfam annotation: Domain name=TCP; Domain location=82-236; Score=80.6; E_value=5e-21; Accession=PF03634.4; Description=TCP family transcription factor
MDTCSPKLLSSLFPEAYDIQLLAASALEERNKFQNKLLPETISNGTNIWDILLLEAISAEPSTSNSTRSNQLTVAAVAEAPNSKKPPPKQTSTKDRHTKVDGREQRIRMSALYATCIFQLTHELGHKLDGETIEWLLQQVELDVIATTDTGTIAANFTSLNISLRSFGSFMSVPSQLRSSYFNLNFSLQQHQHRTFFPGIAFSSNNTNNNTSTLLNFQSNTLNTTMLQQQAKPKLSDDGVPLSLDISDTIV

SEQ ID NO: 158212 - protein, 220 aa, Glycine max
  Coding DNA Sequence Number=SeqID_41434
  Gene Ontology: Mol. function=zinc ion binding
  Homolog annotation: Hit_ID=Q5XM22; Match level="QueryCoverage=43%, HitCoverage=53%, E-value=2e-34, Identity=77%"; Hit description =Resistance-like protein HAAS-2
  Pfam annotation: Domain name=DUF1723; Domain location=43-92; Score =47.4; E_value=4.9e-11; Accession=PF08330.1; Description=Protein of unknown function (DUF1723)
ERPDLKLVSHGRKVTLIGRPVPEIEGLVVATGLSPLIDCSVITGDPGLISAFVERWHSETSTFHLLVGELMITLDDVSSILHFPITDALHNFHALSTEEARFLPTKLLEVSAEEARAETALTRGAYVRLGWVQDIYETRCQARRWIVAARAYLLHLVDCTLFANKSATYVHVVYLDTFRDLAHSGGYAWGVAALVHIYDQLDEACRTTTRQLAGYLTLLQ

SEQ ID NO: 158213 - protein, 178 aa, Glycine max
  Coding DNA Sequence Number=SeqID_41435
GETLPTYSRYCRLPTDYREIEATLCIPGQGFILNTEGHPGKILRKDLTTLAQVWSVLSYSNLAPTSYTSDLTVDRARMIFGLVSRMDMNIGALISGHMTSIAQSNTSRLGFPALITTLCRARGVVSDSLTFERLSLVINLAYIKKNCGIPRIYQFPSEGLGGRRRGQLSFLQLLQLLL

SEQ ID NO: 158214 - protein, 67 aa, Glycine max
  Coding DNA Sequence Number=SeqID_41436
  Gene Ontology: Mol. function=structural constituent of ribosome; Cellular component=intracellular; Biological process=translation
  Homolog annotation: Hit_ID=UPI000068E4CD; Match level="QueryCoverage =98%, HitCoverage=84%, E-value=5e-16, Identity=59%"; Hit description =ribosomal protein L28
  Pfam annotation: Domain name=Ribosomal_L28; Domain location=1-51; Score=52.9; E_value=1e-12; Accession=PF00830.9; Description =Ribosomal L28 family
MVGNNVSHANNKTKRRFEINLLEKKFYLPEQDKHVTLKVSAHGLRVINKIGIEEALERAVRNGLIKK

SEQ ID NO: 158215 - protein, 72 aa, Glycine max
  Coding DNA Sequence Number=SeqID_41437
  Subcellular localization annotation: CTP_CleavageSite=49; ConfidenceScore=5.13e-01
DVLDIVSDIVDPAQSVKDITDLCVQYFRAGCPGHCIRHQSSSSDSVSSVASSSSSAAFPDVETMSGTCVPSN

SEQ ID NO: 158216 - protein, 290 aa, Glycine max
  Coding DNA Sequence Number=SeqID_41438
  Gene Ontology: Mol. function=protein binding; Cellular component =integral to membrane; Biological process=defense response to fungus
  Homolog annotation: Hit_ID=Q1SWI7; Match level="QueryCoverage=96%, HitCoverage=83%, E-value=6e-65, Identity=39%"; Hit description =Leucine-rich repeat
  Pfam annotation: Domain name=LRR_1; Domain location=115-137; Score =20.8; E_value=0.005; Accession=PF00560.23; Description=Leucine Rich Repeat
  Pfam annotation: Domain name=LRR_1; Domain location=139-161; Score =12.6; E_value=1.3; Accession=PF00560.23; Description=Leucine Rich Repeat
  Pfam annotation: Domain name=LRR_1; Domain location=16-41; Score=3.4; E_value=65; Accession=PF00560.23; Description=Leucine Rich Repeat
  Pfam annotation: Domain name=LRR_1; Domain location=168-190; Score =8.9; E_value=6.1; Accession=PF00560.23; Description=Leucine Rich Repeat
  Pfam annotation: Domain name=LRR_1; Domain location=192-215; Score =10.7; E_value=2.9; Accession=PF00560.23; Description=Leucine Rich Repeat
  Pfam annotation: Domain name=LRR_1; Domain location=217-240; Score =2.5; E_value=96; Accession=PF00560.23; Description=Leucine Rich Repeat
  Pfam annotation: Domain name=LRR_1; Domain location=265-287; Score =5.2; E_value=31; Accession=PF00560.23; Description=Leucine Rich Repeat
  Pfam annotation: Domain name=LRR_1; Domain location=43-65; Score =11.6; E_value=1.9; Accession=PF00560.23; Description=Leucine Rich Repeat
  Pfam annotation: Domain name=LRR_1; Domain location=67-89; Score =11.7; E_value=1.8; Accession=PF00560.23; Description=Leucine Rich Repeat
  Pfam annotation: Domain name=LRR_1; Domain location=91-113; Score =9.0; E_value=5.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=115 -137::139-161::16-41::168-190::192-215::217-240::265-287::43-65::67 -89::91-113
  Subcellular localization annotation: CTP_CleavageSite=74; ConfidenceScore=5.11e-01
CTLPHYNEPSLLNFSSLQTLHLSFTSYSPAISFVPKWIFKLKKLVSLQLWSNKFQGSIPCGIRNLTLLQNLDLSGNSFSSSIPDCLYGLHRLKSLEIHSSNLHGTISDALGNLTSLVELDLSYNQLEGTIPTSLGNLTSLVALYLKYNQLEGTIPTFLGNLRNSREIDLTILNLSINKFSGNPFESLGSLSKLSSLWIDGNNFQGVVKEDDLANLTSLTDFGASGNNFTLKVGPNWIPNFQLTYLEVTSWQLGPSFPLWIQSQNQLQYVGLSNTGILDSIPTWFWEAHSQ

SEQ ID NO: 158217 - protein, 290 aa, Glycine max
  Coding DNA Sequence Number=SeqID_41439
  Homolog annotation: Hit_ID=Q47522; Match level="QueryCoverage=16%, HitCoverage=59%, E-value=2e-21, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVTTLNSIELLLVLAFNNNNYFSHAHSFYPGCEEQALDFEPQLLHTNIDKEMCKFINLQHERLKNEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 158218 - protein, 61 aa, Glycine max
  Coding DNA Sequence Number=SeqID_41440
MTRTQHVHIVGEPWGIPLSTDFQVQAIGQFAQATCAPEFGLPRPFNQRLLVLHVGGVAVKQ

SEQ ID NO: 158219 - protein, 70 aa, Glycine max
  Coding DNA Sequence Number=SeqID_41441
MSLPSAIHVFSIIKCEASGDWEACYSVVFQIGSFAKRKKEEVEMRVVITERAGRTKSVSYLCFPVISDER

SEQ ID NO: 158220 - protein, 108 aa, Glycine max
  Coding DNA Sequence Number=SeqID_41442
MTSRDQVWVILPPLYHPEGGGPDDTRRYLTVIRTLLSSRGGGPDDKQRPKADIVFCTFCSSGNNKSFTCGNFMVARDSRQPRGAKLVSYTDFRGPLLDDMRPFFGPCE

SEQ ID NO: 158221 - protein, 85 aa, Glycine max
  Coding DNA Sequence Number=SeqID_41443
MAEIKRKYCYAIPTRPTWAFQDVPPEGGCFWRKQPSLPGRARWQAPPLFSKPRRFRNISVCDFAKIFNRSSTFFVRSSSFFGLQP

SEQ ID NO: 158222 - protein, 112 aa, Glycine max
  Coding DNA Sequence Number=SeqID_41444
MEGLVDLAAIDAFLAFHHGKESPIVAILAMYDTFDRGCEKSSARIVCCALALYVWLWLRVRTQGLDWLPNLKTVRDDEVKASEESDEVQALKAELERARVVKEKFKSIAIKV

SEQ ID NO: 158223 - protein, 148 aa, Glycine max
  Coding DNA Sequence Number=SeqID_41445
MARAGDNGGVYHQLDESQRLFLDAWTTQMQRLLNRNKEEPYRRIVKSSSFTLKPLSPREVNLKMSFPRRFLMDCHLQEASLPNKPTYNSKPQETQHKDAQVKVEYVKRLYDQVKAKYSLKAQVEKDEGPSGEGQSPRVEKDEGPSGEG

SEQ ID NO: 158224 - protein, 337 aa, Glycine max
  Coding DNA Sequence Number=SeqID_41446
  Gene Ontology: Mol. function=cysteine-type endopeptidase activity; Cellular component=endoplasmic reticulum; Biological process =proteolysis
  Homolog annotation: Hit_ID=Q6F6A4; Match level="QueryCoverage=97%, HitCoverage=93%, E-value=1e-131, Identity=69%"; Hit description =Cysteine protease
  Pfam annotation: Domain name=Inhibitor_I29; Domain location=38-95; Score=101.7; E_value=2.2e-27; Accession=PF08246.2; Description =Cathepsin propeptide inhibitor domain (
  Pfam annotation: Domain name=Peptidase_C1; Domain location=121-336; Score=452.4; E_value=5.9e-133; Accession=PF00112.13; Description =Papain family cysteine protease
  Pfam module annotation: Pfam domain module=Inhibitor_I29::Peptidase _C1; Domain location=38-95::121-336
MASIGKKQHILALVLLLSICTSQVMSRYLHEASMSERHEQWMKKYGKVYKDAAEKQKRLLIFKDNVEFIESFNAAGNKPYKLGINHLADQTNEEFVASHNGYKHKASHSQTPFKYENVTGVPNAVDWRENGAVTAVKDQGQCGSCWAFSTVAATEGIYQITTSMLMSLSEQELVDCDSVDHGCDGGYMEGGFEFIIKNGGISSEANYPYTAVDGTCDANKEASPAAQIKGYETVPANSEDALQKAVANQPVSVTIDAGGSAFQFYSSGVFTGQCGTQLDHGVTAVGYGSTDDGTQYWIVKNSWGTQWGEEGYIRMQRGTDAQEGLCGIAMDASYPTA

SEQ ID NO: 158225 - protein, 112 aa, Glycine max
  Coding DNA Sequence Number=SeqID_41447
  Gene Ontology: Mol. function=transition metal ion binding; Biological process=cytoskeleton organization and biogenesis
MSKNRVLKEHNNTFLHWFKDTIFVDDNASKTLRKLADGPKRNVITWQGYDISKYSFYTKAQDEKSTMQNSRVTLRVESQHFASVHDDNPSVAFIPYFGFIEEIWELNYVKFT

SEQ ID NO: 158226 - protein, 52 aa, Glycine max
  Coding DNA Sequence Number=SeqID_41448
  Gene Ontology: Mol. function=cysteine-type endopeptidase activity; Cellular component=endoplasmic reticulum; Biological process =proteolysis
  Homolog annotation: Hit_ID=Q38706; Match level="QueryCoverage=92%, HitCoverage=14%, E-value=7e-17, Identity=75%"; Hit description =Cysteine proteinase
MITSTDDGTQYWIVKNSWGTQWGEEGYIRMQGGTDAQEGLCGNSMDAPYPTA

SEQ ID NO: 158227 - protein, 119 aa, Glycine max
  Coding DNA Sequence Number=SeqID_41449
MELVKTQVPQAGMLKSHGCWVHALRGSDIQKGTRVVSRFIDKRSTNRKTISDLDFSSPPAFDNFHTDKSFLFVLAQVESITVAWLGVVRGGAGVRLERDGGGDFVMVFDFTSDRKLSTD

SEQ ID NO: 158228 - protein, 130 aa, Glycine max
  Coding DNA Sequence Number=SeqID_41450
MVRRLFLKQYIALLTTLIIQPAIWALIGTRKKLASIFKFRNLQRLHWWLTNQLLNEKAVLSLKGELEFRTKNIYYGKPFEFFSQGGYSTFNIGADVSTDVETTCNIGTDVETHIYYIVPVTMSCVTSPPM

SEQ ID NO: 158229 - protein, 202 aa, Glycine max
  Coding DNA Sequence Number=SeqID_41451
  Homolog annotation: Hit_ID=Q5VQ79; Match level="QueryCoverage=35%, HitCoverage=12%, E-value=3e-16, Identity=57%"; Hit description =Putative sulfate transporter Sultr3;4
MLLQYHRAVGYPVVVVSCVVRGVGRVNDASTGKSFYGPGGPYAMFAGKDTSRALAKMSKNDDDIPPSLDDLSDKAIDVLNDWENKFQAKYLGISYANLAPPVYVVLGSSMDLAVGHVSIASLVLGSMLTEEVSPSEQPHHFLQLGLTSTFFAGIFQAALGILSVTHSRTELDGSSETEMMVYPPFEFSDVSPPSIITEGTHG

SEQ ID NO: 158230 - protein, 45 aa, Glycine max
  Coding DNA Sequence Number=SeqID_41452
MEIQVLGHKGVFYILLTGKEKKVLLCFDVVVDNWRSLAGSGSYAE

SEQ ID NO: 158231 - protein, 92 aa, Glycine max
  Coding DNA Sequence Number=SeqID_41453
MLKSDTSFRVETVAKSMASSWNSHTTEKIEGNKLSGFLRFHWRRGEWGRRTNVELGVVVAPGRRWRKCNGKRREEEQLASGERNRRQLGFAL

SEQ ID NO: 158232 - protein, 100 aa, Glycine max
  Coding DNA Sequence Number=SeqID_41454
  Subcellular localization annotation: CTP_CleavageSite=28; ConfidenceScore=5.57e-01
MCGPLKVRACSPLKVRTCGPLKVRTYSPLMARTCSPLKVRVCSPLKVRTCSPLKARACSPLRVRIDYPSERSDNSCNLILSFANLSGNSLRVYVLFDLVT

SEQ ID NO: 158233 - protein, 50 aa, Glycine max
  Coding DNA Sequence Number=SeqID_41455
MDTSEPYTGAMRGTVHEPQVPNYKVVTKDNNWYLKALHWGNEGASCMSLK

SEQ ID NO: 158234 - protein, 73 aa, Glycine max
  Coding DNA Sequence Number=SeqID_41456
MGAKYLEVVKRGSYPNNGWSPDEIRIMLRKWLMDRDTLGYSRWRGSENLGELVNGNYPAFGGVGNSQASLYSS

SEQ ID NO: 158235 - protein, 169 aa, Glycine max
  Coding DNA Sequence Number=SeqID_41457
  Gene Ontology: Mol. function=hydrolase activity; Biological process =metabolic process
  Homolog annotation: Hit_ID=Q3V8K1; Match level="QueryCoverage=88%, HitCoverage=32%, E-value=4e-34, Identity=49%"; Hit description =Amidohydrolase
MTDYIRNIVNNQTENAPVTLIRGATILSMDENVGNHERGDILVTGSTITAIGKDLNAEGAHVIDATNMIAMPGMVDSHRHAWEGQLRRINPNATCLDDYSNATHFSFAKYYRPADIYVGNLLTALGAIDAGITTMIDNSHNSRTAAHSDAAVEALLDAGIRAIHASGAP

SEQ ID NO: 158236 - protein, 320 aa, Glycine max
  Coding DNA Sequence Number=SeqID_41458
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=95%, HitCoverage=89%, E-value=1e-116, Identity=65%"; Hit description =Peptidase C1A, papain
  Pfam annotation: Domain name=Inhibitor_I29; Domain location=14-71; Score=91.8; E_value=2.2e-24; Accession=PF08246.2; Description =Cathepsin propeptide inhibitor domain (
  Pfam annotation: Domain name=Peptidase_C1; Domain location=103-319; Score=409.3; E_value=5.6e-120; Accession=PF00112.13; Description =Papain family cysteine protease
  Pfam module annotation: Pfam domain module=Inhibitor_I29::Peptidase _C1; Domain location=14-71::103-319
MSRRLSEAYSSVKHEKWMAQYGKVYKDAAEKEKRFQIFKNNVHFIESFHAAGDKPFNLSINQFADLHNEEFKALLINGQKKEHNVRTATATEASFKYDSVTRIPSSLDWRKRGAVTPIKDQGTCRSCWAFSTVATIEGLHQITKGELVSLSEQELVDCVKGDSEGCYGGYVEDAFEFIAKKGGVASETHYPYKGVNKTCKVKKETHGVVQIKGYEQVPSNSEKALLKAVAHQPVSAYVEAGGYAFQFYSSGIFTGKCGTDIDHSVTVVGYGKARGGNKYWLVKNSWGTEWGEKGYIRMKRDIRAKEGLCGIATGALYPTA

SEQ ID NO: 158237 - protein, 240 aa, Glycine max
  Coding DNA Sequence Number=SeqID_41459
  Gene Ontology: Mol. function=cysteine-type endopeptidase activity; Cellular component=endoplasmic reticulum; Biological process =proteolysis
  Homolog annotation: Hit_ID=Q38706; Match level="QueryCoverage=99%, HitCoverage=71%, E-value=4e-89, Identity=65%"; Hit description =Cysteine proteinase
  Pfam annotation: Domain name=Peptidase_C1; Domain location=31-239; Score=389.8; E_value=4e-114; Accession=PF00112.13; Description =Papain family cysteine protease
MASHKGYKGSHWQGLRITTQTPFKYENVTDIPWAVDWRQKGDATSIKDQGQCAVAATEGIYQITTGNLVSLSEQELVDCDSVDHGCDGGLMEHGFEFIIKNGGISSEANYPYTAVNGTCDTNKEASPGAQIKGYETVPVNCEEELQKAVANQPVSVSIDAGGSAFQFYSSGVFTGQCGTQLDHGVTAVGYGSTDDGIQYWIVKNSWGTQWGEEGYIRMLRGIDAQEGLCGIAMDASYPTA

SEQ ID NO: 158238 - protein, 76 aa, Glycine max
  Coding DNA Sequence Number=SeqID_41460
  Gene Ontology: Mol. function=cysteine-type endopeptidase activity; Biological process=proteolysis
  Homolog annotation: Hit_ID=Q9AUC7; Match level="QueryCoverage=80%, HitCoverage=19%, E-value=3e-11, Identity=50%"; Hit description =Cysteine proteinase
MVAQASGNKPYKLSINHLADQTNEEYKGSHWQGLRITTQTPFKYENVTDIPWAVDWRQKGDVTSIKEYHHQCYHDQ

SEQ ID NO: 158239 - protein, 140 aa, Glycine max
  Coding DNA Sequence Number=SeqID_41461
MGCTHGPEIYPKAHENPRAFSCIFGPIFLESSIQCPWGVGLHHNPDLKHVVVCNNLLKVKTKSTQCSTIKQLDFVFSDPKSTTSKKILEEVVLIPRVAMAKEERLSSPTMEARKHVIADNGSNGAGFVRENHYGPRERRL

SEQ ID NO: 158240 - protein, 97 aa, Glycine max
  Coding DNA Sequence Number=SeqID_41462
  Homolog annotation: Hit_ID=Q27TE8; Match level="QueryCoverage=33%, HitCoverage=47%, E-value=8e-08, Identity=84%"; Hit description=InsA
MDAWIYLFCEVILGHRGAPVASVSISSPSCSATDGVVGNGKSTTGHKGATGGLPRRSPILVLLSPKHGYRGSSDGLRGISAGMMAHDKYCTINYYIP

SEQ ID NO: 158241 - protein, 104 aa, Glycine max
  Coding DNA Sequence Number=SeqID_41463
MVLIFNDDPTVNHSEIVIFMRQIKQVNNTRELLTQFGATSPTSGGYQAREEIHYNSDNIKVAHKTLKSQNSQNNSSISDLVIKPVQPSCLYSSVRIWAATTCAG

SEQ ID NO: 158242 - protein, 178 aa, Glycine max
  Coding DNA Sequence Number=SeqID_41464
  Gene Ontology: Mol. function=RNA-directed DNA polymerase activity; Biological process=RNA-dependent DNA replication
  Homolog annotation: Hit_ID=Q2AA34; Match level="QueryCoverage=68%, HitCoverage=39%, E-value=7e-14, Identity=28%"; Hit description =F7F22.15, related
LPSQSVQNPKNVSAITLRSGKQCQEPQPANEPAQPHSTPEKDDDKNLKKKQYIPLPFPPRAIYNKKMEEAEKEILETFRKVEELCTNKRKLNGSERISMGRNVSALIGPFQPTDVVIHLANRSVAYPAGFIEDVLVKVGELIFPVDFYILNMEEGFSKGSVSIILGKPFMKTARTKID

SEQ ID NO: 158243 - protein, 211 aa, Glycine max
  Coding DNA Sequence Number=SeqID_41465
MKMKANKTRNELKVSDSKTYRLKNEERRKIFTESPTETSWKRYGGTSAWIFFTETQKSREACRPARPGALCSPWRVGGFLRKFPKAPPFYKGYKNFTEAPKAIFQQNVGGGCRPTRLGKLGLKIAIHTPSLISSTPIFVFFGCFPFETSRNFTDSTTMGVKHFEVVKRRSHADKQWSPNEIRRINKGRRVLRSTGEKDIEVFEVKTLSSLK

SEQ ID NO: 158244 - protein, 103 aa, Glycine max
  Coding DNA Sequence Number=SeqID_41466
MCLSGKERNTGSNKDRRESLKVYQSHTVRGEKVASAQDFVGNQRERTTLGRGLTFSPWVKVYDKLGFWFKACRTAGHDICQGLASGSGIKGMSYIISMIHMQQ

SEQ ID NO: 158245 - protein, 110 aa, Glycine max
  Coding DNA Sequence Number=SeqID_41467
MVIPKFKVPDFDEYKGTTCPKNHLKMYCRKMRAYAKDEELLIHFFQESLTGVAVTRWRDLATQVAPPIIEKEIITIIVGTLPVFYYEKWWVTHLQVLQIWSSPAKGSKWV

SEQ ID NO: 158246 - protein, 64 aa, Glycine max
  Coding DNA Sequence Number=SeqID_41468
MVFFVSYTKAKAENAQVRNSLGHGNVVHTLDIISKIPMIFSGNIELLKANCRAICKVSQCFGRK

SEQ ID NO: 158247 - protein, 370 aa, Glycine max
  Coding DNA Sequence Number=SeqID_41469
  Gene Ontology: Mol. function=gamma-glutamyltransferase activity; Cellular component=integral to membrane; Biological process =tetrapyrrole biosynthetic process
  Homolog annotation: Hit_ID=Q2KWR3; Match level="QueryCoverage=97%, HitCoverage=59%, E-value=1e-164, Identity=79%"; Hit description =Gamma-glutamyltranspeptidase
VLRGLLADEGAARVVVLVGQQLRQRHVDEGGIAVVGLAVGEGQLHGFGDAVHELGAGRADAGQVHVLEQRQGLQEYRPLAPGARLGHGVAVVVIGGGLVVAGRPAGQVVGGDHAAMALAAFVHDLVAARESVDGLGHEAAVEGVAGRLDLALAVGAGLFRFPQHAGPGGGQRRVAEQLAGLGHVAAGQVDLRGGGPVGLEEVLQAGDGVGDTRHQRVAVFGVIDGGFQHVAHAHGAVVAQQLHPGVEGAGNHGGQQAVAGDQLETFGAVALERGGGGRGALAAQHFDAAGAGGMEHRRHFAGRADQVGLDHLQHECGGDTGVERVAAALEQRHAGRAGQPMGGGHDTEGAEDFRASRKHGAILLRTAHGR

SEQ ID NO: 158248 - protein, 68 aa, Glycine max
  Coding DNA Sequence Number=SeqID_41470
MESYYNYRKQMEENEVTPIILGQLFLNTRGTLIDVKEGKLTWWLGDEEEVFKATNKIIVIFSSNIHKP

SEQ ID NO: 158249 - protein, 122 aa, Glycine max
  Coding DNA Sequence Number=SeqID_41471
MKEVVLVVAVVTIMLVATVVGDGGCGDGGGNCSGGDGGVIVGSNGGGNNDSVDDTNGGGGNNVGGDMWQSDGGSNVGDVGFDDGGDSGASGGSDQDDIGDGRGDNGNGGDTGYDSTKCHYQM

SEQ ID NO: 158250 - protein, 169 aa, Glycine max
  Coding DNA Sequence Number=SeqID_41472
  Gene Ontology: Mol. function=DNA binding
  Homolog annotation: Hit_ID=Q1SFS3; Match level="QueryCoverage=89%, HitCoverage=32%, E-value=2e-12, Identity=35%"; Hit description =Lambda repressor-like, DNA-binding
MGLGQVPSLKKRFYQVKIKSLGVASLKELGQLMGQLQRQAFHKVYGMIWDLTMAEVSREAIASLAQYYDQPLRCFTFGNFQLTPTVEEFEEILGCPLGGRKLQNLDTGIGPREASRKWGGWDTKEMFGSKGESLGKSRRMGPVHGHPGTPDLRGGPLSKCGWIGGPGSN

SEQ ID NO: 158251 - protein, 171 aa, Glycine max
  Coding DNA Sequence Number=SeqID_41473
  Homolog annotation: Hit_ID=Q2HPL4; Match level="QueryCoverage=80%, HitCoverage=57%, E-value=2e-62, Identity=81%"; Hit description=Expp1 protein precursor
MVLQRFCSNRIEMRISGHGDLHWDPLNHLLPYDSYGGYMVAFAGRKYAARSPLAFVANSTYTVTSFTLVLEFQRGRLQNFYWKRDGCSSCKEKSNFICLNKQDCAIRTSSCKGRGGAVDCSLGIQLAFSGTDRHLRVLNSWFEVENLRQYSLYGLYSNLRDSLTGQYNKFF

SEQ ID NO: 158252 - protein, 112 aa, Glycine max
  Coding DNA Sequence Number=SeqID_41474
  Gene Ontology: Mol. function=DNA binding; Cellular component=nucleus; Biological process=DNA integration
  Homolog annotation: Hit_ID=Q8RUQ2; Match level="QueryCoverage=97%, HitCoverage=11%, E-value=2e-28, Identity=54%"; Hit description =Putative retroelement
MELEKPDVKTAFLHGRLKEDIMMQQPKGFEVEGKENFVCRLKRSSNDSCVYHSKVKDGSHINLLFYVDDMLIASQKLLAIQKLKSILSSEFEMKDMRVSKKIMGMEIKSDRV

SEQ ID NO: 158253 - protein, 72 aa, Glycine max
  Coding DNA Sequence Number=SeqID_41475
MVNPEKEHWQAMKDIFRFGCNEICDWVRVHDWKLSYHFKDNTSAHNDFIHYIGRVHGSGRSNKGRDLAKGLD

SEQ ID NO: 158254 - protein, 192 aa, Glycine max
  Coding DNA Sequence Number=SeqID_41476
  Gene Ontology: Mol. function=nucleic acid binding; Cellular component= intracellular; Biological process=DNA integration
MSSWVTMFLLSMSVEGGVIQIRGKEKYVVMQGTKQENLYIHHGSSVIGFVSNVSQSSSHMSNDNSLWHMRHGHMLSRETVGITCYHMNRSPSIAIDFKTPVDVWSNKLVEYSMLNVFGCSTYYHVAKDIDSFKPSIYQEAISCSKVEEWTKGMIEEMESLQKNQTWDLVHLLEGKTSNEVQVDLQEEIWIIH

SEQ ID NO: 158255 - protein, 209 aa, Glycine max
  Coding DNA Sequence Number=SeqID_41477
MEESTHLKSNMECIEEEIAKLASNQLHITTYLDEIIQCITVLETSQQQSPSPSSSSANPYPISPSSHLPRMKLEAPRFDGSDPLGWIFKINQFFKYHTTPKPECLVIASFSMKGLALAWFMWMTRNDQISSWSVQALQPLTLVQAAGLARLQEEKIAEHQHSFHGRMHSGPGPGPSSSFTAIFTSITFTNETASPTCQALISRGDGDSM

SEQ ID NO: 158256 - protein, 72 aa, Glycine max
  Coding DNA Sequence Number=SeqID_41478
MKAAMKVAMSNDGSNEGCDRSPNLSHKNDDLGLIHRWIVVKFKQHVCNPFPSILTVGNFDIMSDLREIPLVL

SEQ ID NO: 158257 - protein, 97 aa, Glycine max
  Coding DNA Sequence Number=SeqID_41479
MLRVTLKLNHIVTTIVTKRRVCILYSIARGSKVIESMATNNMSQKPILLSNLASTVKQVPSNFIKSLDDRSTLQDFQLRVRIGQAKSGFERPESSLR

SEQ ID NO: 158258 - protein, 258 aa, Glycine max
  Coding DNA Sequence Number=SeqID_41480
  Gene Ontology: Mol. function=methyltransferase activity
  Homolog annotation: Hit_ID=Q012S8; Match level="QueryCoverage=54%, HitCoverage=39%, E-value=2e-21, Identity=37%"; Hit description=[R] KOG2782 Putative SAM dependent methyltransferases
  Pfam annotation: Domain name=Methyltransf_5; Domain location=82-251; Score=-150.8; E_value=0.0028; Accession=PF01795.10; Description=MraW methylase family
  Subcellular localization annotation: CTP_CleavageSite=47; ConfidenceScore=5.43e-01
MTMLSKISSSLLLSLSSKPKPKPICNPFLLSRSAATKHQKNKKENAKAALAKEKRRTRSDKQFNRDAIIERCRINDIDTDTKFSHVPVMLGEVLDVFSNSTLTSFVDCTLGAAGHSTAVIRGHPELKYLVGMDVDSLAHDIAQPRLDAVLNAGVKAITVLRNFRDVKSVLREIAELHLLGVDAILMDLGMSSMQVHSTTLYVYPFFTYLHAHVPNSVLKHIASHLQTYRDASNPCFFVLCPFHALNLKASSTASTYHI

SEQ ID NO: 158259 - protein, 306 aa, Glycine max
  Coding DNA Sequence Number=SeqID_41481
  Gene Ontology: Mol. function=acetolactate synthase activity; Biological process=branched chain family amino acid biosynthetic process
  Homolog annotation: Hit_ID=P00894; Match level="QueryCoverage=40%, HitCoverage=76%, E-value=1e-57, Identity=92%"; Hit description =Acetolactate synthase isozyme III small subunit
  Pfam annotation: Domain name=LacI; Domain location=266-291; Score =40.3; E_value=6.8e-09; Accession=PF00356.11; Description=Bacterial regulatory proteins, lacI f
  Pfam annotation: Domain name=TPP_enzyme_C; Domain location=1-123; Score=150.4; E_value=4.6e-42; Accession=PF02775.11; Description =Thiamine pyrophosphate enzyme, C-term
  Pfam module annotation: Pfam domain module=LacI::TPP_enzyme_C; Domain location=266-291::1-123
MGFGLPAALGVKLALPNETVVCVTGDGSIQMNIQELSTALQYELPVLVLNLNNGYLGMVKQWQDMIYSGRHSQSYMKSLPDFVRLAEAYGHVGMRVTEPAELETKLAEALEHVKNNRLVFMDVIVDGTEHRGYNIESLTVAPTDDPTLSRMTIQTVGDAKVLEQIEKQLHKLVDVLRVSELGQGAYVEREVMLVKIQASGYGREEVKRNADIFRGQIIDVTPSLYTVQLVGTSDKLDAFLASVRDVAKIVEVARSADNADKSGAIVKLDEIARLAGVSRTTASYVINGKAKQYRVSDKTVEKVMAV

SEQ ID NO: 158260 - protein, 124 aa, Glycine max
  Coding DNA Sequence Number=SeqID_41482
MCKISHGYSQDDVPKWKTPHDSEISKNTIDNNEVNTNVIVQTTCMHKTKVNQNERNVSPLVKTKDSIQMINDGTYEFGDPTVMWLRMPPDSWVTVTKSGVVDKSRAFAPTYPQFVMRNSDLRSS

SEQ ID NO: 158261 - protein, 150 aa, Glycine max
  Coding DNA Sequence Number=SeqID_41483
RGRDEDYRTGRKQARDEDEHRERKFRRNEDDREGRKFRRDDDVYGERKNLRDGDVHGERKNLRENDDRERKHSKDEDGRGERKHRRDDDDDDGYERKQRRRDDDDPEERKQHSRDDDGRGDRKHRREEEERGNKGYERESRGDYSKRGRY

SEQ ID NO: 158262 - protein, 74 aa, Glycine max; identical to SEQ ID NO: 124892
  Coding DNA Sequence Number=SeqID_41484

SEQ ID NO: 158263 - protein, 101 aa, Glycine max
  Coding DNA Sequence Number=SeqID_41485
  Gene Ontology: Mol. function=methyltransferase activity
  Homolog annotation: Hit_ID=Q6YXY1; Match level="QueryCoverage=97%, HitCoverage=27%, E-value=1e-20, Identity=50%"; Hit description =Putative methyltransferase
MATRVFQALRIAVNDDLEDRIVKQTFLNIIKGREDVEERESLNSVLRNTSDEIKEKEAWIKQVIYGSNGTILTKRPITPSGEEEKLNRRSRSAKLRVIQKH

SEQ ID NO: 158264 - protein, 135 aa, Glycine max
  Coding DNA Sequence Number=SeqID_41486
MTQELVARRDTFRLSAPRHSVSPSVIDEQRPMWSSAPFPEMIRRSKSLAFVDRAAFCYHDPRAGSPRRHLTVIRTLLSSRGGGPDDKQRPGFDEDITKGKDHEALEGPMTRGRLKQAQHVIETRLVICIAAIDDD

SEQ ID NO: 158265 - protein, 265 aa, Glycine max
  Coding DNA Sequence Number=SeqID_41487
  Homolog annotation: Hit_ID=Q1RYJ7; Match level="QueryCoverage=96%, HitCoverage=24%, E-value=2e-74, Identity=47%"; Hit description =Timeless protein; Timeless C-terminal
MVLPHFKHSRFKDDQHCSHRIAEVLDLDGKISPAQISNMLKRLGLVVAPRRKMCDADAKGPLSTSPNLLDGDKITGATNHKSVNLEGSLLVQHLQNKKRVQAFNKDQEALIKVLYEQFKDYRRCSYMIANALDKDGKFTTAQVSRKLKQLGLSLPLKSSGGKMHPKGADLMDRSNERMDESDDETLVSLVKRKKMESGKLSRGQLHGQTSQDKLSKGDSDDEMLSFVLKKKINSKVSTEQLLEPINVDSSSRDDSDYEMLSSALK

SEQ ID NO: 158266 - protein, 121 aa, Glycine max
  Coding DNA Sequence Number=SeqID_41488
  Homolog annotation: Hit_ID=Q1RYJ7; Match level="QueryCoverage=75%, HitCoverage=7%, E-value=1e-22, Identity=65%"; Hit description =Timeless protein; Timeless C-terminal
MGDDSFNGGITEVSEGKMLKKMKKQPLLFVELLFWKTRRECHYVNAEYLLSELEEIGSSPENLKKESANWNKTQGDEEIGSSPAKVWTQDIKKTSLMMLLKALHLPLAVTVTKMIISTFTT

SEQ ID NO: 158267 - protein, 115 aa, Glycine max
  Coding DNA Sequence Number=SeqID_41489
MGAVSYFIGLRDYLEALTRYEGVKEFHFEKLLHHGQNVKSGRRHSSQHVLTFTRDKAISGGWTWDDHNCYPDLVEIIHKVVKLMDNLQSRGALRRYTKAINEPSLVAQHFWRVSP

SEQ ID NO: 158268 - protein, 218 aa, Glycine max
  Coding DNA Sequence Number=SeqID_41490
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-27, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GFHVLTFRGLHTLICRGLCVLPLRGLHAIAFRGLHSLIFRGLYVLPLRGLHVLAFGGLHALAFRGLHVLAIRGLHVLAFRGLHVLTFRGLHTLICRGLCVRPLRGLHALAFRGLHTLIFRGLYVLPLRGQHVIAFIGLHALAFRGLHVLAFRGLHILTFRGLHTLIFRGLHVLTFRGLHTLICRGLCVLPFRGIHTLAFSGLHALAFRGLHALTFRGL

SEQ ID NO: 158269 - protein, 123 aa, Glycine max
  Coding DNA Sequence Number=SeqID_41491
  Gene Ontology: Mol. function=catalytic activity; Biological process =metabolic process
MAIWQPTVQMLVNDLMCKVLPIALKKRNDCEELAITTVVSGNLEELNAHETVNEERVSKILDVHVHVETYVPPTFGIWGNGVHLAVVGYGRNVVAAKYSDWVRNSLSVLPPACMCCLMTWLLR

SEQ ID NO: 158270 - protein, 100 aa, Glycine max
  Coding DNA Sequence Number=SeqID_41492
  Subcellular localization annotation: CTP_CleavageSite=34; ConfidenceScore=5.04e-01
SIRGARKARARPTDFPSTFAAPTLASTSAAPLVLAQIDSQRFEAMLQSIHQGQIILLQSLQVVAPPGSMLSIEQFLERVAWPGAQPSLHREDEGPTTQEP

SEQ ID NO: 158271 - protein, 81 aa, Glycine max
  Coding DNA Sequence Number=SeqID_41493
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=75%, HitCoverage=28%, E-value=1e-18, Identity=72%"; Hit description =Inorganic pyrophosphatase
MSDNGEEAGENCPVPHLNERILSSLSRRSVVAHPWHDLEIGPEAPQIFNCVVEITKGSKVMYELDQKIGLIKVEANKIGEG

SEQ ID NO: 158272 - protein, 137 aa, Glycine max
  Coding DNA Sequence Number=SeqID_41494
  Subcellular localization annotation: CTP_CleavageSite=40; ConfidenceScore=5.10e-01
MYPPLELIHKRCSLSCSQSTTQVDVPSTCTTKDVPSNVLRQSSQAGKIKRILRLCRFEFFDKGEGRHKRIQAVSPAFFWKREKRDTKRIQVKNLEGFWQKKKKKKFKEIQKSIGKKLLKCKSRSCFYRLFMSGQKNH

SEQ ID NO: 158273 - protein, 217 aa, Glycine max
  Coding DNA Sequence Number=SeqID_41495
  Homolog annotation: Hit_ID=Q1RUD8; Match level="QueryCoverage=64%, HitCoverage=37%, E-value=4e-10, Identity=29%"; Hit description=IMP dehydrogenase/GMP reductase
MGWLGYQGTAWRRQKLWRIKGPIDAFLAYHHSKESLVIAVLANEYDTFNLRCEKSIARIVYCTPALYVWLVSHIFCHEGFPNIPLIGTRGCINYNPMLAIRQLGYPMRGAPLEEIIAPFVARGFNEANVRILQRIHKAWNTVERKDKELRGSSNGVISGYHKWLRFRRQGITWLPKLKGPSGKEAEVLEESEEVQALKAELERMIMVKEKLKTTVTR

SEQ ID NO: 158274 - protein, 98 aa, Glycine max
  Coding DNA Sequence Number=SeqID_41496
  Subcellular localization annotation: CTP_CleavageSite=34; ConfidenceScore=5.77e-01
MATPPSSPPPPSPTDSTSHSPSTIKRTRKVTRLRSMATRPVRTKRPRVHVDPATGKTDADKDGVDDTVCKKYDISKEKWTQFCQSHRDPSWEDVRKKA

SEQ ID NO: 158275 - protein, 82 aa, Glycine max
  Coding DNA Sequence Number=SeqID_41497
MTYPDVYWAELDFSAYVFPTLSPVLMFAQLLEDLPVPQVLFRQLCMQISSTIISSERGLDDVSFESEGTRLTPLPVHEGFVV

SEQ ID NO: 158276 - protein, 125 aa, Glycine max
  Coding DNA Sequence Number=SeqID_41498
MTKCTTCCQCSCFPNSNSEMKLHKVNEGWVESFNGVADTISLPDCLIYIHLVDIFLQIFIMNPPEEPCKEQGGSTMLMETSHARNRRNHSRTIAGGAVARRSSTMLLETSRCRTSRLQKNLSEFA

SEQ ID NO: 158277 - protein, 214 aa, Glycine max
  Coding DNA Sequence Number=SeqID_41499
  Gene Ontology: Mol. function=nucleoside-triphosphatase activity; Cellular component=cytoplasm; Biological process=defense response
  Homolog annotation: Hit_ID=Q1STU9; Match level="QueryCoverage=64%, HitCoverage=11%, E-value=7e-23, Identity=38%"; Hit description=H+ -transporting two-sector ATPase, alpha/beta subunit, central region; Disease resistance protein
MSNLCLQKEEECGANAGSDFSSGRHGSIMPPESTTIILNDIMTALRQPNIGILGMYGSSNANTENAVEKVTRRVERDGLFNVVVKTCVMKKSDLKKIQGELGNALGLQLHQKTLVERATRLCERIKMEDNILIILHDLQAQINLAKIGIPFGNDHKGCKILLVAKNKEVLSHKMKTQIEFAVDEEPSSSGLTRSHQVQTRGVIVWIKRWWCPVQ

SEQ ID NO: 158278 - protein, 62 aa, Glycine max
  Coding DNA Sequence Number=SeqID_41500
MQWNCGIKLQESTALHYKNVKGARKGEKQANKTDRSNSSCQKTQFHCLPHIIDDEDDEPVGN

SEQ ID NO: 158279 - protein, 81 aa, Glycine max
  Coding DNA Sequence Number=SeqID_41501
MGAIVSIARKLCLIFRTKCRMDEWEEEPLESQLRSRSYAWSFSGREVSKSTISIVNKIMRVQAKPNIFTLGVYESLMRESA

SEQ ID NO: 158280 - protein, 56 aa, Glycine max
  Coding DNA Sequence Number=SeqID_41502
MMEIKHRKFCLAEEYFEEEDENAEKMGHVTGEPEDVHGFCPSETHRENVQKRKEGT

SEQ ID NO: 158281 - protein, 281 aa, Glycine max
  Coding DNA Sequence Number=SeqID_41503
  Gene Ontology: Mol. function=GPI anchor binding; Cellular component =membrane; Biological process=cell adhesion
  Homolog annotation: Hit_ID=Q1RVI7; Match level="QueryCoverage=74%, HitCoverage=72%, E-value=1e-80, Identity=75%"; Hit description =Fasciclin domain, putative
  Pfam annotation: Domain name=Fasciclin; Domain location=77-211; Score= 86.2; E_value=9.8e-23; Accession=PF02469.12; Description=Fasciclin domain
  Subcellular localization annotation: CTP_CleavageSite=25; ConfidenceScore=5.25e-01
MKQTLLFSLLLLAPVFSITTLAQSPAAAPKAPAKPAPATPAPVPAKPLVPSLPQSPSSGADSSGSQDIVKILRKAKSFNTLIRLLKTTQIINQVNAQLVTSKNGGLTILAPDDGAFSELKAGYFNSLGDRQQKALIQYHVLPVYVSSSNFDALSNPVLTLASDSPTGYQLNVTAYGNSVNISTGVVNATLTGIVYTDKTLAIYHVDRVLIPLDFSKPKPIAPAPAVAKAPKADKENSSAEDEDQSQAAKDSSGATSFVSIHGTTLVSFGVALLAATATMSF

SEQ ID NO: 158282 - protein, 315 aa, Glycine max
  Coding DNA Sequence Number=SeqID_41504
  Gene Ontology: Biological process=cell adhesion
  Homolog annotation: Hit_ID=Q1RVI6; Match level="QueryCoverage=52%, HitCoverage=53%, E-value=2e-63, Identity=78%"; Hit description =Fasciclin domain, putative
  Pfam annotation: Domain name=Fasciclin; Domain location=102-237; Score=103.5; E_value=6.4e-28; Accession=PF02469.12; Description =Fasciclin domain
  Subcellular localization annotation: CTP_CleavageSite=57; ConfidenceScore=5.07e-01
MMIMQETQSLIIPTTILILALFYTTSAQLSPIQPPKTSPSPPLSQPSPPSPALPSPPATAPAPGFNTVPLVPVTPSGAPTPTTIIPKGPTIDIVQILRKAKRFSVLIRLLKTTQLINQLNSQLVTSSSGGLTLFAPEDSAFSKLKAGFLNSLTDRQKVELLQFHTLSSCISISNFDTLTNPVQTQAGDDPQRLQLNVTTYSGSQVSMATGAVNASVTGTVYSDNKLAIYQVDKVLLPLDLVLPSKAPAPAPALAKKGLPKADKGNSTAADDGATGGDDDSDGKALQAGVSAGCSMKWVNNVVVIGVVGLVGGVLM

SEQ ID NO: 158283 - protein, 245 aa, Glycine max
  Coding DNA Sequence Number=SeqID_41505
  Gene Ontology: Mol. function=ubiquitin-protein ligase activity; Cellular component=ubiquitin ligase complex; Biological process =defense response to fungus, incompatible interaction
  Homolog annotation: Hit_ID=Q9C7R6; Match level="QueryCoverage=99%, HitCoverage=35%, E-value=1e-65, Identity=52%"; Hit description=Arm repeat-containing protein, putative; 6839-9028
MASAAIFSSLRRRRSPSLEAFLAPVDLSDVALLGTLISVAGDIASCFSGHRFPFQRRNSRALIGKVEIFRSMLGCLRDSATAGALPPTAVLCLKELYLLLYRSKILLDYCAQSSKLWLLLQNHCVSGHFHDLSQEFSTLLDVFPVGEVGLSDDVREQIELLQRQSKRAKLFIDNKDDVLRIRLFWFLDEFESGRVPDSKDLRCFFVDKLRILDGKSCRVEVEALEEQIVNHEGDVEPTVAVLNGM

SEQ ID NO: 158284 - protein, 424 aa, Glycine max
  Coding DNA Sequence Number=SeqID_41506
  Gene Ontology: Mol. function=sequence-specific DNA binding; Cellular component=nucleus; Biological process=regulation of transcription, DNA-dependent
  Homolog annotation: Hit_ID=Q940V6; Match level="QueryCoverage=95%, HitCoverage=98%, E-value=0.0, Identity=80%"; Hit description=Heat shock transcription factor
  Pfam annotation: Domain name=HSF_DNA-bind; Domain location=12-189; Score=171.3; E_value=2.5e-48; Accession=PF00447.8; Description=HSF -type DNA-binding
MDDAQGSSNSLPPFLAKTYEMVDDPSTDSVVSWSVTSKSFIVWNPPEFARDLLPRFFKHNNFSSFIRQLNTYVSKFDLDLVDGFKKVDPEQWEFANDDFVRGQPHLMKNIHRRKPVHSHSLQNLQAQGPLGESERQSFTDEIEKLKHDKEQLLVELQKYQHEWQAYEIQIHCSKDRLEKLEQNQQRMVSSVSHVLQKPVISVNILPLTETLDRKRRLPRSGHFYDEDGVEDAIETCQMLPRENADHTTVLTLNVERLDQLESSMAFWEAIVHDIGDTFVQIQSSMDLDESTSCADSPSLSCAQLDVEVRHKSPGIDMNSEPTTAAVPEPVASKEQPAGTTVAATGVNDVFWEQFLTEDPGASETREVQSERKDYEGRKNEGKPSDLNKFWWNKRNANNLPEQMGHGGSDAVVDINSTTTMSSTI

SEQ ID NO: 158285 - protein, 449 aa, Glycine max
  Coding DNA Sequence Number=SeqID_41507
  Gene Ontology: Mol. function=ubiquitin-protein ligase activity; Cellular component=ubiquitin ligase complex; Biological process =protein ubiquitination
  Homolog annotation: Hit_ID=Q84QD7; Match level="QueryCoverage=99%, HitCoverage=61%, E-value=1e-171, Identity=70%"; Hit description =Avr9/Cf-9 rapidly elicited protein 276
  Pfam annotation: Domain name=Arm; Domain location=154-194; Score =42.6; E_value=1.3e-09; Accession=PF00514.13; Description =Armadillobeta-catenin-like repeat
  Pfam annotation: Domain name=Arm; Domain location=195-237; Score =14.4; E_value=0.19; Accession=PF00514.13; Description=Armadillobeta -catenin-like repeat
  Pfam annotation: Domain name=Arm; Domain location=239-279; Score =21.1; E_value=0.0039; Accession=PF00514.13; Description =Armadillobeta-catenin-like repeat
  Pfam annotation: Domain name=Arm; Domain location=280-318; Score =15.4; E_value=0.15; Accession=PF00514.13; Description=Armadillobeta -catenin-like repeat
  Pfam annotation: Domain name=Arm; Domain location=319-360; Score =12.8; E_value=0.31; Accession=PF00514.13; Description=Armadillobeta -catenin-like repeat
  Pfam annotation: Domain name=U-box; Domain location=20-94; Score =76.4; E_value=8.7e-20; Accession=PF04564.6; Description=U-box domain
  Pfam module annotation: Pfam domain module=Arm::Arm::Arm::Arm::Arm::U- box; Domain location=154-194::195-237::239-279::280-318::319-360::20 -94
MQKKGGKRLITLEIAETFLTVPKEFCCPISLDLMCDPVIISTGQTYDRRSIWRWMEEGHCTCPKTGLLVSHNRLVPNRALRNLIMQWCSAHGVPYDPPEGVDASVEMFLSACPSKASLEANQGTATLLIQQLADGSHAAKTVAAREIRLLAKTGKENRAFIAQAGAIPHLRNLLSSPSAVAQENSVTALLNLSIFERNKSMIMEEEGCLGSIVEVLRFGHTTEARENAAATLFSLSAVHDYKKRIADNVGAVEALAWLLQKGTQRGKKDAVTALFNLSTHTENCLRMIEAGAVKAMVVALGNEVVAEEAAGALVLIVRQPVGAMAVVREEAAITGLIGMMRCGTPRGKENAVAALLELCRSGGAAATQRVVRVPALAGLLQTLLFTGTKRARRKAASLARVFQRRENASLHYAGLGVGYAFASDSASTRNTATFVSDVSLPMSISVSVL

SEQ ID NO: 158286 - protein, 101 aa, Glycine max
  Coding DNA Sequence Number=SeqID_41508
MDLCDKVGSDKGCTQREGEALRNKGGAKGPHAMMKEEQRGPRTRMKEVAVLRHVKGWSEGRWRWQGGGGVAAGRRWRIGVGEEEVGKVMTLRIANLFEGFI

SEQ ID NO: 158287 - protein, 91 aa, Glycine max
  Coding DNA Sequence Number=SeqID_41509
MKMKASKTRNELKVSDSNSYRLKNEKRTKKSEEWRKIFTDLLTETSRKRYGSTSTRFFFTETWFLPKIAEMHSLGGKREVLAAQRLLEEDF

SEQ ID NO: 158288 - protein, 50 aa, Glycine max
  Coding DNA Sequence Number=SeqID_41510
  Subcellular localization annotation: CTP_CleavageSite=22; ConfidenceScore=5.15e-01
MDSGRFQVSVPGSSHPRQVVPLFSSKFDTLNLGGVMILGTRNNSSRLAKA

SEQ ID NO: 158289 - protein, 84 aa, Glycine max
  Coding DNA Sequence Number=SeqID_41511
MTPSQQYHGPIPTPNAPLGTQWNVPGQIPNTGDLFGVDLRHAFSAEADEEEAGRHRGRRNPDRQARRWDRPCGTSSRHHGHQNE

SEQ ID NO: 158290 - protein, 91 aa, Glycine max
  Coding DNA Sequence Number=SeqID_41512
MELVFPQHHRTIAGLQKYQCDDPEKDIDTSGSDTQQMFVACNTFHGHAPPFVENILPLQQCPFFCLSPEFQYLTEACETVVQEIDALMRDH

SEQ ID NO: 158291 - protein, 115 aa, Glycine max
  Coding DNA Sequence Number=SeqID_41513
MYPPLELIHKRCTLSCSQYNNPQVDVPSTCTTKDVPSNVLRQSSQAVSPLKLCEGETKDISGEQGLETRKLIKLLAKEEEEEEVQKDVQRDSKVVKEYVKSYFQVHKMQVKVLHL

SEQ ID NO: 158292 - protein, 129 aa, Glycine max
  Coding DNA Sequence Number=SeqID_41514
  Subcellular localization annotation: CTP_CleavageSite=27; ConfidenceScore=5.34e-01
NSKLIWSTKFRALLSLSLHSSPSSSKLLSMVSYGGELLLDSSFPLKWRLLSLSPFLHSNCHSSSKKQRNPLMKKILSLQAPMELASGIITQDNNIVTARLTGALSKGGNMRGVATNVYLWKTSGKLKET

SEQ ID NO: 158293 - protein, 228 aa, Glycine max
  Coding DNA Sequence Number=SeqID_41515
  Gene Ontology: Biological process=response to stress
  Homolog annotation: Hit_ID=Q2QQA6; Match level="QueryCoverage=75%, HitCoverage=78%, E-value=7e-35, Identity=45%"; Hit description =Universal stress protein family protein, expressed
  Pfam annotation: Domain name=Usp; Domain location=62-205; Score=79.1; E_value=1.4e-20; Accession=PF00582.16; Description=Universal stress protein family
  Subcellular localization annotation: CTP_CleavageSite=38; ConfidenceScore=5.59e-01
MGRPRIRLCFGRATPRVRAFSASSFRSKSPSSSSASIKCENRTEFSSNGGHEAGRDNRGETGNKILVVVDSSFEAKGALEWALSHTVQTQDTVVLVHVARPTREGTESGSKFNVKTYQLLLDMKSMCEMKKPGVVVNVVMLEGEEKGVAIVQEAKKQRVSLLVVGQRKQSILGCIMRRWVRRRGTRPGIVEYCIQNSPCMTIAVRRKNKKHGGYLITTKRHKNFWLLA

SEQ ID NO: 158294 - protein, 105 aa, Glycine max
  Coding DNA Sequence Number=SeqID_41516
  Gene Ontology: Mol. function=sequence-specific DNA binding; Cellular component=nucleus; Biological process=regulation of transcription, DNA-dependent
  Homolog annotation: Hit_ID=Q56NI7; Match level="QueryCoverage=99%, HitCoverage=49%, E-value=1e-26, Identity=57%"; Hit description=MADS box protein M2
  Pfam annotation: Domain name=K-box; Domain location=1-72; Score=59.8; E_value=9e-15; Accession=PF01486.8; Description=K-box region
ENWVIEHEKLKARVEVLQRNQRNFMGEDLDSLNLRGLQSLEQQLDSALKLIRSRKDKSLREHNNLLSKKIKDKEKELAPQEQDGLQNNMDVTSVLVTQPPESLTI

SEQ ID NO: 158295 - protein, 37 aa, Glycine max
  Coding DNA Sequence Number=SeqID_41517
MGVNPTLQIGYNQTNPHDANVGASSLSMHGFASEWML

SEQ ID NO: 158296 - protein, 286 aa, Glycine max
  Coding DNA Sequence Number=SeqID_41518
  Homolog annotation: Hit_ID=Q49L63; Match level="QueryCoverage=95%, HitCoverage=47%, E-value=9e-69, Identity=49%"; Hit description=GEX1
MDNLKSKAEDIGNMAGISIDKQQQLLEGQSTALEELNSLTEFQSKALEESRKTRQYFAEYGHRQHEELIQRQQQIQGFHDRLMENSREILSSQESFESKQASMFVVFDRIFALQNTLLLESRMIKAFFVYSILIFVIFMLTSTKQTYNIRPFLYIDLYVILFVEVLIIRLTSDNIEHQSSIINIARLFFMVAALIQLLHAIFTYKNYETLNHQMLLTLINKVNSMQKEKELPWDLYTDYEGWSEWIDADLPDDVNCLDDPDHIQEVAENPITVTKNYNLRNRNLFH

SEQ ID NO: 158297 - protein, 109 aa, Glycine max
  Coding DNA Sequence Number=SeqID_41519
  Gene Ontology: Mol. function=sequence-specific DNA binding; Cellular component=nucleus; Biological process=regulation of transcription, DNA-dependent
  Homolog annotation: Hit_ID=Q4F8B3; Match level="QueryCoverage=98%, HitCoverage=43%, E-value=7e-28, Identity=59%"; Hit description=MADS box protein
  Pfam annotation: Domain name=K-box; Domain location=13-109; Score =110.2; E_value=5.9e-30; Accession=PF01486.8; Description=K-box region
MMKTLEKYQKYSYSALETTRPINDSQNYQEYLRLKARVEVLQCSQRNLLGEDLAQMNTNELEQLENQLETALKNIRSTKTQFMLDQLSDLHHRETLLIETNNVLRSKVI

SEQ ID NO: 158298 - protein, 94 aa, Glycine max
  Coding DNA Sequence Number=SeqID_41520
  Gene Ontology: Mol. function=sequence-specific DNA binding; Cellular component=nucleus; Biological process=regulation of transcription, DNA-dependent
  Homolog annotation: Hit_ID=Q39685; Match level="QueryCoverage=72%, HitCoverage=28%, E-value=2e-26, Identity=89%"; Hit description=MADS -box protein CMB1
  Pfam annotation: Domain name=SRF-TF; Domain location=9-59; Score =122.2; E_value=1.5e-33; Accession=PF00319.9; Description=SRF-type transcription factor (DNA-binding and dimerisation domain)
MGRGRVELKRIENKINRQVTFAKRRNGLLKKAYELSVLCDAEVALIIFSNRGKLYEFSSTSRCCFEKALLLLLFQMGHTYPPGLGQDHFWNRRV

SEQ ID NO: 158299 - protein, 155 aa, Glycine max
  Coding DNA Sequence Number=SeqID_41521
  Homolog annotation: Hit_ID=O80934; Match level="QueryCoverage=32%, HitCoverage=15%, E-value=3e-10, Identity=64%"; Hit description =Protein At2g37660, chloroplast precursor
MIFMKDDIEKLVSKLVDKVCAPEEDIDALIILTSTVSQIKPGFDPTKGLRPEFYFDGDDAYPEHDELSSIKNQLLQGYSPMIHIHQDLHYLWRHQDHVLILLRLSSQILMRGKVGVVNMPRYDPIAKEAKQLIEAEGSFTLQKLETFKSRNRWKK

SEQ ID NO: 158300 - protein, 139 aa, Glycine max
  Coding DNA Sequence Number=SeqID_41522
MEDVVVHIVLVVTIATIMSMLKSNVTPNQENSQTSCLPFPNCKLYRATIGVGHESGGSYHSTASLELAHQRLNNPSLGNLCLLVPSLSTVTSLQCESCLKKSSVSWPVTRSYAKIHNNSPLAVQPGVLLLTIGSQKGFP

SEQ ID NO: 158301 - protein, 104 aa, Glycine max
  Coding DNA Sequence Number=SeqID_41523
MEMQTYLGKLERLIADYNTLMPFTSDTKTFNKKHIQFFMVLVLAVDCCNKTCDQAKSMNVAQVAFPAQAAVASPALVADVTISSAGYIQLRAAQHPALPVTAMA

SEQ ID NO: 158302 - protein, 121 aa, Glycine max
  Coding DNA Sequence Number=SeqID_41524
VTGCTICGGAHESGCCIPNEEQIAHEVNYMGNQPRGNFNTSGFPGFQNNKQYQQQRQWKNHPGNQFNRDQGGSSTRPQQQMPSLYDRTMKLEETLAQLMQVSMSNQKSTKSAIKNLEVQVG

SEQ ID NO: 158303 - protein, 52 aa, Glycine max
  Coding DNA Sequence Number=SeqID_41525
AANHRGQVQIHECLYQLSPSQQGQGFAPFACPTPDQFRTEVAWPGDWPEAQA

SEQ ID NO: 158304 - protein, 506 aa, Glycine max
  Coding DNA Sequence Number=SeqID_41526
  Homolog annotation: Hit_ID=Q5VMR7; Match level="QueryCoverage=45%, HitCoverage=37%, E-value=7e-15, Identity=25%"; Hit description=2x PHD domain containing protein-like
  Pfam annotation: Domain name=C1_3; Domain location=12-41; Score=7.0; E_value=0.078; Accession=PF07649.3; Description=C1-like domain
  Pfam annotation: Domain name=PHD; Domain location=13-60; Score=41.6; E_value=2.7e-09; Accession=PF00628.19; Description=PHD-finger
  Pfam module annotation: Pfam domain module=C1_3::PHD; Domain location= 12-41::13-60
MATGPADSYTETKCGVCHAGTDEHLLLLCDLCDTASHTYCVGLGYTVPEGDWFCHDCAISRKINIKEDSDQQNVVPTAEPRVTVDIFDIVRETGSQVVQRPRASPLQQNLSSPSVIPLPDRLSYLSRLKGKRPVTGFCHMQRNVKAFRENWNALRSGSLQFRCNSSQPGSTVSQKQDSSSLSHHKLDDLHSMASTSLQQSTVQGGPSNKMLNERVFKDADKAWKMMDRAKKIQLPHHRTGRVDKPSCSGGARKISLAHCNFSEVKDQHSKALDLRNTKKEKQCDYSRLNQNLENRSTLKLEEKRQSRDTCEKMIHVRDHTTHSKGYCERPLSRKVHTSIQGGPCREDGLRNVAEEQSLYACLVTSADLASSRDKFGSMFSNRGVNLVNEEKRLAKSSEDGNTRNIVDSKTEIQSLVKLNLKLLTRDKKLGFDTFKVVARQATHTILAACSSDQQKSSTSSSSSWFSIYEALDWFKTPLIKVAVLMAQSIENLSSRIARGNKADAGA

SEQ ID NO: 158305 - protein, 237 aa, Glycine max
  Coding DNA Sequence Number=SeqID_41527
  Gene Ontology: Mol. function=transcription regulator activity; Cellular component=nucleus; Biological process=regulation of transcription, DNA-dependent
  Homolog annotation: Hit_ID=Q9LEZ3; Match level="QueryCoverage=91%, HitCoverage=41%, E-value=6e-40, Identity=45%"; Hit description =Transcription factor BIM1
MRPARCKGTVERFRRPKTRGKGKFKGSYLKTHDFLQPLERVETKACAKEEATEEILSVVQKQRPPSVEHLLPGGIGTYSISHISYVNNNNNQRGVLKPETSSLFVRQATSTDKNEENSNCSSYTSSGFTLWEESSGKRGNTGKENNAGEKPSLGVTESAAKLGQWTSTERTSQSFSNNRHGGFSSRSSSQTTGQKNQSFIEMMKSARDSNAQDEVLESEETFFLKKEPSSNTQRGMF

SEQ ID NO: 158306 - protein, 287 aa, Glycine max
  Coding DNA Sequence Number=SeqID_41528
  Gene Ontology: Mol. function=transcription regulator activity; Cellular component=nucleus; Biological process=regulation of transcription, DNA-dependent
  Homolog annotation: Hit_ID=Q9CAA4; Match level="QueryCoverage=81%, HitCoverage=66%, E-value=2e-37, Identity=42%"; Hit description =Putative transcription factor BIM2
  Pfam annotation: Domain name=HLH; Domain location=3-36; Score=4.1; E _value=0.053; Accession=PF00010.16; Description=Helix-loop-helix DNA -binding domain
MVNLFQMLRELIPHSDQKRDKASFLLEVVEYIHFLQEKVHKYEGSFQGWSNEPEKLMPWRNNDKPAETFQPRGTDNGSSPSPTLLFASKVDEKNITISQTIPGSTQNVESGLSSATTPKTMDHHAGMMNKAFPIPIPSQLNFFTPTQIGGPGGVVSQLTHRSASDAEKTKYQPSVECQTMTATNEKLKEKELTIEGGAISISSVYSKGLLHTLTHALQSSGVDLSQASISVQIELGKQANIRPSVPVSVCAAKDGDVHSNNQKMMRSRVASSGKSDQAVKKLKTCRS

SEQ ID NO: 158307 - protein, 176 aa, Glycine max
  Coding DNA Sequence Number=SeqID_41529
  Homolog annotation: Hit_ID=Q5VNG4; Match level="QueryCoverage=51%, HitCoverage=18%, E-value=9e-32, Identity=69%"; Hit description =Putative auxin-independent growth promoter
NCVVVWCGFDLDNKRRLRFSGGRSGVGIGEWWFREIVLSSIWGEARISAEWEGLMGLKKWESKVQKVGMGVLGSGGSGSGSGSGSSRSRMKMWMIRATTSVLLWTCIVQLTALGDMWGPRVLKGWPSCFTHESAVRAMDVELPSQRPPLLPPKRVYKNNGYLMVSCNGGLNQMRAA

SEQ ID NO: 158308 - protein, 131 aa, Glycine max
  Coding DNA Sequence Number=SeqID_41530
  Homolog annotation: Hit_ID=Q2PMM5; Match level="QueryCoverage=99%, HitCoverage=5%, E-value=2e-71, Identity=99%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIQYLEFLFVYYMDDPI

SEQ ID NO: 158309 - protein, 142 aa, Glycine max
  Coding DNA Sequence Number=SeqID_41531
  Gene Ontology: Mol. function=methyltransferase activity; Biological process=regulation of transcription, DNA-dependent
  Homolog annotation: Hit_ID=Q3BRI0; Match level="QueryCoverage=81%, HitCoverage=85%, E-value=1e-28, Identity=58%"; Hit description =Putative 6-O-methylguanine-DNA methyltransferase
  Pfam annotation: Domain name=DNA_binding_1; Domain location=33-119; Score=21.9; E_value=2.3e-08; Accession=PF01035.11; Description=6-O -methylguanine DNA methyltransfera
MAARRTDGAGTDRRHRAGADRCTTGDPPAALTPEQARARILAVIRAIPAGQVMGYGQVAMRAGLPGRARLTARILGQNDDPDLPWHRVLRSDGRIAMEEGSAGWREQSQRLRAEGVVVENGRVRMPATDPAAALDAAVWGPG

SEQ ID NO: 158310 - protein, 176 aa, Glycine max
  Coding DNA Sequence Number=SeqID_41532
  Gene Ontology: Mol. function=peptidase activity; Cellular component =integral to membrane; Biological process=ATP synthesis coupled proton transport
  Homolog annotation: Hit_ID=Q5GXN5; Match level="QueryCoverage=72%, HitCoverage=49%, E-value=1e-50, Identity=75%"; Hit description =Integral membrane protein
MEAVPCRCSHVPATAYRHQGPVDRQRDPVPAAAAVPARHADLRAVHAATAAAGLRCVLAGRQLPAVAAADLWLPAWQLRPPVLQHAGGLHVRRAAGADLGREALPAVLPGVRGWRRCLPAAGGYPAGESGHGAGRLRRRVRPAAGLRHAVPEPAGDAAVPADPDEGTDLRDPVRCG

SEQ ID NO: 158311 - protein, 87 aa, Glycine max
  Coding DNA Sequence Number=SeqID_41533
MDKWQRRSPQTRSPQCGCSHRSAGDFDTKTISGRRRKKKNDRVQARGLYNFRSLIYNDNNIGFLKITDVNINYVTSVIIKSMLTSTP

SEQ ID NO: 158312 - protein, 169 aa, Glycine max
  Coding DNA Sequence Number=SeqID_41534
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=100%, E-value=5e-21, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTLRGLHALAIRGLHVLTFRGLHALTIRGLHVLALRGMHALAFRGLDDLTFKGLHALTFRGLHVLPFRGLHALAFRGLHVLTFKGLYAFAIRGLHGLTFRGLHALAFRGLHAPAFRGLHVLRELHALTFRGLHVLAFRGLRILTFRGLHICALREFKVLCP

SEQ ID NO: 158313 - protein, 176 aa, Glycine max
  Coding DNA Sequence Number=SeqID_41535
DEYAKISAEREARERVIDSLHQEATMWTDFDLLLPRTGNKNFNFCDPLQRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWRCQRYLTG

SEQ ID NO: 158314 - protein, 90 aa, Glycine max
  Coding DNA Sequence Number=SeqID_41536
MVRKEQVDMLCLQETKKAVIDKALCQVLWGDAEVRRKMQPTINRKGHGLVTVEKVHGGGSMKEFNDWNVDLEVEDSGVPSGKAGLSLSWT

SEQ ID NO: 158315 - protein, 375 aa, Glycine max
  Coding DNA Sequence Number=SeqID_41537
  Gene Ontology: Mol. function=specific transcriptional repressor activity; Biological process=regulation of transcription, DNA -dependent
MGGRVGRRVGGGQGYGIRECRPPPPAPPPCARWPPRRSWWPAPGRPVRPGTPSGRPAHRRRPPVRPTASGTVPRPGCNGGAARRCRRGRTRRRRRTPAAPARARRILRTARARSRLRGARRPRSCRRERPSGPGPAGWRGAPAARGRRAARRRWWRGWGGKAGRSWQVGREAVEHHRQSIFEGRVRSLPVQRLHGACQGGRGRGRRDALGRGGLAGLLFHHRADHVVADGHQRIGGPQRREAGVAQQLDLRLDAIVLRFGGAGAGVDAGAVAIGQQRAAEAARVGVQEFLPGAARRRQGMHVLAHHGVRQRVQQRLLALEMPVQRRLLHAQAFGQLARGQAVHAHLVQQVQRGGDDGVALQFGHRDSLLGLIIYH

SEQ ID NO: 158316 - protein, 340 aa, Glycine max
  Coding DNA Sequence Number=SeqID_41538
  Gene Ontology: Mol. function=DNA binding; Cellular component=beta -galactosidase complex; Biological process=DNA integration
  Homolog annotation: Hit_ID=Q1SNS9; Match level="QueryCoverage=92%, HitCoverage=38%, E-value=1e-114, Identity=59%"; Hit description =Integrase, catalytic region
MSHSFMPKLRRWELHQMDVHNTFLHGELDEEAPRCLFAKLATALNTYGFQQSYSDYSLFTFKDRHVQLHVLVYVDDLIISGNDGVAMQRFKDYLSQCFHMKDLGKLKYFLGIAVARNSEGIFLCQRKYALNIISETGLLGAKPVGTPLEQNHKLALAMTADWDNLGQYRRLIGRLIYLTLTMPELSYCVHILAQFMQQPKEEHWEAALRGNPGQSILLRADCHLKLYAYCDSDWASSSPISWKTKKQQIESRSSAEAEYRSMTTITCELKWLKGLLSTLGVMHSGLVLLHCDSQAALHIAASPVFHERTKHIEVDCHFVRDAIQNAFGILMLHLEGGIED

SEQ ID NO: 158317 - protein, 316 aa, Glycine max
  Coding DNA Sequence Number=SeqID_41539
  Gene Ontology: Mol. function=ribonuclease H activity; Biological process=RNA-dependent DNA replication
  Homolog annotation: Hit_ID=Q1T293; Match level="QueryCoverage=98%, HitCoverage=88%, E-value=1e-30, Identity=30%"; Hit description =Ribonuclease H
MTKKLITVAWRNLCRPKAEGGIGIRSIYAINKASMIKLAFDFVAKDEQWAIMLRARVLRNGKPPIVSYLELPDQLALQATVNLFIQNSSWVILNVIQQNHPALVQHIREIVIPLEQKEDTMILDHSTNGRLNLKETYKHQAISIVSSKVNITGNSTKVVMGPSVSELLILKHLGINGHPRKFIRIKEVIWCPPKSGWIIYNSDGSAHGYPVMGAVRAIELADRFGWSNLWLESDSALVVQSFAGVSLMHCSLRNRWLNCTAITKSFCFVVGHIYREGNVCADTLASKATSMAGFCWWKSTPSFLVAELNRNRIGLT

SEQ ID NO: 158318 - protein, 82 aa, Glycine max
  Coding DNA Sequence Number=SeqID_41540
MTIVVDEAIRSKRSWGGCEIVFSFLVEELLHLRKFMSLTEEVMNELMYLLEAHADNMCWNILARPKHPNALLACHLGESDSV

SEQ ID NO: 158319 - protein, 127 aa, Glycine max
  Coding DNA Sequence Number=SeqID_41541
GKGRIKRILRLCRFEFFDKEKGDTKEFKRLVLCSFGKGRRETQKEFRRLVLGKFFLAKGEENEKMNSTSFQGLENQKTLKRFCYKEEEEIQRDSRLVKDCMNKCSRFLKCKTKPCFYRLFMSGQDNH

SEQ ID NO: 158320 - protein, 131 aa, Glycine max
  Coding DNA Sequence Number=SeqID_41542
  Homolog annotation: Hit_ID=Q1SWX1; Match level="QueryCoverage=94%, HitCoverage=29%, E-value=1e-07, Identity=26%"; Hit description=IMP dehydrogenase/GMP reductase
MAEVSTEAIASLAQYYDQPLRCFTFGDFQLSPTVEEFEEILGCPLGGRKPYLFSGFYPSLARISKIVQISTQELDHRKQVKMWWLEYQGNVWKQKPESWQEKAAIDAFLAFHDRKESPVVTILADLYDTFD

SEQ ID NO: 158321 - protein, 103 aa, Glycine max
  Coding DNA Sequence Number=SeqID_41543
MKVDMESMKEHMTTMMEAMMSMRKMMEDNTAIVVVVSTATEMDPIHPAGFIQVNRPISNVVGQKGEATKNACGPYHVQVQSKHSFAPYGLPPNYTPPTVVYAS

SEQ ID NO: 158322 - protein, 108 aa, Glycine max
  Coding DNA Sequence Number=SeqID_41544
  Gene Ontology: Mol. function=protein transporter activity; Cellular component=nuclear pore; Biological process=protein import into nucleus, docking
  Homolog annotation: Hit_ID=Q2QZ88; Match level="QueryCoverage=98%, HitCoverage=9%, E-value=5e-24, Identity=52%"; Hit description =Expressed protein
MSEWEEDPDEYIQKNLPSDIDEISGWREDLFTARKSAVNLLGVISMSKGPPMETATDSLSASSKRKKGQKNKKSNQRRSMGELLVLPFLSKFPIPSASNLSQKKILNE

SEQ ID NO: 158323 - protein, 325 aa, Glycine max
  Coding DNA Sequence Number=SeqID_41545
  Gene Ontology: Mol. function=pepsin A activity; Cellular component =cellulose and pectin-containing cell wall; Biological process =proteolysis
  Homolog annotation: Hit_ID=Q1RVV6; Match level="QueryCoverage=92%, HitCoverage=69%, E-value=1e-120, Identity=70%"; Hit description =Peptidase A1, pepsin
  Pfam annotation: Domain name=Asp; Domain location=96-319; Score= -155.2; E_value=0.00019; Accession=PF00026.14; Description=Eukaryotic aspartyl protease
  Subcellular localization annotation: CTP_CleavageSite=73; ConfidenceScore=5.00e-01
MKTTLSLSPLLLFLLFSLVQGLTPKCDTQDHGSTLEVFHVFSPCSPFRPSKPLSWAESVLQLQAKDQARLQFLASMVAGRSIVPIASGRQIIQSPTYIVRAKIGTPPQTLLLAIDTSNDAAWIPCTACDGCTSTLFAPEKSTTFKNVSCGSPECNKVPSPSCGTSACTFNLTYGSSSIAANVVQDTVTLATDPIPGYTFGCVAKTTGPSTPPQGLLGLGRGPLSLLSQTQNLYQSTFSYCLPSFKSLNFSGSLRLGPVAQPIRIKYTPLLKNPRRSSLYYVNLFAIRVGRKIVDIPPAALAFNAATGAGTVFDSGNAFLPRHLRK

SEQ ID NO: 158324 - protein, 180 aa, Glycine max
  Coding DNA Sequence Number=SeqID_41546
MMWDIPNISKSLSDPQGLGEYGHILLIGCIYKTIAKVLPRKLEGVLNTLMRDEGNTWILCKLNFYLSQWKSHLRMHSTKRSETRGSVGFLSLPHGSGLMRQAVAKNPFRSYKVDTFFNLPMTLFVGMLPCIILERNFLWVGLEGGIGKLPGKMGTVCLPKQKGGLGIKNISVFNEPLLAK

SEQ ID NO: 158325 - protein, 95 aa, Glycine max
  Coding DNA Sequence Number=SeqID_41547
  Gene Ontology: Mol. function=DNA binding; Cellular component=nucleus; Biological process=regulation of transcription, DNA-dependent
  Homolog annotation: Hit_ID=Q84PP4; Match level="QueryCoverage=47%, HitCoverage=13%, E-value=8e-21, Identity=93%"; Hit description =Transcription factor MYB102
  Pfam annotation: Domain name=Myb_DNA-binding; Domain location=14-54; Score=25.5; E_value=0.00019; Accession=PF00249.21; Description=Myb -like DNA-binding domain
MGRSPCCDENGLNKGPWTPEEDQKLVQHIQKHGHGSWRALPKQAGLIDSSRNYVQKPLLYPWEKGIPMQRKKTRRSNKASNTYPVSQTLEIVGCI

SEQ ID NO: 158326 - protein, 127 aa, Glycine max
  Coding DNA Sequence Number=SeqID_41548
MDISEDTDIPVILGRPFMLTASCIVDMGKRKLELGNGWRSRGSENKNQNIRSPSERQLRAKRIFGHALSRESQALSPQPLHLRLIWFAKLDKDELGQLQFNLNSAKLQPGSLSDNLSLAKRDLLSPS

SEQ ID NO: 158327 - protein, 57 aa, Glycine max
  Coding DNA Sequence Number=SeqID_41549
METGDKKNPPQKVHHNLNLEEAYRIKPNLKKTKLERKDEQDNGVGLVVEGAELGIFL

SEQ ID NO: 158328 - protein, 91 aa, Glycine max
  Coding DNA Sequence Number=SeqID_41550
MVRSSCFTPILFLCWDEPPRRQCLCAALFPFPTSAYLHHIPCGGAFNCSNTRHSPLSLCCDDAAALQDLVAHIREREWCLGLSLQVRNVFD

SEQ ID NO: 158329 - protein, 128 aa, Glycine max
  Coding DNA Sequence Number=SeqID_41551
MGETHEMPHHNLADFEPCLGYATEGQAVGDIPLQNTLDGPQFCPQPQPLHSTAGKIPPIMACHTLISSRDHPFVGMRPSFDHFEGVQIAIRPTWAIQEVPPEGGAFWRKQPSSPGRAGWQAPSSFSYK

SEQ ID NO: 158330 - protein, 107 aa, Glycine max
  Coding DNA Sequence Number=SeqID_41552
MELTSRLVCTNQTDMTERLLVGSLALEIRILHYLIVRILLPRSSNLAQALRLNAHLPYPHLVTFFLQHFNIPLDSEPYVPIKRSFLISAAMVASFGYHKEHDGMMAL

SEQ ID NO: 158331 - protein, 64 aa, Glycine max
  Coding DNA Sequence Number=SeqID_41553
LPNCAMTHVNACGKHMTILRRIGPPLHLNVMVLDIRMSQRYVIQPWYQFLTDSDFSHGDEVSDQ

SEQ ID NO: 158332 - protein, 102 aa, Glycine max
  Coding DNA Sequence Number=SeqID_41554
  Subcellular localization annotation: CTP_CleavageSite=58; ConfidenceScore=5.09e-01
MTKWWDYVNYVIYVRGRGCHKSPLLHLRFHFTFSRSLLMCKTRCLPRPLRPWTPTTLRGGGGGDTRSNGAERARKRRRKKRDKERKKKKRLNNFDDSYSSEE

SEQ ID NO: 158333 - protein, 41 aa, Glycine max
  Coding DNA Sequence Number=SeqID_41555
MEEFRDIPLSTAIGLFAQATRAPEFGLPKQFNQKLLVLHIW

SEQ ID NO: 158334 - protein, 79 aa, Glycine max
  Coding DNA Sequence Number=SeqID_41556
MVLSSNSLTRAKRENGAKCDVEIRKPFLSLICTTLGLKSVNFRERRAEQGAKFSSFWEISEFLSDCEIPKGGGHIPTPL

SEQ ID NO: 158335 - protein, 179 aa, Glycine max
  Coding DNA Sequence Number=SeqID_41557
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=2e-19, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DGPSGTSTLVFRGLHVLANRGLHTLTLRGLCVLTFRGLHVLTFRGLHALAIRGLHVLTFRGLHALAIRGPHVLTFRGLHALVIRGLHVLTFVGLHALTFRGLHVLANRGLHALTFRGLHVLANRELHALSLRGLHVLTSRGLYILALRGLHALTFRGLRVLIFSVLHIRTLREFKVLYP

SEQ ID NO: 158336 - protein, 165 aa, Glycine max
  Coding DNA Sequence Number=SeqID_41558
MSGKGLQHVRKSLSQYQRLRACLEIKWDTNWERGFVVYVKNSKTSTSLPSGTLERWQRHSKRHDFGYVAVVGAAGPLRLQVLHGGKQNVRVVAGWSSRRDEVVQAIAVALGFWRVRERVFTARLYKLQNLRRCLMTSTLYVTISRTVYLQAPSFMTSIKTTTTGL

SEQ ID NO: 158337 - protein, 64 aa, Glycine max
  Coding DNA Sequence Number=SeqID_41559
MARTRGLGRALGHVTGRGVGRGDRDDSDDAPQRRRPTASARRQRVPVTAAHDEPVVPAPDVEVD

SEQ ID NO: 158338 - protein, 118 aa, Glycine max
  Coding DNA Sequence Number=SeqID_41560
MERVTAVAAAAFSIHSLEEAGLLNLQKMKESPKFPRTKTVREKEGKVSRQPSHGEISTKRSLGQELAMTTESDFPSKCPSGVSPAAGIVSGSWVRWEWLGAVKVKVPTLSVAVVGGGK

SEQ ID NO: 158339 - protein, 138 aa, Glycine max
  Coding DNA Sequence Number=SeqID_41561
  Homolog annotation: Hit_ID=Q10MT0; Match level="QueryCoverage=52%, HitCoverage=49%, E-value=3e-16, Identity=48%"; Hit description=ECA1 protein, putative, expressed
  Pfam annotation: Domain name=DUF1278; Domain location=1-130; Score =164.8; E_value=2.2e-46; Accession=PF06915.2; Description=Protein of unknown function (DUF1278)
  Subcellular localization annotation: CTP_CleavageSite=22; ConfidenceScore=5.47e-01
MAYTLNPFILSTLLTITALISSASMVESRPFSSPSSSSLAVRLKTEGESSYCWDSLWQLQACSGEIVTFFLNGETYLGHGCCQAIRVIGHDCWPNIVASLGFTNEETDVLEDYCDEDVVHSPPPPPPQSIDNPKYIDP

SEQ ID NO: 158340 - protein, 265 aa, Glycine max
  Coding DNA Sequence Number=SeqID_41562
  Gene Ontology: Mol. function=polygalacturonase activity; Cellular component=amyloplast; Biological process=carbohydrate metabolic process
  Homolog annotation: Hit_ID=Q1RUL3; Match level="QueryCoverage=60%, HitCoverage=35%, E-value=8e-61, Identity=63%"; Hit description =Ribosome-binding factor A; Glycoside hydrolase, family 28
  Pfam annotation: Domain name=Glyco_hydro_28; Domain location=38-263; Score=-97.5; E_value=0.00026; Accession=PF00295.8; Description =Glycosyl hydrolases family 28
MTEDPTKELSRLISEGKFEEAFTGALHRSDISIVSWLCSQILSFPLSFSYGKIVNFWGSSMKIPLNVSYIHGTLMPPDGPESWPKNNSRHQWLVFYRINGMSPEGSGLVDRRGEKWWDLPCKPHKVLQTTTDTNFPTKNASGTSWDNTLPGPCDSPIAIRIKNSPRFYFKFDGYKNVHIESIYITAPKLSPNTDGIHIENTNDVKIYSSIISNGCNDVDIKNITCGPGHGIRMTLLLGPPGSSKTTLLLALAGKQPQGSTNSMHD

SEQ ID NO: 158341 - protein, 45 aa, Glycine max
  Coding DNA Sequence Number=SeqID_41563
MNARMHEFGEGDDAGSVLKISGKEGLALSEYDGPLSTAMAARNLA

SEQ ID NO: 158342 - protein, 141 aa, Glycine max
  Coding DNA Sequence Number=SeqID_41564
  Gene Ontology: Mol. function=transferase activity, transferring glycosyl groups; Biological process=metabolic process
  Homolog annotation: Hit_ID=Q9FUJ6; Match level="QueryCoverage=79%, HitCoverage=25%, E-value=2e-35, Identity=67%"; Hit description=UDP -glucosyltransferase HRA25
MGEQQDSLDESLLKLVSIPGGLGPDDDRNDLGKFVAAMQNTMLAMLEKLTQDVHLNGDNKISLIVADFCMGWALDVGSKLGIKGALLWTSSAALFALLYNIPKLIDDGIIDSDGEASFMIMNQVDSSSFDNDKDDDKKPKE

SEQ ID NO: 158343 - protein, 379 aa, Glycine max
  Coding DNA Sequence Number=SeqID_41565
IKAAGGGRMMLVVSVWVRGERHGYIGVIGGDWPELLEPLYSKHNIDTAKREGIQVRCEGVVLDGYRHLREILSAFHDSIVAHHDLERGNRGRKHGQKRHNSSFDKVMCAAVVHEDGCIVVTHLMRYKGCHQEVPREDPEWLWELMVLIDVGYEKVYTGLLKGIFGYGVVVGAGGGGLKGVRAEQRRSANLSSYNLARAIVWDKDRGWKAWTSWCNSRWRPKMKQLRREDGGDPMIRFAICSKLVSSLRVIVVRGCEMRFQGLEHGGPGGGPGRQIEAPQVSDGVWDGRGEVWVVFWEKVGDGKGGNSIHDGFELTVQLCMTLRKGSDCFIEALNGGLTGVMLRHIVVARIDVVIQMHVPSSGSSRPAAVQLGIVNSPPP

SEQ ID NO: 158344 - protein, 43 aa, Glycine max
  Coding DNA Sequence Number=SeqID_41566
MEKVIKAHTDALWARLPEENAKQEKLDLNCQVREIRLKGTLEQ

SEQ ID NO: 158345 - protein, 64 aa, Glycine max
  Coding DNA Sequence Number=SeqID_41567
MSPGREHHWAPRLITYGRGAVTCTTGWSRQTQHSSLSESVVWTRLGYFLSLDWVHGWMMSNCWM

SEQ ID NO: 158346 - protein, 157 aa, Glycine max
  Coding DNA Sequence Number=SeqID_41568
  Subcellular localization annotation: CTP_CleavageSite=17; ConfidenceScore=5.06e-01
MQVCNPNAKLVVAPKASAVSVAPESRHSIMNGANMLVEKGSNHSPLVLVVWNLLLGVSIMVIGNVLLAIIKCVLLYSVKARDWKLRGMLFATASSCAGFIHLSIGLCERGFTMDKFIIGVGAINKILKSKKLQWTLLVFQYHFNKIQVPYMFEMSIS

SEQ ID NO: 158347 - protein, 547 aa, Glycine max
  Coding DNA Sequence Number=SeqID_41569
  Gene Ontology: Mol. function=hydrolase activity; Cellular component =membrane; Biological process=proteoglycan metabolic process
  Homolog annotation: Hit_ID=Q9FF10; Match level="QueryCoverage=95%, HitCoverage=95%, E-value=0.0, Identity=61%"; Hit description =Heparanase-like protein 1 precursor
  Pfam annotation: Domain name=Glyco_hydro_79n; Domain location=22-341; Score=553.2; E_value=2.7e-163; Accession=PF03662.4; Description =Glycosyl hydrolase family 79, N-terminal domain
MRFHLALFLFLASLQATLSQDIEHGSLLVDGAQTKAETGDNFICATIDWWPHDKCDYNHCPWGYSSVVNLDLSHPFLAKAIQALRPLRIRLGGSLQDQVLYDVGSLKSPCHPLQKVKGGLFGFSKGCLHMKRWDELNQFFNETGAIVTFGLNALHGKHQISHNVWEGAWDPTNAYDFIEYTISKGYKIDSWELGNELSGKGIGASVGVAQYGKDLIKLKQILSTLYESSKFKPSLVAPGGFYEKHWYDRLLQVSGSGIINVLTHHLYNLGPGSDEHLERKILDPERLSRVESIFGNLSETIKIYGPWSSAWVGEAGGAYNSGGNHVSNRFLNSFWYLDQLGIASCYSTKVYCRQTLIGGNYGLLNTTTFAPNPDYYSALLWHRLMGKKVLAVSSDVSSPFLRTYAHCTKDRAGVTLLLINLSNQTDFILTVRNPVTASVVENEVATSTHKESSFFDKLKKTFSWVGTKGSEVTFREEYHLTPKDGYLRSQTMVLNGIPLELTDEGDLPPLDPVRNNVRSPIYMTPLSIAFVVYPNFDAPACATHRKL

SEQ ID NO: 158348 - protein, 49 aa, Glycine max
  Coding DNA Sequence Number=SeqID_41570
MSAIAVLGRGGHRRRGRHWGRQEWRGRSVININLDLFFESQSSINYKEN

SEQ ID NO: 158349 - protein, 173 aa, Glycine max
  Coding DNA Sequence Number=SeqID_41571
MTFVPSNQTPTVLRATPYKYCYPKGVNAVTLDANPHVVGLVLKDSVDNHNFDKHSGEGGRLPKSTLLSVATIMHMHVVTALVDRDLTRVIVWFTRLVLMMGCLPIMCRAQAMAYAFMLEQIEVFKSKEGTEELTFMLEQMDLFILVEDVIKESVENEDEVEVSNMMNGMRKLS

SEQ ID NO: 158350 - protein, 530 aa, Glycine max
  Coding DNA Sequence Number=SeqID_41572
  Homolog annotation: Hit_ID=Q1SI48; Match level="QueryCoverage=24%, HitCoverage=26%, E-value=4e-50, Identity=82%"; Hit description=AMP -dependent synthetase and ligase
MFSIGKISKIFRKGVHFREQHRDANLEARANLVVHRGQHRPHRLPEYHSGDADTLRVLEDLVAGVRRLARGALCAFVQWIRSSAVIGIGEEHGEGDDDGDGNGGEMESAILEIIFSQISGFDQLWRLSIVAAVISFTYSTIGLGLGIGKVIGMNSCYSHVHHDDICSSSITGHSEIPSIRVKNNLGTVVSKKGYVLNTTEAETLLSTTLIHEVMHVLGFDPHAFAHFRDERKRQHNQAAKRVHMENNSPRVGFLKSPSSKEDVNPDAYGNGFVTARTKLETPLKGRAHSIIDQVTKVGNSIRSCGYGEGQTQSFDLPIKKRMVIEEIFIWHGASIGFWRGDVKFVIDDVGKLKLTIFYVVPCVLDRVYSGLTQKISSGGFLKKTLFNFAYSYKLNNMEKGLRHGEASPLLDIIVFDKGVEYVIFCLEPHLYLHMWKVTYRWLLVLMSYKDMWRASSSQGLSNYELGKASWSWSWKDRWIAALPTFNYVCSKLSLRSKHLPTVEDDRLGPNRGLDSNPPHKQKILSHNPKG

SEQ ID NO: 158351 - protein, 71 aa, Glycine max
  Coding DNA Sequence Number=SeqID_41573
MAFGITETRGSTMPQGEVATDMRSLPNFDTGNAGKEWFLFNDKDNNSFDNDKGFCDGDHVGGVGEGGVIGD

SEQ ID NO: 158352 - protein, 270 aa, Glycine max
  Coding DNA Sequence Number=SeqID_41574
MAPKRSKATVISRMNTKEEAKNNDVNIKGTVSGKEVVVSLVTIVVASEYAKEGLVFDKDWEKEITQKTVDIRLYGSLHPIIDDKKAMISFLRTANLTYMWKLIHSFLLNMVMPRLGPRDEIYFACLLGKIIRNIGVNVSAMEVFARASQLKGVTFEKIGIAEIFPKYAQKHIKKKVKKGGTIVYAKKPKKQPPSDPRTTQKRKAPYLSLNLNLDQQKKPTIKIKHPQPQPTPSSPLKPQPTSPPKDQESDDVILKTSTPQPPPSLALPPQ

SEQ ID NO: 158353 - protein, 98 aa, Glycine max
  Coding DNA Sequence Number=SeqID_41575
  Subcellular localization annotation: CTP_CleavageSite=75; ConfidenceScore=5.08e-01
MEPMCGSKLYLILFVVLLNRDAQSLLPLTVKQIYNASQSRFCGFSCPLGVVSTSSSVLHKAVGFGRKYRVSKWVVIMAVAKLEEISIPPLDQLQGLEY

SEQ ID NO: 158354 - protein, 443 aa, Glycine max
  Coding DNA Sequence Number=SeqID_41576
MLASVKALPEDERKGKLPENDKFVALEGKLFEEIPDEVILESMKTLSVEEKHRHNAIRLPSWRYMAMLQSVIEASIVEAEDGIIEKTLELLLFIQGQCLILMNNSLLLNMVERKIMMISEEPIRVIELFHRLNRRLMKPVEHEATTWILPSRPPIQKKPNIQVHPNLHTRLYHGFRGYKVLEWQTCNKVWKEMGDIGTHILHLKMQKVKLEKLNLTKLWKASFLGIDPFNFSSWDTFPKEEEYALGVYGDWEPVVAPNPNSLIFEHQPTKTKVYPPSVIVWKSRDAEPSGETFQTKEIILEAPKESMNFQDWELSYYVHELSMKLYAYREEIRSRQASFHRIQRLNIHLPFMLGSQFSCLATLKTQFQIVIDKFVLYQKENCYKGNEPLIEEDENASPTKYVKACLGRFFKHELEALKQKIEVINLDWYAIKMFYKLKSVALV

SEQ ID NO: 158355 - protein, 114 aa, Glycine max
  Coding DNA Sequence Number=SeqID_41577
MELCPTRPRPPPLDHLLLRVCWVPIHTIFHRSTHLEPITFFALVGRRKNAHNGIGHRRCTWIYNATRRGYNRFEIVNNKRLSQMTKSRNRGHHGRAKREIAIFEIKSNKSHHYI

SEQ ID NO: 158356 - protein, 167 aa, Glycine max
  Coding DNA Sequence Number=SeqID_41578
  Gene Ontology: Mol. function=nucleic acid binding; Biological process= DNA integration
  Homolog annotation: Hit_ID=Q1S9I4; Match level="QueryCoverage=97%, HitCoverage=15%, E-value=2e-14, Identity=32%"; Hit description =Integrase, catalytic region; Zinc finger, CCHC-type
  Subcellular localization annotation: CTP_CleavageSite=67; ConfidenceScore=5.07e-01
MAECDGSYKNSKGSIDDKVALMSRNLKQMLKKTMKKICTMMLFFKIVIGSPLSAKSLSWYRNNECSRHMMGERSMFLKLKPVGGGKVAFGGMGKKKINGIGIIGIPSLASIDNVLYVEGLKYNLLSISQFCDSGYIVFFNKEQYIVKTEDDKFFFTSRLHNNLYEII

SEQ ID NO: 158357 - protein, 97 aa, Glycine max
  Coding DNA Sequence Number=SeqID_41579
MERYLQHLVRQQAANHRGQVQIHECLYQLSLSQQGQGFVPFACPTPDQFRAEVAWLGDWPEAQAGEAPTGSPGDAEKARMDEEMTDLLGFLGGSGAT

SEQ ID NO: 158358 - protein, 166 aa, Glycine max
  Coding DNA Sequence Number=SeqID_41580
  Pfam annotation: Domain name=G-patch; Domain location=44-87; Score =21.8; E_value=0.00043; Accession=PF01585.13; Description=G-patch domain
MDSRARSGPFNASLEIEIREDMLVSCPSSTAYVEAAEESLETALQSFEVVMLRHGYEPGMGLGKDSHGNADVVDIRGNPYKYGLGYEPGKPRRRNAPSRLWADRAWPDHVSQCFTSAGIMFEEEVAAIGEEAPQDPPGFVRPCPTNFQVGNWHVMSQSEVYTADSM

SEQ ID NO: 158359 - protein, 108 aa, Glycine max
  Coding DNA Sequence Number=SeqID_41581
MDLIENMTVVGCTICGGAHEFGCCIPIEEHPTREVNYMRNQPKNNFNAGGFSGFQHGQQYNQQQGQWRNHPGNEFNRDQGGPSTRPQQQEPSLFDRTKKLEETLAQFM

SEQ ID NO: 158360 - protein, 74 aa, Glycine max
  Coding DNA Sequence Number=SeqID_41582
MSEFTSNCPPRILASLHQLDFAPYVSGSYNAQWNAPKFLNDKHMLHSSCILGKMEVEESLLGLWLPLHYLLDMR

SEQ ID NO: 158361 - protein, 181 aa, Glycine max
  Coding DNA Sequence Number=SeqID_41583
  Gene Ontology: Mol. function=nucleic acid binding; Biological process= DNA integration
MTRSKRIQEDSKEKEGYFPKTADDILIEKDQTPWKVEVPTDGNLVASKEGQKEVLTPQVSVPFQQRSKDKSEEAQFARSIKMLKMVHINIPFVEAIAQMSKYTKYLKEILSNKGKLMDFAINGLNKECSTIVLKKLSPKLSDPRSFSVPCTIDNLQINRALCDLGASINLMPYFVYKKLGL

SEQ ID NO: 158362 - protein, 55 aa, Glycine max
  Coding DNA Sequence Number=SeqID_41584
MNFIRTRIRGKLLHSMQTRSHNPPLQYKPDIDKLIQKLRVDIREEREKAMASNQA

SEQ ID NO: 158363 - protein, 190 aa, Glycine max
  Coding DNA Sequence Number=SeqID_41585
  Gene Ontology: Mol. function=carboxy-lyase activity; Cellular component=mitochondrion; Biological process=aromatic compound catabolic process
  Homolog annotation: Hit_ID=P0AG03; Match level="QueryCoverage=98%, HitCoverage=99%, E-value=3e-78, Identity=78%"; Hit description=3 -octaprenyl-4-hydroxybenzoate carboxy-lyase
  Pfam annotation: Domain name=Flavoprotein; Domain location=2-123; Score=164.8; E_value=2.2e-46; Accession=PF02441.9; Description =Flavoprotein
MKRLIIGISGASGSIYGVRLLQVLRDVAEVETHLVMSNAARQTLALETPYSLREVQALADVVHDARDIAAGISSGSFKTLGMAILPCSVKTLSGIVNSYSDGLLTRAADVVLKERRRLVLCVRETPLHLGHLRLMTQAAEMGAVIMPPVPAFYHQPKSVEDIIDQTVNRVIDQFDIELPADLFTRWQGFS

SEQ ID NO: 158364 - protein, 101 aa, Glycine max
  Coding DNA Sequence Number=SeqID_41586
SLEQIDQWLAPDFGFTCDSPQISASPHQSDLAPYASGPYNAQWNAPGLLHDKHTLRSSRILGEMEVDEPWLGLWLPLNYQADMGASDVRHWKCGRQTLWLT

SEQ ID NO: 158365 - protein, 123 aa, Glycine max
  Coding DNA Sequence Number=SeqID_41587
  Homolog annotation: Hit_ID=Q7CQV3; Match level="QueryCoverage=92%, HitCoverage=90%, E-value=7e-35, Identity=67%"; Hit description =Putative cytoplasmic protein
MADRGGKSMTVDRLKRDLLNKLINARIDLAAYLQLRKAKGYMSVSESEHLRDNLFELCNFMREKAPALQANYGESEEVALRRAAEVLSIAGVCLMNGRHDCPNFIAVNAEKLENCLTTLSLCI

SEQ ID NO: 158366 - protein, 47 aa, Glycine max
  Coding DNA Sequence Number=SeqID_41588
MSRGSGDLGDVRWGAIAQNQAWPIPTQPGHSQPGLKIETKRSVAAGN

SEQ ID NO: 158367 - protein, 68 aa, Glycine max
  Coding DNA Sequence Number=SeqID_41589
MDEYQWSYDNVMSQEVDMDYENEQECGVNEPYVDCSDAFNTSQVFGTRDDVLQWAQSIAHKNGFVQSL

SEQ ID NO: 158368 - protein, 188 aa, Glycine max
  Coding DNA Sequence Number=SeqID_41590
  Gene Ontology: Mol. function=chitin binding; Cellular component =extracellular region; Biological process=chitin metabolic process
  Homolog annotation: Hit_ID=UPI000044A8F0; Match level="QueryCoverage =72%, HitCoverage=99%, E-value=3e-16, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSFEFGMTGSLDESISCFLIRMDPRRTACPHLQRATRPRHQRTACPHLQRATRPRHQRTAWLHALTFRGLHVLANRGLHALTLRGLHVLANVGLHALTFRGLHILAFRGLHVLTLRGLHVLALRGLHVLALRGLHVLTIRGLHALTSRGLHVLALRGLPALALGTSYPHLQRTTCPHLRRATCPHL

SEQ ID NO: 158369 - protein, 192 aa, Glycine max
  Coding DNA Sequence Number=SeqID_41591
  Gene Ontology: Mol. function=urea carboxylase activity; Biological process=metabolic process
  Homolog annotation: Hit_ID=Q6D598; Match level="QueryCoverage=65%, HitCoverage=10%, E-value=7e-34, Identity=59%"; Hit description=Urea amidolyase
  Pfam annotation: Domain name=Biotin_lipoyl; Domain location=63-131; Score=56.1; E_value=1.1e-13; Accession=PF00364.12; Description =Biotin-requiring enzyme
  Pfam annotation: Domain name=GntR; Domain location=109-176; Score =58.9; E_value=1.7e-14; Accession=PF00392.11; Description=Bacterial regulatory proteins, gntR f
  Pfam annotation: Domain name=HTH_11; Domain location=122-175; Score =0.8; E_value=0.076; Accession=PF08279.2; Description=HTH domain
  Pfam module annotation: Pfam domain module=Biotin_lipoyl::GntR::HTH _11; Domain location=63-131::109-176::122-175
QSEFDFAAHQQFLADNAPEISAFRKRQAAAFEQEVTLWAQEEQEAPLTREETLGVADAEDDALAVCADMNGNIWKVLVAPGDTVQAGQTLIIVEAMKMELAIVAPQAGTVKRIACQAGRPALKQDIFEFRLMPGDRFSENEIAERLAVSRTPVRQALFWLEREGYVEVWFRSGWQVRPFDFAYFEELYDFRT

SEQ ID NO: 158370 - protein, 170 aa, Glycine max
  Coding DNA Sequence Number=SeqID_41592
  Homolog annotation: Hit_ID=Q1T1Y0; Match level="QueryCoverage=60%, HitCoverage=29%, E-value=2e-09, Identity=38%"; Hit description =Ankyrin
  Pfam annotation: Domain name=DUF1723; Domain location=83-132; Score =31.7; E_value=2.5e-06; Accession=PF08330.1; Description=Protein of unknown function (DUF1723)
IMIRTRGVGLVLGRTIEKVMGRRDTSNDDAPNSEGLLHLPERPELKLSSHGRKMTRFERLAPEIEGLVAASGLNSWIECSLDMGDQRLMFAFVERKHKETSSFHLPVREVTITLGDVASLLHLPIVGAFHSFEQLHVDDAVDMLVELLEVSAAKARAETIQCHGSYVRLS

SEQ ID NO: 158371 - protein, 46 aa, Glycine max
  Coding DNA Sequence Number=SeqID_41593
MELASGAKPVRWPQWRLNPVILDVVKKEVTKLLQVGIIYPISNSQW

SEQ ID NO: 158372 - protein, 78 aa, Glycine max
  Coding DNA Sequence Number=SeqID_41594
MGLRIRFDGGGCTNSARQSIRGASDSMEINSWGSRLDGGGCMNDNQFMGLRIRFDGGGCTNSARQSIRGAPDSMVEDA

SEQ ID NO: 158373 - protein, 55 aa, Glycine max
  Coding DNA Sequence Number=SeqID_41595
MKNLCYLANTNGNDVDVAPEFSPLKTVHFGNPSQDTVDPRDGGFGGRLSRWKWEK

SEQ ID NO: 158374 - protein, 75 aa, Glycine max
  Coding DNA Sequence Number=SeqID_41596
MYQFLLHLHHFLALKWGQDRITNSCKTLQHHHILQGDIFLTLGAQEGEKTNTLEDVMVLENFPTVHDPVFTPFQS

SEQ ID NO: 158375 - protein, 53 aa, Glycine max
  Coding DNA Sequence Number=SeqID_41597
LGLECFVSHLDVTLTSSVGPECVELISIVCVELISSVQRAISEWLLGRDCTGS

SEQ ID NO: 158376 - protein, 499 aa, Glycine max
  Coding DNA Sequence Number=SeqID_41598
  Gene Ontology: Mol. function=transporter activity; Cellular component= integral to membrane; Biological process=transport
  Homolog annotation: Hit_ID=UPI000034EE33; Match level="QueryCoverage =88%, HitCoverage=87%, E-value=1e-176, Identity=69%"; Hit description= carbohydrate transporter/ organic anion transporter/ sugar porter
  Pfam annotation: Domain name=MFS_1; Domain location=99-466; Score =186.7; E_value=5.6e-53; Accession=PF07690.6; Description=Major Facilitator Superfamily
  Pfam annotation: Domain name=Sugar_tr; Domain location=95-498; Score=- 119.2; E_value=0.0039; Accession=PF00083.14; Description=Sugar (and other) transporter
  Pfam module annotation: Pfam domain module=MFS_1::Sugar_tr; Domain location=99-466::95-498
  Subcellular localization annotation: CTP_CleavageSite=12; ConfidenceScore=5.02e-01
MASLYSAPPLLRFSSRRSSSLAPDLSLVNLRKSHLRFESKISPIKLQWKSIEGKWQRKRKIQWGVRCTADGIDGGMFLGGRKEGAGVSIPERLKVVSLIACVMCLCNADRVVMSVAIVPLAAKHGWSNSFLGIVQSSFLWGYIFSSVIGGALVDRYGGKRVLACGVFMWSLATILTPLAANHSTVSLLAIRAFFGLAEGVAFPSMSTLLSRWFPTNERASALGMSMAGFHLGNVIGLLLTPIMLSTMGISGPFILFSSLGLLWVITWAYRVTDDPTESNFISRLEQRLIQAGKTGSPKKSNKFPPIRLLLSKLPSWAIIFANATNNWGYFVLLSWMPVYNVNLKQAAWFSAVPWATMAMSGYLAGVASDFLINAGYPTIFVRKFMQTIGFIGPAVTLLCLNYANTPAVAATLMTIALSLSSFSQAGFMLNIQDIAPQYAGILHGISNCAGTIAAIISTIGTGYFVQWLGSFQAFLTITACLYFVTTIFWNLFATSEQIL

SEQ ID NO: 158377 - protein, 78 aa, Glycine max
  Coding DNA Sequence Number=SeqID_41599
MGCGMENCERSCVKQHGWNLETLGIEPFNLKLTAKVNALRGTMCGSEHVPSSANLSPSRFVDSFYYHTSEKYNLQYTC

SEQ ID NO: 158378 - protein, 231 aa, Glycine max
  Coding DNA Sequence Number=SeqID_41600
  Homolog annotation: Hit_ID=Q5L358; Match level="QueryCoverage=44%, HitCoverage=81%, E-value=2e-23, Identity=48%"; Hit description =Hypothetical conserved protein
  Subcellular localization annotation: CTP_CleavageSite=28; ConfidenceScore=5.10e-01
MKQRRVKRTLNLSPPTQSNIPTTSPTTKAHQATKPIPSLPYSPQQHHNSQHNTISDLFLLWSPLSPTHHHQYFASKNPHFQESSLSPQSLQTHTAIYFHLFPQVGSHQNLIFFLPMLKAMNFRSLEEFWAFYVNQHSMPSTRRWHFVGTLFSILFLFFSVFFSWWFLFFVPLSGYGCAWYSHFFVEGNVPATFGHPFWSLLCDFKMFGLMLTGKMDREIKRLGKRPVLQVF

SEQ ID NO: 158379 - protein, 108 aa, Glycine max
  Coding DNA Sequence Number=SeqID_41601
MTTKCILDGRMPIYSRCIWSLGSSLSIHSDTPSRERKRESLEEPKQGNSDVSSIGACRPRIFFINGFLCFLENEWQRNGEKKRESRRHFKKKMSLEEAYHHRRPWIRA

SEQ ID NO: 158380 - protein, 98 aa, Glycine max
  Coding DNA Sequence Number=SeqID_41602
  Gene Ontology: Mol. function=protein tyrosine/serine/threonine phosphatase activity; Biological process=protein amino acid dephosphorylation
  Homolog annotation: Hit_ID=Q9LFA7; Match level="QueryCoverage=88%, HitCoverage=13%, E-value=1e-24, Identity=63%"; Hit description=MRNA capping enzyme-like protein
  Pfam annotation: Domain name=mRNA_cap_C; Domain location=1-67; Score =52.2; E_value=1.8e-12; Accession=PF03919.6; Description=mRNA capping enzyme, C-terminal domain
MALFASQGGLDPLHYSGKIIECSWDSDRQEWIFKRIRTDKSTPNDFNTYRKVMRSIRDNITEDVLLNEINEIICLPLYADRIRIDSKAHIHTNMARRR

SEQ ID NO: 158381 - protein, 48 aa, Glycine max
  Coding DNA Sequence Number=SeqID_41603
  Homolog annotation: Hit_ID=Q2R8T5; Match level="QueryCoverage=75%, HitCoverage=5%, E-value=2e-07, Identity=71%"; Hit description=MRNA capping enzyme, C-terminal domain containing protein, expressed
MKTNIRIGPVTWDMPNIQQKYQIRLRRIYNCYDNVIIMQHGKLMEQDI

SEQ ID NO: 158382 - protein, 118 aa, Glycine max
  Coding DNA Sequence Number=SeqID_41604
  Gene Ontology: Mol. function=protein tyrosine/serine/threonine phosphatase activity; Biological process=protein amino acid dephosphorylation
  Homolog annotation: Hit_ID=Q8GSD7; Match level="QueryCoverage=98%, HitCoverage=17%, E-value=4e-36, Identity=60%"; Hit description=MRNA capping enzyme-like protein
MSVTQAIKIFSDARPPGIYKPEYIDALYAFYHEKKPEMIVCPPTPEWKRTPELVDLNGEAMPDDDDDGVPGSPLHENHVTDTIMRNDDVLGDEIPNDQQDAFRQFCFRTLKLGVGVRS

SEQ ID NO: 158383 - protein, 490 aa, Glycine max
  Coding DNA Sequence Number=SeqID_41605
  Gene Ontology: Mol. function=nucleic acid binding; Cellular component= intracellular; Biological process=chromatin modification
  Homolog annotation: Hit_ID=Q9LLR0; Match level="QueryCoverage=25%, HitCoverage=15%, E-value=1e-37, Identity=66%"; Hit description =Carboxyl transferase alpha subunit
  Pfam annotation: Domain name=ACCA; Domain location=412-485; Score= -89.3; E_value=0.052; Accession=PF03255.4; Description=Acetyl co -enzyme A carboxylase carboxyltransferase alpha subunit
MMEGILICAAPHCLKSFLKKADFESHIQDSHASLLRPNADKEDGNESEAQSVRQSTASDSTARGPQRPVFSPGSNSQQHDLEEKSRRQTPREQPPSRQTMQPKPPYYSQQQHPSDTMSGSVGGGQQGFHQQSFDIQHPPQESSQFADRQQAVGPETPFPEYPTMHPAQPSNVPSLVTSNPMLNPPMPFGYPPYPNERAQPFYGAPYDMPRQDSGSDIGGDQSSLLGFPQGVPSGPNFPGNYLQPWNSGMGGVPFEQAQGGMVVDPREGKGILAPQPMPLPPPPPPPSHMSHGKQNYYSGEVGHDGQGYGWQHDNRDNFGNQGKHGCFFGISCWCFCFGFSEEFNQQFQWCSFENLGEGKVGFEEEDFTVAAKLRKVKKHEYLWPANPDPNVKGEVLSHLSQFKPLKEKPKPVTLDFEKPLVDLQKKIIDVTSNLLSQCVVLVRKMANETGQDFSDQILLLETKYQQQTDDDKSSHEKIAIMLLSDCHLQD

SEQ ID NO: 158384 - protein, 94 aa, Glycine max
  Coding DNA Sequence Number=SeqID_41606
MRAWALGLWEWRPSGKSRRGAWRKVRERKVGGAIRKRVRRELWKRDESDCIMIVAVDLNASPVPEDDEDDFGRQVEEYRTPEERVESAVDIAHQ

SEQ ID NO: 158385 - protein, 283 aa, Glycine max
  Coding DNA Sequence Number=SeqID_41607
  Gene Ontology: Mol. function=transporter activity; Cellular component= mitochondrial inner membrane; Biological process=mitochondrial transport
  Homolog annotation: Hit_ID=O24391; Match level="QueryCoverage=98%, HitCoverage=95%, E-value=1e-120, Identity=72%"; Hit description =Mitochondrial uncoupling protein
  Pfam annotation: Domain name=Mito_carr; Domain location=116-224; Score=81.1; E_value=3.4e-21; Accession=PF00153.17; Description =Mitochondrial carrier protein
  Pfam annotation: Domain name=Mito_carr; Domain location=12-110; Score= 78.5; E_value=2.1e-20; Accession=PF00153.17; Description =Mitochondrial carrier protein
  Pfam annotation: Domain name=Mito_carr; Domain location=229-283; Score=0.1; E_value=0.0035; Accession=PF00153.17; Description =Mitochondrial carrier protein
  Pfam module annotation: Pfam domain module=Mito_carr::Mito_carr::Mito_ carr; Domain location=116-224::12-110::229-283
MLGVANSKSDISFAGTYASSAFAACFPEVCTLPLDTAKVRLQLQKQAVLGDAVTLPRYRGLLGTVGTIAREEGFSALWKGIVPGLHRQCLNGGLRIALYEPVKNFYVGADHVGDVPLSKKILAGFTTGAMAIAVANPTDLVKVRLQAEGKLPPGVPKRYSGSLNAYSTIMRQVIISFVQSASYTQEGVGALWTGIGPNIARNGIINAAELASYDQVKQTILKIPGFTDNVVTHLLAGLGAGFFAVCAGSPVDVGPFAFYMGFIPNFGRLGSWNVIMFLTLEQG

SEQ ID NO: 158386 - protein, 84 aa, Glycine max
  Coding DNA Sequence Number=SeqID_41608
MEMKAWFDEGEKEERQWPWILRVEQTDALLGLDLRFESDTDCCQWERIKCDSSTGRVARLNLYHLLLDGFEESQLGIAGCAYNE

SEQ ID NO: 158387 - protein, 217 aa, Glycine max
  Coding DNA Sequence Number=SeqID_41609
  Gene Ontology: Mol. function=protein binding; Cellular component =integral to membrane; Biological process=protein amino acid phosphorylation
  Homolog annotation: Hit_ID=Q8H609; Match level="QueryCoverage=85%, HitCoverage=31%, E-value=4e-21, Identity=38%"; Hit description =Putative disease resistance protein Cf-2.1
  Pfam annotation: Domain name=LRRNT_2; Domain location=24-59; Score =18.0; E_value=0.011; Accession=PF08263.3; Description=Leucine rich repeat N-terminal domain
  Pfam annotation: Domain name=LRR_1; Domain location=113-133; Score =12.4; E_value=1.4; Accession=PF00560.23; Description=Leucine Rich Repeat
  Pfam annotation: Domain name=LRR_1; Domain location=138-160; Score =6.2; E_value=19; Accession=PF00560.23; Description=Leucine Rich Repeat
  Pfam annotation: Domain name=LRR_1; Domain location=166-188; Score =12.7; E_value=1.2; Accession=PF00560.23; Description=Leucine Rich Repeat
  Pfam annotation: Domain name=LRR_1; Domain location=90-104; Score =5.2; E_value=30; Accession=PF00560.23; Description=Leucine Rich Repeat
  Pfam module annotation: Pfam domain module=LRRNT_2::LRR_1::LRR_1::LRR_ 1::LRR_1; Domain location=24-59::113-133::138-160::166-188::90-104
MKSTVGVCFLFFLLLEAIRCEGCWKEERDALFGLDSRLEDHYFPWNGPDCCQWEGVMCNSSTGRVAQLSLRFRWANKLYINYSDFVVFKDLKNLDLSFNGISGCAGTEAPLQNLEVLDLSSNDLDNAAILSCLDGLSSLKSLYLRDSRFNASSFHVFETLSSKLRNLKVLDISFNPLTNDILSSLGGFTSLKELHLAGIDLDSDLHIQGRIICPFHY

SEQ ID NO: 158388 - protein, 809 aa, Glycine max
  Coding DNA Sequence Number=SeqID_41610
  Gene Ontology: Mol. function=kinase activity; Cellular component =nucleus; Biological process=activation of JNKK activity
  Homolog annotation: Hit_ID=Q1L931; Match level="QueryCoverage=54%, HitCoverage=31%, E-value=1e-59, Identity=30%"; Hit description=Novel protein similar to vertebrate mouse mitogen-activated protein kinase binding protein 1-like
  Pfam annotation: Domain name=WD40; Domain location=156-193; Score =8.1; E_value=4.1; Accession=PF00400.22; Description=WD domain, G -beta repeat
  Pfam annotation: Domain name=WD40; Domain location=197-246; Score =21.4; E_value=0.0033; Accession=PF00400.22; Description=WD domain, G- beta repeat
  Pfam annotation: Domain name=WD40; Domain location=251-289; Score =25.4; E_value=0.0002; Accession=PF00400.22; Description=WD domain, G- beta repeat
  Pfam annotation: Domain name=WD40; Domain location=300-338; Score =9.0; E_value=3.2; Accession=PF00400.22; Description=WD domain, G -beta repeat
  Pfam annotation: Domain name=WD40; Domain location=342-382; Score =1.9; E_value=22; Accession=PF00400.22; Description=WD domain, G-beta repeat
  Pfam annotation: Domain name=WD40; Domain location=386-424; Score =23.2; E_value=0.0009; Accession=PF00400.22; Description=WD domain, G- beta repeat
  Pfam annotation: Domain name=WD40; Domain location=69-124; Score =20.2; E_value=0.0076; Accession=PF00400.22; Description=WD domain, G- beta repeat
  Pfam module annotation: Pfam domain module=WD40::WD40::WD40::WD40::WD4 0::WD40::WD40; Domain location=156-193::197-246::251-289::300 -338::342-382::386-424::69-124
MGSIVYSKTKKFQEESNSVSHTIVPEQDFEQLPALPDAVACQFSALEKIVVIYGDHSLYIYDIHDVNRVTKCFVLVSHSSCIWDIKNLCCENMHDPSLACTARGCLGGISFATCSADGTVRIWDIALQSDFLKDAEELKTELLSSSCLVTAGTFERDAVKADLTNQEFRSLAVSSDGNYLAAGDCKGNLHIYNLHTSDYTCFQGAHDAEILTLSFTLSTQDISKEIAKDNYFLASGGRDCMIHLYDVKRNFDLIDSIDDHSGAVTSIKISSNGCRILSCSSDSFLVLRDVVIADSGYKFLQQHRQRALQRGTVYDMAVDRTCETVVTVGQDKKIKTFDMAAQKLIRSYNHDKNFGEPIKVIMDPSCTYVVCSFSNKSICMYDFITGEMVAKATGHAEIVTGVIFLPDCKHIVSVDGNGCVFVWKLPAPLSARILERIMEKNNPLSPRSSVQRPAYNYLSFCKEECRHSKINPEDVWSLRNNSQSGDGMLYPESSHSEASSFKFSVSRLPKWAQAKVTSSINVNKNLNCNSLEFQNVQELSRFLVICRRENLVTVKLCLEYAPSSPEVQIPSDHASPLPDTLNSQDSSRFGGTYSSLLIKSLNFSNIPLDNHWHSIYTVCMEALSSPEMQNLCETKFPEIPLSLRQHKAVICEDQNSFGPNNLSKNEKRGVAPEHVGCNNNDVSWCSEEVSESKAEQLYLSESGSVSETTTEGNLGSLPSEEDSDMFKQHFGSLSNTHKVKSRNSLVRRFSARYTVQWDYPGDCKKLFSSPVGNKSGRKSSEDKGATHTVSEDRSLQVKETEEVTNSSEQ

SEQ ID NO: 158389 - protein, 104 aa, Glycine max
  Coding DNA Sequence Number=SeqID_41611
  Homolog annotation: Hit_ID=UPI0000D6178A; Match level="QueryCoverage =75%, HitCoverage=5%, E-value=4e-08, Identity=40%"; Hit description =WD repeat domain 62
MRLLNINPEKGLFLEKIELETPKGKLVLEEVIGLTTKNGNGLASNALSSKCAYLAGSVVVIYDMNLGTQSHLMVSNRSPKPLSCVALSRDGCFVAAGEGWFETA

SEQ ID NO: 158390 - protein, 159 aa, Glycine max
  Coding DNA Sequence Number=SeqID_41612
  Homolog annotation: Hit_ID=Q1SP02; Match level="QueryCoverage=93%, HitCoverage=36%, E-value=9e-16, Identity=32%"; Hit description=IMP dehydrogenase/GMP reductase
MLVDLLLVSGEAARAETGHCHGPYVCLSWLRDIYTLQDLSQTGRYAWGAAALVHMYDHLNDACINSSRQLAGYATLLQCWIYKHFPSVAECIADPDYDEVSPHACRWISMKKTVKTISTKTYRQHLDRLRILDVCWMPYGEHRLVREFQLISCFFRQLR

SEQ ID NO: 158391 - protein, 199 aa, Glycine max
  Coding DNA Sequence Number=SeqID_41613
  Gene Ontology: Mol. function=DNA binding
  Homolog annotation: Hit_ID=Q1S0F5; Match level="QueryCoverage=69%, HitCoverage=29%, E-value=2e-11, Identity=32%"; Hit description=IMP dehydrogenase/GMP reductase
QISAQELDRQKQVETGVVEIPRKCLEAKARILASKGEWALFIDILALLIFGGVLFPNVDGLVDLAAIDAFFAYHDHKESSVVAMQADLYDTFDRRCEKNSTRIVCCTPVLYVWLVSHLFRQEVRHACPLESHRSCTEKGGANWDQLLASKEGASVNWFPRWKEGRTGGCISYNLVLAIRQLGYPMRGAPLEDELVPVIS

SEQ ID NO: 158392 - protein, 384 aa, Glycine max
  Coding DNA Sequence Number=SeqID_41614
  Gene Ontology: Mol. function=nucleoside-triphosphatase activity; Cellular component=membrane
  Homolog annotation: Hit_ID=Q83IM7; Match level="QueryCoverage=99%, HitCoverage=78%, E-value=1e-133, Identity=60%"; Hit description =Hypothetical protein yjgR
  Pfam annotation: Domain name=DUF853; Domain location=8-384; Score =791.7; E_value=4.2e-235; Accession=PF05872.2; Description=Bacterial protein of unknown function (DUF853)
MSEPRIIAKAMKDGKPEQDLVILPALANRHGLITGATGTGKTVTLQKMAEQFSRIGVPVFLADVKGDLSGIGAEGVPSEKLQARLAAIGVSDWQPQACTIIPWDIYGEKGHPIRATISDLGPLLLGRLLDLNEVQSGVLQLVFKIADDNALLLLDMKDLRTMLQFVGDNAKQFQTQYGNISAASIGAIQRGLLTLEEQGADQFFGEPMLDINDLMKTDANGHGVINLLAADKLINQPKLYSVFLLWLLAELFEPLPEVGDPEQPKLVVRLIRSKGVGIYYVTQNPLDIPDSVLGQLGNRVQHALRAFTPRDQKAVKTAAQTLRANPAFDAETAITELGVGEALVSFLDEKGRPNVVERAMVIAPESKMGMLGAEGLNSAINKSP

SEQ ID NO: 158393 - protein, 65 aa, Glycine max
  Coding DNA Sequence Number=SeqID_41615
WLRRGNQYIDNDDVRVFRRKLDIMKRHEPYPSTVISLLPPVCLVGSLTWRKTKMFVDPQNANTTT

SEQ ID NO: 158394 - protein, 202 aa, Glycine max
  Coding DNA Sequence Number=SeqID_41616
  Gene Ontology: Mol. function=transferase activity, transferring hexosyl groups; Biological process=carbohydrate biosynthetic process
  Homolog annotation: Hit_ID=UPI0000E699F7; Match level="QueryCoverage =87%, HitCoverage=48%, E-value=9e-19, Identity=31%"; Hit description =glycosyl transferase, family 8
  Pfam annotation: Domain name=Glyco_transf_8; Domain location=22-202; Score=19.8; E_value=1.1e-07; Accession=PF01501.10; Description =Glycosyl transferase family 8
MNHDVLQEINAEPLFPVQSDQHIVFGVDGKFKAHALITILSIMKHAGDRVYHFHLISSELTPADNPRLARLFQGSRHGVTLHHLPDQLFATLPVTELFTRATYYRFLAPLILPQAEKLLYLDADMVCINPLNELWQIPTGPEAVALVVGEIASLQPVLAKNAGLRGERYFNAGMMLIDVAQWRADNISERAFTLLSEHGRNF

SEQ ID NO: 158395 - protein, 111 aa, Glycine max
  Coding DNA Sequence Number=SeqID_41617
MINDGTYEFGDPTVMWLRMPPDSWVTVTKSGVVDKSRTFAPMYPQFVMRELRTYVVLDSCETKNSLGVFFTKMRTCFSKETKLPTDQSNICFWMKNNVSIGEGEYADEIFS

SEQ ID NO: 158396 - protein, 572 aa, Glycine max
  Coding DNA Sequence Number=SeqID_41618
  Gene Ontology: Mol. function=protein serine/threonine kinase activity; Cellular component=integral to membrane; Biological process=protein amino acid phosphorylation
  Homolog annotation: Hit_ID=Q6ZIG4; Match level="QueryCoverage=97%, HitCoverage=86%, E-value=1e-127, Identity=64%"; Hit description =Receptor protein kinase PERK1-like protein
  Pfam annotation: Domain name=Pkinase; Domain location=248-519; Score =118.7; E_value=1.6e-32; Accession=PF00069.15; Description=Protein kinase domain
  Pfam annotation: Domain name=Pkinase_Tyr; Domain location=248-519; Score=106.3; E_value=8.8e-29; Accession=PF07714.7; Description =Protein tyrosine kinase
  Pfam module annotation: Pfam domain module=Pkinase::Pkinase_Tyr; Domain location=248-519::248-519
MEFTVELEIFARIRHKNLLSFRGYCAEGHERLIAYGDWKFGATKYLHHQATPHIIHRDIKANNVYLDSDFQARIGGFRFAKLIPDGAIHVSTEVKGTLSYLAPEYAMLGKANEGCDVYSFGILFLELASGRRPVEKLSSTVKQAMVDLALPLVCEKKFSELAYPRLNGNYVEEELKRVVFVALICAQVLPGKRPTMLDVVELVKVPVVRCKLYFWIKGSGYLQIAESKSRSPNSPVTAKELHSATNNFNYDNKLGEGSFGSVYWGQLWDGSQIAVKRLKVWSNRAETEFTVELEILARIRHKNLLSLRGYCAEGQERLIVYEYMQNLSLHSHLHGHHSFECLLDWNRRMNIAIGSAEGIVYLHHQATPHIIHRDIKASNVLLDSDFRARVADFGFAKLMPDGATHMTTKVKGTLGYLAPEYAMLGKANESCDVYSFGILLLELTSGKRPIEKLNSTVRRSIVDWALHLVCEKKFSEIADPRLNGNYVEGELKRVVLVALMCAQDLPEKRPTILDVIELLKGESKDKFYHIENSEMFRSLLAVESNDETSVAEDSLDYISEEKELQRPLKGNN

SEQ ID NO: 158397 - protein, 205 aa, Glycine max
  Coding DNA Sequence Number=SeqID_41619
  Gene Ontology: Mol. function=methyltransferase activity; Biological process=metabolic process
  Homolog annotation: Hit_ID=Q00TN0; Match level="QueryCoverage=99%, HitCoverage=21%, E-value=2e-44, Identity=40%"; Hit description =Homology to unknown gene
MAEPDHIFVNPLPNLTNGNQPAGYPFFYIKPVKHGKIIRKFYPKANGPITDIDPIGNSPVIIQKSLLEEIAPTWVNISLQMKDDPETDETFGWVLEMYAYAVASALHGVRHILHDNFMLQPPWDFDVENKFIIHYTYACDYNLKGELTYGKIGEWRFNKRFYLTGPPPKNLSLPPPGVPESVVLLVKMINEATANIPKWDSLNRS

SEQ ID NO: 158398 - protein, 195 aa, Glycine max
  Coding DNA Sequence Number=SeqID_41620
  Homolog annotation: Hit_ID=Q2HUH8; Match level="QueryCoverage=55%, HitCoverage=30%, E-value=9e-08, Identity=31%"; Hit description =Histidine triad (HIT) protein; Homeodomain-like
MLVADGEDHRWWTVERIDATDRDVETVTAVTQSSNSGCSGKEQRWPSLFNVEPPNNEVESPTGLENIQLDEGEENSSVYSSSSNPGTPIEVEEYGTTSTMSRSIGQKATKRKSKGKRDENTSNNLNLSSIESAMKDKYANIAKLIELKEAQERHLQEHERCLEYEILMKDTSDMSEKQLQDHKKYCDYIRQKQGF

SEQ ID NO: 158399 - protein, 77 aa, Glycine max
  Coding DNA Sequence Number=SeqID_41621
MDPNIDLDTLLDQMVDEELEDNTKEQQVEVTRGHRLRRKVKCTVALRIFAYGSPSDSVDECIWIVEAIASECLQRFV

SEQ ID NO: 158400 - protein, 86 aa, Glycine max
  Coding DNA Sequence Number=SeqID_41622
MQKCNFVMVEECAVVNVHDSTMVERSCACGASKVKVARARNVVRDNNNGGEELHVRSLKGEGHMRGGDEIGLCNYGEGRKEPRFWT

SEQ ID NO: 158401 - protein, 54 aa, Glycine max
  Coding DNA Sequence Number=SeqID_41623
MMLLSAERSPEGPAAQNVESTVATVAEQTAQLEDHYDLWKKLKDIAGITHLRKL

SEQ ID NO: 158402 - protein, 408 aa, Glycine max
  Coding DNA Sequence Number=SeqID_41624
  Gene Ontology: Mol. function=RNA-directed DNA polymerase activity; Cellular component=chromatin; Biological process=one-carbon compound metabolic process
  Pfam annotation: Domain name=zf-H2C2; Domain location=330-364; Score =16.0; E_value=0.0027; Accession=PF09337.1; Description=His(2)-Cys(2) zinc finger
  Pfam module annotation: Pfam domain module=RVT_1::zf-H2C2; Domain location=12-173::330-364
MLESGIIKPANRPYSSPVISVKKKDGSWRFCIDYRTRNKVTVLDKFPIPLIEELLDELKGAKFFSKIDLRAGYLQIRMRPEDIEKIAFRTHQGHYEYAIMPFGLSNAPATFQCAMNLTLQDFLKKFVLVNEFFANIKKCSSGKTKIEYLGHMISGVGVAVDKKKVQAVLNWPIPKTVKALRGFLGLAGYYRRFICGFGKIARPLNNMLKARNFKWTTKSSEAFKRLQEALTSAPVLTMPDFDQPFVIKCDASEKGIGVVLSQNKKAIAYFRASNRVADALSRKEEDKEIQALTRPYWHEVAEIDREVQEDPVLAKIKDDLRLDPNSYGGHSGVDRTYRRLAQSLYWKGMMKTIQELVARCQVCQRNKYQASSPAGLLQPLPVPYQGYVVMNRPWAFVQWLEKADIEEE

SEQ ID NO: 158403 - protein, 96 aa, Glycine max
  Coding DNA Sequence Number=SeqID_41625
MKEGIGHILDLTPIGEKRKESLKRLTLTSHTSIGRTMVEQQLKRKSASKSYGSHSYPKKNQGQGILGEAPSKPKDDKEKTIEKQPPKASMQEKTSY

SEQ ID NO: 158404 - protein, 320 aa, Glycine max
  Coding DNA Sequence Number=SeqID_41626
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=P49972; Match level="QueryCoverage=96%, HitCoverage=64%, E-value=1e-153, Identity=87%"; Hit description =Signal recognition particle 54 kDa protein 2
  Pfam annotation: Domain name=SRP54; Domain location=1-133; Score =159.6; E_value=7.9e-45; Accession=PF00448.13; Description=SRP54-type protein, GTPase domain
  Pfam annotation: Domain name=SRP_SPB; Domain location=164-254; Score =128.2; E_value=2.4e-35; Accession=PF02978.9; Description=Signal peptide binding domain
  Pfam module annotation: Pfam domain module=SRP54::SRP_SPB; Domain location=1-133::164-254
MESDPVKIAVEGVERFKQENCDLIIVDTSGRHKQEAALFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNLLKMGPISQVFSMLPGFSAELMPKGREKESQAKIKQLDSSNPKLMNESRMMRIARGSGRPVREVMEMLEEYKRLAKIWSKMKGLKIPKKGEMSALSRNMNAQHMSKVLPPQMLKQIGGMGGLQSLMKQMGSAKDMMGMFGGGGD

SEQ ID NO: 158405 - protein, 188 aa, Glycine max
  Coding DNA Sequence Number=SeqID_41627
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=P49972; Match level="QueryCoverage=93%, HitCoverage=32%, E-value=4e-82, Identity=87%"; Hit description =Signal recognition particle 54 kDa protein 2
  Pfam annotation: Domain name=SRP54; Domain location=100-188; Score= -74.0; E_value=7.7e-06; Accession=PF00448.13; Description=SRP54-type protein, GTPase domain
  Pfam annotation: Domain name=SRP54_N; Domain location=2-88; Score =103.2; E_value=7.6e-28; Accession=PF02881.9; Description=SRP54-type protein, helical bundle domain
  Pfam module annotation: Pfam domain module=SRP54::SRP54_N; Domain location=100-188::2-88
MVLAELGGSISRALQQMSNATIIDEKVLNDCLNDITRALLQSDVQFKLVRDMQTNIKNIVNLEDLAAGHNKRRIIQQAVFNELCKILDPGKPSFTPKKGKTSVVMFVGLQGMTILMLVVCASGSGKTTTCTKYAFYHQKKGWKPALVCADTFRAGAFDQLKQNATKAKIPFYGRYTPVLTVVGYEMTR

SEQ ID NO: 158406 - protein, 190 aa, Glycine max
  Coding DNA Sequence Number=SeqID_41628
MSHHSSSVNGEGTSHKDPLSRILDELSSLKLWKEKLERKEKGKERLKINQDEREQIREEERRKILKEMRKEKKHASYRRHRSHLKTHSHRREKERKPQEANINLPYFHGKDNVEANLVWEIRVEQQLKKKSTSKSYGSHSYPNKDQGQGILGVTPSKPKDDKGKTIEKQAPKASMQEKTSSIKCFKCLGK

SEQ ID NO: 158407 - protein, 162 aa, Glycine max
  Coding DNA Sequence Number=SeqID_41629
MATPPSFPPPLPSPPPLTEAASQPVVHIDPSIGKADDPYKKKLKTYLGIVACDKVNVKYENWKQRQFKSDFTSKWALAIDKDNVDDTICEKYGISKEERAQFCQSRRDLSWEDVQKKAQAIQKQNTAPYMLSRRGYEYLEQKLMAEKTKKKLVEAAQSKSTE

SEQ ID NO: 158408 - protein, 165 aa, Glycine max
  Coding DNA Sequence Number=SeqID_41630
  Gene Ontology: Mol. function=DNA-directed DNA polymerase activity; Cellular component=intracellular; Biological process=DNA replication
  Homolog annotation: Hit_ID=UPI0000669682; Match level="QueryCoverage =98%, HitCoverage=17%, E-value=1e-54, Identity=66%"; Hit description =DNA polymerase I
  Pfam annotation: Domain name=DNA_pol_A; Domain location=1-165; Score=- 70.1; E_value=2.6e-10; Accession=PF00476.11; Description=DNA polymerase family A
QAKTVNFGIIYGQGAFALAEQTGLSRSEAKQMIEAYFETYPKLKEYMAEQVKKARELGYVETILGRKRHLKDINSNNFVVRGHAERNAVNAPVQGSAADVVKMAMIKIDKQLDEQNLQTKMLLQVHDELVFESPIEEIEVATKLIKTEMESAIETQVPLLVEVGV

SEQ ID NO: 158409 - protein, 71 aa, Glycine max
  Coding DNA Sequence Number=SeqID_41631
MQQLMMLLDQDQYIRWHRLKDENVRFQGLFMKVDALVGVIVTDRDLVLMNAVKTVFSDATNLCVDFTLTRM

SEQ ID NO: 158410 - protein, 395 aa, Glycine max
  Coding DNA Sequence Number=SeqID_41632
  Gene Ontology: Mol. function=protein binding; Cellular component =integral to membrane; Biological process=defense response to fungus
  Homolog annotation: Hit_ID=Q1T2W5; Match level="QueryCoverage=85%, HitCoverage=74%, E-value=2e-60, Identity=31%"; Hit description =Leucine-rich repeat
  Pfam annotation: Domain name=LRR_1; Domain location=119-141; Score =13.7; E_value=0.68; Accession=PF00560.23; Description=Leucine Rich Repeat
  Pfam annotation: Domain name=LRR_1; Domain location=148-170; Score =5.6; E_value=25; Accession=PF00560.23; Description=Leucine Rich Repeat
  Pfam annotation: Domain name=LRR_1; Domain location=15-40; Score=8.0; E_value=8.9; Accession=PF00560.23; Description=Leucine Rich Repeat
  Pfam annotation: Domain name=LRR_1; Domain location=172-195; Score =13.4; E_value=0.81; Accession=PF00560.23; Description=Leucine Rich Repeat
  Pfam annotation: Domain name=LRR_1; Domain location=197-220; Score =8.3; E_value=7.9; Accession=PF00560.23; Description=Leucine Rich Repeat
  Pfam annotation: Domain name=LRR_1; Domain location=221-243; Score =4.6; E_value=40; Accession=PF00560.23; Description=Leucine Rich Repeat
  Pfam annotation: Domain name=LRR_1; Domain location=245-268; Score =14.0; E_value=0.54; Accession=PF00560.23; Description=Leucine Rich Repeat
  Pfam annotation: Domain name=LRR_1; Domain location=270-292; Score =3.6; E_value=60; Accession=PF00560.23; Description=Leucine Rich Repeat
  Pfam annotation: Domain name=LRR_1; Domain location=326-348; Score =14.0; E_value=0.53; Accession=PF00560.23; Description=Leucine Rich Repeat
  Pfam annotation: Domain name=LRR_1; Domain location=350-372; Score =11.2; E_value=2.3; Accession=PF00560.23; Description=Leucine Rich Repeat
  Pfam annotation: Domain name=LRR_1; Domain location=374-395; Score =9.1; E_value=5.7; Accession=PF00560.23; Description=Leucine Rich Repeat
  Pfam annotation: Domain name=LRR_1; Domain location=44-67; Score=7.1; E_value=13; Accession=PF00560.23; Description=Leucine Rich Repeat
  Pfam annotation: Domain name=LRR_1; Domain location=70-92; Score =14.4; E_value=0.4; Accession=PF00560.23; Description=Leucine Rich Repeat
  Pfam annotation: Domain name=LRR_1; Domain location=95-117; Score =21.2; E_value=0.0037; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=119-141::148-170::15-40::172-195::197 -220::221-243::245-268::...
  Pfam module annotation: Domain location=270-292::326-348::350 -372::374-395::44-67::70-92::95-117
  Subcellular localization annotation: CTP_CleavageSite=77; ConfidenceScore=5.86e-01
MTSSVFQGGFNFSSKLQNLYLGNCSLTDRSFLMSSSFNMSSSSSLVSLDLSSNLLKSSTIFYWLFNSTTNLHNLVLYNNMLEGPIPDGFGKVMNSLEVLDLSGNKLQGEIPSFFGNMCALQSLDLSNNKLKGEISSFFQNSSWCNRYIFKGLDLSYNRLTGMLPKSIGLLSELEDLNLAGNSLEGDVTESHLSNFSKLEMLSLSENSLSLKLVPSWVPPFQLKYLGIRSCKLGPTFPSWLKTQSSLYRLDISDNGINDSVPDWFWNNLQYMRDLNMSFNYLIGSIPNISLKLRNRPSVLLNTNPFEDVSHNQIKGQLPDCWKSVKQLVFLDLSSNKLSGKIPMSMGALVNMEALVLRNNGLMGELPSSLKNCSSLIMLDLSENMLSGPIPSWIGE

SEQ ID NO: 158411 - protein, 122 aa, Glycine max
  Coding DNA Sequence Number=SeqID_41633
  Homolog annotation: Hit_ID=Q1SKD7; Match level="QueryCoverage=95%, HitCoverage=34%, E-value=1e-09, Identity=32%"; Hit description =Ankyrin
MAPKKLSTKRSRIDATGEGSSAASEFDSHRFRSAEHQERRVQLREDEYTDFQEEIARRHWTPLETPMAKFDPEIALEFYVNAWPAEEGVRDMHSWVRGQWIPFDADALSQFLGDPLVLEEGQ

SEQ ID NO: 158412 - protein, 119 aa, Glycine max
  Coding DNA Sequence Number=SeqID_41634
  Homolog annotation: Hit_ID=Q1SM20; Match level="QueryCoverage=69%, HitCoverage=21%, E-value=1e-08, Identity=39%"; Hit description =Nucleic acid-binding, OB-fold
MSRKENIIFELHTKKGTWKKVVRINDMWHVNKHNGRKAIEMVFMDQMGAKIGATFSRELFVEFESRLHCGSAYVIQNIKVVENHSEYKEAEHPEILPGVHVITSFTDIIVEVAPRDTLV

SEQ ID NO: 158413 - protein, 108 aa, Glycine max
  Coding DNA Sequence Number=SeqID_41635
MTLLLSNLLPSDHHSDLPQPKWIASPMRSPLDLEKSNRALGFPALIIRSPINRAFIKKFCAPWQAQGEAPQQPRDGQQLATDARPPPPKFTSAHIQRLECCLQPVVDQ

SEQ ID NO: 158414 - protein, 97 aa, Glycine max
  Coding DNA Sequence Number=SeqID_41636
  Subcellular localization annotation: CTP_CleavageSite=42; ConfidenceScore=5.12e-01
QWTRRSPTGPWGFQLGLRASVSPTGCPSPPARSCHRDIGIAPARHPMDPEKSNRVLGFLALIMGLCQFYEARVAPNKVIRPPINRAFIKKYYAPRQA

SEQ ID NO: 158415 - protein, 75 aa, Glycine max
  Coding DNA Sequence Number=SeqID_41637
MAHHPHSLCSHGPGYRAPFQLTSPVESPTVATNPSVEGRHGAHGCIFQGRKARGVATNVYSRKTSEKPKRVVYEL

SEQ ID NO: 158416 - protein, 145 aa, Glycine max
  Coding DNA Sequence Number=SeqID_41638
  Gene Ontology: Mol. function=two-component sensor activity; Cellular component=membrane; Biological process=response to stress
  Homolog annotation: Hit_ID=Q43FL7; Match level="QueryCoverage=97%, HitCoverage=92%, E-value=4e-11, Identity=30%"; Hit description=UspA
  Pfam annotation: Domain name=Usp; Domain location=1-142; Score=56.3; E_value=1e-13; Accession=PF00582.16; Description=Universal stress protein family
MINIILPVDFGDKTEQLVDGAIKFAKEINGKIHLIHVAPTDIGFAIGDMGFQYFPEVEENEIREELVQLNRLEQRIISHDVECEHLLKQGIAKDIILEYAKSKNASYIVMGSHGRSGIYDVFVGSLTKGLTKSSTIPVLVLPIHE

SEQ ID NO: 158417 - protein, 45 aa, Glycine max
  Coding DNA Sequence Number=SeqID_41639
MGFCGKEKGYNAKDISLSSNMISKFPMERMLGIGLRCLNFTIIQC

SEQ ID NO: 158418 - protein, 125 aa, Glycine max
  Coding DNA Sequence Number=SeqID_41640
  Gene Ontology: Mol. function=RNA-directed DNA polymerase activity; Cellular component=intracellular; Biological process=RNA-dependent DNA replication
MGEERCKAVKEEFDKLLRANFIREVRFFTWLTNIVMVKKANGKWACPKDAYTLSSIDRLVDGTFGFQVLSFPDAYSRYNQIRMHPLDEEKTTFITKDVNFWYNMPFCLENAGATYQRLMDRLFKQ

SEQ ID NO: 158419 - protein, 124 aa, Glycine max
  Coding DNA Sequence Number=SeqID_41641
MNQNTNQGRNFPEKKLVGFTPILVSYVNLLPYLLNNAMVAIIPAKIPQPPFSRGYNLNATCAYHGGVLGHSIKHCMTLKHKPTIDTSEPYTGAMRGTMHEPQANLGADQNSHPVGQKPERAAKD

SEQ ID NO: 158420 - protein, 96 aa, Glycine max
  Coding DNA Sequence Number=SeqID_41642
MESRKRAITEDIPSSSTPAPPSVTVGQDVQSSPTLVPMLQSLFRGQFIIMHSLQELAHNRPIISMEHFLEQVAWPEAQLPLVRPNEAASLEPTPVQ

SEQ ID NO: 158421 - protein, 66 aa, Glycine max
  Coding DNA Sequence Number=SeqID_41643
MDQLKRLSIPSEMLRFSNHASYPRLGHPTRKISMQQRQANIRIVRFPDPNYGVKTINFIINSPYLS

SEQ ID NO: 158422 - protein, 133 aa, Glycine max
  Coding DNA Sequence Number=SeqID_41644
MGELDQLEERLRDIEGGEDYAFANLEELFLVPNIITPPKFKVSDFDKYKGITCPKNHLQMYCWKVGAYAKDEKLLIHFSQESLTGTIVTRQCQLMQSYPPRALDRRLQEDWAKDAREGPRVLMSLRVDFGPMG

SEQ ID NO: 158423 - protein, 99 aa, Glycine max
  Coding DNA Sequence Number=SeqID_41645
  Gene Ontology: Mol. function=identical protein binding; Cellular component=cytoplasm; Biological process=negative regulation of enzyme activity
  Homolog annotation: Hit_ID=O65836; Match level="QueryCoverage=92%, HitCoverage=12%, E-value=1e-23, Identity=57%"; Hit description=P69F protein
MTLGTLVYDTEPDDYIPYLCGLGYSDTQVGIIAHKTIKCSKISIIPKGELNYPSFSVVLGSPQTFTRTVKNVGEANSSYAVMVNLPEGVDIKAPNALGH

SEQ ID NO: 158424 - protein, 58 aa, Glycine max
  Coding DNA Sequence Number=SeqID_41646
  Gene Ontology: Mol. function=identical protein binding; Biological process=negative regulation of enzyme activity
  Homolog annotation: Hit_ID=Q9LWA3; Match level="QueryCoverage=85%, HitCoverage=9%, E-value=1e-12, Identity=79%"; Hit description =Subtilisin-like protease
MTMRAFEQSSYATKMWNGQVARMFTPGCMMSGFNIAGLGKLGTLEEKDVTTGAKNFQL

SEQ ID NO: 158425 - protein, 48 aa, Glycine max
  Coding DNA Sequence Number=SeqID_41647
MVKYHTKSKTEMNRGTWGRARMDARPMINRSLSRIQLWTIEKRYWEAA

SEQ ID NO: 158426 - protein, 262 aa, Glycine max
  Coding DNA Sequence Number=SeqID_41648
  Homolog annotation: Hit_ID=Q09JM0; Match level="QueryCoverage=20%, HitCoverage=95%, E-value=4e-10, Identity=65%"; Hit description=10 kDa putative secreted protein
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERDGGSRLIALCARTPKRESGLKFLNRDVAADGNVRESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQN

SEQ ID NO: 158427 - protein, 151 aa, Glycine max
  Coding DNA Sequence Number=SeqID_41649
  Homolog annotation: Hit_ID=Q1SRN1; Match level="QueryCoverage=57%, HitCoverage=6%, E-value=5e-07, Identity=28%"; Hit description =Integrase, catalytic region
MDPISIKLDDDNFPAWKAEVLGKIKERNLEKFMTMKDLGGRPPKSSEEYKSWKEQDQVLYRWLLASLSTKILHGIARCEYALELWKVIEVYFLDGWVNGPKSIDWPAGPTVRVSNEPIFLNDPWLCHIFGPAPLNPWTMRVWPAGSVGYPY

SEQ ID NO: 158428 - protein, 128 aa, Glycine max
  Coding DNA Sequence Number=SeqID_41650
  Homolog annotation: Hit_ID=Q2A9Z4; Match level="QueryCoverage=68%, HitCoverage=15%, E-value=2e-08, Identity=38%"; Hit description=Zinc knuckle family protein
MTIEESIHVAFDETNSISPRKDIHDDITNTLEDTHIHEEVHKDKEDGNSRDSQSKENQINMDFPREWRTSRYHPLDNIIGDISKGVTTRHSLKDVVEASFMMMNQAILMIPKAQVIDSSLIQDFKIKH

SEQ ID NO: 158429 - protein, 83 aa, Glycine max
  Coding DNA Sequence Number=SeqID_41651
EEAYISGLFFSPVTSAKERRLPRVEIDPGASINVMPLRALADLGMNSYEPAKSDQGYYSGVQCRLAAIGKIRLLCVPNMGSED

SEQ ID NO: 158430 - protein, 179 aa, Glycine max
  Coding DNA Sequence Number=SeqID_41652
MWWKGKDVDYDSLEDLMTDQDALNLANYALEHKHEAKIYMANNVVNEELINGQGVVEMYFEGYDNDLEYGVNDAFDWDFGLDNGQSSMKQKAKKKVANKDPLEMSGDNEVDPPHIGSGVFNKGYKNESKDTKKLILSMQLGDWLLIVEMTTSTTFHHLFYDNLHNFQIFPWSPVTDLRR

SEQ ID NO: 158431 - protein, 94 aa, Glycine max
  Coding DNA Sequence Number=SeqID_41653
MACRDKYGHLPPFVEDSMSFDRDYCNLPLPSIDKKVRWHADTNMVICPFGRRLSVFRPRLLKSPFAIQRQSSLMARKGKYGHLPPFVEDSTSFD

SEQ ID NO: 158432 - protein, 109 aa, Glycine max
  Coding DNA Sequence Number=SeqID_41654
  Subcellular localization annotation: CTP_CleavageSite=66; ConfidenceScore=5.15e-01
VRTHKDIQWTRRSPTGPWGFQLWLQASVSPTGCPFPPARGRACRTPSGPKEVQQGPGFPALITGLCQFYRVPVTPSKAKGETPQQPGDGQQQAKNAPPPPPEPLSSSTK

SEQ ID NO: 158433 - protein, 59 aa, Glycine max
  Coding DNA Sequence Number=SeqID_41655
MARSVSASCPYSRGLYGRELKRFLVIIPKVVISLLMVSGGINETLGLIRILVMDLKRAN

SEQ ID NO: 158434 - protein, 134 aa, Glycine max
  Coding DNA Sequence Number=SeqID_41656
MTLAYNSLDTTCIPMYNMNVYYTWVMPFLNSRRDLSSGREEEGVEIMSKRRDSNSDKNEVGWEFIGVNVVRNRNKDRDTLIIIHLQRNPREWTTSKKIRACLVEGKEWEGANRMMHPLFLISILTWDGVSIFYH

SEQ ID NO: 158435 - protein, 735 aa, Glycine max
  Coding DNA Sequence Number=SeqID_41657
  Gene Ontology: Mol. function=amino acid transporter activity; Cellular component=integral to membrane; Biological process=amino acid transport
  Homolog annotation: Hit_ID=Q5JKI7; Match level="QueryCoverage=66%, HitCoverage=99%, E-value=1e-152, Identity=51%"; Hit description =Putative GABA-specific permease
  Pfam annotation: Domain name=AA_permease; Domain location=287-735; Score=-43.6; E_value=0.00014; Accession=PF00324.11; Description =Amino acid permease
  Pfam annotation: Domain name=PAP2; Domain location=1-137; Score =126.7; E_value=6.4e-35; Accession=PF01569.12; Description=PAP2 superfamily
  Pfam module annotation: Pfam domain module=AA_permease::PAP2; Domain location=287-735::1-137
MTDAIKDAVGRPRPDFFWRCFPDGKGVFDPVTSNVLCTGDKGVIKEGHKSFPSGHTSWSFAGLVYLAWYLSGKLRAFDRRGHVAKLCLVFLPILVAAMIAVSRVDDYWHHWQDVFAGALIGMIIASFCYLQFFPPPYDVDGWGPHAYFQMLAESRNGAQPSTVNNEIHHVQSAELQAVSLYIPPQHDADTRGNSWDSSPMLVEKTASNIIHVELTLGKNQHVRFTSVFLYLKIMDSAATENMISPSHVVAITNGDASSSLDSGHARLLELGYKQQLKRDLSAISNFSLSFSVLSVLTGITTLYNTGLNYGGPVSMQYGWFIASGFTMLVALSMAEICSSYPTSGGLYYWSAKLAGPTWAPFASWITGCTGGKNGGGYEASKYVVIAFHGGILFLLGIINSLPISVISFLGQLGAIWNALGVFLLMILIPSVATERASVKFVFTHFNDKNDNGINSRPYIFLLGLLMSQYTLSGYDASAHLTEETKGADRNGPKGIISSVGISIIVGWGYILGIAFAVTDIPYLLSESNDAGGYAIAEIFYLAFKRRYGNGIGGIICLMIVAVSIFFCGMTLVTSNSRMAYAFSRDGAMPLSSLWHKVNKQEVPIYAVWLSVFISFCMALTSLGSIVAFEAMVSIAVIVLYIAYALPIIFRVTLAQKHFVPGPFNLGRYGIIIGWVSVLWVVFISILFSLPVSYPITIQTLNYTPVALGCLIILVVSYWILSARHWFKGPITNVKH

SEQ ID NO: 158436 - protein, 55 aa, Glycine max
  Coding DNA Sequence Number=SeqID_41658
MEASGAAIPVVSQSTCSLRVGVRLLETPRDIPTEGGAFWWKQPSSPGRAELAWAS

SEQ ID NO: 158437 - protein, 377 aa, Glycine max
  Coding DNA Sequence Number=SeqID_41659
  Gene Ontology: Mol. function=proteasome activator activity; Cellular component=proteasome complex (sensu Eukaryota); Biological process =RNA elongation from RNA polymerase II promoter
  Homolog annotation: Hit_ID=Q6Z8S7; Match level="QueryCoverage=98%, HitCoverage=47%, E-value=1e-128, Identity=56%"; Hit description =Putative signal transducer and activator of transcription interacting protein
  Pfam annotation: Domain name=WD40; Domain location=150-188; Score =5.4; E_value=8.6; Accession=PF00400.22; Description=WD domain, G -beta repeat
  Pfam annotation: Domain name=WD40; Domain location=20-60; Score=12.3; E_value=1.3; Accession=PF00400.22; Description=WD domain, G-beta repeat
  Pfam annotation: Domain name=WD40; Domain location=222-260; Score =44.0; E_value=4.9e-10; Accession=PF00400.22; Description=WD domain, G-beta repeat
  Pfam annotation: Domain name=WD40; Domain location=266-309; Score =13.8; E_value=0.62; Accession=PF00400.22; Description=WD domain, G -beta repeat
  Pfam annotation: Domain name=WD40; Domain location=330-373; Score =26.1; E_value=0.00013; Accession=PF00400.22; Description=WD domain, G-beta repeat
  Pfam module annotation: Pfam domain module=WD40::WD40::WD40::WD40::WD4 0; Domain location=150-188::20-60::222-260::266-309::330-373
TTRIYAPWKVEASLQDGEFWHEIARPQVHGHDINCMAVIHSKGNHRFLCGAEEKVARVFEAPLSFLKTLNNATLQKSCSSDDIMGDVQILGANMSALGLSQKPIYAQAVHEAPKRSGIDGLDTIETIPDAVPTVFTEPPIEDQLAWHTLWPESHKLYGHGNELFSLCCDHKGELVASSCKAQSAAVAEVWLWQLQEFLIGYCNSAYILITQLWFTGTGEISYSLLVRQEGHKRIIWSCSWNPHGHEFATGSRDKTVKIWAIERESVKQLMSLPQFTSSVTALSWVGLHHRKNNGLLAVGMENGQIELWNLSYNRADDGSIAAPGLAASLAVRIDPFICHASTVNRLAWKKNEDDQTSMQLASCGADNCVRVFDVSVE

SEQ ID NO: 158438 - protein, 721 aa, Glycine max
  Coding DNA Sequence Number=SeqID_41660
  Homolog annotation: Hit_ID=Q9ZU48; Match level="QueryCoverage=97%, HitCoverage=95%, E-value=1e-110, Identity=39%"; Hit description =Expressed protein
  Pfam annotation: Domain name=Extensin_2; Domain location=293-683; Score=-134.0; E_value=0.045; Accession=PF04554.4; Description =Extensin-like region
  Pfam annotation: Domain name=PB1; Domain location=62-155; Score=92.9; E_value=9.6e-25; Accession=PF00564.15; Description=PB1 domain
  Pfam module annotation: Pfam domain module=Extensin_2::PB1; Domain location=293-683::62-155
  Subcellular localization annotation: CTP_CleavageSite=51; ConfidenceScore=5.06e-01
MEAQPPTPSTAPPPPPQHLSYPDSVESSPRSRNTDSWDEPFAPASTKLRLMCSYGGHIVPRPHDKSLCYVGGDTRIIVSERATSLADLSTRLSKTFLNGRPFTLKYQLPNEDLDSLISVTTDEDLENMIDEYDRTAAAATSAVKPSRIRLFLFPTKPESTHSIPAQILDTSAKSDDWFLNALNGAGLLNRGFSDSASVNCLLGLDDEVAGNNLEPGSKDGVDGGVGGGGASQGGSFGNGKNLKQDVHSVPDSPMLETTSSFGSTSSSPSLANLPPIRVHVVEDQRVLGIEDQFAQIGVGVGPKQQPDEGFVLLSSPPPPPVPATLAAVGVPIGPATVVAGEHHNRVVSDDERSDHGVPVGYRKPPTPQPQVQSQTQAQSQAQTQTLAPQFHQKSTAGGAVVDLPSPDSVSSDSSLANAISRSKAAVYQEQAQIQPGTTRVPSNPVDPKLNVSDLHGRIQMQQHVHDPGYLLQQQFEQHQQLQSQQQQQFEQHQQLQSQPQHQFEQHQHQHQQTLPQQQQQFIHGAHFIHHNPAIPAYYPVYPSQQHPQHPQVYYVTARQAQAYNLPLQQANMGESAGNIASSRPQTPPNPSTLVQQPATYNPIRNAPMPKTEMNAYRAATAGNPQLVQVPTSQHQQQYVTYSQIHHPSQSMAPNSAAPANYAFDYADPAHAQIYYSQPMAPTIPSQYQTMTAAAVMMQEGSAQHPSDSVKQQQQIRTSQPL

SEQ ID NO: 158439 - protein, 59 aa, Glycine max
  Coding DNA Sequence Number=SeqID_41661
MYRNAWLAKQKVVEDIYDNWKISYHDLPRFLQAMQQYLLCMLMKKETLLMPPQGGGPSL

SEQ ID NO: 158440 - protein, 190 aa, Glycine max
  Coding DNA Sequence Number=SeqID_41662
  Gene Ontology: Mol. function=protein dimerization activity; Cellular component=nucleus; Biological process=regulation of transcription, DNA-dependent
  Homolog annotation: Hit_ID=Q8RYC6; Match level="QueryCoverage=96%, HitCoverage=100%, E-value=3e-44, Identity=48%"; Hit description =Auxin-responsive protein IAA32
  Pfam annotation: Domain name=AUX_IAA; Domain location=2-183; Score= -56.2; E_value=1.9e-05; Accession=PF02309.7; Description=AUXIAA family
MESNTSRFLLNSSTLHSVFYQEKQDDGIIDLGLSLGTVRHEAYHSSANLYDEELMDWPHSNLNLKNSRTMHSRSVHQNFDEEIEGVQSNERWAYVKVNMDGVTIGRKICVLDHGGYSSLALQLEDMFGSQSVSGLRLFQSGSEYSLFYKDRQDNWRPVGDVPWKEFIECVKRLRIARKNSGIVSYSSRCT

SEQ ID NO: 158441 - protein, 69 aa, Glycine max
  Coding DNA Sequence Number=SeqID_41663
MEAYEREIKGHCVADVVGGDELGSVGGVVDIVRKRGKSKVTTISRRLVVVLNSSTPVVSSTALCAGAQM

SEQ ID NO: 158442 - protein, 135 aa, Glycine max
  Coding DNA Sequence Number=SeqID_41664
  Homolog annotation: Hit_ID=Q1SPB9; Match level="QueryCoverage=54%, HitCoverage=12%, E-value=3e-08, Identity=44%"; Hit description =Transposase
MATRRDRWNEERALGHLVDFECVFARRLENEDVVKDIMVEGAHGRLKRLLRDSTRDLNNCWDAMNNMVVLQHTTIKASFRKNINVVEHKFNTPVYKLHDFVSREAQDLIFHELQWVNTVVLIFGIPLRSVPLQQK

SEQ ID NO: 158443 - protein, 431 aa, Glycine max
  Coding DNA Sequence Number=SeqID_41665
  Gene Ontology: Mol. function=proteasome activator activity; Cellular component=proteasome complex (sensu Eukaryota); Biological process =RNA elongation from RNA polymerase II promoter
  Homolog annotation: Hit_ID=Q6Z8S7; Match level="QueryCoverage=98%, HitCoverage=50%, E-value=1e-164, Identity=62%"; Hit description =Putative signal transducer and activator of transcription interacting protein
  Pfam annotation: Domain name=WD40; Domain location=104-145; Score =18.3; E_value=0.027; Accession=PF00400.22; Description=WD domain, G -beta repeat
  Pfam annotation: Domain name=WD40; Domain location=158-201; Score =1.7; E_value=23; Accession=PF00400.22; Description=WD domain, G-beta repeat
  Pfam annotation: Domain name=WD40; Domain location=208-254; Score =32.3; E_value=1.7e-06; Accession=PF00400.22; Description=WD domain, G-beta repeat
  Pfam annotation: Domain name=WD40; Domain location=293-343; Score =27.0; E_value=6.6e-05; Accession=PF00400.22; Description=WD domain, G-beta repeat
  Pfam annotation: Domain name=WD40; Domain location=399-431; Score =1.2; E_value=26; Accession=PF00400.22; Description=WD domain, G-beta repeat
  Pfam annotation: Domain name=WD40; Domain location=46-95; Score=31.8; E_value=2.4e-06; Accession=PF00400.22; Description=WD domain, G-beta repeat
  Pfam module annotation: Pfam domain module=WD40::WD40::WD40::WD40::WD4 0::WD40; Domain location=104-145::158-201::208-254::293-343::399 -431::46-95
MREVEVKRVFIGAGCNRIVNNVSWGASGLLSFGAHNAVAIFCPKSAQILTTLPGHKAVVNCTHWLPSSRFLFKAKQLEQHYLLSGDADGAIILWELSLADGKWRQVLQLPQSHKKGVTCISGIMVSQTEAMFASTSSDGTACVWELAFPMTGSGDCKLSCLDSFSVGSKSMVTLSLAELPGDSGQIVLAMGGLDNKIHLYCGGRSGKFVHACELKGHTDWIRSLDFSLPISINGEVNNIFLVSSSQDKGIRIWKMALRSSMSNGHGIDRKGEISLSSYIEGPVLVAGSSSFQVSLESLLIGHEDWVYSVMWQPPLVAPMEEDAYYQPQSILSASMDKTMMIWQPEKTSGVWMNVVTVGELSHCALGFYGGHWSPNGDSILAHGYGGSFHLWKNVGNDNWLPQKVPSGHFASVTDIAWARSGDYIMSVSHDQ

SEQ ID NO: 158444 - protein, 783 aa, Glycine max
  Coding DNA Sequence Number=SeqID_41666
  Gene Ontology: Mol. function=protein serine/threonine kinase activity; Cellular component=cellulose and pectin-containing cell wall; Biological process=protein amino acid phosphorylation
  Homolog annotation: Hit_ID=Q9ZU46; Match level="QueryCoverage=89%, HitCoverage=99%, E-value=0.0, Identity=62%"; Hit description =Putative receptor-like protein kinase
  Pfam annotation: Domain name=LRRNT_2; Domain location=96-136; Score =60.0; E_value=7.9e-15; Accession=PF08263.3; Description=Leucine rich repeat N-terminal domain
  Pfam annotation: Domain name=LRR_1; Domain location=163-186; Score =10.2; E_value=3.5; Accession=PF00560.23; Description=Leucine Rich Repeat
  Pfam annotation: Domain name=LRR_1; Domain location=187-209; Score =15.9; E_value=0.15; Accession=PF00560.23; Description=Leucine Rich Repeat
  Pfam annotation: Domain name=LRR_1; Domain location=211-233; Score =10.9; E_value=2.6; Accession=PF00560.23; Description=Leucine Rich Repeat
  Pfam annotation: Domain name=LRR_1; Domain location=235-258; Score =13.0; E_value=1.1; Accession=PF00560.23; Description=Leucine Rich Repeat
  Pfam annotation: Domain name=LRR_1; Domain location=260-282; Score =19.4; E_value=0.013; Accession=PF00560.23; Description=Leucine Rich Repeat
  Pfam annotation: Domain name=LRR_1; Domain location=284-307; Score =4.1; E_value=50; Accession=PF00560.23; Description=Leucine Rich Repeat
  Pfam annotation: Domain name=Pkinase; Domain location=483-775; Score =60.5; E_value=5.7e-15; Accession=PF00069.15; Description=Protein kinase domain
  Pfam annotation: Domain name=Pkinase_Tyr; Domain location=483-775; Score=-20.3; E_value=3.2e-11; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=96 -136::163-186::187-209::211-233::235-258::260-282::284-307::483 -775::483-775
MRGEPTEEERGGEVSVGRVMEGGRGEEASGGGKEDNREGRTNLTTDPSSSSSSSSFPCIFGFAPTVTLLEEGEMPPFALLFFLLSCNSLAPVVHSLNAEGSVLLTLKQSLTDPQGSMSNWNSSDENPCSWNGITCKDQTIVSISIPKRKLYGSLTSSLGSLSQLRHVNFRNNKLFGNLPPQLFQAQGLQSLVLYGNSLSGSVPSEIQNLRYLQALDLSQNFFNGSLPAGIVQCKRLKTLVLSKNNFTGPLPDGFGTGLSSLERLDLSFNKFNGSIPSDLGNLSSLQGTVDLSHNHFSGSIPASLGNLPEKVYIDLTYNSLNGPIPQNGALMNRGPTAFIGNPGLCGPPLKNSCGSDIPSASSPSSFPFIPDNYSPRDGNGSRGSEKNKGLSKGAVVGIVVGDIIGICLLGLLFSFCYSRVCGFNQDLDESDVSKGRKGRKECFCFRKDDSEVLSDNNVEQYDLVPLDSHVNFDLDELLKASAFVLGKSGIGIMYKVVLEDGLALAVRRLGEGGSQRFKEFQTEVEAIGKLRHPNIATLRAYYWSVDEKLLIYDYIPNGSLATAIHGKAGLDTFAPLSWSYRLKIMKGTAKGLLYLHEFSPKKYVHGDLKPSNILLGHNMEPHISDFGVGRLANIAGGSPTLQSNRVAAEQLQGRQKSISTEVTTNVLGNGYMAPEALKVVKPSQKWDVYSYGVILLEMITGRSSIVLVGNSEIDLVQWIQLCIEEKKPVLEVLDPYLGEDADKEEEIIGVLKIAMACVHSSPEKRPTMRHVLDALDRLSISSD

SEQ ID NO: 158445 - protein, 121 aa, Glycine max
  Coding DNA Sequence Number=SeqID_41667
MVRWMTMKNLTLEDTGTQYSDRIAQTGQTLSDKGSKRSYTFRRNLDNKGGNLEPLSGVGDAATEDREKAVLVDKGVDVEGNGNDREVVLSRILMVAEELLGVGFVGGGGRWQRSATRLWEK

SEQ ID NO: 158446 - protein, 75 aa, Glycine max
  Coding DNA Sequence Number=SeqID_41668
SDKALASILIMQFSSLRLHGIKGVCGHIMHIRDIVAQLKALEGERVNLTLHGKKKGDQAKNKGKILDHSVIKKES

SEQ ID NO: 158447 - protein, 180 aa, Glycine max
  Coding DNA Sequence Number=SeqID_41669
  Gene Ontology: Mol. function=metal ion binding; Cellular component =integral to membrane; Biological process=metal ion transport
  Homolog annotation: Hit_ID=Q5PIH9; Match level="QueryCoverage=98%, HitCoverage=59%, E-value=5e-28, Identity=34%"; Hit description =Putative inner membrane protein
MLHKQCQRHQRHAGTERHTHHRQHTPARNPDDAGEQQHRQRTAAGPHAGGNNNTRPAFPVAAVPSRDAMRVAAMIMMMMLRWRPAPGLQHHHHAQPGNEHCAGFLQIPAAHAEIAGRQVKTNREDKDKGNRAQALHQAAQQRHAQRHAARGLMGGQPGGNDKFTVPGTHRVQNAVNEGHS

SEQ ID NO: 158448 - protein, 127 aa, Glycine max
  Coding DNA Sequence Number=SeqID_41670
DLLAIVFDFQRVNIPLLKQDLAAIGLQHDTGASKTAAQGRGMRHDAESGCRLTAVALQRGRNPHAGDIQDHFLHYYDRHQNRISLRERAAAERADAAVVALERVSGMGAAKSDSAAPDAGYPFTANQ

SEQ ID NO: 158449 - protein, 193 aa, Glycine max
  Coding DNA Sequence Number=SeqID_41671
VASTRHLVDPEKSDRALGFSALVTGLYQSYRVPVPTARSCHRDIGKGRVHKTPSGPEEVQQGPGVSSSDYGPLSDLQGIALAGHPVDPKKFNRILGFPALITGLSFIKKYCDPRQADGETPQQPRDGRQQATDAPPPPLEFTSAQSQKGDQVQSQRKVKYLVRDRQVIRRPAQDVKEALLGGNLVPFKSLLVI

SEQ ID NO: 158450 - protein, 139 aa, Glycine max
  Coding DNA Sequence Number=SeqID_41672
  Gene Ontology: Mol. function=nucleotidyltransferase activity; Biological process=biosynthetic process
  Homolog annotation: Hit_ID=Q1F7U0; Match level="QueryCoverage=95%, HitCoverage=27%, E-value=3e-11, Identity=33%"; Hit description =Expressed protein
MTESCIRSVVEAIHSSPFQAVLHLAGGASQVHFSLLFGCTQSVELNETIVIGRYQVVGSLLSVPGASNTVLEVVVPYSKMSLIQLLGKIPSQFCGQQTAEDMALLAYNRALKLSKPGSPAVGVGFTGSLASSRPKLGEH

SEQ ID NO: 158451 - protein, 72 aa, Glycine max
  Coding DNA Sequence Number=SeqID_41673
MARQLKEMGVVKSGEEFGIGGLVFVLCVTLSLLTTIIFFCADGVPKNSKKASQDNNYGGSACAAGCGGGCGG

SEQ ID NO: 158452 - protein, 34 aa, Glycine max
  Coding DNA Sequence Number=SeqID_41674
MGLEKLTPNLCPVVIPTTHLLFVYLLFAVEYNNL

SEQ ID NO: 158453 - protein, 125 aa, Glycine max
  Coding DNA Sequence Number=SeqID_41675
  Gene Ontology: Mol. function=RNA-directed DNA polymerase activity; Cellular component=intracellular; Biological process=RNA-dependent DNA replication
MGPLQEETEIVDLGTGNRKKEVKIGMGMTAPIREELTALLKDYQDIFAWSYQDMPSLSSDIVQHILPLNPECSPVKQKVRRMKPETSLKIKKEVKKQFDTSFLAVARYPEWVANIVPVPKKDGKV

SEQ ID NO: 158454 - protein, 141 aa, Glycine max
  Coding DNA Sequence Number=SeqID_41676
KTDIQTGPFTCGCGKDNDQPVLRYRVEVMVSQNNDSSKFLLCDRECAELIGEIVEVNRVKIEDGDVDLNASPQALDRLLGYVLAFKVRIQSKFRNVVVLRYSNELDLINVVLDMLANTEACSKIDASNVDCNNAMHPECVS

SEQ ID NO: 158455 - protein, 497 aa, Glycine max
  Coding DNA Sequence Number=SeqID_41677
  Gene Ontology: Mol. function=aspartate kinase activity; Cellular component=chloroplast; Biological process=amino acid biosynthetic process
  Homolog annotation: Hit_ID=UPI00005F8AB0; Match level="QueryCoverage =89%, HitCoverage=98%, E-value=0.0, Identity=77%"; Hit description =COG0527: Aspartokinases
MQVFLSQIENDAGAQRAAPAVGDNDLFEQVVMQGTHHLFGFFARHQEAQVIAAGAVADQADIERIEHTEHLFAHAAGARQLVADDRHQRQVFFHFHPAQRRQLGQQRGGQQAAANGGGAGGVHGQRNADLRGGDQIDGDVVARQNVEHLGQEAARVQHVQAVQRQQRLLAAQRQRAEQRRILGGVAHQRAAGRRILAGADEYRNVAAHRRQQGGRMQHLGAEGGHFRRLFETDFVDALGRRHHARIGGVDARHVGPDIYPANAERLAEQRGGIVAAAAAERGGAAFRLAADKALGDHQRFLQARLQLRPGQFAERGAVRHGAAEVIVGAHHFAHVEPFGLHVAGAQDFNEQQGGHQLPMADQFVGQRRRGGQRRGFRQHGDVFQQAVDLFADHRRRREAIEDGVLDAADLIKPVVALVGLATLGQGDQQVGDARRGGQHHQADLRVGQHDVGAAVHGFKVGDAGAAEFGYHGGILGCCLVHLETSCQGCPFEGTVIP

SEQ ID NO: 158456 - protein, 523 aa, Glycine max
  Coding DNA Sequence Number=SeqID_41678
  Gene Ontology: Mol. function=solute:hydrogen antiporter activity; Cellular component=integral to membrane; Biological process =potassium ion transport
  Homolog annotation: Hit_ID=UPI0000E68DAA; Match level="QueryCoverage =84%, HitCoverage=73%, E-value=1e-102, Identity=44%"; Hit description= sodium/hydrogen exchanger family protein
MTRLPPRFSFHSILLANGLLSGLPNCHQAVSLLLISSFERDLAYGIICPAHVGAYRPGVAAGAVAGLAAAPAGHFAVVAVRHRARPDGASGAAGSAVRRSAVSAGVAVGGDHPVRRGADAAFRGDTRPRRRGAQSGHRRHAGHLSGHQPRQLVAAGFPAGAGGSDRRGDGGDRADGDRPADARECGVLYPSVLDAGHDRRRRPDRRRAVRLPARPGAAPRLAAALPAEPGGAGDHADRLRRFQRHRRRIRPADRHGDGHLAGQHARRGHQRYSGVQRGAVGDPDLGAVHHSGGAARYPGAVEHGLAAAPAAAGGAVHRPAAVHRGVDLALFPALARSAVAVLDRPARHRRRGGQLAVRADAAAQRLPGRRPAGDRGVRHHHRHRGAAKPDQRDDGALAAGAAAKAARRADRRRQQRGAHAGAGADQAKRAGNRHRQQLGILPPGAHGRHPGLLWPRLLRTRRELSRSEQYRPGAGAVAQSPPERAGGLPLRSSLRRGSRVCHPFGSAAERARRQRGKLAFPPA

SEQ ID NO: 158457 - protein, 970 aa, Glycine max
  Coding DNA Sequence Number=SeqID_41679
  Gene Ontology: Mol. function=glucose-6-phosphate isomerase activity; Cellular component=extracellular space; Biological process =gluconeogenesis
  Homolog annotation: Hit_ID=Q8ZAS2; Match level="QueryCoverage=52%, HitCoverage=93%, E-value=0.0, Identity=90%"; Hit description=Glucose- 6-phosphate isomerase
  Pfam annotation: Domain name=PGI; Domain location=52-538; Score =990.7; E_value=5.4e-295; Accession=PF00342.9; Description =Phosphoglucose isomerase
MTNINPSQTAAWQALQQHYAQMKDVRIADLFAQDSDRFSRFSATFNDQMLVDYSKNRITQETLEKLQALAKETDLQGAIKSMFAGEKINRTEDRAVLHIALRNRSNSPILVDGKDVMPEVNAVLAKIKQFCARVIGGEWKGYTGKPITDVVNIGIGGSDLGPYMVTEALRPYKNHLNMHFVSNVDGTHIAETLQSLNPETTLFLVASKTFTTQETMTNAHSARDWFLSSAADQQHVAKHFAALSTNGKAVAEFGIDTDNMFEFWDWVGGRYSLWSAIGLSIALSIGYDNFEQLLSGAHAMDKHFAETPAEKNLPVLLALIGIWYNNFFGAETEAILPYDQYMHRFAAYFQQGNMESNGKYVDRNGNPVDYQTGPIIWGEPGTNGQHAFYQLIHQGTKLVHCDFIAPAISHNPLGDHHAKLLSNFFAQTEALAFGKSLDVVEAEFAAQGKTPEQVKHVAPFKVFEGNRPTNSILLREITPFSLGSLIALYEHKIFTQGAILNIFTFDQWGVDRHFEADAGAHVVGGAVIAVGVPQAGIESNLRIEAVTPAELNAFQRIGTRERPVDGLVVRIHLGVHQTGAPTLAVVQHHFHAAGQHLTVAAHRMAQRVTLLVVTAPIDVVVVHHVVGVAVRAGISTFDMPVDRGRAPFRMAFKPQHVGVMRRQHACFIFTGDLAIQADRHADERLQLEFEVKTAQLVARIVFRIAGIVVAGDAIPEGTPGVRTAITTPHHDARSAQLQEVGRHHGQAATDQLGVRHGSVLRQLAGGQLVLPAADPRQPRGFKRRLVGALQHKAGHRARGVGADQAAVVARAPPLGNLAEGEPLVPDFHRAVGAVHVEFGAVADALIAFHRALQTHVPELAVGAGADGQAIVGVFVLAEALRGAGFIGRGVTADANVGFQGIDAALYAVDNVFLGVGHRLGLRDNGADLFLAQRPGGQADVDDAAVRQPGEIVTQIVVRGYQAGGVAGQCT

SEQ ID NO: 158458 - protein, 82 aa, Glycine max
  Coding DNA Sequence Number=SeqID_41680
MAGRVGVHKLIMKGLLSPFSSLHTKSGMCFQHSSHPLYIYSCIVNQPLPLDVNVIHIHRERKGKGEELEEVMGDGRVGKEYI

SEQ ID NO: 158459 - protein, 443 aa, Glycine max
  Coding DNA Sequence Number=SeqID_41681
  Gene Ontology: Mol. function=nucleic acid binding
  Homolog annotation: Hit_ID=Q1PFF3; Match level="QueryCoverage=65%, HitCoverage=85%, E-value=4e-64, Identity=49%"; Hit description=Zinc finger family protein
  Pfam annotation: Domain name=zf-CCCH; Domain location=359-385; Score =53.9; E_value=5.5e-13; Accession=PF00642.15; Description=Zinc finger C-x8-C-x5-C-x3-H type (and similar)
  Pfam annotation: Domain name=zf-CCCH; Domain location=397-423; Score =24.5; E_value=0.00037; Accession=PF00642.15; Description=Zinc finger C-x8-C-x5-C-x3-H type (and similar)
  Pfam module annotation: Pfam domain module=zf-CCCH::zf-CCCH; Domain location=359-385::397-423
ESSAAASITISQSDLDNKDMNPLSQYRPRSMDPALAIRPFDSTIPFSVLRFNEESSCTSHDDSALSPYSERKAYSAPSKMHNKDTCSPSSNGGFGGGASAGQMPSTGGLYSSLYSALSSENLPSLSASCSNSSGGGGSLYPYSESIQKHQDMVNRQSMCLNRLVETSKEVEALREENGLLRAANKELQKQLHLVIQASLENHYGGGGSSGQMQPTLFDVLHGFRGLHIGEGNKENYADWNNNNHNNQNHNNIMNNNNNNNKELQEVSDESPTSVIENNNVVEVERFSLPKSISVRSNGYLKMSQSAALAPNNNNATRNKGATRPRASATPPEPVQKVYVRGGEKEEEPLEMIVYNQGMFKTELCNKWQETGTCPYGDHCQFAHGIGELRPVIRHPRYKTEVCRMVLAGVVCPYGHRCHFRHALTEQEKAVVSQPKPRSMKLER

SEQ ID NO: 158460 - protein, 58 aa, Glycine max
  Coding DNA Sequence Number=SeqID_41682
MTEDLNHEEASLIHNVVYLPDTVEVIFPKENVRKHLPITQVYSRIRKNLGREPQWQYV

SEQ ID NO: 158461 - protein, 531 aa, Glycine max
  Coding DNA Sequence Number=SeqID_41683
  Gene Ontology: Mol. function=amino acid transporter activity; Cellular component=integral to membrane; Biological process=amino acid transport
  Homolog annotation: Hit_ID=Q5JKI7; Match level="QueryCoverage=97%, HitCoverage=95%, E-value=1e-118, Identity=54%"; Hit description =Putative GABA-specific permease
  Pfam annotation: Domain name=AA_permease; Domain location=1-390; Score=-114.8; E_value=0.011; Accession=PF00324.11; Description=Amino acid permease
  Pfam annotation: Domain name=MFS_1; Domain location=132-531; Score= -49.7; E_value=0.059; Accession=PF07690.6; Description=Major Facilitator Superfamily
  Pfam module annotation: Pfam domain module=AA_permease::MFS_1; Domain location=1-390::132-531
ISLMRVGWFICVYRFNIVGQWAVTTSVDYSLAQLIQVIILLSTGGKNGGGYEASKYVVIAFHGGILFLHGIINSLPISLLSFLGQLAAIWNVIGVFVLMIVIPSVATERASAKFVFTHFNTENGEGINSKPYIFLLGLLLSQYTLTGFDASAHMTEETKDADRNGPKGIISSVGISIVVGWGYILGITFAVTDILYLLSEDNDAGGYAIAQVFYQAFKKRYGHGTGGTICLVIVAVAIFFCGMSSVTSNSRMAYAFSRDGAMPLSSLWHQVNNQEVPIYAVWLSVFISFCMALTSLGSIVAFEAMVSIATIGLYIAYAFPIFFRVTLAKKHFVPGPFNLGRYGVVVGWVAVLWVLTISVLFSLPVSYPITIETLNYTPVAVGCLLILVLSYWIISGRHCVIGSSIFMGSGKSKTVSSDVGYVPLDSGHARLRQLGYKQELNRHLSVISNFAFSFSIISVLTGVTTLYNTGLNYGGPVSFVYGWFIASGFTMIVALSMAEICSSYPTSGGLYYWSAKLAGPRWAPFASWITG

SEQ ID NO: 158462 - protein, 91 aa, Glycine max
  Coding DNA Sequence Number=SeqID_41684
  Subcellular localization annotation: CTP_CleavageSite=45; ConfidenceScore=5.09e-01
MRTRSPLKARAYNPLQARMCSPLMARTYSPLKVIGTSIQGSTFMRKQEINSSRGPIDCPFEKGDNSCNLILSFSNLFGNSLRVYILFDSVT

SEQ ID NO: 158463 - protein, 60 aa, Glycine max
  Coding DNA Sequence Number=SeqID_41685
MPISPCRCIGWSVPSWHRDRAHETPNGLEEVQQGPGVSNSGYGPLSVLQGAHSPSEVMPS

SEQ ID NO: 158464 - protein, 80 aa, Glycine max
  Coding DNA Sequence Number=SeqID_41686
GFPNVPLIGTRGCISYNHVLAIRQLGYPMRGAPLEEELAPAISRGFNKTNGDVNVCIHDFDDVKEESNKAASNDKHLLQE

SEQ ID NO: 158465 - protein, 723 aa, Glycine max
  Coding DNA Sequence Number=SeqID_41687
  Gene Ontology: Mol. function=RNA binding; Cellular component =ribonucleoprotein complex; Biological process=mRNA processing
  Homolog annotation: Hit_ID=Q5VMQ5; Match level="QueryCoverage=93%, HitCoverage=95%, E-value=1e-165, Identity=48%"; Hit description =Putative CRS2-associated factor 1
  Pfam annotation: Domain name=CRS1_YhbY; Domain location=201-284; Score=104.4; E_value=3.3e-28; Accession=PF01985.11; Description=CRS1 YhbY domain
  Pfam annotation: Domain name=CRS1_YhbY; Domain location=319-402; Score=70.4; E_value=5.6e-18; Accession=PF01985.11; Description=CRS1 YhbY domain
  Pfam module annotation: Pfam domain module=CRS1_YhbY::CRS1_YhbY; Domain location=201-284::319-402
  Subcellular localization annotation: CTP_CleavageSite=87; ConfidenceScore=5.70e-01
MALKLPHTFPIFAPSLDPNPNPPRQSSELRFSRWNNPETRSPNARRTPRPTGPAKRSKSPARPKVDRQSHPAFRFSNIPKSKPQRVSGAPENVKISDDGLSYVIDGAPFEFKYSYTETPKVKPIKMREAPFVPFGPDTMPRPWTGRAPLPASKKKLKEFDSFVLPPPHKKGVKPVQSPGPYLAGTGPRYVKSREEILGEPLTQEEIRDLVKSCMKAQRQLNIGRDGLTHNMLDNIHAHWKRRRACKIRCKGVCTVDMDNVCHQLEERTGGKIIHRKGGVLYLFRGRNYNYKTRPHFPLMLWKPVPPVYPRLVQRVPEGLTLEEATKMRQKGSTLIPICKLGKNGVYCDLVKTVREAFEECELVRINCQGLNKSDYRKIGAKLRDLVPCTLLSFEYEHILMWRGPNWKSSIPDRGDDRKESKQIEVDHKNYKPLPSEALEFSAPSLQMNPLEHESNLLHDTSISSISSDVTLDKVEVSYPNENSHQSMSGVTEVPSLTKIYDVETTNDSTDSYAEPEPRTSLIPSMTIPHYDSHAEFSSKAMSESHGTEHIMDSKSCSDGLSASISGSHATLGGSDNSTNGMVDSHSNKLLDALGEEDVSQAPRSAAPSMKAIWLLLEQAVEKGSALVLDKDSLDADNIYQNTVAFAKSAPPGPAFRKNTKAVSQKNPKQEGSTLETKETTIDSMKRKKENSTKIPRKANFDDQLLNVVPQGTLGVDELAKLLT

SEQ ID NO: 158466 - protein, 201 aa, Glycine max
  Coding DNA Sequence Number=SeqID_41688
  Gene Ontology: Mol. function=transferase activity; Cellular component= membrane; Biological process=metabolic process
  Homolog annotation: Hit_ID=Q1SRU7; Match level="QueryCoverage=91%, HitCoverage=61%, E-value=2e-41, Identity=59%"; Hit description =Exostosin-like
  Pfam annotation: Domain name=Exostosin; Domain location=59-201; Score= -98.8; E_value=0.0093; Accession=PF03016.6; Description=Exostosin family
  Subcellular localization annotation: CTP_CleavageSite=28; ConfidenceScore=5.08e-01
MEMEMPHGLQCPKRMIITAVSIPRRKMRCMMPPKSRTLFQEMNRILVRKRASARAMRPRLSSKLDLEILAARSEIEHAPIVTHDKELYAPLFRKAPYETRHHMEYCIKALCNADVTQGFKIGRDVSLPEAYVRSDKDPDMKIYGPMPHGVTSKMNYINHMKNSKYCICPKGYEVLNWDVFSIILAEKDIPNLKQILLSVSQ

SEQ ID NO: 158467 - protein, 200 aa, Glycine max
  Coding DNA Sequence Number=SeqID_41689
MMVVMSIVDNSGSGGGGSCGSGGGGAIGGDIGGISGGGGDVIRNGGSNNVSGLGGNNGTRVMVDDNDGGGDGGCDDIGGGCSDSSTNGSGGDDNGVGGRSDSDASSNPDIGGGGGGHGDNGSSGICENKIGISEGEEFEGVRNLPEGEGRWEKEIRREGLKREKEEGVERAGRIEEEAMGTSLTNTIELWMRKEQSERGE

SEQ ID NO: 158468 - protein, 172 aa, Glycine max
  Coding DNA Sequence Number=SeqID_41690
  Gene Ontology: Mol. function=lactoylglutathione lyase activity; Cellular component=cytoplasm; Biological process=carbohydrate metabolic process
  Homolog annotation: Hit_ID=Q6ES23; Match level="QueryCoverage=82%, HitCoverage=79%, E-value=8e-70, Identity=72%"; Hit description =Putative glyoxalase I
  Pfam annotation: Domain name=Glyoxalase; Domain location=1-98; Score =57.3; E_value=5.1e-14; Accession=PF00903.15; Description =GlyoxalaseBleomycin resistance proteinDioxygenase superfamily
MKLLRKRDIPEEKYTNAFLGYGPEDSHFVIELTYNYGVDKYDIGTGFGHFGIAVDDVAKAVELIRAKGGKITREPGPVKGGRSVIAFIEDPDGYKFELIERGPTPEPLCQVMLRVGDLNRSIEFYEKAFGMELLRTRDNPEYKVYEIVKILLRILHDTYSGKIKLEDNRVPF

SEQ ID NO: 158469 - protein, 112 aa, Glycine max
  Coding DNA Sequence Number=SeqID_41691
  Gene Ontology: Mol. function=sugar porter activity; Cellular component=integral to membrane; Biological process=carbohydrate transport
  Homolog annotation: Hit_ID=Q7XA51; Match level="QueryCoverage=80%, HitCoverage=18%, E-value=8e-26, Identity=64%"; Hit description =Monosaccharide transporter
MEVDIVSWFSHSPCDCHALERVRGTPNVDAEFEDLVEASKEAKSMENPFQNLLLKKNRPQFIIGALAVPVFQQLTGNNSILFCAQTLGFGARAALYSSVITSVALLLPTKTN

SEQ ID NO: 158470 - protein, 114 aa, Glycine max
  Coding DNA Sequence Number=SeqID_41692
  Subcellular localization annotation: CTP_CleavageSite=53; ConfidenceScore=5.09e-01
MTGVIVLNRGQQPKLGPHQSHFFAVARNVNVFWLTATATAILNHDRSLWCNVVESNFWALADKYSRLLTNSCNPNAVVAEMGYWVPSQTNNVIFRGANVDWEAVLCARKGSGKT

SEQ ID NO: 158471 - protein, 88 aa, Glycine max
  Coding DNA Sequence Number=SeqID_41693
  Gene Ontology: Mol. function=lactoylglutathione lyase activity; Biological process=carbohydrate metabolic process
  Homolog annotation: Hit_ID=Q6ES23; Match level="QueryCoverage=64%, HitCoverage=19%, E-value=1e-17, Identity=73%"; Hit description =Putative glyoxalase I
MTVIPHLQIAIGTDDVYKTAEAIKLAGGKITREPGPLPGINTKITACLDPDGWKSKNKGNRDESLNHLVIKVLILLNIKSFVYPYLAI

SEQ ID NO: 158472 - protein, 113 aa, Glycine max
  Coding DNA Sequence Number=SeqID_41694
MNEERMTNGEERRKTFTDLLTETSRKRYGSTSAWIFFTETIFFHPKQLKCIAKGEFYGSITKALWKHIGLDFPLFPLPFHQCYVKYAYPRFSEILRKHYGSPENHFSTKRGGS

SEQ ID NO: 158473 - protein, 109 aa, Glycine max
  Coding DNA Sequence Number=SeqID_41695
MPGEKDSVGDSLDITLVALFQKQTRYPSGISLTPQCNPLHEPTRWDGSEADIFHQLKGSDIREFHPLHTHLNWIKGFTGRRDKISSMSSSQRSGDHGFFSDRMFLWFLL

SEQ ID NO: 158474 - protein, 631 aa, Glycine max
  Coding DNA Sequence Number=SeqID_41696
  Gene Ontology: Mol. function=galactose oxidase activity; Biological process=cell wall catabolic process
  Homolog annotation: Hit_ID=Q8S198; Match level="QueryCoverage=82%, HitCoverage=82%, E-value=1e-122, Identity=45%"; Hit description =Glyoxal oxidase-like
  Pfam annotation: Domain name=DUF1929; Domain location=521-630; Score =117.5; E_value=3.8e-32; Accession=PF09118.1; Description=Domain of unknown function (DUF1929)
  Pfam annotation: Domain name=Glyoxal_oxid_N; Domain location=120-366; Score=391.0; E_value=1.8e-114; Accession=PF07250.2; Description =Glyoxal oxidase N-terminus
  Pfam module annotation: Pfam domain module=DUF1929::Glyoxal_oxid_N; Domain location=521-630::120-366
MSHSLKVFFVFTLLFLAVVEAKHKKKHKHKIRHGPKPFLPLIPPFGSDELPPVPQLPPIFEPPSNIPQLPPFPLKQDGEEGQGVENTQQDAKEGIENKLFEVTSIGHWEIISENAGVSAMHINLLPTNKIIVYDAKVYRTSRIKLPDGVPCVPYRDMGGQEDKLDCFAHAVEYDIETNQVRPLQITAGDPWCSSGGVAPDGTFVSAGGFDTGARSVRYMGPNCQNCEWREYDNIFGADRWYATQQILPNGEFILVGGRRSFSYEFIPVEGQRGEKPYFFPFLYETSDIDENNLYPFVHLSTDGNLFIFSNNRSLLLNPTTHKIVRTFPVLPGGSRNYPASGMSALLPINLNDPATATKAEVMVCGGNLPDAFHIAETTKIFLPALRDCNRLTISEPFPEWESELMPSGRTMGDLLVLPNGDLLLINGATMGTAAWWDADLPNYTPVLYKPEDPKGLRFTVLKPSQIARMYHSTSTVLPSGKIWVSGSNTHNTYRDVDKFPTETRVEAFSPPYLDANFDKYRPQIDEDASEKELAYGGLFEASFSVEDGAELTKNNIKVSMYSPPFTTHGFSMGQRLLFLKIDELNVQGQEGSYRVRVEAPPSNAIAPPGYYLLFVVYRGLPAAKGMWVHIQ

SEQ ID NO: 158475 - protein, 283 aa, Glycine max
  Coding DNA Sequence Number=SeqID_41697
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SVV2; Match level="QueryCoverage=94%, HitCoverage=91%, E-value=1e-101, Identity=63%"; Hit description =Putative xyloglucan endotransglucosylase/hydrolase protein 26 precursor
  Pfam annotation: Domain name=Glyco_hydro_16; Domain location=21-200; Score=318.4; E_value=1.3e-92; Accession=PF00722.11; Description =Glycosyl hydrolases family 16
  Pfam annotation: Domain name=XET_C; Domain location=226-278; Score =87.7; E_value=3.5e-23; Accession=PF06955.3; Description=Xyloglucan endo-transglycosylase (XET)
  Pfam module annotation: Pfam domain module=Glyco_hydro_16::XET_C; Domain location=21-200::226-278
MWVALLIFALAPNIIQVDANISKSMHLTWGVRHASILGEDLHLVLDKTSGSAAQSKRSFLFGSIEMLIKLVPGNSAGTVTAYYLSSAGSQHDEIDFEFLGNSTGQPYTVHTNIYTQGKGSREQQFFLWFDPTADFHNYTIHWNPTAIVWYVDSVPIRVFRNHEKEGIAYPNKQGMRVYTTLWNADDWATRGGLVKTDWHSAPFTARFHHFRARACKSGGARSTNQCASNVPANWWTSRRYKQLSHSQIGQLNWVRNNYMIYDYCTDTKRFNGQIPPECFKPQF

SEQ ID NO: 158476 - protein, 188 aa, Glycine max
  Coding DNA Sequence Number=SeqID_41698
  Homolog annotation: Hit_ID=Q60D96; Match level="QueryCoverage=67%, HitCoverage=93%, E-value=2e-20, Identity=44%"; Hit description =Unknow protein
MEKMIAVGIVWGATNAIMRRGALLWDEALKSSAKPNPHSTLCQKMRISLGNWVKLLSIWQYSIPFLINLSASATFFAILSDAPLSLAVPVTNATTFAATAVFGILLGERTHLPRAFFGTALIVLVTQLLVSPGSPPICRDIGGTLIGAPCSARLASPCSEMVESGSEWCAVPVRLNKAASGCPVVCVP

SEQ ID NO: 158477 - protein, 210 aa, Glycine max
  Coding DNA Sequence Number=SeqID_41699
  Gene Ontology: Mol. function=S-adenosylmethionine-dependent methyltransferase activity; Biological process=metabolic process
  Homolog annotation: Hit_ID=Q6ZIU7; Match level="QueryCoverage=91%, HitCoverage=59%, E-value=4e-49, Identity=50%"; Hit description =Bicoid-interacting protein 3-like
  Pfam annotation: Domain name=Bin3; Domain location=101-210; Score =228.5; E_value=1.5e-65; Accession=PF06859.3; Description=Bicoid -interacting protein 3 (Bin3)
MQHEQVANMHYTSSANRVEDAYWNLRKTVRLKSTGNKPVKASKLQDKDHADDSENSVTTLLNVKTEEISKEHSSSEQIDLLKIVSFKRENFVQTQHPPGKQYDTILCLSVSKWIHLNWGDDGLITLFAEVWKLLRPGGIFVLEPQPWKSYESNRNVSETTAANYRNIMIRPEQFQEILLDKIGFRTVEDITSGLTDSKTGFNRPILVFCK

SEQ ID NO: 158478 - protein, 95 aa, Glycine max
  Coding DNA Sequence Number=SeqID_41700
MAVDVREAEPEEDLGRDLRKRFLFLKKSEKGEQFVASGYKKKSETCCRCDECFRSKWDVRNFQVGEKETEIRLNWERQKKMKKKKIKIFNGSFKI

SEQ ID NO: 158479 - protein, 55 aa, Glycine max
  Coding DNA Sequence Number=SeqID_41701
METFKNLREYRLIKEKSSGKITLATHENQSQAWLTHPPPASYLWRLHQPAFISPK

SEQ ID NO: 158480 - protein, 263 aa, Glycine max
  Coding DNA Sequence Number=SeqID_41702
  Gene Ontology: Mol. function=translation elongation factor activity; Cellular component=intracellular; Biological process=translational elongation
  Pfam annotation: Domain name=S1; Domain location=102-175; Score=16.1; E_value=0.0063; Accession=PF00575.13; Description=S1 RNA binding domain
  Pfam annotation: Domain name=S1; Domain location=8-81; Score=88.4; E _value=2.2e-23; Accession=PF00575.13; Description=S1 RNA binding domain
  Pfam module annotation: Pfam domain module=S1::S1; Domain location =102-175::8-81
MAPVKNEDLIPGATFTGKVKSIQLFGAFIDFGGFTDGLVHVSQLSDGYVKDVASVVSVGQEVKVKLIEVNTETQRISLSMRENNNDTVKPGPRKDEVKKNTKFVEGQDLKGTLKNLARSGSFISLPDGEEEFLPISEESDEGFENFTGISSLQVGQQVSVQVLRINRGQLTLTMKKEDVAALDSEIGQGVVHVATNPFALAFRKNKDIATFLEEGKKIHNTVEISSAARTSKEIVKQGEIVSDVSDAQGEPESSKGLVDDASF

SEQ ID NO: 158481 - protein, 85 aa, Glycine max
  Coding DNA Sequence Number=SeqID_41703
LRHLLNIESSPEKHKNFLNRFIPIWYLTGDIWKGDVETTLDSERNYAPAHTLTLDGAVKCLEGWLPPCNLPDLPPTAMTSRDDGG

SEQ ID NO: 158482 - protein, 135 aa, Glycine max
  Coding DNA Sequence Number=SeqID_41704
MRLWKGSYYTMQYAIGGVSCDSVFHVKMLAHPQIRLTEFSSSVTRFRGFHEVSAIGRMFCDSVFHVKMLAHPQIHFTELSSSVVQFGGSDRGFMECHVIQEDSSAPKIWERTKLYVKNLEMKNRYIEGHAEDWGI

SEQ ID NO: 158483 - protein, 80 aa, Glycine max
  Coding DNA Sequence Number=SeqID_41705
DFLSVVSLVTIFQRNERGFEAFSPHGQDHLGLPSGVETKHERQKPIKALKDERKRGWGHNRPIVALLCAKQAGNVAARQP

SEQ ID NO: 158484 - protein, 340 aa, Glycine max
  Coding DNA Sequence Number=SeqID_41706
  Gene Ontology: Mol. function=nucleic acid binding
  Homolog annotation: Hit_ID=Q0ZCD0; Match level="QueryCoverage=49%, HitCoverage=15%, E-value=2e-10, Identity=26%"; Hit description =Integrase
EDPYKHLKEFHIVCSTMKPPDVQEDHIFLKAFPHSLEGVAKDWLYYLAPRQLSGESLYEYWERFKKFGGALGDMTPAEARNLIEKMFSNSQQFSARNDAIVLKGVHEVATDSSSSTENKKLEGKLDALVNLVTQLAMNQKSYTVARVCGLCSSVDHHTDLCPSLQQSGVNEQPEAYVADIYNRPPQQQNQQQQNNYDLSSNRYNPGWKNYPNLRWTSPSQQQQTVPPFQNAAGPSKPYVPPPMQQHQQQSQQRQQTTEAPPQPSLEELVRQMTIRNMQFQQETRASIQSLTNQMGSGNQIQVPPLVVAPAPEPVKLHSTPEKEDEIVAQKRKLPNKNFHA

SEQ ID NO: 158485 - protein, 192 aa, Glycine max
  Coding DNA Sequence Number=SeqID_41707
  Homolog annotation: Hit_ID=Q06765; Match level="QueryCoverage=95%, HitCoverage=80%, E-value=8e-59, Identity=57%"; Hit description=ADR6 protein
  Pfam annotation: Domain name=BURP; Domain location=51-188; Score=9.4; E_value=1.4e-09; Accession=PF03181.6; Description=BURP domain
MELHFLVISISVLFAPNTPIPSALRDLVKPGPEGVEIDNLPMQIVDTQYPKTFFYEEDLHPEKTMNVQFSKSPFTQPFTVFAWLKGLEIKDIEKGHTFADICMMREHVEGERNWERTFKYFQVPFVDKQEQYTVEGVQNLGGKAVMCHRLNFRTAVFYCHVVHGTTAFIVPMVAGDGTKTRTLSFATRILRP

SEQ ID NO: 158486 - protein, 233 aa, Glycine max
  Coding DNA Sequence Number=SeqID_41708
  Homolog annotation: Hit_ID=Q06765; Match level="QueryCoverage=70%, HitCoverage=63%, E-value=1e-55, Identity=59%"; Hit description=ADR6 protein
  Pfam annotation: Domain name=BURP; Domain location=61-229; Score =168.4; E_value=1.8e-47; Accession=PF03181.6; Description=BURP domain
MVLGAYVAARTSVNTGMPPVVEAEASSLLEAILWAKEFLYLAQNKEGTSENGPETQAISSNRTKMQDVGPCRPAWPISTLLESGVGFEFRRTILDDQGEDKYCAESLETLMNFVISKLGKNVQAFSSSFLSKQEEYTVEGVHNLGGKAVMCHRLNFQKAVFYCHEVHETTAFMVPLLAGDGTKTQALAVCHFDTSVLNFELFRQIMKVDPGTNPLCHFLGNKSILWVPNLATE

SEQ ID NO: 158487 - protein, 271 aa, Glycine max
  Coding DNA Sequence Number=SeqID_41709
  Subcellular localization annotation: CTP_CleavageSite=62; ConfidenceScore=5.69e-01
MTASSGSRRSSSPTTTFCRHPLKQSSHLCPTTLFCSPPSGRGCGCGKGSSQGSPDGVCKLSSAKTTWDLLHAAAGEVERMRLKQEGYAFNHQNGNLIPQRKPSPVIPLPSKTTTSTPNPDMGGFYTQQHSLSHQRLQIAQFQMLRQQQLAKQQNSVWNLQKQCGGVYSQRQQQNNQMDHNRGRNNDVNNSVGGRNVRPLGLSASAWPPLQHAKQQNQNYGSGMRAVFLGNPSGRRECAGTGVFLPRRVDTPEPRKKQGELHKHIFEVLRCI

SEQ ID NO: 158488 - protein, 112 aa, Glycine max
  Coding DNA Sequence Number=SeqID_41710
MENHRFISKSDSAKARSNRKRIRQQKVHLNVQDSVHASVNPASSHTEDDYNQPKSPPHSVHAIFNRASHDAEDHFNICDSSQNESSGSIEVGYPNCESSHHDSSMDTEVNVL

SEQ ID NO: 158489 - protein, 49 aa, Glycine max
  Coding DNA Sequence Number=SeqID_41711
MEVNEPWLGLWLPLNYQVDMGASQHRTPKLGYQVGPLVLVKSSTLNLGG

SEQ ID NO: 158490 - protein, 88 aa, Glycine max
  Coding DNA Sequence Number=SeqID_41712
MKAKRDQKWLRGARTVSPGNINHVPSSLMGQRLPNLNLLNDVLCSFSAGKGQRLVGRDPIPICIRSHVPANRKQKYAANRDRSSSYLG

SEQ ID NO: 158491 - protein, 153 aa, Glycine max
  Coding DNA Sequence Number=SeqID_41713
  Subcellular localization annotation: CTP_CleavageSite=62; ConfidenceScore=5.42e-01
MNCVFVHVSSTFGFGTVFHDCLSADPQGNPPFSPFLRSSMNCIFVHVSSTFEFGAVFHDCLSADPQGNPPFSPFFGISMNCIFVHVSSTFEFGTVFHDCLSADPQGNPPFSPFFRSSMNCVFVHVSSTFMFRTVFHDWLSADPQGNPPFSPFG

SEQ ID NO: 158492 - protein, 204 aa, Glycine max
  Coding DNA Sequence Number=SeqID_41714
  Gene Ontology: Mol. function=hydroxypyruvate isomerase activity
  Homolog annotation: Hit_ID=Q0M7Z8; Match level="QueryCoverage=98%, HitCoverage=81%, E-value=6e-64, Identity=62%"; Hit description =Hydroxypyruvate isomerase
MTSGIIGDLNVADFVLQALEGRDEIALHDLHVVEIILDQQVGMPDTVHDPLGLIGVGEEIAGQGQFRNPPDVAQRGRDCRQACLPELADRHRAVDTGQTIDLSASQNFCIADRRFNGRLKFGDPVRQAGDAALACGPVAGRQVEQSLCEIAPLELRCNRLCRLLVGADIFDCRKTIGSGGGEPFHERMFGIKHGQIGGEFRHWQ

SEQ ID NO: 158493 - protein, 52 aa, Glycine max
  Coding DNA Sequence Number=SeqID_41715
MSVEKYQSGLFKDRRQEMFDRRHPVILFILDIDRSSFLADVNYHLFFINIGE

SEQ ID NO: 158494 - protein, 136 aa, Glycine max
  Coding DNA Sequence Number=SeqID_41716
MIEVFKGEDVKPNFKIIAHRVKACYEGFQQPRHSMSGIEYNCGHLTTTQAVSIGVEYGCGDSTTTVEGILVCMTMNYFLELASDMSILSLDSLDSATWSRLWYIQHSRGNQYDNGSTMTPLLNNVNLLTMVMVNSL

SEQ ID NO: 158495 - protein, 125 aa, Glycine max
  Coding DNA Sequence Number=SeqID_41717
MFIQLVTYDTSTKCVEHIIFDWADLEINLGAQGHTVLNGMPRNSPMIRTCHIRVVSSRKWRLRNLCWAYGYHCNIEQIRDDIAGEDIGTWDYKGIMESLATHELQPLHEVLTPSSPRHSSWVPYY

SEQ ID NO: 158496 - protein, 85 aa, Glycine max
  Coding DNA Sequence Number=SeqID_41718
  Gene Ontology: Mol. function=structural constituent of ribosome; Cellular component=intracellular; Biological process=translation
  Homolog annotation: Hit_ID=O82204; Match level="QueryCoverage=80%, HitCoverage=43%, E-value=4e-11, Identity=51%"; Hit description=60S ribosomal protein L28-1
MASDDGKMNLLLKTSKISENRMVTRMKAPKMIGRLSFRVGLTLEVANNYYRPDLKKAALARLSVVNRSLRVAKSGVKKRNRQAVK

SEQ ID NO: 158497 - protein, 112 aa, Glycine max
  Coding DNA Sequence Number=SeqID_41719
MHNVSKHQPIWQTNIGEPVSTHTTTCEVDKLYKKPEFKELHNRRLGRGLKNWSSALSASTSAQHEEPTWRPDLACIWWLSTHLAAWPAFGGLAHNHLYPLDFACVLREHMQA

SEQ ID NO: 158498 - protein, 50 aa, Glycine max
  Coding DNA Sequence Number=SeqID_41720
MALPQPRGSSLSKAPVVVAPCMALKRVNIRSIVFEVLKTMNQNCIHETPN

SEQ ID NO: 158499 - protein, 580 aa, Glycine max
  Coding DNA Sequence Number=SeqID_41721
  Gene Ontology: Mol. function=protein binding; Cellular component =membrane; Biological process=defense response
  Homolog annotation: Hit_ID=Q1SW19; Match level="QueryCoverage=96%, HitCoverage=59%, E-value=1e-130, Identity=45%"; Hit description =Disease resistance protein
  Pfam annotation: Domain name=NACHT; Domain location=195-350; Score= -39.0; E_value=0.064; Accession=PF05729.3; Description=NACHT domain
  Pfam annotation: Domain name=NB-ARC; Domain location=157-466; Score =274.2; E_value=2.5e-79; Accession=PF00931.13; Description=NB-ARC domain
  Pfam module annotation: Pfam domain module=NACHT::NB-ARC; Domain location=195-350::157-466
MEKLQEIAVSLAVDYLLPPLKKAVNSVMEVPKDAADMKDKLDGIQAMIHDVDKMAATEEGNSRDGLKAKVKLLVETSFCMEDIVDEYIIHEERQLGDVPGCASLPCKAIDFVKTRASRLQFAYMNQDVKSEFPGIKERNKSEDCSQIQSSRGNQNITFDNLRMAPLFLKEAEVVGFDSPRDTLERWLIEGREKLTVVSVVGMGGLGKTTLAKKVFDKVQTHFTRHVWITVSQSYTIEGLLLKFLEAKKRKDPSQSVYSTMDKASLISEVRNHLSRNRYVVVFDDVWNENFWEEMKFALVDVENGSRIIITTRYREVAESCRTSSLVQVHELQPLSDDKSFELFCKTAFGSELDGHCPNNLKDISTEIVRKCEGIPLAIVATGGLLSRKSRDAREWQRFSENLSSELGKHPKLIPVTKILGLSYYDLPYHLKPCFLYFGIYPEDYEVECGRLILQWVAEGFVKSDEAAQTLEEVAEKYLNELIQRSLIQVSSFTKCGKIKSCRVHDVVREMIREKNQDLSFCHSASERGNLSKSGMIRHLTIASGSNNLTGSVESSNIRSLHVFGDQELSESLVKSMPTKY

SEQ ID NO: 158500 - protein, 187 aa, Glycine max
  Coding DNA Sequence Number=SeqID_41722
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=53%, HitCoverage=12%, E-value=2e-17, Identity=77%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=24-140; Score=-127.3; E_value=0.059; Accession=PF00977.11; Description =Histidine biosynthesis protein
MMHVLETWWEAWVHGYFASGIGGILWASLAGGNGEIRVSPTGMAEHLQTDPLKKMFEIISPLEYIGRERDKEKFTKLDKTKFGQGKGFNVDLIKLISDAVSIPVIASSGAGAPQHFSEVFYKTNETVALAAGISFTGKRQFSVFKNPLSLKITTNKWDYLCPFGAYSVGKRAFVKGRRRSWNLIISI

SEQ ID NO: 158501 - protein, 805 aa, Glycine max
  Coding DNA Sequence Number=SeqID_41723
  Gene Ontology: Mol. function=RNA-directed DNA polymerase activity; Biological process=RNA-dependent DNA replication
  Pfam annotation: Domain name=AT_hook; Domain location=9-21; Score =14.7; E_value=0.067; Accession=PF02178.9; Description=AT hook motif
MKEVVVGSKRSRGRPPKTVSPIPINPPSLVAPPEMESEIHDEDEDGDLANSKQGPANGSETVAQETLIEDQDGIGRKLWVDVISGNRNLAKGRVMQYVAPKVVDGEIDVKIEDKDVAPELKFWETTLILYVLGGDISMHMLKNFMEKAWNFVSLPDMYYHDDGYFMLCFKSHADMDAVLMKGPYTIRNMPLILQEWRPDFDLKKDMLSTIPIWVKLPKLALHLWGETSLNKIGSAIGIPPVTDECTTHRLRVSYARILVECQTIGHQCDGAAKHKIWKPKPKKVDPDKQPKAEKNSTLVKTPIRDKGPNIIDVEDGGCWTVVNKSRDKRKGKDAAESSSTLQCLNGFEALGALNGPQGPYDRGPSGKLREISSHLLKLQPTIVVLIQTRVKQEKAQKIRDKLCLKGRYLDNYNHHENGRLWIEWNDNKGPWCAVGDYNNGAKSQDRVGGKLVTEAEYEDLQAMMDATGLSEMDSSGEFFTWTNKQADNPIYSMIDRILANIDWFQTHSDANLTILPPPHVSDHSILYLSEPLHVRKRNQFRFNNCWVDAVGFYSIVERSWNQPARGTPMQRLWYKLHRLRPHLLKLNKFTNDIQKNKLVAREKLDQAQQDLRNNIMDAPRIEEVKRLTNEVIHWNEMEEKMLMQRSKIDWIRAGDGNNAFFHAYLKSRQNAKRIKVIHKDDGTILTTQKEITQEVLAFYGKLMGHDSRSLQHVDIDALRRGDHLTMVQREDLVRPVTVKEIEDALNGISDLKSPGVDGYSSKFFKSCWNIVKEDVVNAAQEFFAQDQLFLPFNQTVVTLVPKSDN

SEQ ID NO: 158502 - protein, 376 aa, Glycine max
  Coding DNA Sequence Number=SeqID_41724
  Gene Ontology: Mol. function=fructose-6-phosphate phosphoketolase activity; Cellular component=intracellular; Biological process =organic acid metabolic process
  Homolog annotation: Hit_ID=Q1B884; Match level="QueryCoverage=99%, HitCoverage=45%, E-value=1e-175, Identity=78%"; Hit description =Fructose-6-phosphate phosphoketolase
  Pfam annotation: Domain name=XFP; Domain location=1-375; Score=219.1; E_value=1e-62; Accession=PF03894.5; Description=D-xylulose 5 -phosphateD-fructose 6-phosphate phosphoketolase
MTAEATKVLGAYLRDVIDLNPNNFRLMGPDETASNRLSTVYERTDKVWLERSETTDEHLGPEGRVMEVLSEHLCQGWLEGYLLTGRHGLFNCYEAFAHIVDSMLNQHAKWLSSSTEVPWRQPIASLNYLLTSHVWRQDHNGASHQDPGFIDHVANKRPEVVRVYLPPDANTLLAVTDHCLRSRHCVNVVVAGKQPALTYLSMEAARAHCARGLGIWDWASNAPNEPDVVLACAGDVPTLETLAAADILRRRLPELAVRVVNIVDIMRLQPASEHPHGLPHSDFDALFTPDKPIIFAYHGYPWLIHRLAYRHTNHDRMHVRGFKDRGTTTTPFDMVMLNDLDRFHLVMDVIDRVEGSGQPSRKPTAGNGRRPEIAAC

SEQ ID NO: 158503 - protein, 78 aa, Glycine max
  Coding DNA Sequence Number=SeqID_41725
MTEYTNCLTNGILEAYSGILEGFKATDNELVEIIIKKGEGYLRRQSECSKKERRMDCDGGAAEDGGDGKQTTKDARLQ

SEQ ID NO: 158504 - protein, 91 aa, Glycine max
  Coding DNA Sequence Number=SeqID_41726
  Subcellular localization annotation: CTP_CleavageSite=56; ConfidenceScore=5.12e-01
GRSNRGFIFPYQEAFLYNKEKNKMKDCKSTSGKDVSFTSRISQSLTNSSQSFKPALASSSGRCKSSHNQISQNSLQLGPFSLSRNPRHVKL

SEQ ID NO: 158505 - protein, 70 aa, Glycine max
  Coding DNA Sequence Number=SeqID_41727
MSGFTRDSPQISASPHQLDLAPYASEPYNAQWDAPGLLRDKHTSRFESYSRRNGGVVHHWKCSRQTLWLI

SEQ ID NO: 158506 - protein, 53 aa, Glycine max
  Coding DNA Sequence Number=SeqID_41728
MSITVDHDRSMLGSSEPTELESQSVSVTGDHDPLLRIPLTPTKRVSSDELDNE

SEQ ID NO: 158507 - protein, 226 aa, Glycine max
  Coding DNA Sequence Number=SeqID_41729
  Gene Ontology: Mol. function=endopeptidase inhibitor activity; Cellular component=cellular_component; Biological process=biological_ process
  Homolog annotation: Hit_ID=Q9XIS8; Match level="QueryCoverage=80%, HitCoverage=88%, E-value=1e-40, Identity=49%"; Hit description =Trypsin inhibitor p20
  Pfam annotation: Domain name=Kunitz_legume; Domain location=50-220; Score=164.8; E_value=2.3e-46; Accession=PF00197.9; Description =Trypsin and protease inhibitor
PSLVTPIHCLEVQQAKIMKSSIPTTTTSTLLTLFLLSAFTSHLPSAGADAVTDRDGAAIRNGGTYHILPLFGVKNGGLELAATRNETCPLTVVQSRTAQIFRGLPVRISSPYRIAYISEGLILNLAFASSPSCAPTPPNWTVVKGLPEGQGVKLLGYGRSTVSGWFKIEKSSLEYLYKLVFCARASKACGEIGISVDDEGINRLVLTEEEGDGIIVEFMKASSVSA

SEQ ID NO: 158508 - protein, 66 aa, Glycine max
  Coding DNA Sequence Number=SeqID_41730
MCVSRAHKERKKEVGMCTQRMKDDEMEVLGSGRHTKGWCRKQMWSVGSKGPNMVRLRKGPCKNNTK

SEQ ID NO: 158509 - protein, 526 aa, Glycine max
  Coding DNA Sequence Number=SeqID_41731
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=72%, HitCoverage=31%, E-value=5e-89, Identity=56%"; Hit description=Chromo
  Pfam annotation: Domain name=Peptidase_A3; Domain location=178-332; Score=-94.2; E_value=0.069; Accession=PF02160.6; Description =Cauliflower mosaic virus peptidase (A3)
  Pfam module annotation: Pfam domain module=Peptidase_A3::RVT_1; Domain location=178-332::331-501
MAKHNDRTRLQHLQSQVSAIQTWMEDQRTRDKKLQDRFDELQASNQARMDLTQRSIDLLIQSQSHTIGGSKSNRGTPGSSNGVSVTSIATVSAVRDISLGFPHFDGNTPVLEWIFKEEKFFNYHSTPDLDRVDIASIHFQKDFSFTHKCPNRQILLLQTESDDVELEGHDSKDIIDNVDGTIMFTTYIDKLPVKVLVDGGSSDNFLQPKVAKVLKLPVEPTPSFKVMVGNGNYMAAEGVVSKLTIKAKNARFQLPVFLLPISGADLILGSSWLKTIGPHIANYDKLQLKFMYDGSQLVKVKPYRYPHSQKEEIEKLVNGMLEEGIIHPSKNPFSFPIILVKKKDGSWRVCTDYGALNSITIKDTFPIPTVDELIDELYEAVFFSKLDFKSGYHQILFNPEDRYKTAFRTHHGHFEWLVMPFGLTNAPITFQSLMSDIFKGALRRFVLVFFFYDILILSSNWKDHLSHLEVVLNTLKQHHLFARFSKCAFGVREIDYLGHTLLGVGVAMETTKLQAVLNWPLPTSLK

SEQ ID NO: 158510 - protein, 56 aa, Glycine max
  Coding DNA Sequence Number=SeqID_41732
MAQTKVHRWCCDDVVVSRPIGCTHADLELGAIGGRKWICAMWVCTTMLKDKGGVAE

SEQ ID NO: 158511 - protein, 146 aa, Glycine max
  Coding DNA Sequence Number=SeqID_41733
  Gene Ontology: Mol. function=copper ion transporter activity; Cellular component=integral to membrane; Biological process=copper ion transport
  Homolog annotation: Hit_ID=Q39065; Match level="QueryCoverage=74%, HitCoverage=65%, E-value=2e-21, Identity=47%"; Hit description =Copper transporter 1
  Pfam annotation: Domain name=Ctr; Domain location=21-133; Score=59.8; E_value=9.2e-15; Accession=PF04145.6; Description=Ctr copper transporter family
MYMSPGQDMSSMSNDRNNMSMMMHNSFYWGKDAIVLFPRWPENNVGMYILALIFVFFLAMAVEVLSNQPLLKPGTSPLVGGLIQAGVHLFRISFVYMVMLAVMSFNAGIFIAAVVGHTLGFFVAKFRALSIANRKDKGSSSILNNV

SEQ ID NO: 158512 - protein, 81 aa, Glycine max
  Coding DNA Sequence Number=SeqID_41734
  Subcellular localization annotation: CTP_CleavageSite=50; ConfidenceScore=5.37e-01
MASMLVSRTIEFNNLTGKIGPSVFNHCTPSTTSAPQFGNMWKSTEKKPLSCPMENSSLTVNHLIQPYFNLLSENQLRAVNT

SEQ ID NO: 158513 - protein, 111 aa, Glycine max
  Coding DNA Sequence Number=SeqID_41735
MMVQGWFCGCRGVGVESDVEFIFGQGGGCTWFWNLVSGGGALHGLEEVGLSCNAKVVSIDYGCVSSDVDGADGLGEKKGPIAIWLGSISTSVHNWYWATTKAHLTFMEATW

SEQ ID NO: 158514 - protein, 342 aa, Glycine max
  Coding DNA Sequence Number=SeqID_41736
  Gene Ontology: Mol. function=oxidoreductase activity, acting on the aldehyde or oxo group of donors, NAD or NADP as acceptor; Cellular component=cytoplasm; Biological process=methionine biosynthetic process
  Homolog annotation: Hit_ID=Q3BRK7; Match level="QueryCoverage=99%, HitCoverage=99%, E-value=1e-164, Identity=85%"; Hit description =Aspartate semialdehyde dehydrogenase
  Pfam annotation: Domain name=Semialdhyde_dh; Domain location=9-124; Score=161.7; E_value=1.9e-45; Accession=PF01118.15; Description =Semialdehyde dehydrogenase, NAD binding domain
  Pfam annotation: Domain name=Semialdhyde_dhC; Domain location=143 -324; Score=270.8; E_value=2.7e-78; Accession=PF02774.9; Description =Semialdehyde dehydrogenase, dimerisation domain
  Pfam module annotation: Pfam domain module=Semialdhyde_dh::Semialdhyde _dhC; Domain location=9-124::143-324
MSNAQRSFHVAVVSATGAVGETMLSILAERDFPVGTLSVLASERSAGGEIEFNGQKVKVQDLATFDPSGVEIALFSAGGSVSKEYAPKFAAAGAVVIDNSSAFRYDDDVPLVVSEVNPEQVANRPRGIIANPNCSTMQMLVALAPLHRKYGIERINVSTYQSVSGGGRSATEELGKQTGQLLSFQEIDPQRFPVQIAFNLIPHIDDFQDNGFTKEEMKLIWETRKILGDDSILVNPTAVRVPVFYGHSESVAIETRDKVTVAEARALLEQSPGIEVVDRHEAGGYPTPVTHASGTDAVYVGRIREDLSHPRGLNLWIVSDNVRKGAALNAVQLAELVAAEQR

SEQ ID NO: 158515 - protein, 132 aa, Glycine max
  Coding DNA Sequence Number=SeqID_41737
MASRKRKAPSTPTQVRFDRSRFTSQEAWERYTYIIVPRKLLPERNVVEFYTNLYDRKDKSPKQICPQELAAKLCIPGRGFELNADGQPLKILRKNMTTLAQTWSVLSFSNLIPTSQLLMSLLTWPDSFMALL

SEQ ID NO: 158516 - protein, 175 aa, Glycine max
  Coding DNA Sequence Number=SeqID_41738
  Subcellular localization annotation: CTP_CleavageSite=36; ConfidenceScore=5.06e-01
AKFDIGEATKVKTKVMSTVATRWRQFKSTLTSKFVFAKSEGQQTQDVVTKYGLDPEAWKQFEETRLTPNWEGIRKRAQSIQKHNDCPHVLSRGGYDLLEKKLLDQKRKRIQEEALLSENAASLDEPPSPIKRHVKWKVARTRAVGNMTSESAQEIANKIVGSPICCNVHMFKYFE

SEQ ID NO: 158517 - protein, 195 aa, Glycine max
  Coding DNA Sequence Number=SeqID_41739
  Gene Ontology: Mol. function=protein binding
  Homolog annotation: Hit_ID=Q9T0K5; Match level="QueryCoverage=49%, HitCoverage=12%, E-value=2e-28, Identity=67%"; Hit description =Extensin-like protein
  Subcellular localization annotation: CTP_CleavageSite=41; ConfidenceScore=5.45e-01
MGPKSTLRLMRTLGPSLASLAHSSWSLLSNALARTPSTGKRMFVVGNIHVLFNPNRGDIKLSQLDIQLHDHRNMLGQLEIQTNKVFGSQIVDEPSLLTDLTLLHINTNRFYNTVQHKFDKLKLPFELDLSNNCFVRKFPDVVLCLSQLKFLDMRFIKFKGTVLKELFDKDLDAIFINDNRFIFNLLENLKTRWCR

SEQ ID NO: 158518 - protein, 41 aa, Glycine max
  Coding DNA Sequence Number=SeqID_41740
MVSRRVRESGVFGLFGWEGFILWSEVAAGVWKKGWKKDTKE

SEQ ID NO: 158519 - protein, 77 aa, Glycine max
  Coding DNA Sequence Number=SeqID_41741
  Homolog annotation: Hit_ID=Q1T1V6; Match level="QueryCoverage=44%, HitCoverage=2%, E-value=8e-08, Identity=80%"; Hit description=AAA ATPase
MDRDFEHKHDQSLVHSVEDNKVNYLLEWEESNCDDIATSVDVEEHLYGLAKDMRIMLVTSSQRLALIPFHSNGTAAG

SEQ ID NO: 158520 - protein, 124 aa, Glycine max
  Coding DNA Sequence Number=SeqID_41742
MGDSDYGGLIQQPLIDWEAIFVGGSSSENTHRGASNSESSSLERVRALHRTGRGISHLCGRAWPSATSGVPIPVIVILPTSASSGVTKCSGCGDVKASPHELLQANDTRARINLRGHPIWRAFA

SEQ ID NO: 158521 - protein, 130 aa, Glycine max
  Coding DNA Sequence Number=SeqID_41743
MYSRMQSQGLALSPKAKASVEEVRDADARIPVPTQEVQLVGMTLNTFLSWATYLVKPFSEHDKQVVEGQVKPIDMSDPDIDPLYLMTLIIPQLFLKLLQAYDSDNYASGECRCEWIPRVTVYTKIWAIAL

SEQ ID NO: 158522 - protein, 131 aa, Glycine max
  Coding DNA Sequence Number=SeqID_41744
YILCGTRRGYIYLGLTENKRGYISCGSVLVEGASTRVSKRTREGHSMQQSQDDKSTIQNSGVSLMAESQHFAIVPDDKPRLAFMLYFGAIEEILEVDSNISVRTDDFGFTLIDLKKLAYQNEPFIMAEQAK

SEQ ID NO: 158523 - protein, 353 aa, Glycine max
  Coding DNA Sequence Number=SeqID_41745
MDFVFCIFLENAMRSLSTHVALSEMNTHLPDELPMAKRGLFAKPRWPPGSVRALGQGQLLKRKVEIYHTEFDDFKTELERLNLHKHLTNLAYGTIDVALVKEFYANLYSFEDPSPKQARVRGHLVKIDVDSLNTFLETPVVLEDGGVWSVLSYSNLAPTSHTSDLTVDRARLIFGLVSHMDMNIGALISGQMTFIAQSNSCRLEFPALITALRQARGVVSDSLTFERLSPTINLAYIRKNYWNIDDLIVAFRGARRARARVVCPGAQPSFDREGEGPIAQVPQQVQDASSETTIPEPFTHHPEAGEEQVRLETTATLERSLESTSELPTPMADLSSPQPAADPSTPLHDIPED

SEQ ID NO: 158524 - protein, 627 aa, Glycine max
  Coding DNA Sequence Number=SeqID_41746
  Gene Ontology: Mol. function=nucleoside-triphosphatase activity; Cellular component=integral to membrane; Biological process=transport
  Homolog annotation: Hit_ID=Q9SZR9; Match level="QueryCoverage=99%, HitCoverage=99%, E-value=0.0, Identity=53%"; Hit description =Probable white-brown complex homolog protein 9
  Pfam annotation: Domain name=ABC2_membrane; Domain location=358-564; Score=169.2; E_value=1e-47; Accession=PF01061.14; Description=ABC-2 type transporter
  Pfam annotation: Domain name=ABC_tran; Domain location=71-259; Score =139.9; E_value=6.9e-39; Accession=PF00005.17; Description=ABC transporter
  Pfam module annotation: Pfam domain module=ABC2_membrane::ABC_tran; Domain location=358-564::71-259
MDHLQHQEMVDIESQTVEIPDILHKGKRQVILKFDNVVYKIKTKKGGVFVKNKETEEKEILKGVKGVVEPGEMLAMLGPSGSGKTTLLTALGGRLRGKLYGSITYNGEAFSNSMKRNTGFVTQDDVLYPHLTVTETLVFTALLRLPNTISKEEKVKKAKDVIDQLGLTKCKDSIVGSPFLRGVSGGERKRVSIGQEMLINPSLLFLDEPTSGLDSTTAQRIVSTLWELACGGRTIVMTIHQPSSRLYYLFHKVLLLSEGNSLYFGKGSEAIEYFSNIGYAPALAMNPADFLLDLANGIYTDESNTDHAIDKQKLVSMCKINCAAQLKPAALEGINDSSKSQNRFQEKGSEKWPTSWSQQFTVLLRRDIKERRHESFSALRVAQVFVVALISGLLWYKSDISHLQDQIGLLFFVSGFWGFFPLFQAIFTFPQELLMLEKERSSGMYRLSSYFMSRVVADLPMELSLPTIFILITYWMAGLKGKLLNFLYTLLTLLLHVLVSQGLGLALGATVMDQKAATTLASVLMLCFLLAGGFYVQHVPVFISWVKYISINYYNYQLFIASQYSDGETYPCSTGQCRVAEFPSIKQTGFHFNLQEQVMAASALVIMMIGYRLIAYVALMRIGVTKK

SEQ ID NO: 158525 - protein, 117 aa, Glycine max
  Coding DNA Sequence Number=SeqID_41747
  Subcellular localization annotation: CTP_CleavageSite=7; ConfidenceScore=5.28e-01
MSMPNFNCQKSMNIINNFNGLNQEFLTIMPNFRVHNATLSSEFIMPNKKCLTSSTKRRMPNYNVIRSTLIQANFKVHNVILHYDNVPKGVRHNDARQRKAHGRDHQVMNRTLRIAKG

SEQ ID NO: 158526 - protein, 93 aa, Glycine max
  Coding DNA Sequence Number=SeqID_41748
MYVWAIRRFVGSVSKANDVPTCCRDGSGDWMHHLRAHKRKTFLDSLKLLFSIIGHSSLMEKRVESALKFDLEFLGTKASLTSNLIRITRSNFA

SEQ ID NO: 158527 - protein, 1189 aa, Glycine max
  Coding DNA Sequence Number=SeqID_41749
  Gene Ontology: Mol. function=transmembrane receptor activity; Cellular component=membrane
  Homolog annotation: Hit_ID=O80386; Match level="QueryCoverage=99%, HitCoverage=99%, E-value=1e-167, Identity=36%"; Hit description=COP1- Interacting Protein 7
MDPYSRLDHALFQLTPTRTRCDLVVVGGGVSERLASGLLEPFLSHLKSAKDQISKGGYSITLRPPGEHAHWFTKATLQRFVRFISTPEVLERFVTIEKEIVQIEGSIQSSERNNLLAEAEGSISSTDGRVKRSTTSSKMKDESAGINEDGHEENSRVRLQRVLDNRKAMLCKEQAMAYARALVAGYYPESVDDLICFADAFGASRLREACINFLELCKQKNEDKLWIDEIAAMQAAAQPELPYLRTSGIILAGEDDTSSKLNGIVDASISESTPSHASLDIGHDYSLPTSGQTPSTDGRAQIPMSWPNHLPQYMHNFQGHHPFQQMSPYQGYLYPGMQVPSSYYPGNMQWPSNMEDPHIVHDRDKDYHKSSYKKKKKKHSQTLQQSEEDSSTASSDSSYESDSDNHSRKGKKHSSTEHHHKKKHGKKSSRKVVIRNINYITSNGDGEKGSVTEGSLSNEEEFINGDSLKQQVEEVVGSFERRNKSSSRHRKKQHIAKHSGKLNGSNDADSNGMKGNNNWDAFQNLLLRDDDSTPDTEEQPMKFQEEYIGSQNFENGRSNEFNHEPDFSKTRAVSNDSFVVTERGFDGEVQNRVDNFKDGKDAPSLMKKNINTDEAMLFSQRNDKSGSYSMSNLSGNGPESSLTKCQTEEDWFIINQSGKPGNVDQNRDFSMFDGISVSSSATDSFHVEKNRKDIVTDDSFMIQARSSEDQFNSQSAADLSLVSDIVGATEFMNSTQEGSHNKNETLNSHEPDDLFMVLDRDSTLEQSLAPWSMEMDYDNNISSNEANRKLSEVETDKNHSSNLEGTDTKTPGVKNGKVSSKEAKPKALNASLGKSKSNITSRSKASPGSKTRVTKSKSEKEEENRKKKEELMIQRQKRIAERSASKKTGTGTKTSLTSAKKENPKIHPSNEETKKLQKPVIRNSTIERLATARVSQSKVSPSPAKSGPTKKPTLKANGVPLQKTTSTEKKQDPKEVKSSSLKEDAKKTNGEVLGATNGQAKNEIEISVALPRNSGATQSVETNNSNLGLKDNGELSKTSSEKDATSLISEREHVHANVGQLHADPSLPNHNLALGGNQPRGEEVSNKLSSLPGDSKPQHITDVITNPTAALPSKPLTVSAVNSNVNQEIHENNAILPQVTEKQISTTPPPNNQVMMPESVHSRKKWNTDEDNSKPAKGFRKLLFFGRKS

SEQ ID NO: 158528 - protein, 112 aa, Glycine max
  Coding DNA Sequence Number=SeqID_41750
MSNPSKSHNVDGKKDVKFDGIVMFIKCYMLHASNMKIGIVFLTLDANIILAKCHNLPFSRRVRQDSKECHPKRTTRGSCHQCLFEENIRKTKKRSAYFENKGPRVVYAWGRY

SEQ ID NO: 158529 - protein, 75 aa, Glycine max
  Coding DNA Sequence Number=SeqID_41751
MRLLIKEEGDEDAQYKKEDPKGRAGYFTPKSFGGPSELEARQGEPGRDKDTNFVRAILLFDWATGENQGSETEKI

SEQ ID NO: 158530 - protein, 191 aa, Glycine max
  Coding DNA Sequence Number=SeqID_41752
  Homolog annotation: Hit_ID=Q6T7D3; Match level="QueryCoverage=80%, HitCoverage=83%, E-value=5e-59, Identity=71%"; Hit description=Fiber protein Fb34
  Pfam annotation: Domain name=DUF1218; Domain location=50-165; Score =226.5; E_value=5.8e-65; Accession=PF06749.3; Description=Protein of unknown function (DUF1218)
MTDLELFLTWVKKFGIDVIVKVLFQKQSPSACENVMASVVTDNEKNYNYCVYNSDIATGYGVGAFLFLLVSQVLIMVASRCFCCGKPLNPGGSRACAVVLFIICWVFFIIAEVCLLAGSVENAYHTKYRTIFGENPPSCETVRKGVFAAGAAFVFFTAIISEFYYINYSRARESFQPYAGGETGVGMGTYK

SEQ ID NO: 158531 - protein, 116 aa, Glycine max
  Coding DNA Sequence Number=SeqID_41753
HGPEIYPKAHKNPTAFSCISGPIYLEFSIQCPCGVGLHHMTPVEARNLIEKMASNSQQFSARNDAIVLRGFHGVAMDSSSSAENKKLEGKLDSLVNLVTQLARNQKSASAPIARVC

SEQ ID NO: 158532 - protein, 448 aa, Glycine max
  Coding DNA Sequence Number=SeqID_41754
  Homolog annotation: Hit_ID=Q9LDG7; Match level="QueryCoverage=63%, HitCoverage=31%, E-value=1e-77, Identity=54%"; Hit description=WD-40 repeat protein-like
  Pfam annotation: Domain name=WD40; Domain location=292-330; Score =39.5; E_value=1.2e-08; Accession=PF00400.22; Description=WD domain, G-beta repeat
MSKALGGTTEDEDEEEQQLLEQDQDCFYDSHDRLLSLSSSCSCSNSNSDNENDAEEHQNDTLPNFTNFYDIWISQPSSVSERRTRLLLSLGLSSLTRPIPRDRASPLRFISDTTTTNPNKPPNPKPPPPPPPPPPPPPPPPSPPIEELCTIRDLDNGKEFVVNELENLREVATGRQLTMEEFEMTVGHSPIVQELMRRQNVEEANVDSNAGGSKAKKKGTGWLKSIKSVASSVAGYRDRRSSDERDTSSEKGGRRSSSATDDSQEGSGGAFHGSERVRVKQYGKSCKEVTALYKSQEIRGHSGSIWSIKFSLDGKYLASAGEDCVIHVWQVVEGERKGELLLLDREKGEDGNVNMFLVVNGSPEPMAGAAGLLSPLGDGERKRKGRSSVSRKSLSLDQFVVPQTVFALTDKPVCSFLGHLHDVLDLSWSKTQVIFCTLILDLPDFSLN

SEQ ID NO: 158533 - protein, 319 aa, Glycine max
  Coding DNA Sequence Number=SeqID_41755
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=99%, HitCoverage=35%, E-value=1e-109, Identity=62%"; Hit description=WD -40 repeat protein-like
  Pfam annotation: Domain name=WD40; Domain location=106-144; Score =10.1; E_value=2.4; Accession=PF00400.22; Description=WD domain, G -beta repeat
  Pfam annotation: Domain name=WD40; Domain location=13-51; Score=37.6; E_value=4.4e-08; Accession=PF00400.22; Description=WD domain, G-beta repeat
  Pfam annotation: Domain name=WD40; Domain location=146-186; Score =11.1; E_value=1.8; Accession=PF00400.22; Description=WD domain, G -beta repeat
  Pfam annotation: Domain name=WD40; Domain location=55-92; Score=6.0; E_value=7.3; Accession=PF00400.22; Description=WD domain, G-beta repeat
  Pfam module annotation: Pfam domain module=WD40::WD40::WD40::WD40; Domain location=106-144::13-51::146-186::55-92
MDKTVRLWHLSSKSCLKIFSHSDYVTCIQFNPVDDRYFISGSLDAKVRIWSIPDRQVVDWTDLHEMVTAACYTPDGQGALVGSYKGSCHLYNTSENKLQQKSKINLQNKKKKSHHKKITGFQFAPGSSSEVLITSADSRIRVVDGVDLVHKFKGFRNATSPISASLTANGKYVVAASEDSHVYIWKNEADCRPNRTKGVTVTRSYEHFHCKDVSVAIPWPGVGDAWDMHDTLSGEQPELDNHADEVASANHPPTPVEENFVTEGSRSASGYSNSPRHATIASATNTYFFDRISATWPEEKLLLATRNQSPRVSMDFSNG

SEQ ID NO: 158534 - protein, 174 aa, Glycine max
  Coding DNA Sequence Number=SeqID_41756
  Gene Ontology: Mol. function=receptor activity; Cellular component =integral to membrane; Biological process=negative regulation of transcription
  Homolog annotation: Hit_ID=Q9C929; Match level="QueryCoverage=98%, HitCoverage=52%, E-value=3e-59, Identity=57%"; Hit description =Putative G protein-coupled receptor; 80093-78432
  Pfam annotation: Domain name=LANC_like; Domain location=3-174; Score=- 75.1; E_value=0.00094; Accession=PF05147.3; Description=Lanthionine synthetase C-like protein
MGAYQVTKDGNDHNLCSEIVKACDSASIDSRKVTFICGRAGVCALGAVIARHSEQIGIPHDLPYELLYGRAVADEVTMAGRQLGRKGRCPLMYEWHGKKYWGAAHGLAGIMHVLKDMELKPDEVEDVKGMLRYVINNRFPWGNYPSSEGSENDRLVHCCHGAPGLTLTLVKATE

SEQ ID NO: 158535 - protein, 238 aa, Glycine max
  Coding DNA Sequence Number=SeqID_41757
MKTPVLTNLWLSECYLAKPRKRKSSASRPQAQYDTRRFHSLDAWNRYMDNILGRNILPERNVQIYHTKFDEFKVELERRNLHKHLTNLQEGSIDVAIVKEFYANLYNLEDQSPKQAKVSGHLIKIDADSFNDFLETLVVLYEGESLPTYSRFCRLRTNHQEIEARLCIPRKGFVLNVEGQPWKLLKKDLTTLAQTWSVLSYSILAPTSHTSDLNMDRARLVYGLVTHMDMNIVFSMSS

SEQ ID NO: 158536 - protein, 563 aa, Glycine max
  Coding DNA Sequence Number=SeqID_41758
  Gene Ontology: Mol. function=CTP synthase activity; Cellular component=cellular_component; Biological process=pyrimidine nucleotide biosynthetic process
  Homolog annotation: Hit_ID=UPI0000162F30; Match level="QueryCoverage =99%, HitCoverage=91%, E-value=0.0, Identity=61%"; Hit description =CTP synthase/ catalytic
  Pfam annotation: Domain name=CTP_synth_N; Domain location=1-234; Score=237.6; E_value=2.7e-68; Accession=PF06418.4; Description=CTP synthase N-terminus
  Pfam annotation: Domain name=GATase; Domain location=270-505; Score =259.5; E_value=7e-75; Accession=PF00117.18; Description=Glutamine amidotransferase class-I
  Pfam annotation: Domain name=Peptidase_C26; Domain location=287-487; Score=-106.3; E_value=0.025; Accession=PF07722.3; Description =Peptidase C26
  Pfam module annotation: Pfam domain module=CTP_synth_N::GATase::Peptid ase_C26; Domain location=1-234::270-505::287-487
MSPFEHGEVFVLDDGGESVIDKERRGDYLGKTVQVVPHITDAIQDWIERVAHIPVDGKTSPADVCVIELGGTIGDIESMPFIQALGQFSYRVGAGNFCLVHVSLVPVLNVVGEQKTKPTQHSVRALRGQGLTPHILACRSTMGIQILEYTQGTSIYYDAQKEQKCIPAFTLILTVNIFKFLTFSFFQAENIVTLYDVPNIWHIPLLLRDQKAHEAMFKVLNLHGVTKEPNLEEWTCRAESSDLLHEPVGSYSLSGEIYVPFRFLPLRSKGGVNFNFMAALLHASVDCQKKLVVDWIPASNLESATAKENPDAFKAAWKLLKGADGVLVPGGFGDRGVQGKIIAAKYARENRIPFLGICLGMQIAVIEFARSVLGVQDANSTEFEPHTKSPYIIFMPEGSKTHMGGTMRLGSRRTYFQTKECKSAKLYGCKSFIDERHRHRYEVNPDLVARLENAGLSFTGKDETGQRMEIVELPNHPYFIGAQFHPEFKSRPGKPSPLFLGFIGAACGQLDAVLQRSSIVDNGLSKGVINDISAVKTYRTRTATRTTYRSAEYVYGSCNGLHF

SEQ ID NO: 158537 - protein, 194 aa, Glycine max
  Coding DNA Sequence Number=SeqID_41759
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=94%, HitCoverage=20%, E-value=1e-100, Identity=88%"; Hit description =Plastid alpha-amylase
MSWKEVGYDGWRLDFVRGFWGGYVKDYIDASEPYFSVGEYWDSLSYTYSEMDHNQDAHRQRIIDWINATNGTSGAFDVTTKGILHPALERCEYWRLSDEKGKPPGVLGWWPSRAVTFIENHDTGSTQGHWRFPSGKQMQGYAYILTHPGTPSVFYDHISSHDKSEIASLISLRKRNKIHCRSRVKRVKPNTQKS

SEQ ID NO: 158538 - protein, 234 aa, Glycine max
  Coding DNA Sequence Number=SeqID_41760
MESYFVISVSFGLLPLLLPLRFTSSDLNHQHHHTNNIIAAPSPPYQQHHRAIQATLTPTDLCATTPPRNGEVARAQEASKIDSRTQMENLVAEAWAFNRMESETVNEHIDDDLNETMPLIPEETDNEDNNNNDRANFLRCQFLIVILENMRRQLAHALLLQNKLFDKAPLCAEAAVVHEETGPSEVNIFSGTRLIDSSQAPTTQVKPVCQLHKVLKFKLSPDSEIQNVTAKEAK

SEQ ID NO: 158539 - protein, 93 aa, Glycine max
  Coding DNA Sequence Number=SeqID_41761
MGHENGLQVVRGKCLGLGNQVRIALEKCGELGLKMGSVATYPFAGERGEAHGCIFQRRKMRGVATNVYLRKTSKKSKEIGHEEYSRFGSCIYV

SEQ ID NO: 158540 - protein, 278 aa, Glycine max
  Coding DNA Sequence Number=SeqID_41762
  Gene Ontology: Mol. function=peptidase activity; Cellular component =membrane; Biological process=translation
  Homolog annotation: Hit_ID=Q5KSB6; Match level="QueryCoverage=99%, HitCoverage=100%, E-value=1e-130, Identity=82%"; Hit description =Hypersensitive-induced response protein
  Pfam annotation: Domain name=Band_7; Domain location=9-185; Score =140.1; E_value=5.8e-39; Accession=PF01145.15; Description=SPFH domain  Band 7 family
MGQMFSMCGFVQVEQSSVVIKEVFGKYDDVLDPGCHCVPWYFGNRVAGALSLRIQQLDVRCETKTKDNVFVTVVASIQYRALAEKASDAYYKLTNTKAQIQSYVFDVIRASVPKMELDATFEQKNDIAKTVEEELEKAMSAYGYEIVQTLIVDIEPDERVKRAMNEINAAEAEKILQIKRAEGDAESKYLAGLGVARQRQAIVDGLRDSVIAFSENVPGTTSKDILDMVLMTQYFDTMKDIGASSKSNAVFIPHGPGSVHDVASQIRDGLLQGNATKS

SEQ ID NO: 158541 - protein, 171 aa, Glycine max
  Coding DNA Sequence Number=SeqID_41763
  Gene Ontology: Mol. function=peptidase activity; Cellular component =membrane
  Homolog annotation: Hit_ID=Q5KSB6; Match level="QueryCoverage=86%, HitCoverage=66%, E-value=1e-34, Identity=48%"; Hit description =Hypersensitive-induced response protein
  Pfam annotation: Domain name=Band_7; Domain location=6-152; Score= -26.9; E_value=0.0049; Accession=PF01145.15; Description=SPFH domain Band 7 family
MGQVYGCFQVKHSSVAIKEVFGKYDDVLEPGCHFVAWCFGRRVAGALSLRVKLRLRTMCLLVWLPQSNIEHWQKRQQMFTTNSPIPKHRYNPYVFDAYGYEIVQTLIVDIEPDEGVKKAMNEINAASRLRMAANEKAEVKKILQIKRAEKIGNEIERPEDDGEFGKALNKG

SEQ ID NO: 158542 - protein, 63 aa, Glycine max
  Coding DNA Sequence Number=SeqID_41764
MNLGEGEMDFSTMMHKELKGIVRIEIGAKGTKIPIEIYIKHYIGGLNILVNDLSLALMEIDFD

SEQ ID NO: 158543 - protein, 404 aa, Glycine max
  Coding DNA Sequence Number=SeqID_41765
  Homolog annotation: Hit_ID=Q337M4; Match level="QueryCoverage=79%, HitCoverage=88%, E-value=1e-121, Identity=65%"; Hit description =Uncharacterized conserved protein, putative, expressed
  Subcellular localization annotation: CTP_CleavageSite=66; ConfidenceScore=5.87e-01
MFATTNSSTLSPLFSFSRTTATSLPSKPTFWNLVPMKQSSSPGHLALALDNPRRTLHVSCGSTSPHASQRSSIQGGEAFFRGVLESMQSVYLNRNRTAKAILDLVHSAENNSLCYDHLAFRTFGVNGYGIDSMASFFLDYGYTQREELRFPAKKLRALWFSPPADSLASNGSGINGPLPRIFISELLVDQMSPQTQEIIKKYTESSVDGNKYAALASSLGHLTWEKPLYSEFQQLASESEYAAWTLVNGYALNHVTISTHRLKTHLKEIKKLNQFIKDSGFRLNSEGGVLKVSPDGLLQQSSTVADSISFKFSDGITESVPCSYIEFAERLVLPQYKNLPDTEVKEFHRRDGFEVASADKIFESTSKEQLSRHNIESQILHASSRFSLVFLQKSGLARDEEVSM

SEQ ID NO: 158544 - protein, 173 aa, Glycine max
  Coding DNA Sequence Number=SeqID_41766
  Subcellular localization annotation: CTP_CleavageSite=22; ConfidenceScore=5.43e-01
MPTAETVKLTRGSAWLLLRRPRAATSASRRVPLFRAAQTPSRLLRAASHKIQIPFFLLRGPHICYVAEITQFSSVSISGVCGLPGFKGCWHMGLGAENGKVVESWDVCKSKGRKKKKGDEGGEAEAGCWVRLRFIGSCISSRSKVDTSVSGSGTSTHYGKFITISLQDLLLFL

SEQ ID NO: 158545 - protein, 90 aa, Glycine max
  Coding DNA Sequence Number=SeqID_41767
  Pfam annotation: Domain name=Ras; Domain location=17-88; Score=-82.3; E_value=0.0042; Accession=PF00071.12; Description=Ras family
MAAPPARARADYDYLIKLLLIGDSGVGKSCLLLRFSDGSFTTSFITTIGIIVCDTWKLVALPVGIWFVALPDVGLKDSEKNKGEIVLRKI

SEQ ID NO: 158546 - protein, 73 aa, Glycine max
  Coding DNA Sequence Number=SeqID_41768
  Subcellular localization annotation: CTP_CleavageSite=44; ConfidenceScore=5.48e-01
MVPNNTCNKRKNPLNTVHKHNSTSTSKQRRKMQTQQEFSTKKKSQKLKKNEIQEMPLFELGNWEQAIDHLGKW

SEQ ID NO: 158547 - protein, 480 aa, Glycine max
  Coding DNA Sequence Number=SeqID_41769
  Gene Ontology: Mol. function=transporter activity; Cellular component= membrane; Biological process=oligopeptide transport
  Homolog annotation: Hit_ID=Q9CAR8; Match level="QueryCoverage=97%, HitCoverage=79%, E-value=1e-160, Identity=62%"; Hit description =Nitrate transporter (NTL1); 53025-56402
  Pfam annotation: Domain name=MFS_1; Domain location=6-420; Score= -45.7; E_value=0.039; Accession=PF07690.6; Description=Major Facilitator Superfamily
  Pfam annotation: Domain name=PTR2; Domain location=5-408; Score =379.4; E_value=5.6e-111; Accession=PF00854.12; Description=POT family
  Pfam module annotation: Pfam domain module=MFS_1::PTR2; Domain location=6-420::5-408
MAKELGLFVQGLIVLTIQARDPSLKPPKCDLDTPCQEVNGSKAAMLFIGLYLVALGVGGIKGSLPAHGGEQFDETTPSGRKQRSTFFNYFVFCLSCGALIAVTFVVWIEDNKGWQWGFAISTISIFVSIPVFLAGSPTYKNKIPSGSPLTTILKVLIAALLNSCTYKNTSSAVVNMTSSPSNPHSGRTESQQETVKASTTTETPTSNLKFLNKAVTNKPRYSSLECTVQQVEDVKVVLKMLPIFACTIILNCCLAQLSTFSVEQAATMDTKLGSLKVPPSSLPVFPVVFIMILAPIYDHIIIPYTRKATKSEMGITHLQRIGFGLVLSIVAMAVAAIVEIKRKRVATQSGLLDDPTKPLPITFLWIAFQYLFLGSADLFTLAGLLEFFFTEAPIRMRSLATSLSWASLAMGYYLSSVIVSIVNSVTGNGTHNKPWLSGANFNHYHLEKFYWLMCVLSGLNFLHYLYWATKYKYRGTGTTN

SEQ ID NO: 158548 - protein, 765 aa, Glycine max
  Coding DNA Sequence Number=SeqID_41770
  Homolog annotation: Hit_ID=Q10RM9; Match level="QueryCoverage=93%, HitCoverage=96%, E-value=1e-68, Identity=28%"; Hit description =Expressed protein
MNFLLRSTTGVYREPSPSIPVPEPRVDTHHRSASAGSSLENRVSDDPYAWYDARVVSGVFLKHVDVAEDEGWVTIPCKELPENWTCAPDIQSLCSLDRSFLFPGERVHILACFSACKQDTSSFKVDAVTSDNGIGHSPKKENGNIENRNNSVSGEGEPGTSDEEQMEDVSDDESLLQKEVLKKQTALLLQKFENSHFFVRISESDDPLWSKRSSSEIFSNSSDANTEKASTIKSKGDTFSPISTIIDRGNFDSNVSGGVARNSVKCCALPNGDLVGLDFKVPLSDEVVWAHVEKTYRRIPSKESKSDKGNPGTIARGRLRKVVGETILKDLEVNVGVNFLRDPCIEILQFEKRQERMSSPDSKVDAANQDSCAELLNWMLPLDNGRPSTYPPFPPHLTSTSGIGSSSQGSNFSGSSSSQLFSFGNFRSYSMSSLPQTMSTPSAPVKAVSSKPNFDLKDWDQISSQKYFWKKMGFEGLLSFRGVSLEQERFHNVAPIHAPDIVIFIDTITIVLEEFTKNGSLSSLPISCIEAGNDHSLPNLALRDIMISVVSEMSGQSLAAYGKTCQLPIQILTLQASNLTSEDLTLTVLAPASFTSPLSVVSLNSPTTPMSPFLGFSELLVRVNGERGIGATQRQSFTLGVKDNEKQSYDGKAQAVSTSDDVIPGSDLSCTHLWLQSRIPLGCIPSQSIATIKLELLPLTDGIIVLDTLQIDVKEKVSGYLLCAGEWLAQEWYVAFTCWEEACVVVVVEGNVNLGTSQSGDDTPS

SEQ ID NO: 158549 - protein, 52 aa, Glycine max
  Coding DNA Sequence Number=SeqID_41771
  Homolog annotation: Hit_ID=Q9FM20; Match level="QueryCoverage=64%, HitCoverage=6%, E-value=2e-09, Identity=79%"; Hit description =Nitrate transporter NTL1
MNVKRRIKVNFNVNGVELEAPQVSTWEGYVDWRNKPALRGRHGGMLAASFVL

SEQ ID NO: 158550 - protein, 51 aa, Glycine max
  Coding DNA Sequence Number=SeqID_41772
METLTLSGKILRIATDFADIDKNLSSLLLTLCDMLGADTLVDLVISNATAL

SEQ ID NO: 158551 - protein, 229 aa, Glycine max
  Coding DNA Sequence Number=SeqID_41773
  Gene Ontology: Mol. function=nucleotide binding; Biological process =translation
  Homolog annotation: Hit_ID=Q2L097; Match level="QueryCoverage=62%, HitCoverage=36%, E-value=2e-25, Identity=40%"; Hit description =Putative lipoprotein precursor
  Pfam annotation: Domain name=ParBc_2; Domain location=1-155; Score =73.9; E_value=5e-19; Accession=PF08857.1; Description=Putative ParB -like nuclease
MGQEGVKSFTPRSTLRDPASFSCKAPVGSEPGPMKTAVIGPDNQLYLTDGHHTFSNFADIAGLSTPVQVRITDDFRPLKSQAAFWQKMAAAHLVWLETPNGKIAPEALPQELGRQHMQDDEYRSLIYFVRDIGFDKPDNPPPFLEFFWGQWLSRELPLKAFNLRDRDGYAAAVKKVAEKMVSVPKDTVIAQSDSGPLTAQALGARDAVNQKALNKLSADNGKLSWAFKH

SEQ ID NO: 158552 - protein, 92 aa, Glycine max
  Coding DNA Sequence Number=SeqID_41774
  Gene Ontology: Mol. function=oxidoreductase activity; Biological process=electron transport
  Homolog annotation: Hit_ID=Q48JC8; Match level="QueryCoverage=91%, HitCoverage=22%, E-value=3e-13, Identity=44%"; Hit description =Oxidoreductase, FAD/FMN-binding
  Subcellular localization annotation: CTP_CleavageSite=20; ConfidenceScore=5.04e-01
MAGGRCRSAPASVRGRGRVAAAAGAPGCATVAGGDQRIAVRCRTRRHGVVSGRRLCGAGQKRAGQSGLATARSPRPATARLRSKPAGTVRGC

SEQ ID NO: 158553 - protein, 66 aa, Glycine max
  Coding DNA Sequence Number=SeqID_41775
MRRGAKRKMKQGQEAKHDAPEDNKPKAQPRAKRAKTSKPQSEPEYFEDKHNLCTLYLPLFWFGALT

SEQ ID NO: 158554 - protein, 153 aa, Glycine max
  Coding DNA Sequence Number=SeqID_41776
MVFLAILGFRFSGSHRHLLFEQREVWKVCDFVRVSITIIVRRWNANTFAGPHKSTEQRVIDASSKKLNDVEDDDVVVIDGVEARVEAVAEGEVKAVVEGEIMAEGQVDQQALVEVQVEVEVQVGEQGLVKVQVEPVGETNVQAQMEAEVHVHE

SEQ ID NO: 158555 - protein, 120 aa, Glycine max
  Coding DNA Sequence Number=SeqID_41777
  Gene Ontology: Mol. function=damaged DNA binding; Biological process =mismatch repair
  Homolog annotation: Hit_ID=Q1XBQ8; Match level="QueryCoverage=80%, HitCoverage=9%, E-value=4e-27, Identity=63%"; Hit description=DNA mismatch repair protein
MKNGSLKEGTLNWEMLQFKPKFPRQVLLCRVGEFYEAWGINVCILVEYEGLNPFGVPAILPVYEYMLLINFGLNTALWRRQAQGPTQARSRKCLFISGLKEGRGIWTEVKVSSITDREQP

SEQ ID NO: 158556 - protein, 237 aa, Glycine max
  Coding DNA Sequence Number=SeqID_41778
  Homolog annotation: Hit_ID=P0AAS9; Match level="QueryCoverage=18%, HitCoverage=69%, E-value=2e-18, Identity=91%"; Hit description =Hypothetical protein ybdD
  Pfam annotation: Domain name=HTH_3; Domain location=133-183; Score =37.0; E_value=6.7e-08; Accession=PF01381.12; Description=Helix-turn -helix
MTARLPGPISKKYRRQKIISGYALAITASSIRFGTNPITIVMFWPLSAEYQQVTCTRRKPPMAVQLIKDDNGKTQYVVIPYDEYFRMCLQMAEIDDETDDDLEDIEVEHDELDDVELPGEVCSIMTWQNVSLQAAWRILRGMSQQEVAEKLGITQSAVSQLEALDSRPQKRTREKLAAIYGWLTALRPALAAVTGVLTIAEKFVVGHWRLVRMVDPHMLDIVVVVRHANHHFGGLAQ

SEQ ID NO: 158557 - protein, 249 aa, Glycine max
  Coding DNA Sequence Number=SeqID_41779
  Homolog annotation: Hit_ID=Q47522; Match level="QueryCoverage=14%, HitCoverage=45%, E-value=6e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRCPVSVVALWPMLPDSTPCAGAVTDGARIADREYGEEGLRSDEEEDMYADTAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMLRKILNRG

SEQ ID NO: 158558 - protein, 120 aa, Glycine max
  Coding DNA Sequence Number=SeqID_41780
  Homolog annotation: Hit_ID=Q2LW31; Match level="QueryCoverage=39%, HitCoverage=42%, E-value=1e-11, Identity=64%"; Hit description =Hypothetical cytosolic protein
  Pfam annotation: Domain name=DUF1458; Domain location=73-120; Score =76.3; E_value=9.6e-20; Accession=PF07311.3; Description=Protein of unknown function (DUF1458)
VTTMDGWDVIEPAEPGGKPGKVRLRDSIELTPGNVRVYNENEIHSPRRDGPAKLIRIEGNPNQSLPGRVWQPLVGSSTVSSDDAIKNAIERAAKTLNHLNWFEVVETRGHIADGKVAHFQ

SEQ ID NO: 158559 - protein, 86 aa, Glycine max
  Coding DNA Sequence Number=SeqID_41781
MNEERTNGEEQGKIFTYWLTEMSRKRYGSTSAWIFFTETRPSGTFWKLGCLRRKQLGDKLLHVFEKWFPGLPRLPEYFRKISENFG

SEQ ID NO: 158560 - protein, 74 aa, Glycine max
  Coding DNA Sequence Number=SeqID_41782
MAPRKLASKRSRKDKAERRVQLRDDEYTDFQEEIVRQQWASVVTPMAKFDPDVVPEFYANAWPTEEGVRDMRSW

SEQ ID NO: 158561 - protein, 85 aa, Glycine max
  Coding DNA Sequence Number=SeqID_41783
MVVDVVNSIGIETRLNIIGINKHQPTRSRGLQGWFFAYPFMGKVTTFVAQPVSQEASNYDEVFLQLSLLFDDILKVLMIFYMLFS

SEQ ID NO: 158562 - protein, 76 aa, Glycine max
  Coding DNA Sequence Number=SeqID_41784
  Pfam annotation: Domain name=Abhydro_lipase; Domain location=5-65; Score=-3.4; E_value=0.0086; Accession=PF04083.6; Description=ab -hydrolase associated lipase region
MWKRLTLEGEMCWSTSVTTQDGYILNLARIRMGESREPQILLWHGHFMETLIALVAHSQDQLQNMLTSIVLLSPIA

SEQ ID NO: 158563 - protein, 138 aa, Glycine max
  Coding DNA Sequence Number=SeqID_41785
  Homolog annotation: Hit_ID=Q1RTJ9; Match level="QueryCoverage=85%, HitCoverage=35%, E-value=5e-15, Identity=40%"; Hit description =Cyclin-like F-box; F-box protein interaction domain
MPGYHLVGSCNGLHCGVSEIPEGYRVCFWNKATRVISRESPTLSFSPGIGRRTMFGFGYDPSSDKYKVVAIALTMLSLDVSQKTEMKVYSAGDSSWRNLKGFPVLWTLPKVGGVYLSGTLNWVVIKGKETIHSEIVII

SEQ ID NO: 158564 - protein, 56 aa, Glycine max
  Coding DNA Sequence Number=SeqID_41786
MKSSQVVLTYGAYPLMVVRSLCDFHLVEGLVDQSSGSLFGLVEPGPLTVVVMVLKE

SEQ ID NO: 158565 - protein, 163 aa, Glycine max
  Coding DNA Sequence Number=SeqID_41787
  Gene Ontology: Mol. function=protein dimerization activity; Cellular component=extracellular region; Biological process=RNA-dependent DNA replication
  Homolog annotation: Hit_ID=Q1SE58; Match level="QueryCoverage=86%, HitCoverage=18%, E-value=2e-13, Identity=31%"; Hit description=HAT dimerisation
AEEIREDTEDGIFVLLWKLKIPPKAAVFTWQLIKDLLPTKMNLRGRQVEISDPMCPLCNNSEEVAAHLFFNCSKVLPLWWESLSWVNSVGAFPKEQKDHFMQHSRRNATRTKDIRWSYWQIALTRTIWQHRNKVVFDNQTFNASKLMDEALLLGGYMLRPLPR

SEQ ID NO: 158566 - protein, 81 aa, Glycine max
  Coding DNA Sequence Number=SeqID_41788
MGTDVKRNEDMGYVGVRELSWRWATGDGGVKLPAFIVDHRVVPGDMSRGSGDLGDIRRAPGSQQIKGKQDHKARRLVVAGQ

SEQ ID NO: 158567 - protein, 97 aa, Glycine max
  Coding DNA Sequence Number=SeqID_41789
  Subcellular localization annotation: CTP_CleavageSite=59; ConfidenceScore=5.50e-01
ELSSTPSSQFHIVSSTSSSNLVLPSHNVHPMQTKSKSRIHQPRMHPLLFLAQFEPKTIRQAIDDPQWFAAMKQEYEALFNDKAWDLVPLPKDRKVVG

SEQ ID NO: 158568 - protein, 211 aa, Glycine max
  Coding DNA Sequence Number=SeqID_41790
  Gene Ontology: Mol. function=homocysteine S-methyltransferase activity; Cellular component=intracellular; Biological process=folic acid and derivative biosynthetic process
  Homolog annotation: Hit_ID=Q7WF24; Match level="QueryCoverage=100%, HitCoverage=16%, E-value=1e-108, Identity=90%"; Hit description=5 -methyltetrahydrofolate--homocysteine methyltransferase
  Pfam annotation: Domain name=Pterin_bind; Domain location=1-140; Score=38.7; E_value=6.7e-10; Accession=PF00809.12; Description =Pterin binding enzyme
MIDSSKWDVIETGLKCVQGKPVVNSISMKEGLEPFRHHARLCRRYGAAVVVMAFDEQGQADTLERRKEICGRAYEILVEEEGFPPEDIIFDPNVFAVATGIDEHNHYAVDFIEGTRWIRENLPHARISGGVSNVSFSFRGNEPMREAIHTVFLYYAVKEGMTMGIVNAGQLGVYADLDPKLRDLVEDVVLDRAEPVGKTDPADERTPTERL

SEQ ID NO: 158569 - protein, 181 aa, Glycine max
  Coding DNA Sequence Number=SeqID_41791
  Homolog annotation: Hit_ID=Q5Y2C2; Match level="QueryCoverage=81%, HitCoverage=36%, E-value=5e-07, Identity=32%"; Hit description =Silaffin
MDSTSSPLDGYMSSPSEDCTSLPLEDCMSSPSEGCTPSPSKDYTSSPSEGYTSSVSEGSTFAPSEDLRITPTRHPVDPEKSNRALGFPAPIMGLCQSYRVPVPPARSLHHDIRIAPTRHPVDPEKSNRVLGFLALITGLFQFYRVHAAPIKVIRPSINRAFIKKYCAPQASTGGDTTAAWG

SEQ ID NO: 158570 - protein, 61 aa, Glycine max
  Coding DNA Sequence Number=SeqID_41792
  Homolog annotation: Hit_ID=Q9LW42; Match level="QueryCoverage=75%, HitCoverage=2%, E-value=1e-10, Identity=65%"; Hit description =Helicase-like protein
MAKHVIAAEIISVFTHGQLYVALSRVNSAKGLKILIHDDEQKSMNSTTNVVYKEVFRNIKT

SEQ ID NO: 158571 - protein, 173 aa, Glycine max
  Coding DNA Sequence Number=SeqID_41793
MVLSHMQAIADPYQWKWVITGWHSILQNAMVLALCQGNDFLVYLFDGKASTRAIYEQIYNDDFSNIDKLQLPSFMTLYRATRENSSFTPSEVCTVAVGKLHQLRNDFIHYHPRGWSLQVDGLPQWILASGELLDHFLASGEVVRWYDENDEKAFREKYAEFQDRLHGVISVYS

SEQ ID NO: 158572 - protein, 96 aa, Glycine max
  Coding DNA Sequence Number=SeqID_41794
MSSNNRNATFAKPEPKSNNSGRSERMKTHEAKEAVRARDWECWESEMRKEEGEEWSGKIRVLENGSQWLGGIIKRSWLHTTYSNWNGEGSYRQWGG

SEQ ID NO: 158573 - protein, 294 aa, Glycine max
  Coding DNA Sequence Number=SeqID_41795
  Subcellular localization annotation: CTP_CleavageSite=24; ConfidenceScore=5.23e-01
MARNPRQDFSVSKPSSSFLPSTIVAQQSFNLWCSFLLQIAKGGHFRGREVRGYKWDFENPGEVWFSKSAFCADFCCEIVQQDFAQVQKNTRLLLVVERAVQNEFWMFASRSQRIDGDPVLRETRIWATWEYVSSVGGGQQGMVGLCAHCGCGKLVVHHRPTATYGTWRYVAGVRRPWGRQVGRAPGSQQIKGKQDHKARRLVVAGQLLENEVRKLREPLVIDYQPIVMAAQLIRDRVEMECLEGAWETLEGNTRCRFRGTIRFTATSLVHPDEPARTLQRTVAWTAPWISFVYF

SEQ ID NO: 158574 - protein, 129 aa, Glycine max
  Coding DNA Sequence Number=SeqID_41796
MVALVLKLHKLPKEHFWKNSDEDNWEVMMDDDDVIRDNISQLIDENTTMSCLFKEEKVLEVRKYHDSINKYKMGTRNTEALCFRWVMKVSVEMRIEDSRRRMSYTKALSECQLAKRTACILQVEREDWR

SEQ ID NO: 158575 - protein, 68 aa, Glycine max
  Coding DNA Sequence Number=SeqID_41797
MAQALCELQLELQNGLPCTIVVSGNSKGESEGFIPKTPASKETRRNKVSTKGNWSPFDSPKDTSFSKP

SEQ ID NO: 158576 - protein, 79 aa, Glycine max
  Coding DNA Sequence Number=SeqID_41798
MKLARYTSYPLFFHFKDISASATLSSSISKISLHRYHILAAFQQISDRYIHQSEVLAADISRIINLKEKQLKHIYPSAK

SEQ ID NO: 158577 - protein, 244 aa, Glycine max
  Coding DNA Sequence Number=SeqID_41799
  Gene Ontology: Mol. function=RNA-directed DNA polymerase activity; Biological process=RNA-dependent DNA replication
MAAEQNSDFVDLWKLKIPAKAQVFAWRCIRDRLPTKMNLTRRQVVVNDLMCPLCGEVEEEAAHLFFNCRNILPIWWESLPWMGLSTAVPQSRKDHYLQHVPEFADGKKLISWRCWWIAMTWTTWKLRNRIVFQNAIFDGRKLMEDVILTLWTWLKTMDKDFAIHFNQWSSNLKEASFTVTRDNTGQVLGRGTKITLYLKEDQLEYLEERRLKDLIKKHSEFISSYQLAGLSPITLHLSNSNPHQ

SEQ ID NO: 158578 - protein, 129 aa, Glycine max
  Coding DNA Sequence Number=SeqID_41800
MSLIQCNTEQSKPAIEKVFVRLVKHVCNLIGKQNLKNQRHAYLHEHSKGLKNQRLRLRRGTDGVSSGSRREGLHGDNQNVRLEAGRSSRRKEVVQGLGSSSRVSTFRQARALVLTARLYINSNIYDGAS

SEQ ID NO: 158579 - protein, 48 aa, Glycine max
  Coding DNA Sequence Number=SeqID_41801
MTKVACALYIGAAASLAMVTKVKRKRSSKWDEEDFKFNIFVPPKDFWH

SEQ ID NO: 158580 - protein, 244 aa, Glycine max
  Coding DNA Sequence Number=SeqID_41802
  Gene Ontology: Mol. function=transcription regulator activity; Cellular component=nucleus; Biological process=regulation of transcription
  Homolog annotation: Hit_ID=Q9LRN3; Match level="QueryCoverage=86%, HitCoverage=55%, E-value=6e-44, Identity=47%"; Hit description =Similarity to helix-loop-helix DNA-binding protein
  Pfam annotation: Domain name=HLH; Domain location=211-243; Score=8.3; E_value=0.019; Accession=PF00010.16; Description=Helix-loop-helix DNA- binding domain
MPPIFNTLDYSLDQHHLYAPNQHQQHLMKFQGSGDENNNGSMVDYMPQTTPPHGFYGATSAATTSYDKLSFADVMQFADFGPKLALNQAKNCEESAIDPVYFLKFPVLNNKMEEDQQNMMMNNDDPDGDEAENHHHDERFNNLVSVEDKEGMMVREDEETTRVSDDNNSVQIRFLGHEEPQQKNNCAVQENKNGKRKRPRTVKTSEEVESQRMTHIAVERNRRKQMNEHLRVLRSLMPGSYVQR

SEQ ID NO: 158581 - protein, 99 aa, Glycine max
  Coding DNA Sequence Number=SeqID_41803
MTKLKTTLSPGTKPVAPKWIEVKSHVQTGCYEYGYYIMHWMWNIITSDIKSDWSMFTSSKMTSSTSIEELSVLYGIGIEIAGMPREGDQGMKIMIKESS

SEQ ID NO: 158582 - protein, 151 aa, Glycine max
  Coding DNA Sequence Number=SeqID_41804
  Gene Ontology: Mol. function=transcription regulator activity; Cellular component=nucleus; Biological process=regulation of transcription
  Homolog annotation: Hit_ID=Q9LRN3; Match level="QueryCoverage=48%, HitCoverage=19%, E-value=4e-29, Identity=90%"; Hit description =Similarity to helix-loop-helix DNA-binding protein
MKLVEMETGLHEETAESKSCLADVEVKLLGFDAMIKILSRRRPGQLIKTIAALEDLQLIILHTNITTIEQTVLYSFNVKVASDSRFTAEDIASSVQQIFNFIHANTSMCCSRTRITCDFYSCLYEIKILILHRRLHPKSFGFTIVIVVRGD

SEQ ID NO: 158583 - protein, 73 aa, Glycine max
  Coding DNA Sequence Number=SeqID_41805
  Gene Ontology: Mol. function=hydrolase activity; Cellular component =cytosol
  Homolog annotation: Hit_ID=Q8LQ52; Match level="QueryCoverage=97%, HitCoverage=16%, E-value=2e-24, Identity=75%"; Hit description=Metal- dependent phosphohydrolase HD domain-containing protein-like
MVLHSIAIVGDITPSDGVPKAEKSRMEQEALSKMCELLGGGIRAEEIKELWAEYENNSSLEANLVKDFDKVSV

SEQ ID NO: 158584 - protein, 95 aa, Glycine max
  Coding DNA Sequence Number=SeqID_41806
MTDEEEAENPTEASREECLLGSPKPSEPGGWDQTETSLRFGAASRKKKIAGARIEREGEERSGPERYSVGRGMCMVGIGMGTPISGTTIAIKITH

SEQ ID NO: 158585 - protein, 246 aa, Glycine max
  Coding DNA Sequence Number=SeqID_41807
MVRAFEVLCPVFNIQPNVLVFLHFFQMKLTGNIGWVSVATYPTTGVRKASQMLAWASWGIGKSKNRPFCPLPWYPFVFLIKTLSDSLLRVETVSMNSMSKKLFEFDSNIFCHFKGRFFKVLATNVVADGFVDPCGKGRQGHIGVAPSLTRRAAPHEEGRIMPPSSVAPAAGEGGHPTGEVGPATIVVKGANKELEEELLMYKKEAMEQHEKDFHKTVRQAEFFTKDLQLGLFDPFKDMEDDVRCST

SEQ ID NO: 158586 - protein, 134 aa, Glycine max
  Coding DNA Sequence Number=SeqID_41808
  Gene Ontology: Mol. function=DNA binding; Biological process=DNA integration
MMQSGQRRSEQAPQSQLHHRSQVFHLACQCCHGKKGHWKMCTDYIDLNGTCPKDAYPLPSIDRLVYGASGFQIGQNVKVYANNMVVKSQSIFQHVADLKEVLGELHKYDMHLNLERCTFGVGGGKFLGFMITHR

SEQ ID NO: 158587 - protein, 150 aa, Glycine max
  Coding DNA Sequence Number=SeqID_41809
MKEDIVIKNTLKAKKTNEREKESQSQARRFKKRRQKFEVMAGGLDKFDKPVILTPIEVTILDTRQLLSMLGASKKSRSSYLSRILPQHQTVSLDIGQTPLTLDNLFRPHAGSKLGGLTYYPSSTKSTWQATWQTSAFHVSHGTRARTTDP

SEQ ID NO: 158588 - protein, 116 aa, Glycine max
  Coding DNA Sequence Number=SeqID_41810
  Gene Ontology: Mol. function=DNA binding; Cellular component =mitochondrion; Biological process=DNA integration
MIEKVDLALINSARRLKPYFQSHHVIVKTKYPIKQVLRKPKLAGRMYEPYGPMKTQSMADFQAKFVGNDQTTPDWWSLYVDSMSNVKGSGAGIILEGSNNVTLEQYLKLNFKASNN

SEQ ID NO: 158589 - protein, 623 aa, Glycine max
  Coding DNA Sequence Number=SeqID_41811
  Gene Ontology: Mol. function=nucleoside-triphosphatase activity; Cellular component=integral to membrane; Biological process=transport
  Homolog annotation: Hit_ID=Q1SP34; Match level="QueryCoverage=99%, HitCoverage=95%, E-value=0.0, Identity=70%"; Hit description=AAA ATPase
  Pfam annotation: Domain name=ABC2_membrane; Domain location=379-589; Score=177.8; E_value=2.7e-50; Accession=PF01061.14; Description=ABC -2 type transporter
  Pfam annotation: Domain name=ABC_tran; Domain location=96-288; Score =162.4; E_value=1.1e-45; Accession=PF00005.17; Description=ABC transporter
  Pfam annotation: Domain name=MMR_HSR1; Domain location=97-181; Score=- 18.0; E_value=0.045; Accession=PF01926.13; Description=GTPase of unknown function
  Pfam module annotation: Pfam domain module=ABC2_membrane::ABC _tran::MMR_HSR1; Domain location=379-589::96-288::97-181
  Subcellular localization annotation: CTP_CleavageSite=9; ConfidenceScore=5.09e-01
MAACLKPPRLSSTEDDSLILFSTSNSPEESNSPSSSFYHSPPTSLHQFRTANKLSVRNLSYTLLPHKTTPLSFFHLTQNPKPVNILKSVSFVARSSEVVAVVGPSGTGKSTLLRIISGRVKDEDFDPKSVSINDQPMTSPAQLRKTCGFVAQVDNLLPMLTVKETLMYSAKFRLKEMTPKDRERRVESLLQELGLFHVANSFVGDEENRGISGGERKRVSIGVDMIHNPPILLLDEPTSGLDSTSALQVIELLSSIAKAKQRTVVLSIHQPSYRILQYISKFLILSHGSVVHNGSLEQLEETISKLGFQIPTQLNALEFSMEIIRGLEGSDSKYDTCTIEEKEPFPNLMWPEEENCGVQILRSQCNKESYGSLCYANLIEILFLCSRFWKIIYRTKQLFLARTMQALVGGFGLGSVYIKIRRDEGGAAERLGLFAFSLSFLLSSTVEALSIYLQERIVLMKEASRGAYRISSYMIANTFVFLLFLFVVSILFAVPVYWLVGLNPSLSAFTFFTLVVWLIVLMASSLVLFLSAVSPDFISGNSLICTVLGAFFLFSGYFIPKESIPKYWLFMYYVSLYRYPLDALLTNEYWNVRNECFSHQIEGSQCLITGFDVLKSRGLERDN

SEQ ID NO: 158590 - protein, 298 aa, Glycine max
  Coding DNA Sequence Number=SeqID_41812
  Homolog annotation: Hit_ID=Q1SJX9; Match level="QueryCoverage=53%, HitCoverage=38%, E-value=2e-42, Identity=60%"; Hit description=SWIRM
MVRTRGVGRALGRAIGKETPIEEVLTGIYGFPGGPYDTSVLRDFENQFALRVWNGEHKEEEDDDDDENPNAEEDLTKHNYDLEDQMHHNHPNSQPHVETEVLSDHGVQIFQFPTVMKRSVNFPHSSITAIVALERALESGENKAPSALAAPVLENVSHGQLQALSFVPSDSFAFDGDSSFVITPPPILEGRGIVKRYGTKALVVPMHSTDWFLPATVHRLERQVSVLPGILQGDKSDSLLYGSVDNGKKICWNEDFHSKGGRLRLEKAKEDYLVRLKREWEQDALDDATQKPPTAASE

SEQ ID NO: 158591 - protein, 111 aa, Glycine max
  Coding DNA Sequence Number=SeqID_41813
MWKPSSASSFHGKIASVQDIHANNNIDHIPLHSRLSEQIDFQNLSELMCHRVLLENRKYQRILNNTFMMSLPTGKCDRPSPLEASLSSSVAALLPRLFLLLDLKHDQHLSF

SEQ ID NO: 158592 - protein, 99 aa, Glycine max
  Coding DNA Sequence Number=SeqID_41814
WFTTSRSVGVVITDWNDVATVVHVVFGGSRLVVVSVFEALWLKWRGYGDCKVGLLKRVNSKAGKEGRGYVYEVRERTVVSYSFKALKKCSFELANTTTT

SEQ ID NO: 158593 - protein, 79 aa, Glycine max
  Coding DNA Sequence Number=SeqID_41815
MSTPESAGATSKFSNKDFTNLVLTLKYNCKLHEKVHSSSSSQVVEEEYEGVMQSYPQGHLTEDFKKIGPEMQEKALGFS

SEQ ID NO: 158594 - protein, 136 aa, Glycine max
  Coding DNA Sequence Number=SeqID_41816
MKANKTRNELKVSDSKTYRLKNKERTKNEALQKNIGLDFLLFPLPFHQYQVKYAYPRFSEILWNPRKPFFNKRREVFAAQLAQASGCLARKKEKVQNPLDGPRFENCYLHPQLDKINNSPQMKLGCNILFTHPSLC

SEQ ID NO: 158595 - protein, 128 aa, Glycine max
  Coding DNA Sequence Number=SeqID_41817
MDLEKSSRALGFPTLVMGLCLSYRVPVPPARSCHRDIGITPARHPVDPEKSNRVLGFPALITCLCQFYGVPVAPNKVIRPPINRAFIKKYCAPQAGAGRDTTTAWGCPAAGNRCIAATSRAPQLMYKG

SEQ ID NO: 158596 - protein, 153 aa, Glycine max
  Coding DNA Sequence Number=SeqID_41818
  Gene Ontology: Mol. function=RNA-directed DNA polymerase activity; Biological process=RNA-dependent DNA replication
MVHLLWISSSGAYIHLVFEREQGRVHPLWIFACKGFYKVIENLKNRWVILVALASFTPTFGKEKSTRFTLERGLACLTLFLEEKKSTSLPLMDIEISRKKNGTYLITKRIMESKQSKDIQEEISDEGVKSLFNIEFESNVSSKRLFMEQIDGL

SEQ ID NO: 158597 - protein, 382 aa, Glycine max
  Coding DNA Sequence Number=SeqID_41819
  Gene Ontology: Mol. function=transition metal ion binding; Cellular component=nucleus; Biological process=proteolysis
  Pfam annotation: Domain name=Transposase_21; Domain location=200-362; Score=159.2; E_value=1.1e-44; Accession=PF02992.5; Description =Transposase family tnp2
WMNESRMSPAYEEGVEQFLQFASERSRLDEDGKFFCPCINCLNERQQILDDIQEHLLCDGIKKNYTMRIWHGELTDIQSGSQAEAFDVEMGDHLEDMICDLRQESFQQAHAPMHDTLQTDSKKPLFPGCNNSLTLLSVVLSLVNVKAIYGWSDKSFSSPLQLVHNMLPDENTLPKSYYQAKKTLCPMMKDDDEFSSDENSKKKYDGMLCHSADSSQWKKIDRLYPDFSKEARNLRLGLATDGMNPYGSLSTKHSSWLVLLPGNDIDVYLSPLIEDLTKLWDEGVSVFDGFRNETFDLCAMLFCTINDFPAHGNLSRYSVKGHRACPICEEDTSYIQLKHEKNISDSVIGTLLNIQGKTKDGLNTRQDLAEMGIRAQLNPRSD

SEQ ID NO: 158598 - protein, 48 aa, Glycine max
  Coding DNA Sequence Number=SeqID_41820
MEESSGTRQMRRKLCVGGFKIQFNYNTYCTYENSELGHVRVDVVKVNF

SEQ ID NO: 158599 - protein, 129 aa, Glycine max
  Coding DNA Sequence Number=SeqID_41821
  Gene Ontology: Mol. function=DNA binding; Cellular component =intracellular; Biological process=DNA integration
  Homolog annotation: Hit_ID=Q1S3H4; Match level="QueryCoverage=86%, HitCoverage=19%, E-value=5e-33, Identity=60%"; Hit description =Integrase, catalytic region
MTLGLFWERFVYSRSPFSQITANKYLFTKVDSKPRLIRWIILLQEFDLEIKEKEGCENVVVDHLSRLVNEEVTLKEKDFLDEFPYGSLLVVHERPCFSNMENFKVTSVIPKDFNWHQRKKFFHDARQYV

SEQ ID NO: 158600 - protein, 397 aa, Glycine max
  Coding DNA Sequence Number=SeqID_41822
  Gene Ontology: Mol. function=RNA-directed DNA polymerase activity; Biological process=RNA-dependent DNA replication
MYKTLDEGKEIIKNMASNDYELLTQQLDVLTKQTFKNPQLQSVQNTQSRAQQVLSYALCGSGHPSDQCFMHDGSQEEMNYKGNKNQQGNYGNPPYNNAFNQGWRNNNNHGWKQDVGPSNRPPPHVEKFKSGSLFANTQTNPKEKCKAITTRRVNEDEKSELEEEMNPLTKDLPYPHALTRKGNMQAFVHSKKQLSDASPLKKSLIDAFEALNEEEENENEECLKHLKTLKEVPLEEEVENDGNKPVIISGSIFPMEEEKLIDVLKANKELITQPQRQLNPNMKEEVRKEVLKLLEVGMIYPILDSLWISSGQVVPKKGGMMIVCNTKNELIPTRIVTGWRMCTDYRKLNQATRNDHFPLPFMNQMLEKLVSQALHCFLDGYNQIVVDPKDQEKTAFT

SEQ ID NO: 158601 - protein, 211 aa, Glycine max
  Coding DNA Sequence Number=SeqID_41823
MVRGTKVRYDVVTINKFLKTDFQDLEAQSCTYFELKDKDDFDPDKLAKVLCIPGKSYVKAKESNKAYKFKKDALRTITQISMSFAFSNVAPTLHTSNLNRQRASLIYCILANIPINIGKVISDKIHSLASLSRNPSQKKKIEQNCVNKNDTNQPYVPCPPPPPSSSPTVDQMMVVIRRGCQSLNASSYRPNPNFNAFMAWPGGDQPSLGGW

SEQ ID NO: 158602 - protein, 106 aa, Glycine max
  Coding DNA Sequence Number=SeqID_41824
  Gene Ontology: Mol. function=DNA binding; Cellular component =mitochondrion; Biological process=DNA integration
  Homolog annotation: Hit_ID=Q1SKC8; Match level="QueryCoverage=98%, HitCoverage=25%, E-value=5e-33, Identity=60%"; Hit description =Integrase, catalytic region
MRLNSYESSNHYKPKVKTYHDKKILHKEFRPGQQVLLFNSKLKFFPGKLKSKWFGPFIVKEVNPYGAIVLEDPTSKRNWVLNGQRLKLYLGGEVEKVTTIMLLNNP

SEQ ID NO: 158603 - protein, 81 aa, Glycine max
  Coding DNA Sequence Number=SeqID_41825
MQYLGSDPRSSPTETKRKSKAKNELKLEDRIENETGIKSRKQNWNLKQNTKMELLREQCHAVNSNPKTENETLQYLCLREQ

SEQ ID NO: 158604 - protein, 234 aa, Glycine max
  Coding DNA Sequence Number=SeqID_41826
  Homolog annotation: Hit_ID=Q1S4V4; Match level="QueryCoverage=41%, HitCoverage=21%, E-value=1e-12, Identity=33%"; Hit description =Endonuclease/exonuclease/phosphatase
  Subcellular localization annotation: CTP_CleavageSite=20; ConfidenceScore=5.17e-01
MSRRGGSKQQPNSRRPAPPSASPSPAERGHGRGRGHEESSLIPAPSPVNAPSDPPPASTIGVPSGVAPVRAASPSLGAELESLTSAVEMQPSAPSSAKAVRFSERIGFGLVGRKIKVRANHFQVQVAEQDLFHYETHSSGKKVERVCKRCGFDSFRIQNAQGQPEGIWVLWNSEDSRMDVLASEEQFVHMRLALSKGEPWLIIGVYGSPQYQRRNKLWDGLTNITSSCLEPWQF

SEQ ID NO: 158605 - protein, 130 aa, Glycine max
  Coding DNA Sequence Number=SeqID_41827
MATRTWGIIDFMANEFEKANVESRKAQAEYKDKVKGDQDSKGVIIDHISLRKNFAKALTKKIERLNKEFALFKVDAEKAEKKLESDLGEAEFKILKSHEVDIEKDVNHQGELVNEVEIPENEAPTKLAQV

SEQ ID NO: 158606 - protein, 219 aa, Glycine max
  Coding DNA Sequence Number=SeqID_41828
MGYLKVHTLTLLNFSLCLIPGTVLCALAGARCCRQKFALLESSVPLGGTAIIGGVVHPGAGATTPAGGTTATEGEPCPNIRVHSISREDEAESPLPSSPHNVINLELEATTIQVLVCHPFIPPPPRKPSKVTLSRVHEEVRSYENSFLTYESITDFLESVEFCDIDGLDIKISPNRWSTCLFPIMRELWPSLITQVDRLKGRIRTTSKMTRFLFPLPSA

SEQ ID NO: 158607 - protein, 74 aa, Glycine max
  Coding DNA Sequence Number=SeqID_41829
MEDCTRGSSLVNHEAWLQTLWWRMHERKRNSWGSEKKARMEDCTRGSSLVNHEAWLQSLWWRIHERKRNSWGSE

SEQ ID NO: 158608 - protein, 311 aa, Glycine max
  Coding DNA Sequence Number=SeqID_41830
  Gene Ontology: Mol. function=lysine permease activity; Cellular component=membrane; Biological process=amino acid transport
  Homolog annotation: Hit_ID=Q2KW72; Match level="QueryCoverage=63%, HitCoverage=99%, E-value=6e-90, Identity=82%"; Hit description =Putative amino acid efflux protein
  Pfam annotation: Domain name=LysE; Domain location=123-310; Score =104.1; E_value=4e-28; Accession=PF01810.9; Description=LysE type translocator
SAPTARHLQARHAPGAGDHAVPGGHGRSGFRRHHDRARHGGIRRLRAAPLMGRSQCEALFDAGGDESREIRIGGADDAVGRGITCRPAIARPEPAALDWPPPSFTHIPAMALHSWLIYLVAVIGLSITPGPNTLLALTHGALHGHRKALCTIAGGAVGFIALIALSMLGISALLKAWGPALTVLKWAGGAYLIWLGIQLWRSPGVQLRPAPDMPRLRGTRMFSQGFLSAISNPKALLFYGAFLPQFIDPARSLFTQFVIMAATFAVIEFLVEYVLARLAHRVRPWLERAGRRFNKVCGGLFAAMGVALPGS

SEQ ID NO: 158609 - protein, 378 aa, Glycine max
  Coding DNA Sequence Number=SeqID_41831
  Gene Ontology: Mol. function=catalytic activity; Biological process =folic acid and derivative biosynthetic process
  Homolog annotation: Hit_ID=Q1H0S1; Match level="QueryCoverage=41%, HitCoverage=33%, E-value=8e-61, Identity=74%"; Hit description=Para -aminobenzoate synthase, component I
  Pfam annotation: Domain name=Chorismate_bind; Domain location=1-159; Score=130.0; E_value=6.7e-36; Accession=PF00425.8; Description =chorismate binding enzyme
AAEELTHSIKDRAENLMIVDLLRNDIGKVCEVGSVQVDALFKLQKFTNVHHLVSIVRGILAPGFNALDLLRGCFPGGSITGAPKLRAMEIIEELEPHRRGIYCGSIGYIGFDGCMDSNIAIRTAVVHNQQMTFFAGGGVVADSDCDKEYQETFDKASHVTHYGSLVQWLQLVVRWGDGKVIIVPGGGLYADAVRDFQRMRAALPQGHINDSQAHALAIYAMDQMARSLVAMVPELALVRNPLEIAESGWQHRGLVWLPSEMALNPVLANELALPETWEVTSDSLAAWLAWQLEASHLLLVKSDDRLLEMRDGLQLGKLQALDIVDQGLSSLLTEAKFQTWIAHQTQYKLFEQGFSKSLEVIAFLKSAKMQHDRWQDQQ

SEQ ID NO: 158610 - protein, 145 aa, Glycine max
  Coding DNA Sequence Number=SeqID_41832
MGKVEEVQEQMKADMEAMKEKMATMTEAMMSMKKIMEANAVAVAATSVVAKIWWAKILGSTDGPHDAQIQNKHAFPPYGLHPNYTPPNVAYTPKEDVNNSTPTLIESQQPQSDHAHVSQPMGETHGMPHHNLADFEPCLGYATEG

SEQ ID NO: 158611 - protein, 295 aa, Glycine max
  Coding DNA Sequence Number=SeqID_41833
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-32, Identity=32%"; Hit description= UPI00006A17C9 related cluster
MSSPPEDYTSSPSEDYMSSHSEGFTPSPSEDYTSSPSEDYTSSPSEDYTSSPSEDYTSSPSKDYTSSPSEDDTSLPLEGFTPSPSKGYTPSPSEDHTSSPSEDYTSSPSEDYMTTRPYLQRATCPRHQRTARPPLRRATRPHLQRTTRPHLQRTTCPRHQRTARPPLRRATRTHLQRTTCPRLKRTTRPRLQRTTHPPVQRASRLRLQRTIHPRHQRTIRPHLQRTTRPRLQRTTRLHHHRATYSRLQRTTRPHLQRATRPRHQRTARPPIRRATRLHLQRTSRPRLKRTTRPRL

SEQ ID NO: 158612 - protein, 177 aa, Glycine max
  Coding DNA Sequence Number=SeqID_41834
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=2e-15, Identity=35%"; Hit description= UPI00006A17C9 related cluster
GTDLRNTNIHNVDVLFISDTLFSALRVRASPPLAPVCRIPIPISIPSSVREQKSCKNEEGEERGIANGLRTTKARMCSPLKARTCSPMKVRTCNPMKVRTCSPLKVRTCSPLKVKACSPLKVRVCSPTKVRTCSPLKARMCSPLKARTCSPLKVRACSPMKARTCSPLKVRTCSPLK

SEQ ID NO: 158613 - protein, 359 aa, Glycine max
  Coding DNA Sequence Number=SeqID_41835
  Homolog annotation: Hit_ID=Q2SF20; Match level="QueryCoverage=80%, HitCoverage=72%, E-value=4e-10, Identity=26%"; Hit description =Uncharacterized protein conserved in bacteria
MLGGDLAHPERIERTALAQMVQHLRQPAQIDRVLREAAASIDAQRHVEGASLIKTMVAGHEPERLHKAGAIQHGGTADDAGRNQPQALARHSASQMLRQHRQPFLHALIAGEAGTKEPEPLKRPIEIGEEMHADLMRQERFDTALFHNGVPGNQKFLARHHQTRRQVVADFHPCLEARLLGQVGLDHLARLPCDGVTIYHRDFAALLPARAILQHPQRQRQQRRFDGAIEGAGKIRESAPVQIGQHRQLQIDLLLFLSIEMVKHRIFQMIENHRIELSLLLLDIDAQRPVEKTRRELEAAVPKFLEGPAGIDWRDGEKEIEGRYDIVDGPVCAPDRIDEGLAAERPVAGHLERVHPCRE

SEQ ID NO: 158614 - protein, 220 aa, Glycine max
  Coding DNA Sequence Number=SeqID_41836
DFARTAARRRVQIMRTSMTTLTQMWMTLLLSNVLPSDHNYDLPLPKCQLVYAILTRMSAHVAQLIADAIYLFAGMPPTRHPLDPDKSNRALGFPALIMGLCQSFGVPVTPSKVIRPSITRAFIEKYCTPRQLQGDAPQAADVPPQPHQADPARSLGMDRYLQHLVRQQAANQRGQVQIHECLYQLNLSQQGQGSLGDAEGTRMDEEMTDLLDFLGGSGAT

SEQ ID NO: 158615 - protein, 111 aa, Glycine max
  Coding DNA Sequence Number=SeqID_41837
MVHDIFVKVKLEVTRISTILNVFGSRLSNDVTRSIFCPNFCKMVTSILQLDSMNLFVEARAWFNPITQGMAILIANTSTTFHRDERLGNTHAMHGKCNYEIEMPEETSFLS

SEQ ID NO: 158616 - protein, 111 aa, Glycine max
  Coding DNA Sequence Number=SeqID_41838
  Gene Ontology: Cellular component=integral to membrane
  Homolog annotation: Hit_ID=P64445; Match level="QueryCoverage=70%, HitCoverage=92%, E-value=6e-13, Identity=44%"; Hit description =Hypothetical protein ynaJ
TTACADERKRKFSPRSSRPLGIVRARFTVKRKEMRYYLRGLFILALIVGTVMSNAIIGGVIDQYGIPFSHWTLTMYLTQGFMIALYTTVFTALMSIPLWYFFLGEKDDSQG

SEQ ID NO: 158617 - protein, 373 aa, Glycine max
  Coding DNA Sequence Number=SeqID_41839
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=4e-44, Identity=32%"; Hit description= UPI00006A17C9 related cluster
LVLITFRGLHILTIRGLNVLAIRGLHALTFRGLHILTFRGLHALTFRELHVLTIRGLHALTFRGLHVLAFRELHILAFRGLHVLTFRRLHVLTFIGLHVLTFRGLDVLAFRGLHVLTNRGPHALTFRALHVLTIRGLHALAFRGLHVLAIRGLHDLTFRGLHVLAFRGLHALAIGGLHALTFRGLHALAFRGLLVHTIRGLHVLTIRGLHVLTIRGLHILAFRGLHVLTFRGLHALAFRGLHVLTFRGLHVLAIRGLHARTFRGLHILAIRGLDSLGFRGLHVLVFRGLHALAFRGLHALAFRGLHALAFRGLRILTFIGLYICALREFKIWMTLLLSNIPPDDHNVDLPPMEVSVGLCRHDIGEYARGSTDF

SEQ ID NO: 158618 - protein, 412 aa, Glycine max
  Coding DNA Sequence Number=SeqID_41840
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=92%, HitCoverage=76%, E-value=1e-117, Identity=50%"; Hit description=Beta- mannosidase 4
  Pfam annotation: Domain name=Glyco_hydro_1; Domain location=31-411; Score=272.5; E_value=8.1e-79; Accession=PF00232.9; Description =Glycosyl hydrolase family 1
MLQRQLRAVLILFCCVQFHVQSCDEIEDVISRSQFPEGFLFGTGTSSYQAIEGAYFEDGKGLSNWDAFSHTPGKIKKDENGDIADDHYHRYLEDIELMSSLGVNVYRFSISWARILPRIEPFVTIHHYDLPQELEERYGGWISPLIQSDFVHFAEICFKSFGDRVKYWTTINEPNLFADFGYMEGTYAPGHCSPPFGNCNTGNSDVEPLIVMHNMLLSHAKAVELYRKHFQVGGKRIKFQDGSLISKLLMLIQAKQGGTIGIVAFSFMYDPLRDEECDRQAVSRGLAFDIAWVLDPLVFGEYPPEMRSILGSKMPVFSPVEKSLIKGSLDFIGINHYGTLYAKDCSLSTCSLGADHPIAGFLERTATRDGIPIGDPTGVPDFFVVPRGMEKLVEYIKIRYRNMPMYITENGG

SEQ ID NO: 158619 - protein, 610 aa, Glycine max
  Coding DNA Sequence Number=SeqID_41841
  Gene Ontology: Mol. function=receptor activity; Cellular component =intracellular; Biological process=small GTPase mediated signal transduction
  Homolog annotation: Hit_ID=Q9LUQ2; Match level="QueryCoverage=99%, HitCoverage=100%, E-value=0.0, Identity=60%"; Hit description =Leucine-rich repeat protein; contains similarity to elicitor -inducible receptor EIR
  Pfam annotation: Domain name=LRR_1; Domain location=10-32; Score=0.2; E_value=2.6e+02; Accession=PF00560.23; Description=Leucine Rich Repeat
  Pfam annotation: Domain name=LRR_1; Domain location=115-136; Score =15.2; E_value=0.24; Accession=PF00560.23; Description=Leucine Rich Repeat
  Pfam annotation: Domain name=LRR_1; Domain location=161-179; Score =8.4; E_value=7.7; Accession=PF00560.23; Description=Leucine Rich Repeat
  Pfam annotation: Domain name=LRR_1; Domain location=208-229; Score =11.6; E_value=1.9; Accession=PF00560.23; Description=Leucine Rich Repeat
  Pfam annotation: Domain name=LRR_1; Domain location=231-261; Score =8.0; E_value=9; Accession=PF00560.23; Description=Leucine Rich Repeat
  Pfam annotation: Domain name=LRR_1; Domain location=263-284; Score =4.8; E_value=36; Accession=PF00560.23; Description=Leucine Rich Repeat
  Pfam annotation: Domain name=LRR_1; Domain location=285-303; Score =12.4; E_value=1.3; Accession=PF00560.23; Description=Leucine Rich Repeat
  Pfam annotation: Domain name=LRR_1; Domain location=326-348; Score =6.5; E_value=18; Accession=PF00560.23; Description=Leucine Rich Repeat
  Pfam annotation: Domain name=LRR_1; Domain location=408-429; Score =11.9; E_value=1.7; Accession=PF00560.23; Description=Leucine Rich Repeat
  Pfam annotation: Domain name=LRR_1; Domain location=431-453; Score =10.4; E_value=3.3; Accession=PF00560.23; Description=Leucine Rich Repeat
  Pfam annotation: Domain name=LRR_1; Domain location=455-477; Score =10.8; E_value=2.7; Accession=PF00560.23; Description=Leucine Rich Repeat
  Pfam annotation: Domain name=LRR_1; Domain location=46-67; Score =11.6; E_value=1.9; Accession=PF00560.23; Description=Leucine Rich Repeat
  Pfam annotation: Domain name=LRR_1; Domain location=479-501; Score =4.9; E_value=35; Accession=PF00560.23; Description=Leucine Rich Repeat
  Pfam annotation: Domain name=LRR_1; Domain location=503-524; Score =10.4; E_value=3.2; Accession=PF00560.23; Description=Leucine Rich Repeat
  Pfam annotation: Domain name=LRR_1; Domain location=526-547; Score =19.1; E_value=0.016; Accession=PF00560.23; Description=Leucine Rich Repeat
  Pfam annotation: Domain name=LRR_1; Domain location=549-570; Score =18.9; E_value=0.019; Accession=PF00560.23; Description=Leucine Rich Repeat
  Pfam annotation: Domain name=LRR_1; Domain location=573-592; Score =7.1; E_value=14; Accession=PF00560.23; Description=Leucine Rich Repeat
  Pfam annotation: Domain name=LRR_1; Domain location=69-90; Score =14.4; E_value=0.41; Accession=PF00560.23; Description=Leucine Rich Repeat
  Pfam annotation: Domain name=LRR_1; Domain location=92-113; Score =10.5; E_value=3.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=10 -32::115-136::161-179::...
  Pfam module annotation: Domain location=208-229::231-261::263 -284::285-303::326-348::408-429::431-453::455-477::46-67::479 -501::503-524::526-547::549-570::573-592::69-90::92-113
MDRILKAARASGSLNLSNRSLTEIPDEVYRNLEGLGGDDKWWEAAELQKLILAHNSIASLKEDLRNLPFLSVLNLSHNSLSQLPAAIGELPQLKMLDVSFNSIVKIPEEIGSAVSLVKLDCSNNRLTELPSSLGRCLELSDLKGSNNLITNLPEDLANCSKLSKLDMEGNRLTVMSENLISSWTMLTEFNSSKNLLNGIPTSIGGLSRLIRLDLHQNRISAIPSSIIGCHSLTELYLGSNSNLSRCKNNNISTLPVEIGALSRLGTLDLHSNQLKDYPVEACKLSLLVLDLSNNSLSGLPPEMGKTILFTDIESLPFVSCLGKMTTLRKLLLSGNPMRTLRSSLVSGPTPALLKFLRSRLSEDEDSEAVTTTKEVITMATRLSISSKELSMEELGLSAVPSEVWESGEVIKLNLSRNSIQELPVELSSCVSLQTLILSKNQIKDWPGSILKSLSSLSCLKLDNNPLRQIPSDGFEMVPKLQILDLSGNAASLLDGPAFSSLPYLQELYLRRMRLSEVPSDIVGLHQLRILDLSQNSLQSIPVGLKALTSLQELDLSNNNIAVLPPELGLLEPSLQALRLDGNPLRSIRRTVLDKGTKAVLQYLKDKLPEQ

SEQ ID NO: 158620 - protein, 325 aa, Glycine max
  Coding DNA Sequence Number=SeqID_41842
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=81%, HitCoverage=45%, E-value=6e-30, Identity=36%"; Hit description=Beta -mannosidase 4
MESADVNSQKGSSSEQALPLTRCLFTFPFSAFIYVQRKINNDENGVIADDHYHRYLISISFILTCIYYILRLIYDLTAGLDIQQEDTVLMSSLGLNLIFMKRTGGIYGDINPNGIMFYNKIIDNLLLKGEIQDIRIALVKVKTKPAKGNLINGLIFIFITVWHCPNLYLNPGIEPFVTIHHQDLPQELEERYGGWISPLMQRDFVHLAEFVSRALETGLSTGQPSMSQPWLQTLPIGNEYMPLVTVLHLLEAVILHKPRLLNYTASTFRGKRIKVQDGSLISKPLMLIQAKQGGTIGIVSHSLMYEPLRDEECVDKLRVGPWLFR

SEQ ID NO: 158621 - protein, 637 aa, Glycine max
  Coding DNA Sequence Number=SeqID_41843
  Gene Ontology: Mol. function=RNA-directed DNA polymerase activity; Cellular component=chromatin; Biological process=chromatin assembly or disassembly
MVGNGQHLQCTCLCEAITIDIQSTQFRVDLYLLPISGANVGTGLYCHIAILLDEIAHDAIQEPHPAIQALFTRFHLLFQQPHALPPEHDTDHHIHLLPHSNPINNGLIQPSTSPFSSPVLLVKKHDGSWRFCVDYRALNAITIKDRFPIPTIDELLDELGGAKCFSKLDLLQGYHQIRMNSADIPKTAFRTHHDHYEFRVMPFGLCNASSSFQATMNKIFRPYLRHFIIIFFDDILIYSGSFEDHLLHLEMAFQVKYLGHLVLHKGVKPLASKVEAIYQWPTPRSTRAIRSFLGLAGFYRRFIRGYATIAAPLVHITTMEHFEWTAQAQTTFEQLKQALSEAPVLALLDFQLPFIVETDAFGIRMGVVLSQQGHPIAFFSKPFSPKLLRASAYDVSQFVSHCIDCQHAKYETKRVVRLLCPLPVPHQPWEDLSLDFIIGLPPYHDNTMILVVVDRFSKGVHLGMLPSVNTAHTVASLFMEIVGKIHGIPCSLAQENVKTLADAKRRERIYQPGDWVMLKLRPHRQTSANGSQAIMGKLAKRFNGPFQVLEQASSTEQGPWEVLVQWQGLFPDETSWEDWAQLCKDYHLEDKVILQGPKNDTKAEEHGVASKEHKPGVRIEGRSKRAITKPSYLIDYL

SEQ ID NO: 158622 - protein, 213 aa, Glycine max
  Coding DNA Sequence Number=SeqID_41844
MCTVIVHQHHHLVVGDQAQQAESGGKSKCHYIRQNGVFILCNQKKNPRGTTVTSIVFLITVEVEATLAMGGEFVRAWVGVVKHEGATANGCPRVSPLGDEQGRSLAQGSRAGAPTLRMNLRGEARNKTTQEEGQRKINDSIGEVLKLRQGLKKYGPGGELAITGTEGGGGMDRVGEEDEESMGPEKSIIKLVEEPHGCCWVEENNESIKIDRE

SEQ ID NO: 158623 - protein, 86 aa, Glycine max
  Coding DNA Sequence Number=SeqID_41845
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=59%, HitCoverage=10%, E-value=1e-12, Identity=65%"; Hit description=Beta -mannosidase 4
MHLTTILDIRQEDIELMSSLGVNVYRFSISWTRILPRGIYGNINPSGIMFYNKIIDNLLLRGKVAMSMITWVIILHSATLFDFFHG

SEQ ID NO: 158624 - protein, 142 aa, Glycine max
  Coding DNA Sequence Number=SeqID_41846
  Homolog annotation: Hit_ID=Q1T344; Match level="QueryCoverage=55%, HitCoverage=28%, E-value=7e-11, Identity=41%"; Hit description=RNA polymerase, RBP11-like
MDEDQWMHDNIMSEEIDMNEQNEDEDGMKSEHVDCFDAFNTSQVFATCDDVLNWARAVVYEISFELCGKSMVGGQGWMMKLTCGSHNHEMTKSLVGHPYVGRLTKDEKIIIVDMTKSMVKPRNILLTLKEHNVNSYTTIKQT

SEQ ID NO: 158625 - protein, 399 aa, Glycine max
  Coding DNA Sequence Number=SeqID_41847
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=92%, HitCoverage=69%, E-value=1e-105, Identity=50%"; Hit description=Beta- mannosidase 4
  Pfam annotation: Domain name=Glyco_hydro_1; Domain location=1-375; Score=198.4; E_value=1.7e-56; Accession=PF00232.9; Description =Glycosyl hydrolase family 1
MPQELEEIYGGWISPLIQRDFVHFAEICFKSFGDRVKYWTTINEPNQFSDFAYMRGIYPPGRCSPPFGNCKTGNSDVEPLIALHNMLLSHAKAVDLYRKHFQVRGNRTKGQYWSLNSKPFMLIQAKQGGTIGIVADSLMFEPLRDEECDRQAASRALTFELARVLDPLVFGEYPAEMRSILGSKLPVFSPKEKSLIKGSLDFIGINHYGTLYAKDCTLSTCSLGADHPIRGFVETTATRNGVPIGEPTGIAQFFVVPRGVEKLADYIKMRYHNIPMYITENGYSPPPKPDVTIHDSLQDFKRIDYHKAYLAALLRSIRKGADVRGYMIWSLMDNFEWASGYDIRFGLYYVDRQTLERIPKLSVQWFSSFLNNTSHTNKQDLSEQYVRSKDVMTAGFEVI

SEQ ID NO: 158626 - protein, 565 aa, Glycine max
  Coding DNA Sequence Number=SeqID_41848
  Gene Ontology: Mol. function=GTP binding; Cellular component =intracellular; Biological process=biological_process
  Homolog annotation: Hit_ID=Q1SLV9; Match level="QueryCoverage=96%, HitCoverage=94%, E-value=0.0, Identity=76%"; Hit description=GTP1/OBG
  Pfam annotation: Domain name=MMR_HSR1; Domain location=308-410; Score= 78.1; E_value=2.8e-20; Accession=PF01926.13; Description=GTPase of unknown function
  Pfam annotation: Domain name=NGP1NT; Domain location=42-168; Score =232.7; E_value=8.2e-67; Accession=PF08153.2; Description=NGP1NT (NUC091) domain
  Pfam module annotation: Pfam domain module=MMR_HSR1::NGP1NT; Domain location=308-410::42-168
  Subcellular localization annotation: CTP_CleavageSite=33; ConfidenceScore=5.08e-01
MAKKKEKKVNVSGKPKHSLDVNRSNDAKKESRSAATVRRLKMYNTRPVRDRKGKVLSHELQSKELPSTRIQPDRRWFGNTRVVNQKELEFFREELQSRMSSNYNVILKEKKLPLSLLNDHQKQARVHLLDREPFQDAFGPKTKRKRPSLMAADYESLLKKADGSQDAFEQKYGSSVSAEANDEDGFRDLVRHTMFEKGQSKRIWGELYKVIDSSDVVVQVLDARDPQGTRCYHLEKHLKENCKHKHMVLLLNKCDLVPAWATKGWLRVLSKEFPTLAFHANINKSFGKGSLLSVLRQFARLKRDKQAISVGFVGYPNVGKSSVINTLRTKNVCKVAPIPGETKVWQYITLTKRIFLIDCPGVVYHNNDTETDVVLKGVVRVTNLKDAADHIGEVLKRVKKEHLERAYKIKECHFTIGSLLRLMISSTNLFWLSSIRPRLDMLPLFALGGEPDLMTAAKMILHDWQRGRIPFFVSPPRVEDLSEEPNVNGVDLDDSVDGNEASAAMKAIADVLSSQQQTSVPVQNDLYSENELKGEAADQYPNTNANEDILAPDSNTSEEDPTNVS

SEQ ID NO: 158627 - protein, 68 aa, Glycine max
  Coding DNA Sequence Number=SeqID_41849
  Homolog annotation: Hit_ID=Q10NJ7; Match level="QueryCoverage=50%, HitCoverage=10%, E-value=7e-07, Identity=77%"; Hit description =Mitochondrial carrier protein, expressed
  Subcellular localization annotation: CTP_CleavageSite=45; ConfidenceScore=5.33e-01
MLQQQQMGTVSQLLAVGLAGAFAKTCTAPLARLTILFQRSATAIVAAMSRYFDSPSPQWLHQPHFLAI

SEQ ID NO: 158628 - protein, 195 aa, Glycine max
  Coding DNA Sequence Number=SeqID_41850
  Gene Ontology: Mol. function=transporter activity; Cellular component= mitochondrial inner membrane; Biological process=mitochondrial transport
  Homolog annotation: Hit_ID=Q10NJ7; Match level="QueryCoverage=96%, HitCoverage=67%, E-value=1e-73, Identity=61%"; Hit description =Mitochondrial carrier protein, expressed
  Pfam annotation: Domain name=Mito_carr; Domain location=47-137; Score= 110.2; E_value=5.8e-30; Accession=PF00153.17; Description =Mitochondrial carrier protein
MKKDLEHLVTIAHRLPYSSVNFYAYECYKNLLRLLLGEKHRGNTGADLFVHFVAGGLSGITAAAATYPLDLVRTRFAAQRSSTYYRGISHAFTTICRDEGFLGLYKGLGATLLGVGPDIAISFSVYESLRSFWQSRRPDDSTVMISLACGSLSGVASSTATFPLDLVRRRKQLEGAGGRARVYNTSLFGTFKHII

SEQ ID NO: 158629 - protein, 565 aa, Glycine max
  Coding DNA Sequence Number=SeqID_41851
  Gene Ontology: Mol. function=calmodulin binding; Cellular component =integral to membrane; Biological process=response to biotic stimulus
  Homolog annotation: Hit_ID=Q9FI00; Match level="QueryCoverage=99%, HitCoverage=86%, E-value=0.0, Identity=62%"; Hit description=MLO -like protein 11
  Pfam annotation: Domain name=Mlo; Domain location=6-554; Score=589.2; E_value=3.9e-174; Accession=PF03094.6; Description=Mlo family
MEENSQETRSLALTPTWSVATVLTVFVAVSLLVERSIHRLSNWLRKTNRKPLLAALEKMKEELMLLGFISLLLTATSRMIANICIPSKFYNSAFAPCTRSEIDEEMEDNGSEERKLLMASSYPHLVRRMLNGINSSTCKEGYEPFVSYEGLEQLHRFIFVMAVTHISYSCLTMLLAIVKLIVAFSYEKGFNNQTITLILNHMSRVSDSLNQIHSWRVWEDEAHMDRHNSLTEITKELTMRRQSTFVKSHASNPLIKNSSLIWVTCFFRQFGRSVVRADYLTLRKGFIMNHNLSLKYDFHSYMVRSMEEEFQRIVGVSGPLWGFVVAFMLFNIKGSNLYFWIAIIPVSLVLLVGTKLQHVIATLALENAGITGFFTEAKLRPRDELFWFNKPELLLSLIHFILFQNAFELASFFWFWVFPYPFYILELDHGHGVKEIISFKFQLNFDCLEMNYPKMRWQFGYYSCFIRNHLLLYIRLILGFAGQFLCSYSTLPLYALVTQMGTNYKAALIPQRIRETIHGWGKAARRKRRHGMFTDDSTIHTDTSTVLSIEEDDQLIDTPEVELQQ

SEQ ID NO: 158630 - protein, 162 aa, Glycine max
  Coding DNA Sequence Number=SeqID_41852
MDNSHVTDNDGCSKLNGMNAEHANTCEGGGSGGVRCCSGRQRWHTRYTMLGAFWCTAFHTDQVDLLRINLIRKFIQKCFEDQVDPRDDVLWWAQSVAYENGFVAVIVRKKEFVRRDTETRKYRYPFKLRGKLVVGGQGWMTKLICGIHNHELAKSLVGHSYA

SEQ ID NO: 158631 - protein, 190 aa, Glycine max
  Coding DNA Sequence Number=SeqID_41853
  Homolog annotation: Hit_ID=Q9LUQ4; Match level="QueryCoverage=88%, HitCoverage=24%, E-value=8e-78, Identity=75%"; Hit description =Arabidopsis thaliana genomic DNA, chromosome 3, P1 clone: MJK13
MVKLWSLILWLTRLTYGLDYKGNVCGQKHAVQDLRELELRYWLSPNQVYQSGLKDSQFKLVNARSICLLDCPIPSEDSLTWVCDYPEGDIHVSLNDWIDMNYDYFEFLTPEMRNSSLQLQGPCYPVIFPSVNVYWSCQFIAKASNVSLKHWQQMGGVTINENIVIDKSIHKYINSHSAVLKGKHNTLSAS

SEQ ID NO: 158632 - protein, 429 aa, Glycine max
  Coding DNA Sequence Number=SeqID_41854
  Gene Ontology: Mol. function=choline transporter activity; Cellular component=integral to membrane; Biological process=transport
  Homolog annotation: Hit_ID=Q9LUQ4; Match level="QueryCoverage=98%, HitCoverage=66%, E-value=1e-179, Identity=69%"; Hit description =Arabidopsis thaliana genomic DNA, chromosome 3, P1 clone: MJK13
  Pfam annotation: Domain name=DUF580; Domain location=46-424; Score =425.0; E_value=1.1e-124; Accession=PF04515.3; Description=Protein of unknown function, DUF580
MADIGKAWLVLIVCGGILPLFVSVIWLLMIRHFVAAMPWVTVVLFDVLIISVTMFFYLKVGWIGNDAISPIIGEHDPYIHVFVRVAAKVIGEVRALIIFPIIPYGILAVFYMLWISAALHLFSSGRVVQNNCNSNCCTYDLLEKRVICDQCCGYSIRYTPHIGVAILFHLFGCYWATQFFIACSSTVIAGSVASYYWAHGEASPEIPFLSVFSSMKRLMRYSLGSVALGSLTVSFVESIRFLLESIRRKLKGSSHMPDSWIDKAAYQSSQCFRRCIEWTIKSVNRNAYIMIAITGKSFFRASAIATELIMNNILRIGHVNVIGDVILFLGKLCVSLSSAVFAFLMLDTHNYSSAHNKISSPLLPVVVCWALGYIVATLFFAVVEMSIDTIILSFCQDSEEHGTAHYAPPLLIETLGDQNDMQRLTQGPQ

SEQ ID NO: 158633 - protein, 94 aa, Glycine max
  Coding DNA Sequence Number=SeqID_41855
VSPRIMCAEYTKLGLCVPLDTTVSEWQRGADNRKNDQTWSLLAIGHNCVCLAKGGADNRKNDQTWSLLAIGHNCVCLAKGGADNRKVSPRITSS

SEQ ID NO: 158634 - protein, 46 aa, Glycine max
  Coding DNA Sequence Number=SeqID_41856
MLPLKIASSGGKWWPEELDKGVAGRVHGSSVDYTMKKIFQKLFLKS

SEQ ID NO: 158635 - protein, 412 aa, Glycine max
  Coding DNA Sequence Number=SeqID_41857
  Gene Ontology: Mol. function=calcium ion binding
  Homolog annotation: Hit_ID=Q9FF58; Match level="QueryCoverage=89%, HitCoverage=96%, E-value=7e-31, Identity=31%"; Hit description =Arabidopsis thaliana genomic DNA, chromosome 5, P1 clone:MUP24
  Pfam annotation: Domain name=F-box; Domain location=42-89; Score =43.3; E_value=8.2e-10; Accession=PF00646.23; Description=F-box domain
  Pfam annotation: Domain name=LRR_2; Domain location=191-216; Score =20.8; E_value=0.0048; Accession=PF07723.3; Description=Leucine Rich Repeat
  Pfam annotation: Domain name=LRR_2; Domain location=333-358; Score =4.4; E_value=4.1; Accession=PF07723.3; Description=Leucine Rich Repeat
  Pfam module annotation: Pfam domain module=F-box::LRR_2::LRR_2; Domain location=42-89::191-216::333-358
MPNRGSVLRSLCLSPLIVSQKAKVRRNNGQKSPTKPKAAQLDRISSLPDEIICHILSFLPTIEAVTTSVLSTRWRSLWTLVLTLDFDDNWPCFFNTTFASVFGSILAQRKAKCIKRLCLYNYSKPFSLDLIGSLVSTAVAQNLEEMDLICNYYFEVTLPNTLFTCKTISVLKLSLGLTINLNNISSIHLPSLKVLHVDVLYLVDDESIMRLFSGCPVLEELCYEEVKSNNSTSFKICVPSLKKLHLKCHDKRVQVVTPSLEYLQVQETKVRDSLVGNLPNLLQAHADIYFDQHEKEYVFNFFNAIRQTKFLGLSTYTIEALTDASFGFPEFHNLVHLQLCLSTIDSCSLIQLLLARCPKLEILDIDKVYGKVKKSGNSPLHQFLIVLTHILRRLNLKSMGAPNTSWNLQSIF

SEQ ID NO: 158636 - protein, 40 aa, Glycine max
  Coding DNA Sequence Number=SeqID_41858
  Gene Ontology: Mol. function=lactoylglutathione lyase activity; Biological process=carbohydrate metabolic process
  Homolog annotation: Hit_ID=Q9ZS21; Match level="QueryCoverage=80%, HitCoverage=17%, E-value=6e-11, Identity=93%"; Hit description =Glyoxalase I
MLNVNGIGKMKGIAFIKDPDGYWIEIFDRKTIGNVTQAPA

SEQ ID NO: 158637 - protein, 162 aa, Glycine max
  Coding DNA Sequence Number=SeqID_41859
  Homolog annotation: Hit_ID=Q9FHZ6; Match level="QueryCoverage=75%, HitCoverage=39%, E-value=2e-30, Identity=53%"; Hit description =Arabidopsis thaliana genomic DNA, chromosome 5, P1 clone:MGN6
MGTLATLYVQESMTKRPEFTAWLAEVKQVNLENMSNWEEKQMFKEFMEDHNTATFPSKKYYNLDAYYRREMEKEMKKGFKKVQATERTIFNDEEQRRQELLQAREKHKEEQVMALKHSMQTGMAQAMKEQAQLREEMAYQYKLGNFEAAAAIQRRLDPDAAI

SEQ ID NO: 158638 - protein, 328 aa, Glycine max
  Coding DNA Sequence Number=SeqID_41860
  Gene Ontology: Mol. function=fatty-acyl-CoA synthase activity; Cellular component=peroxisome; Biological process=jasmonic acid biosynthetic process
  Homolog annotation: Hit_ID=Q9M0X9; Match level="QueryCoverage=100%, HitCoverage=61%, E-value=3e-97, Identity=54%"; Hit description=4 -coumarate--CoA ligase-like protein
  Pfam annotation: Domain name=AMP-binding; Domain location=2-281; Score=35.0; E_value=4.4e-09; Accession=PF00501.18; Description=AMP -binding enzyme
MEMAGPVTQGDTAALLYSSGTTGLSKGVVLTHRNFIAASVMIGMDDDIAGEQNDVYLCVLPMFHAFGLAVVTYAALQRGSAVVVMGRFELKALLRAVEKHWVTKLWLVPPILLALAKQSVGYGMTETCGIVSLENPRVGVRHTGSTGTLGSGVEAQIVSVDTQKPLPPRQLGEIWVRGPNMMQVDQWILSQNSCITSWTGNCSCKIMFEAKDLHWNACYNTVNQACTKTISHGDLGYFDEDGQLYVVDRIKELIKYKGFQVAPAELEGLLVSHPEILEAVVVPNSHLSYFLCNRYPDDEAGEVPIAYVVRSPNSSLTEEEIQKFIAKQ

SEQ ID NO: 158639 - protein, 50 aa, Glycine max
  Coding DNA Sequence Number=SeqID_41861
MVKYVRNGREGEEMGLRTLPSSLYSVSAAAVLVSFPTGEGSAIGPWTFSN

SEQ ID NO: 158640 - protein, 54 aa, Glycine max
  Coding DNA Sequence Number=SeqID_41862
MVVLEDDLLEGVPKESEGKVMKKNDGPVVPLSGEETLCCGEEDYKFVMFEVPRW

SEQ ID NO: 158641 - protein, 186 aa, Glycine max
  Coding DNA Sequence Number=SeqID_41863
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=1e-17, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TAPPRLQKAARPRLRGLHVLAFRRLHALAFRGLHALAFRGLHVLAIRGLHVLPFQGLHALALRGLYVLLFRGQHTLAFVGLYGLTFRGLYVLPFRGLHVLAIRGLHALALEDYTGLHVLAFIRLCALTFRGLYVLAFRGLYILAIRGLHVLTFRGQHDLAFRGLHVLTFRGLHVFTFRRLHALTLK

SEQ ID NO: 158642 - protein, 114 aa, Glycine max
  Coding DNA Sequence Number=SeqID_41864
  Gene Ontology: Mol. function=protein disulfide oxidoreductase activity; Cellular component=chloroplast; Biological process =glycerol ether metabolic process
  Homolog annotation: Hit_ID=Q95AH9; Match level="QueryCoverage=92%, HitCoverage=58%, E-value=2e-47, Identity=80%"; Hit description =Putative thioredoxin m2
  Pfam annotation: Domain name=Redoxin; Domain location=7-114; Score= -8.5; E_value=0.018; Accession=PF08534.1; Description=Redoxin
  Pfam annotation: Domain name=Thioredoxin; Domain location=10-113; Score=167.3; E_value=3.8e-47; Accession=PF00085.10; Description =Thioredoxin
  Pfam module annotation: Pfam domain module=Redoxin::Thioredoxin; Domain location=7-114::10-113
MKHFVLLDIAVAPVTDANWQSLVIESESPVLVEFWAPWCGPCRMIHPIIDELAKEYTGKLKCYKLNTDESPSTATKYGIRSIPTVIIFKNGEKKDTVIGAVPKTTLTSSIEKFL

SEQ ID NO: 158643 - protein, 332 aa, Glycine max
  Coding DNA Sequence Number=SeqID_41865
  Gene Ontology: Mol. function=nucleotidyltransferase activity; Cellular component=cellular_component; Biological process=biological_ process
  Homolog annotation: Hit_ID=Q9FHZ9; Match level="QueryCoverage=68%, HitCoverage=44%, E-value=7e-89, Identity=71%"; Hit description =Similarity to topoisomerase-related function protein
  Pfam annotation: Domain name=PAP_assoc; Domain location=112-170; Score=56.2; E_value=1.1e-13; Accession=PF03828.9; Description=PAP25A associated domain
MLTYHSDTIGECYAYPRSIKQVTHHVIHAPSPIVLGVKGFDIDNGPKAAEYIQEAVVKWPPLRPLCLILKVFLQQRELNEVYSGGIGSYALLTMLMAMLRNLRLSQASAEHNLGVLLVHFFDFYGRKLNTSDVGVSCNGTGTFFVKSSKGFLNRGRPSLIAIEDPQAPENDIGKNSFNYFQVRSAFSMALKNLTDAKIITSLGPNRSILGTIIRPDPVLLERKGGLNGDVTFDKLLPGAGEPLQQQYGDEDMLCNWQLDYEEEPLPRGVNTSAEPSTRSSTKKRKSSSKKSSKKLKENGDLQMVRNEENDSRKENSKKKRRKKKTHQGDSGY

SEQ ID NO: 158644 - protein, 142 aa, Glycine max
  Coding DNA Sequence Number=SeqID_41866
  Gene Ontology: Mol. function=microtubule motor activity; Cellular component=microtubule associated complex; Biological process =microtubule-based process
  Homolog annotation: Hit_ID=Q6EP41; Match level="QueryCoverage=68%, HitCoverage=47%, E-value=6e-18, Identity=45%"; Hit description =Putative dynein light chain 2
  Pfam annotation: Domain name=Dynein_light; Domain location=42-132; Score=53.6; E_value=6.4e-13; Accession=PF01221.9; Description=Dynein light chain type 1
MEEEQEPKLIHGSKAMRMHTPTPNPNPSQTIMRLASLAISFNVRLKSSHMPLHMQEHALRHTRSLFLLHHPPSPKPSNTLIARALKKEFDSKYGLAWHCVIGNSFGSFVSHTGGGFIYFSIDSLSVLLFKTEVHLVTQPPPT

SEQ ID NO: 158645 - protein, 85 aa, Glycine max
  Coding DNA Sequence Number=SeqID_41867
  Gene Ontology: Mol. function=protein disulfide oxidoreductase activity; Cellular component=chloroplast; Biological process =glycerol ether metabolic process
  Homolog annotation: Hit_ID=Q95AH9; Match level="QueryCoverage=91%, HitCoverage=42%, E-value=6e-10, Identity=51%"; Hit description =Putative thioredoxin m2
  Subcellular localization annotation: CTP_CleavageSite=69; ConfidenceScore=5.77e-01
MATVQLQSLTLVRSSALPSATFSPPIAVSGRRNSAALPRYSGLRLRPAAETSFPTHASSRTASRGGGVKCEAGDTAVEVIEHFDE

SEQ ID NO: 158646 - protein, 200 aa, Glycine max
  Coding DNA Sequence Number=SeqID_41868
  Gene Ontology: Mol. function=nucleotidyltransferase activity
  Homolog annotation: Hit_ID=Q9FHZ9; Match level="QueryCoverage=96%, HitCoverage=31%, E-value=2e-22, Identity=37%"; Hit description =Similarity to topoisomerase-related function protein
MEEEQELKIPETIIYDTIGPLALSAVDDSPLSDHLEPIAVFRNEISLETPQRASPASAAVDFFSLDVAADASARDPFPELLAAAPEPMTPAPAPEPKLESGWFHGNCKFKSPMLQLHKDYQAKFSLLLLENNTHSTYGTQIRYSFLEIVDFCAFLSPTAEEKAARDLAIESVFGVVKHIWPHCQVEVFGSFRTVAVSSDK

SEQ ID NO: 158647 - protein, 925 aa, Glycine max
  Coding DNA Sequence Number=SeqID_41869
MDSLLSILFFLLTLSSLNPSFASQPSYQDHCGSIVPESTPNENTHNSSPFDDHQRGYFTGGDSIIDGGTSLNQYFDLQPMYIRATKFSDLFNVEATVSLTSSISYYWNSSHGDSLRYERKRRYRRNHVYFKLEGFWSESSGKACMVGKGNGYSKTGKHLNLDAVFKLDKVFSASNITSLVNGSLESLSSPKDESYFEPISVVMFPKANYKYTLNSTEVTNEFSSGSDAMKGGLSLSSLSFCSRPLSRAIRRLPLEFSPECNSSKNCTPFSENSGPLPFLVSLKGIECSISNNKHRLRILVRFLNTSNYWISQSFNPKTMLVGEGWWDEKKNMLCVVACHIIESSLAGTHVGDCSIRLRLRFPSTWSINSTSSIVGQIWSNKSTNDSGYFKKITFRNEDDGSVGIQATKYEYSLLDRAKKSCPAPKPVKNKEKRYPDANSYDMRFDMAVRESNKRVAWGYSSPLAVGGEISTIDQISSSITVDSTFDQNVSSSIVESPEVVLHSGGLFNISYKISLWPNSTSNDKNSLLNHSSGSVRISAEGIYDSGEGSLCMIGCRDLHLNSLTPTAHSVDCEIVVKFQLPPLDERSGIYIKGSIESTRKKSDSLYFKPLELSSAAFYTEAAEKLVWRMDMETIMVLISTTLASVFVGLQLYHVKRHPNVLPLLSLVMMAMLTLGYMIPLVLNFEALIAQNPNNKNFVFGNVVWLEVNEIAVRLITMVAFLLQFRLLQLTWSSRKSDESNKGLWIAERKATCVTLALYAAGLLIALLLKLKKDGDAVPVITPLNQHHSSWENIKSYGGLVLDGFLLPQIILNLFSNMRGNVLSCSFYFGTTFVRLLPHAYDLYRTHNYARVDSGSYFYADPSADFYSTAWDIVIPLGGVLLAIIIYLQQRFGAHCILPQRFKGSKVYEKVPVVAESEAEVETANL

SEQ ID NO: 158648 - protein, 186 aa, Glycine max
  Coding DNA Sequence Number=SeqID_41870
  Gene Ontology: Mol. function=metal ion binding
  Homolog annotation: Hit_ID=Q9LS99; Match level="QueryCoverage=40%, HitCoverage=33%, E-value=9e-12, Identity=42%"; Hit description =Similarity to RING zinc finger protein
  Pfam annotation: Domain name=zf-C3HC4; Domain location=141-182; Score= 34.7; E_value=3.2e-07; Accession=PF00097.15; Description=Zinc finger, C3HC4 type (RING finger)
MAEFTELFPLGEQFDGLMHVYVYVITFDLPTLFIVLFILTVLFFILYRILNGLFFWLLEMRPIEHDIEEGNTNTHLANYGETEPSHHFTIFHALVHPWALVTAFEGAFNEKRGQRLRASKKLPPLVNYGKHGVTRSCGEECAICMEEFKVSQLCQVFPECKHIFHSDCIDHWLQKKLTCPICRSCI

SEQ ID NO: 158649 - protein, 358 aa, Glycine max
  Coding DNA Sequence Number=SeqID_41871
  Gene Ontology: Mol. function=small conjugating protein ligase activity; Cellular component=integral to membrane; Biological process=protein modification process
  Homolog annotation: Hit_ID=Q1RVR2; Match level="QueryCoverage=77%, HitCoverage=33%, E-value=1e-114, Identity=71%"; Hit description =Ubiquitin-conjugating enzyme, E2
  Pfam annotation: Domain name=UQ_con; Domain location=15-164; Score =98.2; E_value=2.4e-26; Accession=PF00179.16; Description=Ubiquitin -conjugating enzyme
MNLFLEQPPKNWAKKIQEEWRILEKDLPASIFVRVYESRMDLLRAVIIGAEGTPYHDGLFFFDVFFPSAYPNVPPKVHYHSGGLRLNPNLYACGKVCLSLLNTWSGSKNEKWVPGMSTILQVLVSIQGLILNTKPYFNEPGYAHMSGSANGEKMSFQYNEDTFILSLRTMMYMIRKPPKGGRKGWGAIKEAMPRHAFAFQWKNFEDLVKGHFCNRASDILVACKAYMEGAQVGCLVKGGVQDVDEGDRSCSQQFKDSLSGYMNMLVKEFAKVGAKDIDKLLPPATTPVAIKPSVFMCDGNDNDNNDDVIISSDDRDISDGCDDTNNDNDNGGVDNDVSGDDGDNDNGVGGDTKWWYWL

SEQ ID NO: 158650 - protein, 63 aa, Glycine max
  Coding DNA Sequence Number=SeqID_41872
MVKGRKPFVLNEKLKGIKGALKEWSKQHGEDFDGRIVEANKEVDDIDKLGELQDLVDKQHNRR

SEQ ID NO: 158651 - protein, 272 aa, Glycine max
  Coding DNA Sequence Number=SeqID_41873
  Gene Ontology: Mol. function=N-methyltransferase activity; Cellular component=integral to membrane; Biological process=DNA methylation
  Homolog annotation: Hit_ID=Q2ZPI3; Match level="QueryCoverage=100%, HitCoverage=57%, E-value=1e-147, Identity=89%"; Hit description=N-6 DNA methylase:Type I restriction-modification system, M subunit
  Pfam annotation: Domain name=N6_Mtase; Domain location=75-272; Score =139.7; E_value=8e-39; Accession=PF02384.7; Description=N-6 DNA Methylase
  Pfam annotation: Domain name=UPF0020; Domain location=103-258; Score=- 61.7; E_value=0.055; Accession=PF01170.9; Description=Putative RNA methylase family UPF0020
  Pfam module annotation: Pfam domain module=N6_Mtase::UPF0020; Domain location=75-272::103-258
MESVGDAELAKGKMFTTKDIGQALKDSFRGIELANPKLHGIFGDASWTNKERLSDELLVTLLNHFNKVNLGVASVRDDDMGRAYEYLIKRFADKANKKAGEFYTPRTIVRLMVNILDPKAGESVYDPACGTGGMLLETIHHVKENGGDPRLLKIKGQEKNLTTEAIARMNLFLHGQEDFDIVRGDTLREPKFLQSDRLETFDCVVANPPFSLKEWGYDLWSNDPYGRKQYGLAPKTNGDFAWVQHMFASLNGNGRMAVVLPHGVLFRGGVEG

SEQ ID NO: 158652 - protein, 864 aa, Glycine max
  Coding DNA Sequence Number=SeqID_41874
  Gene Ontology: Mol. function=zinc ion binding
  Homolog annotation: Hit_ID=Q9ZT97; Match level="QueryCoverage=89%, HitCoverage=91%, E-value=3e-60, Identity=37%"; Hit description =Putative inhibitor of apoptosis
  Pfam annotation: Domain name=zf-C3HC4; Domain location=810-849; Score= 10.8; E_value=0.012; Accession=PF00097.15; Description=Zinc finger, C3HC4 type (RING finger)
MASLVASGSSQMAPADPPLGEPNKIIPLPQHESLSYEFSAEKFEITPGHGQVSASGMCSVSQDHSDALKLDLGLSSPVASSDVRISQPKEELEVDEFHDADWSDLTEAQLEELVLSNLDTIFKSAIKKIVACGYIEDVATKAILRSGICYGCKDAVSNVVDNGLAFLRNGQEINPSREHYFEDLVQLEKYILAELVCVLREVRPLFSTGDAMWRLLICDMNVSLACAMDGDPSSSLGSDGIADGCSSVQTESQSKLETKGPELSLPSPCKSVSSGSQPKKSSVEGNTGLDKSKNSQILVGPSEKEAANSGRDSIDKSSSTSGTSQSPLVEEKCGNIRKVHSSSTKRDYILRQKSFHMEKGYRTYGSKGSSRGGRLNGLNGLILDKKLKSVSEPTTINLKSASINISKAMGVDVTQDNLNADFSSNDGPSTPTAFSLDSTVTVSRSTNTLSSVHDGNIPAVGSSNVLSATDTNLSLSLSSNSKSPTTPVCCNNKPPNSSCMGILHDRSLGKWIPQDRKDEMILKLVPRVQELQNQLQEWTEWANQKVMQAARRLCKDKAELKTLRQEKDEVERLKKEKQSLEENTMKKISEMENALSKASAQVERTNADVRKFEVENAALRKEMEAAKLRAAESATSYQEVSRREKKTQMKFQSWEKQKSLFQEELMTEKHKLAQLQQELEQAKVQQQQVEAAKAKEELLLQASSIRKEREQIEESAKSKEDMIKLKAEENLHRYRNGIQKLEKEIVQLRQKTDSSKIAALRRGIDGNYASSCMDMKGTALRESQATFISELVSNLNDCSLIGGVKRERECVMCLSAEMSVVFLPCAHQVVCTTCNELHEKQGMQDCPSCRSPIQRRIFVRFART

SEQ ID NO: 158653 - protein, 490 aa, Glycine max
  Coding DNA Sequence Number=SeqID_41875
  Gene Ontology: Mol. function=endonuclease activity
  Homolog annotation: Hit_ID=Q9ZU86; Match level="QueryCoverage=88%, HitCoverage=91%, E-value=1e-110, Identity=53%"; Hit description =Expressed protein
  Pfam annotation: Domain name=Exo_endo_phos; Domain location=68-444; Score=14.0; E_value=0.0016; Accession=PF03372.13; Description =EndonucleaseExonucleasephosphatase family
MFGVIRRKLRHLYSRILWLLWKRPRSKVVIKRFRKLNFKGHHKAELCKNKSTSDPNGLLVESQSGRAIRIATFNVAMFSLAPAVSEFNEWVVSNHENGSNKKSLLAKGDFPKSILKQSPLHASLDKAQSLSDSEILPRSNLKVSINLPDNEISLANSRLLASIESKEGTSDTIMGNVSGRHQVPARSPVCFPFIMNYCEGTERFTCSRSILEVLREIDADVLALQDVKAEEEKNMKPLSDLAAALGMKYVFAESWAPEYGNAILSKWPIKKWRVQKIADDDDFRNVLKATVDVPWAGEINFHSTQLDHLDENWRMKQVHAIIRSNDPPHILAGGLNSLYGADYSSERWTDIFKYYEKLGKPRPRSEVMNFVKSKGYVDAKDYAGECEPIAIIAKGQNVQGTCKYGTRVDYILASPNSHYKYVPGSYSVISSKGTSDHHIVKVDIMKVNASAQKNAIRQCRKLKRKVVKITPPCSATGVRESTPPPKIFVP

SEQ ID NO: 158654 - protein, 511 aa, Glycine max
  Coding DNA Sequence Number=SeqID_41876
  Homolog annotation: Hit_ID=Q5XWK4; Match level="QueryCoverage=60%, HitCoverage=78%, E-value=6e-63, Identity=42%"; Hit description =Expressed protein-like
  Pfam annotation: Domain name=DUF616; Domain location=136-451; Score =653.6; E_value=1.6e-193; Accession=PF04765.4; Description=Protein of unknown function (DUF616)
MVCFWYCDELGGNITSEIEDTRSYAITRYEFLKPRGVIEDKPQDSNSSRVFSLTSRHRSTARPPPAPNSLSLSKSKRKMGYFPTWGHRCDHFAFPPPPPADRRRPGPRPCPVCYIPVKQAIASMPGSPSESPILRTLTYVHDENPIEGEPHGGSDFGGYPSLEERDAAFDIKETMKVHCGFVKGSRPGRQTGFDFDEADLLELDQYHDVIVASAIFGNYDVIQQPRNISLEAKKNIPFYMFIDEETEMYMKNASILSSSRRVGLWRIIIVRNIPYADSRRNGKVPKLLLHRIFPNVRYSIWIDGKLELVVDPYKVIERFLWRQNATFAISRHYRRFDVFVEAEANKAAGKYENASIDHQIQFYKYHDGLTHYSRTKLPITSDVPEGCVIIREHIPITNLFTCLWFNEVDRFTSRDQLSFSTVRDKIMAKTDWSISMFLDCERRNFVIQAYHRDILEQMPPPAAVTWRPGPPTYTNRPQMRNHPRRGRGDRRSGSKHHHRVVGTVHMNHILI

SEQ ID NO: 158655 - protein, 138 aa, Glycine max
  Coding DNA Sequence Number=SeqID_41877
  Homolog annotation: Hit_ID=Q69T67; Match level="QueryCoverage=74%, HitCoverage=12%, E-value=6e-35, Identity=63%"; Hit description =Lustrin A-like
  Pfam annotation: Domain name=DUF231; Domain location=1-128; Score =57.7; E_value=3.7e-14; Accession=PF03005.6; Description=Arabidopsis proteins of unknown function
MSTAYHPQTYGQTEVANRCLEACLRGGQWNSGGQCHKETEPIFNEAYLQRYPSKMLALEHVIQQMKARVVYMNISRLTDYRKDGHPSVYRTGYKASMNHNTAALFEDCSHWCLPGVPDTWNELLYVSLLKYGKGTWKS

SEQ ID NO: 158656 - protein, 314 aa, Glycine max
  Coding DNA Sequence Number=SeqID_41878
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q69T67; Match level="QueryCoverage=37%, HitCoverage=13%, E-value=1e-42, Identity=68%"; Hit description =Lustrin A-like
  Subcellular localization annotation: CTP_CleavageSite=32; ConfidenceScore=5.60e-01
MHVLFNVKRVAFSESFLSHRRRLFTWFSLSVSASLVLVSLFLLSNSLRVPKVSVFVPKLDAVGANSSIGPCPLLPFNTSHTFSSESNTFDTSKSNGSESSVQRIEEGSVAMEILHGVNNVSGENIKSVAEGRGLENSSLSSNLLPESNNGKQSKHEGGLDGEKNLKNVTVTHNDEMHVGLYDEKCDIFDGKWVRDGSKPHYPLGSCRLIDRDFNCHRNGRPDAEYVKWRWQPNGCKIPSLNATDFLERLRGQRLVFVGDSLNRNMWESLVCILRQSIKNKKRVFEISGRREFKKKGVYAFRFEASFLVTSMLFM

SEQ ID NO: 158657 - protein, 124 aa, Glycine max
  Coding DNA Sequence Number=SeqID_41879
MGEHISIDENTSSLTRLRYARARIKTLCFESLNKIVKLQMNGLIRDLRIYEEMEGDEQYCCCFKERKKINFSEDESPIFGISEEWGSSNASIDNFEEEYEWLGGGFPFRGEMPEMAIENLFSLV

SEQ ID NO: 158658 - protein, 75 aa, Glycine max
  Coding DNA Sequence Number=SeqID_41880
MASPLPFYIFSQQSCSPRRAGHSPRCYRVQFYLNTYDTPLIEPNGSGFSEQDQEGMFLKTIKSKGHNTGGRDANH

SEQ ID NO: 158659 - protein, 67 aa, Glycine max
  Coding DNA Sequence Number=SeqID_41881
  Subcellular localization annotation: CTP_CleavageSite=37; ConfidenceScore=5.38e-01
MRGYVMVTRTFRQPGANKPVDAQRLTLSPAPFVVLTREVSKSGGRRRYLMVIRAFRQPRGTNSTVSG

SEQ ID NO: 158660 - protein, 74 aa, Glycine max
  Coding DNA Sequence Number=SeqID_41882
MAMVNPRKIYQSPFPRWYNPNATYAYHGGVPGHSIEQCIAFKHKDGLNVRTNPLASHGGSTVNAVEEWEPQGLK

SEQ ID NO: 158661 - protein, 134 aa, Glycine max
  Coding DNA Sequence Number=SeqID_41883
  Subcellular localization annotation: CTP_CleavageSite=25; ConfidenceScore=5.17e-01
MGSKFQQSIQSVSLYSGTQSDIRVRSYRRVNWLRDSTFNFERLVILRDSFRHPSKKLLSFELSQSFNIKYRASQYITGLNQTSEASTFNFERLDILRDSIRHPSKKLLSFELGQRFNIQFRASRYITGLNQTSE

SEQ ID NO: 158662 - protein, 93 aa, Glycine max
  Coding DNA Sequence Number=SeqID_41884
MENWRTALRNNFAGLQTRRVSEKSGEWRIGGQRYAITSRGSRLEGGGHMNSARQLHSWVSQKSKEWRIGEQRYAITSRGSLLQGGGHMKSPRQ

SEQ ID NO: 158663 - protein, 366 aa, Glycine max
  Coding DNA Sequence Number=SeqID_41885
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q6K3D4; Match level="QueryCoverage=89%, HitCoverage=29%, E-value=1e-110, Identity=60%"; Hit description =Putative PKG-Ib
  Pfam annotation: Domain name=PP2C; Domain location=54-348; Score =107.4; E_value=4.2e-29; Accession=PF00481.12; Description=Protein phosphatase 2C
MGCVHGKCCTRYPSPSVGGSRDFRELGPYCAQRKHILTQSSLQFVPVPSHNFTLEYSVLTQRGYYPDSPDKENQDSFGIRTQFQGNPSVHFFGVYDGHGEFGGQCSNFVKDRLVENLSSDIALLEDPVKAYTSAFLTTNDDLHKNEIDDSLSGTTAITVLVIGNTLYVANVGDSRAVLAVKDGNRVVAEDLSSDQTPFRRDEYERVKLCGARVLSVDQVEGHKDPDIQTWGDEENQGDDPPRLWVQNGKLPGAAFTRSVGDKLAETIGVIAVPEVSTVQLTPNHLFFVVASDGVFEFLSSQTVVDMLCFLLDNTVEDFSVLAASYSDPRDACAAIAGESYKLWLEHEGRTDDITIIIVQIKGLSNV

SEQ ID NO: 158664 - protein, 74 aa, Glycine max
  Coding DNA Sequence Number=SeqID_41886
MGCMCCKPSAIEDSKESPRERLSSKSDKSVSDLRVSRGTSSRREEAFWLKDRYDNNDGRAALIDKQGNGSVRVQ

SEQ ID NO: 158665 - protein, 897 aa, Glycine max
  Coding DNA Sequence Number=SeqID_41887
  Gene Ontology: Mol. function=protein kinase activity; Cellular component=nucleus; Biological process=protein amino acid phosphorylation
  Homolog annotation: Hit_ID=Q9LJR3; Match level="QueryCoverage=98%, HitCoverage=99%, E-value=0.0, Identity=59%"; Hit description =Photomorphogenesis repressor protein-like
  Pfam annotation: Domain name=Pkinase; Domain location=32-348; Score= -92.4; E_value=0.0047; Accession=PF00069.15; Description=Protein kinase domain
  Pfam annotation: Domain name=WD40; Domain location=570-608; Score =19.4; E_value=0.013; Accession=PF00400.22; Description=WD domain, G -beta repeat
  Pfam annotation: Domain name=WD40; Domain location=620-658; Score =3.6; E_value=14; Accession=PF00400.22; Description=WD domain, G-beta repeat
  Pfam annotation: Domain name=WD40; Domain location=662-701; Score =43.6; E_value=6.8e-10; Accession=PF00400.22; Description=WD domain, G-beta repeat
  Pfam annotation: Domain name=WD40; Domain location=712-750; Score =13.3; E_value=0.86; Accession=PF00400.22; Description=WD domain, G -beta repeat
  Pfam annotation: Domain name=WD40; Domain location=755-792; Score =33.0; E_value=1.1e-06; Accession=PF00400.22; Description=WD domain, G-beta repeat
  Pfam annotation: Domain name=WD40; Domain location=802-840; Score =10.7; E_value=2.1; Accession=PF00400.22; Description=WD domain, G -beta repeat
  Pfam module annotation: Pfam domain module=Pkinase::WD40::WD40::WD40:: WD40::WD40::WD40; Domain location=32-348::570-608::620-658::662 -701::712-750::755-792::802-840
  Subcellular localization annotation: CTP_CleavageSite=18; ConfidenceScore=5.33e-01
MEPSGSAFQNSGSSRALNSSGVSDRNQRVHCPQRNPFLGEASQDSGFRKERDRFLLAQGGQPKNLGGGFSGLCEDEVEVDPFFCAVEWGDISLRQWLDKPERSVGAFECLHIFRQIVEIVSVAHSQGVVVHNVRPSCFVMSSFNHISFIESASCSDTGSDSLGEGLNNQGGEVKTPTSLCPHDMPQQSMGSEDFMPVKTLTTPAQSDSSCMLSSAVYAARASLIEETEENKMKDRRKDDEVEGKKQSFPMKQILLMEMSWYTSPEEGAGESSSCASDVYRLGVLLFELFCPLSSREEKSRTMSSLRHRVLPPQLLLKWPKEASFCLWLLHPDPSGRPTLGELLQSDFLNEQRDDMEEREAAIELRQRIDDQELLLEFLLLLQQRKQEVAEKLQHTVSFLCSDIEEVTKQHVRFKEITGAELGSDEHSASSFPSMTVVDSEGSAFLGTRKRVRLGMDVKNIEECVDDVGDDQKSNGSFLSKSSRLMKNFKKLESAYFLTRCRPAYSSGKLAVRHPPVTSDGRGSVVMTERSCINDLKSKEQCREGASAWINPFLEGLCKYLSFSKLKVKADLKQGDLLHSSNLVCSLSFDRDGEFFATAGVNKKIKVFECDSIINEDRDIHYPVVEMASRSKLSSICWNTYIKSQIASSNFEGVVQLWDVTRSQVISEMREHERRVWSIDFSSADPTMLASGSDDGSVKLWSINQAIPFLHLGVSVGTIKTKANVCCVQFPLDSARFLAFGSADHRIYYYDLRNLKMPLCTLVGHNKTVSYIKFVDTVNLVSASTDNTLKLWDLSTCASRVIDSPIQSFTGHANVKNFVGLSVSDGYIATGSETNEVFIYHKAFSMPALSFKFQNTDPLSGNEVDDAAQFVSSVCWRGQSSTLLAANSTGNVKILEMV

SEQ ID NO: 158666 - protein, 312 aa, Glycine max
  Coding DNA Sequence Number=SeqID_41888
  Gene Ontology: Mol. function=RNA binding; Cellular component=plasma membrane-derived thylakoid photosystem II; Biological process =aromatic amino acid family biosynthetic process
  Homolog annotation: Hit_ID=Q4C0K5; Match level="QueryCoverage=72%, HitCoverage=92%, E-value=9e-35, Identity=36%"; Hit description=RNA -binding S4
  Pfam annotation: Domain name=S4; Domain location=236-283; Score=26.0; E_value=0.00013; Accession=PF01479.15; Description=S4 domain
MNDDWWYKQLSKWRNLVMSGKTEECQHVVRMLILEKEASYAVEFEKRGVLGDNKAVFMNSFATFELLVHAASGVSQTVQALKGEVDLLLKGVGERSVMKEVKHILEMARRASLKREILHTYFLTPPVLKEYMQVLEKLADVKAIAQGGYPQAECCRISVGHPEELASDPDIISALSPPAEHIHILYLIEEQLQRSAKAVGEQGAQIIVVPELVEFLMSTLVKVRNVPASCTKIPLISLDYEPPSAGFKVSRSKLVDMISNGDVRINWIHVTTKGTTLKSGDIVSVSGKGRLKIGEINSSKKGKFAVELIQYL

SEQ ID NO: 158667 - protein, 53 aa, Glycine max
  Coding DNA Sequence Number=SeqID_41889
MEMRRIALRLPREMKMATMVEREIAEPMHAKTLTLGKGDTREGASGFRVLSDE

SEQ ID NO: 158668 - protein, 88 aa, Glycine max
  Coding DNA Sequence Number=SeqID_41890
  Homolog annotation: Hit_ID=Q9SZ28; Match level="QueryCoverage=73%, HitCoverage=42%, E-value=6e-14, Identity=49%"; Hit description=STIG1 like protein
MGLARTREETFFSAARTIVAMFLVTRTTAGCVATSASKEKDAVMGFVPMCCPMHDTVASATSSAHLEIHVGMGFKAMHETDARKLMKK

SEQ ID NO: 158669 - protein, 687 aa, Glycine max
  Coding DNA Sequence Number=SeqID_41891
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component =mitochondrion; Biological process=protein metabolic process
  Homolog annotation: Hit_ID=Q2QXL4; Match level="QueryCoverage=91%, HitCoverage=88%, E-value=1e-146, Identity=44%"; Hit description=Rf1 protein, mitochondrial, putative, expressed
  Pfam annotation: Domain name=PPR; Domain location=132-166; Score =21.1; E_value=0.0041; Accession=PF01535.11; Description=PPR repeat
  Pfam annotation: Domain name=PPR; Domain location=203-237; Score =54.2; E_value=4.3e-13; Accession=PF01535.11; Description=PPR repeat
  Pfam annotation: Domain name=PPR; Domain location=238-272; Score =41.3; E_value=3.2e-09; Accession=PF01535.11; Description=PPR repeat
  Pfam annotation: Domain name=PPR; Domain location=273-307; Score =36.6; E_value=8.3e-08; Accession=PF01535.11; Description=PPR repeat
  Pfam annotation: Domain name=PPR; Domain location=308-342; Score =43.3; E_value=8.2e-10; Accession=PF01535.11; Description=PPR repeat
  Pfam annotation: Domain name=PPR; Domain location=343-377; Score =35.5; E_value=1.8e-07; Accession=PF01535.11; Description=PPR repeat
  Pfam annotation: Domain name=PPR; Domain location=378-412; Score =50.0; E_value=7.8e-12; Accession=PF01535.11; Description=PPR repeat
  Pfam annotation: Domain name=PPR; Domain location=413-447; Score =46.4; E_value=9.8e-11; Accession=PF01535.11; Description=PPR repeat
  Pfam annotation: Domain name=PPR; Domain location=448-482; Score =21.8; E_value=0.0024; Accession=PF01535.11; Description=PPR repeat
  Pfam annotation: Domain name=PPR; Domain location=483-517; Score =39.5; E_value=1.2e-08; Accession=PF01535.11; Description=PPR repeat
  Pfam annotation: Domain name=PPR; Domain location=518-552; Score =41.9; E_value=2.1e-09; Accession=PF01535.11; Description=PPR repeat
  Pfam annotation: Domain name=PPR; Domain location=553-587; Score =40.7; E_value=5e-09; Accession=PF01535.11; Description=PPR repeat
  Pfam annotation: Domain name=PPR; Domain location=588-622; Score =49.3; E_value=1.3e-11; Accession=PF01535.11; Description=PPR repeat
  Pfam annotation: Domain name=PPR; Domain location=623-657; Score =39.5; E_value=1.1e-08; Accession=PF01535.11; Description=PPR repeat
  Pfam annotation: Domain name=PPR; Domain location=82-116; Score=8.8; E_value=0.68; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=132 -166::203-237::238-272::273-307::308-342::343-377::378-412::413 -447::448-482::...
  Pfam module annotation: Domain location=483-517::518-552::553 -587::588-622::623-657::82-116
  Subcellular localization annotation: CTP_CleavageSite=69; ConfidenceScore=5.61e-01
MTLSVRASSKPFLTLNEARFLFPFSFFSFSTLQYNNKFLFHAAVAEPKLLVRVLNTVRNRPVVALRFFRWAERQTGFKRSEISYSVILDILARNGLMRSAYCVMEKVVSVKMENGVIDVVSSSEVSMPSVKLILDLLLWIYVKKSLLEKCLLVFYKMVSKGLLPDVKNCNRVLRLLRDRDNNIDVAREVYNVMVECGICPTVVTYNTMLDSFCKKGMVQEALQLLFQMQAMGCSPNDVTYNVLVNGLSHSGEMEQAKELIQDMLRLGLEVSVYTYDPLIRGYCEKGQIEEASRLGEEMLSRGAVPTVVTYNTIMYGLCKWGRVSDARKLLDVMVNKNLMPDLVSYNTLIYGYTRLGNIGEAFLLFAELRYRSLAPSVVTYNTLIDGLCRLGDLDVAMRLKDEMIKHGPDPDVFTFTTFVRGFCKMGNLPMAKELFDEMLNRGLQPDRFAYITRIVGELKLGDPSKAFGMQEEMLARGFPPDLITYNVFIDGLHKLGNLKEASELVKKMLYNGLVPDHVTYTSIIHAHLMAGHLRKARALFLEMLSKGIFPSVVTYTVLIHSYAVRGRLKLAILHFFEMHEKGVHPNVITYNALINGLCKVRKMDQAYNFFAEMQAKGISPNKYTYTILINENCNLGHWQEALRLYKDMLDREIQPDSCTHRSLLKHLNKDYKLHVVRHLENVIAAGE

SEQ ID NO: 158670 - protein, 1499 aa, Glycine max
  Coding DNA Sequence Number=SeqID_41892
  Gene Ontology: Mol. function=RNA-directed DNA polymerase activity; Cellular component=chromatin; Biological process=chromatin assembly or disassembly
  Pfam annotation: Domain name=Chromo; Domain location=1399-1453; Score= 51.6; E_value=2.6e-12; Accession=PF00385.14; Description='chromo' (CHRromatin Organisation MOdifier
  Pfam annotation: Domain name=RVP_2; Domain location=309-441; Score= -24.8; E_value=8.6e-05; Accession=PF08284.2; Description=Retroviral aspartyl protease
  Pfam annotation: Domain name=RnaseH; Domain location=842-963; Score= -26.8; E_value=0.018; Accession=PF00075.14; Description=RNase H
  Pfam annotation: Domain name=rve; Domain location=1097-1253; Score =127.2; E_value=4.6e-35; Accession=PF00665.16; Description=Integrase core domain
  Pfam annotation: Domain name=zf-H2C2; Domain location=1038-1079; Score=5.3; E_value=0.072; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1399 -1453::309-441::583-752::119-209::842-963::1097-1253::1038-1079
MEARVNALEGEISVVRSSLVSFQEEVKENHANLIAMLEKHFGKSLDDEGTGSAVSKNKETPEKKTETPKGSHADKMNEFHQSAKKVELPSFEGEDPAGWISRAEVYFRVQNTTPEVKVSLAQLCMDGPTIHFFNSLIGEDEDLTWESLKIALLERYGGHGDGDVYEQLTELKQEGSVEDYITEFEYLIAQIPRLPEKQFQGYFLHGLQSEIRGRVRTLATMGEMSRTKLLQVTRAVEKEVKGGNGSGFGRGPKNGPYRSNSHGGNKGVSDWVMVKNKEGGDGEAKVLAVEVEGGEEDEQGEMSMLDLHHIAHENHQTMKFQGIIKGVEVLILVDSGASHNFISQKLVHHMDWPIEQTQQMKVKLGNGVQIEAQGRCKELEMYIGSHKLRPNLQLFELGGIDVVLGMEWLKTLGDTIINWKQHTLSFWEEGRWVTLSNKEGCKNPMIALQSIVGKPRPKKEGDVWRIEGVEPKVVCESIRTESPHRVLEVVLGEYANVFQTTCESVLSENQHRELEEVLGEYAHVFQTPSSLPPRRKKEHAINLIDGHGAVNVRPYRYPHHHKNEIERQVQEMLAAGIIRHSTSSFSSPVILVKKKDNTWRMCIDYRALNKVTIPDKFPILVIEELLDELHGAKFFTKLDLKSGYHQVRVKDSDIEKTAFRTHEGHYEFLVMPFGLTNAPSTFQNLMNDVFRPLLRKSVLVFFDDILIYSQDWDSHLRHVREVLGLLSTHSLVVNKKKCSFAQQTVEYLGHVISENGVAVDPSKVISVLQWPQPRNVKEGVRGFLGLTGYYRKFIKDYGKVAKPLTELTKKDGFKWDEKTQAAFDTLKQKLTTAPVLALPDFSTNFVIECDASGTGLGAILMQQKRPVAYFSKALGVRNLAKSAYEKELMAVVLAIQHWRPYLLGRKFVVSTDQRSLKQLMQQKIMTAEQQNWAAKLMGYDFDIVYKQGKLNKGADALSRVYEDSELSAMSSIATWIQGEQIKAEVQRDGKLQKIIAEIQLDPLSWPGYSYRQGTLLYEGRLVISNKSLLIPTLLQEFHSTPQGGHSGFYKTYRRMAANLYWIGMKGMIQEFVLQCDTCQRQKYMASSPGGLLHPLPIPEQIWEDISLDFITGLPKSKQFEAILVVVDRLSKYAHFIPLKHPYTARSIAEIFCKEIVRLHGIPLSIVSDRDPIFVSNFWREMFKLQGTKLKMSTSYHPETDGQTEVVNRCLETYLRCFISDQPRTWVTWIHWAEYWYNTTYHSSTDKTPFEVVYGRPPPLLTSWTQGETRVASVQKDLMDRDEALRQLKTQLLKAQERMKSQADKKRVDRSFMCGEWVFVKLRAHRQQSVVTRINAKLAAKYYGPYPIVERVGGVAYKLKLPEGSRVHPVFHVSLLKKAVGNYQEDKELPDLLEDPVEACEPEAVLASRKIKQQGEEVRQFLIHWKGKTMEEATWEEELMMRSQFPNFDLEDKVNSEEGSIDRVQENEGYPHQQLIHSTQNGVRPFLVYTRRKGRKVFGG

SEQ ID NO: 158671 - protein, 121 aa, Glycine max
  Coding DNA Sequence Number=SeqID_41893
  Homolog annotation: Hit_ID=Q0KIN0; Match level="QueryCoverage=62%, HitCoverage=4%, E-value=1e-10, Identity=44%"; Hit description =Integrase core domain containing protein
MDMQTYLGKLDHLLADYNNLRPFTSDAETFYLQCNQYFMVLALAGLPHDLDSVGNQILSAPSVPTYDMVSEQLLRLSTLHVFGQSEAFLNWEHQLSENRNRETILGVVISRFSYLVGFVLL

SEQ ID NO: 158672 - protein, 89 aa, Glycine max
  Coding DNA Sequence Number=SeqID_41894
MMQITRIEEEMLNIILAKDQTYDEVSRLFAVRWKDQLDRHWHLVDKHDNMHDVVCNKDLVSPTIVHGWTTLRTFYGLRGDHHVTLTYYG

SEQ ID NO: 158673 - protein, 121 aa, Glycine max
  Coding DNA Sequence Number=SeqID_41895
DRDGQWLKKDAQPLQDERTPSPPPQRDDSSALMNEVLSELRGLRTYVGKRFDSSDGRFEGMDTRITQLKEDELNCHHQKGGDCRSKDFDFDVLIMPCDHALLKFNSRQKSKKFKIHHQEDL

SEQ ID NO: 158674 - protein, 81 aa, Glycine max
  Coding DNA Sequence Number=SeqID_41896
MEVVHWVGCRNSKKQMHNKIGHSISGWSSATMFRGIDVIFRVKAEANNSSFRVRIDVISLLQMGVKTRCDMQQVLFKGYLP

SEQ ID NO: 158675 - protein, 160 aa, Glycine max
  Coding DNA Sequence Number=SeqID_41897
  Homolog annotation: Hit_ID=Q1SXA8; Match level="QueryCoverage=55%, HitCoverage=6%, E-value=2e-07, Identity=34%"; Hit description=Zinc finger, CCHC-type; Polynucleotidyl transferase, Ribonuclease H fold
MEEGYATNKPPLFKVAKYDCWKKEYTKVHNFRSAKQMSDTLSITYEGSSQTIVTTLRALKNIDTTSLGELVGTLKVHEQELQEDKGIKKGKSLAPSTLKEKPLSKGASKEPSAENFSKEKYDKDDELAFISRKIRKMWKNKSGSRWKNSSKKIFKEKKAS

SEQ ID NO: 158676 - protein, 103 aa, Glycine max
  Coding DNA Sequence Number=SeqID_41898
MDNYLKGIINRSVLFFNTIALALVSALKGLDDTQQSKSKSPARWIVVKCNRQKGSTECGYYVLHWMSTIILGNFQNNWEMTIGTRKIEGASQPVSKVLFESEK

SEQ ID NO: 158677 - protein, 311 aa, Glycine max
  Coding DNA Sequence Number=SeqID_41899
  Gene Ontology: Mol. function=phosphoglycolate phosphatase activity; Biological process=methionine biosynthetic process
  Homolog annotation: Hit_ID=Q2R483; Match level="QueryCoverage=99%, HitCoverage=65%, E-value=1e-113, Identity=60%"; Hit description =Haloacid dehalogenase-like hydrolase family protein, putative, expressed
  Pfam annotation: Domain name=Aldolase_II; Domain location=1-136; Score=-9.5; E_value=7.6e-05; Accession=PF00596.11; Description=Class II Aldolase and Adducin N-terminal domain
MEPEDMYVLSHSGSVLSAPSPKPWPHKPPKCSDCDPLFKKITHMEMIKGIKGHGYYDELVVPIIENTAYEYQLTESFAKAIEDYPKATAVLVRNHGVFVWGDSWISAKTQSECYHYLFDAALKLHQMGLDWSTPNHGPIQSARRGLSIAGESNVSVKARKSNGDSDPLPRCVVLDIEGTTTPISFVSEVLFPYARDNVGRHLSLTYDTPETKADIKLLRSQVQSDLEQGIAGAVPIPPDDAGKQEVIAALVANVDAMIKADRKITALKELQGHIWKTGYENNELEGIVYDDVPEALEKWHALGIKVVFAGS

SEQ ID NO: 158678 - protein, 273 aa, Glycine max
  Coding DNA Sequence Number=SeqID_41900
  Homolog annotation: Hit_ID=Q9FN40; Match level="QueryCoverage=96%, HitCoverage=56%, E-value=1e-41, Identity=35%"; Hit description =Arabidopsis thaliana genomic DNA, chromosome 5, TAC clone:K19P17
MTSSRERLVKAVKQFVEVRYKVFGDRYGQNIIDILDFPIKVVLSPFTLAFDIAGSAPRGFGVPELISKLSATSVFEMEIIKMSFSPFTIPPSMAVRLFQLNQCSRNRIRVLGMPAYTLRESFVAYSGLTVRARAGISHAIAALGTYDIAFELGRKKATAESVADAIANNRAELVHIPSSLDFQKPLPSKECPTCDGTGVMSCPECKHRLLHVRISADDVSIVDSMIMEPPWQACNVLKKIDYPYEIMGGFTYDDDVKQKIWWQYKVVTSYSFL

SEQ ID NO: 158679 - protein, 111 aa, Glycine max
  Coding DNA Sequence Number=SeqID_41901
MCPWCGLQTETTTHTLLMCDEVRRLWFASQSMNHMVFKQKKMIVEQIMQQAHCLILLPVEDNQSVTRRNERWQKPLPSQIKANFDAAVRKGVATLAAATKFLPNTYIKRRV

SEQ ID NO: 158680 - protein, 445 aa, Glycine max
  Coding DNA Sequence Number=SeqID_41902
MGPALVTIDLDDYDDVREIPKPKGPNSEDYRLERRWKRFEHSSSNKRLKQNHSDSGTRTVKSHGKVASLTVKEGHMSHMSEDEVDEDYKFFLLTYDPHIDVVCDGGVDGSDDDINIGHNSDHNDHLYREEESLNNNPKLDKGSKQRGETENERNKRSGSVGKQTSGSMKAKKNLEAKKGLSKKMPREDVSGVPKNNGQTNMESVVADEDYQIFLNSCRDDYIPSELIGKRSSVMQNSQVLDYAPSEVDEDYLQYLNSVLIVDGEVEFMSERNTSKTDNVDGDTDSNSSEPDVILLEPDQIHENTPFVSSRTFDSSWFETEKNPKGNWQLSACDNSQFRRRLMNDLQRPYDQEEYDRLLCEVRQKKQKERHRETRHGVVKSYPTRGFHKSYLDLYPDLAKAIAEFKKPERVLFLVRGFVFWLQNVTHEGIFRPWLDKHCLDILRRM

SEQ ID NO: 158681 - protein, 596 aa, Glycine max
  Coding DNA Sequence Number=SeqID_41903
  Homolog annotation: Hit_ID=Q2HRX8; Match level="QueryCoverage=86%, HitCoverage=41%, E-value=2e-29, Identity=33%"; Hit description=IMP dehydrogenase/GMP reductase
  Pfam annotation: Domain name=DUF1723; Domain location=160-209; Score =53.1; E_value=9.6e-13; Accession=PF08330.1; Description=Protein of unknown function (DUF1723)
  Pfam annotation: Domain name=DUF1723; Domain location=538-587; Score =54.5; E_value=3.5e-13; Accession=PF08330.1; Description=Protein of unknown function (DUF1723)
  Pfam module annotation: Pfam domain module=DUF1723::DUF1723; Domain location=160-209::538-587
MSDGFCGTHLQIMVTGRGVGRGDRDDSDDAPQRRRTIAPARRQRVVVTADHVDEPVIPAPDVQDDPMEAPATVDDIPADTGTEAAEDENEGFPGGSSDPSVLTLYADHIACSVWRGEERPELKLSSHGRKVHSLGRPVPTIEGLIAGTGLSPLITCSVDTGNRGLLSAFVERWHRETSSFHLLVGELTITLDDVSSLLHLPVIGDLHAFQCLHVDDAVQMLVDLLMVSTKSARAETTQCRGPYVHLQWVRDIYERRCQTGHWTTAACAYLLHLLGCTLFANKSAINVHVVYLEAPHDLSMTERYAWGVAALVDMYDQLNDASMSHSRQLGGYITLLAGFMSTFPRSRSPPLIRTTTRLPCECAGHDTGRGVGRGDRDDSNDAPQRRRPTASARRQRVLVTVVDDEPVVLATKADGASVEADVYADEPMAGGDVQDTGADTLADTGAHAAEDELEGFPGGPRDPSVLTEYADHVAGNIWTGDMMLTNCVFLYTSIQERPELKLFSHGRKVHSLGRPVLAIEGLVAGTELSPLIACLIDTGDRGLLSSFVERWHRETCSFHLPVGEVTITLDDVMSLLHLSVVGDLHAFQPVHVDDAV

SEQ ID NO: 158682 - protein, 161 aa, Glycine max
  Coding DNA Sequence Number=SeqID_41904
LTKEQLLTQVRLNWVTELSLPFAPFLVGGDTCFLSLKDGSPTSIVLSCPPRALEESRATLFVLLRRRCGAERQKGSQKGGHTGAKKAKITSSTKETQVKGPEQARDSDEAQTQRAQANKQRAIAALPRGNLSLSFLLPGVIVLMERIENEVRGYQTQEARA

SEQ ID NO: 158683 - protein, 337 aa, Glycine max
  Coding DNA Sequence Number=SeqID_41905
TSSREESTKGKARLHVVKRDASLGEETKGKSRLHVVRRDASSGEESTNDKARLHVIRRDASSREKINDKARLHVIKRDASFGEKSTKDKARLHVVRRDVPSREESTKDKTRLHVVRRNTSSRKETNDKAHLHVVRRDGSSEEETKGKTHLHVVRRDISSGKETNDKARLHIVRRDSSCGEKTKTKGETYIEGNAYGQSQQAVEHGEVDPENGGSSRHCYGKCTAGCANPFPNYDPNLGDLCARRSCWTVGDLVIDLCDGLRIWCSREGLQEVEGMKIEGAKFGEGCEDAWKFLWLLAKKGGSSIHNHKEEVDVKDALWKIECAVDIYSLNEFYEFRV

SEQ ID NO: 158684 - protein, 56 aa, Glycine max
  Coding DNA Sequence Number=SeqID_41906
  Gene Ontology: Mol. function=electron carrier activity; Cellular component=membrane; Biological process=electron transport
  Homolog annotation: Hit_ID=Q5JNJ5; Match level="QueryCoverage=63%, HitCoverage=15%, E-value=9e-09, Identity=63%"; Hit description =Phytocyanin protein, PUP2-like
MELEIRVCLLLFLFGILSGSQAYTFYVGGKDGWVLYPSENYNHWAERMRFQVSDTL

SEQ ID NO: 158685 - protein, 172 aa, Glycine max
  Coding DNA Sequence Number=SeqID_41907
  Gene Ontology: Mol. function=drug transporter activity; Cellular component=membrane; Biological process=multidrug transport
  Homolog annotation: Hit_ID=Q6Z493; Match level="QueryCoverage=55%, HitCoverage=21%, E-value=6e-17, Identity=45%"; Hit description =Putative MATE efflux protein family protein
MLKSRSLDGTVTHFTPLLDVSHHKENTRQYRWWNSKILDLEEAKHQLLFSLPMFLTNLFYYLIVLVSVIFAGHLGDLQLAGATLANSWFSVTGLAVMLAGATLANSWFSVTGLAVMSQSLYCYINLKTLQEQLPFTPKRFRQTWTGFSFESFNYIFTDLKLALLSAAMVWKH

SEQ ID NO: 158686 - protein, 80 aa, Glycine max
  Coding DNA Sequence Number=SeqID_41908
MASNNKVASILFVAMMLINSSYAARVHVVRRDASSKEETKDKVHLHVRRDTSLGEETKNKTRLHVLRRDTSSGEESTGIL

SEQ ID NO: 158687 - protein, 502 aa, Glycine max
  Coding DNA Sequence Number=SeqID_41909
  Gene Ontology: Mol. function=drug transporter activity; Cellular component=membrane; Biological process=multidrug transport
  Homolog annotation: Hit_ID=Q8H3W4; Match level="QueryCoverage=88%, HitCoverage=86%, E-value=1e-104, Identity=42%"; Hit description =Putative ripening regulated protein DDTFR18
  Pfam annotation: Domain name=MatE; Domain location=297-449; Score =92.6; E_value=1.2e-24; Accession=PF01554.9; Description=MatE
  Pfam annotation: Domain name=MatE; Domain location=94-254; Score =113.8; E_value=5e-31; Accession=PF01554.9; Description=MatE
  Pfam annotation: Domain name=TatC; Domain location=269-445; Score= -85.8; E_value=0.093; Accession=PF00902.8; Description=Sec -independent protein translocase protein (TatC)
  Pfam module annotation: Pfam domain module=MatE::MatE::TatC; Domain location=297-449::94-254::269-445
MATKAVPRIIFWRSAIIQVLPHQIYADNVEQMKEEIEKMVASNSSDDSIGTPLVIRGSDNNGRDQNTRLHQVEGWWNKVLDMEEAKCQLLFSLPMILTNTFYYLITSISVMLVGHLGELQLAGSTLANSWFNVTGSAVMVGLSGALETLCGQGFGAKEYQMLGIYLQASCIISLIFSIIISIIWFYTEPILVLLHQSHDIARTTALYMKFLIPGLFAYSFLQNILRFLQTQSVVMPLVALSALPLLIHIGIAYGLVQWPGLSFTGAPVATSISQWISMLLLALYVMYAKKFKQTWQGFSMHSFHYVFTNMKLALPSAAMVCLNTQFIAYMVPVGLGAAGSTRVSNELGAGNPEQAKHAMNVTVKLSFLFSFCFALALGFGHNIWIQLFSGSAKIKEEFASMIPLLAISIVLDAVQGVMQGVARGCGWQHSTVYINLATFYLVGLPISCLLGFKTNLHYKGLWIGLICGLLCQVVTLFLFLRLAKWTKLDLSGDKDKDHPLVV

SEQ ID NO: 158688 - protein, 55 aa, Glycine max
  Coding DNA Sequence Number=SeqID_41910
MLEEKEQKVVEGRAVEGRKKKLAACNARYRSGARRSSLQLQLRKSTAIDYSSLFC

SEQ ID NO: 158689 - protein, 97 aa, Glycine max
  Coding DNA Sequence Number=SeqID_41911
  Homolog annotation: Hit_ID=Q9FGQ4; Match level="QueryCoverage=54%, HitCoverage=30%, E-value=2e-08, Identity=56%"; Hit description =Arabidopsis thaliana genomic DNA, chromosome 3, TAC clone:K5K13
MKAVAGLTHHNNAKPVADSSFSKAKPEHSLDSQFKLPKASQLLCHNLEGNVGALTNFEVLDFLLTKGTSKDPTRVIAKVAQSEYKVRFDFSNKWEYL

SEQ ID NO: 158690 - protein, 321 aa, Glycine max
  Coding DNA Sequence Number=SeqID_41912
  Gene Ontology: Mol. function=DNA binding
  Homolog annotation: Hit_ID=Q1SYZ1; Match level="QueryCoverage=99%, HitCoverage=98%, E-value=6e-29, Identity=71%"; Hit description=Myb, DNA-binding; Calcium-binding EF-hand
MIGTGRANPPLQILRAPPFRNPRQAQNAREEVQAGGGARERAAPPPRPSLVPLQVVVARRLDKGAEHAPPDGNNHWENFLKYKEVLGDVQLLESPKPITTAKLGFDVDSDDDDEGEEEEEEEEEKDDDGGDEEEDVLKVRRLGSVVELREAVVKREERQREREFRRKKVEAERERKRREAEFRRERRREWLEDREMELEERQLRWVRRELEKRLRLERELDVERRWRKRVEEKMEEEEMEWRQRMVAMQVEHEKQMMQMHVEASQNQMQVLGIMARFLCQFFGSGTDGLNNGLGTLPPQVLHHGGGLGNVKPDANSPSRFI

SEQ ID NO: 158691 - protein, 50 aa, Glycine max
  Coding DNA Sequence Number=SeqID_41913
MCILEEERLVMEMGESVLLETACGKNKDTKSQANQKGTGYAKPKETSKSE

SEQ ID NO: 158692 - protein, 232 aa, Glycine max
  Coding DNA Sequence Number=SeqID_41914
  Homolog annotation: Hit_ID=UPI00005FA708; Match level="QueryCoverage =47%, HitCoverage=40%, E-value=8e-35, Identity=75%"; Hit description =COG1509: Lysine 2,3-aminomutase
  Subcellular localization annotation: CTP_CleavageSite=58; ConfidenceScore=5.11e-01
TSNQLSAAGERVTFVDQQPGSQCQLLGNVTGSQSNWLTGSGGEGSSLRGAANDLRNRAAEMGGNVIYGATSPTQNLLSAFAPLDSKMSGQYSSSTVAINGDTTVMAPTVGCAFMRTGQLAGNVTPDAAADPAAFCSAHHQFPAPASAPYSPTPWSAAAAPAPDAGIKQRIAELCQSLRIVINAAQQHALVQQGDAGAFKPLHAFAQRLVNLLRVVDVADQQHLQTRIRQQLA

SEQ ID NO: 158693 - protein, 82 aa, Glycine max
  Coding DNA Sequence Number=SeqID_41915
MERWRRVTFLAKLISMKYKGKGNIKEDIMEMFNLASKLMSLKPDWCLRVLLCGGDNNDDDGVSSNDGRDTSGGLWAMKKSFQ

SEQ ID NO: 158694 - protein, 149 aa, Glycine max
  Coding DNA Sequence Number=SeqID_41916
MVASIVKTTKLNQLPSITNLGASGGIELIRWGYVENAVIIITSSIPCIRPLVMSSVKKFSSHSFSRSYELRSPFTGNRRTGENDTAQSRRKLATTNNDVETCSIERILNPYSHNTVIGSHQTSSNRSDRGITKQVEMSVYSSDDPARSV

SEQ ID NO: 158695 - protein, 77 aa, Glycine max
  Coding DNA Sequence Number=SeqID_41917
MAKLTHKETSNVTNNPIFNMASLAQPPHTLSLPLKLALLINMHYILKPKQGKAKVKEVKETKVEEKKVEEKIEEKKD

SEQ ID NO: 158696 - protein, 330 aa, Glycine max
  Coding DNA Sequence Number=SeqID_41918
  Gene Ontology: Mol. function=protein binding; Cellular component =signal recognition particle, endoplasmic reticulum targeting; Biological process=SRP-dependent cotranslational protein targeting to membrane
  Homolog annotation: Hit_ID=Q1SYZ9; Match level="QueryCoverage=92%, HitCoverage=72%, E-value=1e-126, Identity=75%"; Hit description=AAR2
  Pfam annotation: Domain name=AAR2; Domain location=1-309; Score =342.0; E_value=1e-99; Accession=PF05282.2; Description=AAR2 protein
MDPETALELVKHGVTLLLLDVPQYTLVAVDTQMFSVGPAFKGIKMIPPGVHFVYYSSSSRDGKEFSSIIGFFIDAGPSEVIVRKWDQQEERLIKLSEEEEERYSQAVKNLEFDRQLGPYNLSHYEDWKQLSNFITKSVIERLEPIGGEITVECENEIVRNATKMPMEDALGKQLKVGNSATSVGKSQRKGCYYTSIPHVVKCKGISGQELTSLNLDKTQLLETLLAKDYGGSEDLLLGELQFAFVAFLMGQSLEAFLQWKSLVSLLFGCTEAGLGYVAYGYKTLIDYAKISSVGLPFRTRTHLFTKLQSSGISTWNVVNFIPDCCSSSDF

SEQ ID NO: 158697 - protein, 33 aa, Glycine max
  Coding DNA Sequence Number=SeqID_41919
MSISLELDVIFDHKCDAQSNTLRMADFKGRMHI

SEQ ID NO: 158698 - protein, 358 aa, Glycine max
  Coding DNA Sequence Number=SeqID_41920
  Gene Ontology: Mol. function=protein serine/threonine kinase activity; Cellular component=chloroplast; Biological process=protein amino acid phosphorylation
  Homolog annotation: Hit_ID=Q10BD9; Match level="QueryCoverage=87%, HitCoverage=79%, E-value=1e-127, Identity=66%"; Hit description =Protein kinase APK1B, chloroplast, putative, expressed
  Pfam annotation: Domain name=Pkinase; Domain location=53-312; Score =77.0; E_value=6.1e-20; Accession=PF00069.15; Description=Protein kinase domain
  Pfam annotation: Domain name=Pkinase_Tyr; Domain location=53-312; Score=80.0; E_value=7.6e-21; Accession=PF07714.7; Description =Protein tyrosine kinase
  Pfam module annotation: Pfam domain module=Pkinase::Pkinase_Tyr; Domain location=53-312::53-312
LSSKDGNKEEDGLSSKVSTPSDPPTPRTEGEILKSSNMKSFNFSELKTATRNFRPDSVVGEGGFGCVFKGWIDEQTLAPVRPGTGMVIAVKRLNQEGLQGHSEWLLRHPNLVKLIGYCLEDDQRLLVYEFLTKGSLDNHLFRRASYFQPLSWNFRMKVALDAAKGLAYLHSDEAKNYNAKLSDFGLAKDGPAGDKSHVSTRVMGTYGYAAPEYMATGHLTKKSDVYSFGVVLLEIMSGKRALDSNRPSGEHNLIEWAKPYLSNKRRIFQVMDARIEGQYTLRESMKVANLAIQCLSVEPRFRPKMDEVVRALEELQDSEDRAGGVGSSRDQTARRSGHSSSSSGPRQHRGRQHETTRK

SEQ ID NO: 158699 - protein, 1058 aa, Glycine max
  Coding DNA Sequence Number=SeqID_41921
  Gene Ontology: Mol. function=protein serine/threonine kinase activity; Cellular component=integral to membrane; Biological process=protein amino acid phosphorylation
  Homolog annotation: Hit_ID=Q9FN37; Match level="QueryCoverage=96%, HitCoverage=97%, E-value=0.0, Identity=59%"; Hit description =Putative receptor protein kinase
  Pfam annotation: Domain name=LRRNT_2; Domain location=39-77; Score =22.2; E_value=0.0019; Accession=PF08263.3; Description=Leucine rich repeat N-terminal domain
  Pfam annotation: Domain name=LRR_1; Domain location=114-136; Score =14.5; E_value=0.39; Accession=PF00560.23; Description=Leucine Rich Repeat
  Pfam annotation: Domain name=LRR_1; Domain location=138-160; Score =14.2; E_value=0.48; Accession=PF00560.23; Description=Leucine Rich Repeat
  Pfam annotation: Domain name=LRR_1; Domain location=162-183; Score =10.9; E_value=2.6; Accession=PF00560.23; Description=Leucine Rich Repeat
  Pfam annotation: Domain name=LRR_1; Domain location=185-208; Score =5.9; E_value=22; Accession=PF00560.23; Description=Leucine Rich Repeat
  Pfam annotation: Domain name=LRR_1; Domain location=210-231; Score =6.1; E_value=20; Accession=PF00560.23; Description=Leucine Rich Repeat
  Pfam annotation: Domain name=LRR_1; Domain location=233-255; Score =13.1; E_value=1; Accession=PF00560.23; Description=Leucine Rich Repeat
  Pfam annotation: Domain name=LRR_1; Domain location=257-279; Score =8.2; E_value=8.4; Accession=PF00560.23; Description=Leucine Rich Repeat
  Pfam annotation: Domain name=LRR_1; Domain location=281-303; Score =16.6; E_value=0.087; Accession=PF00560.23; Description=Leucine Rich Repeat
  Pfam annotation: Domain name=LRR_1; Domain location=305-327; Score =6.6; E_value=17; Accession=PF00560.23; Description=Leucine Rich Repeat
  Pfam annotation: Domain name=LRR_1; Domain location=329-351; Score =16.6; E_value=0.088; Accession=PF00560.23; Description=Leucine Rich Repeat
  Pfam annotation: Domain name=LRR_1; Domain location=353-375; Score =13.3; E_value=0.89; Accession=PF00560.23; Description=Leucine Rich Repeat
  Pfam annotation: Domain name=LRR_1; Domain location=377-399; Score =12.6; E_value=1.2; Accession=PF00560.23; Description=Leucine Rich Repeat
  Pfam annotation: Domain name=LRR_1; Domain location=401-422; Score =5.3; E_value=29; Accession=PF00560.23; Description=Leucine Rich Repeat
  Pfam annotation: Domain name=LRR_1; Domain location=452-474; Score =6.9; E_value=15; Accession=PF00560.23; Description=Leucine Rich Repeat
  Pfam annotation: Domain name=LRR_1; Domain location=476-498; Score =14.2; E_value=0.47; Accession=PF00560.23; Description=Leucine Rich Repeat
  Pfam annotation: Domain name=LRR_1; Domain location=500-522; Score =16.9; E_value=0.071; Accession=PF00560.23; Description=Leucine Rich Repeat
  Pfam annotation: Domain name=LRR_1; Domain location=586-608; Score =13.2; E_value=0.93; Accession=PF00560.23; Description=Leucine Rich Repeat
  Pfam annotation: Domain name=LRR_1; Domain location=610-632; Score =23.4; E_value=0.00082; Accession=PF00560.23; Description=Leucine Rich Repeat
  Pfam annotation: Domain name=LRR_1; Domain location=634-656; Score =5.5; E_value=26; Accession=PF00560.23; Description=Leucine Rich Repeat
  Pfam annotation: Domain name=LRR_1; Domain location=90-112; Score =2.8; E_value=87; Accession=PF00560.23; Description=Leucine Rich Repeat
  Pfam annotation: Domain name=Pkinase; Domain location=777-1048; Score= 157.0; E_value=4.9e-44; Accession=PF00069.15; Description=Protein kinase domain
  Pfam annotation: Domain name=Pkinase_Tyr; Domain location=777-1048; Score=113.0; E_value=8.8e-31; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=39-77::114- 136::138-160::162-183::185-208::210-231::233-255::257-279::281 -303::305-327::329-351::353-375::377-399::401-422::452-474::476 -498::500-522::586-608::...
  Pfam module annotation: =610-632::634-656::90-112::777-1048::777-1048
MVLFRCFSVTLLQSCFLACLLCLSLGLNNNNNNQALSCDPHDLSALKEFAGNLTSGSIITAWPNDTFCCNWLGVVCANVTGDAGGTVASRVTKLILPKMSLNGTISPSLAQLDQLNVLNLSFNHLKGALPVEFSKLKQLKFLDVSHNMLSGPVAGALSGLQSIEVLNISSNLLTGALFPFGEFPHLLALNVSNNSFTGGFSSQICSASKDLHTLDLSVNHFDGGLEGLDNCTSLQRLHLDSNAFTGHLPDSLYSMSALEELTVCANNLSGQLSEQLSKLSNLKTLVVSGNRFSGEFPNVFGNLLQLEELEAHANSFFGPLPSTLALCSKLRVLNLRNNSLSGQIGLNFTGLSNLQTLDLATNHFFGPLPTSLSNCRKLKVLSLARNGLNGSVPESYANLTSLLFVSFSNNSIQNLSVAVSVLQQCKNLTTLVLTKNFRGEVISESVTVEFESLMILALGNCGLKGHIPSWLSNCRKLAVLDLSWNHLNGSVPSWIGQMDSLFYLDFSNNSLTGEIPKGLAELKGLMCANCNRENLAAFAFIPLFVKRNTSVSGLQYNQASSFPPSILLSNNILSGNIWPEIGQLKALHVLDLSRNNIAGTIPSTISEMENLESLDLSYNDLSGEIPPSFNNLTFLSKFSVAHNRLEGPIPTGGQFLSFPSSSFEGNLGLCREIDSPCKIVNNTSPNNSSGSSKKRGRSNVLGITISIGIGLALLLAIILLKMSKRDDDKPMDNFDEELNGRPRRLSEALASSKLVLFQNSDCKDLTVADLLKSTNNFNQANIIGCGGFGLVYKAYLPNGAKAAVKRLSGDCGQMEREFQAEVEALSRAQHKNLVSLKGYCRHGNDRLLIYSYLENGSLDYWLHECVDENSALKWDSRLKVAQGAARGLAYLHKGCEPFIVHRDVKSSNILLDDNFEAHLADFGLSRLLQPYDTHVTTDLVGTLGYIPPEYSQTLTATFRGDVYSFGVVLLELLTGRRPVEVIKGKNCRNLVSWVYQMKSENKEQEILDPVIWHKDHEKQLLEVLAIACKCLNQDPRQRPSIEIVVSWLDSVRFDGSQQ

SEQ ID NO: 158700 - protein, 238 aa, Glycine max
  Coding DNA Sequence Number=SeqID_41922
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=57%, E-value=2e-77, Identity=61%"; Hit description =Integrase, catalytic region
  Pfam annotation: Domain name=rve; Domain location=34-190; Score=72.1; E_value=1.8e-18; Accession=PF00665.16; Description=Integrase core domain
MCRNVHQFVRQCPTCQQVKYKPKRPAGLLQPLPIPASLWEDLSLDFITGLPSSQGHTTILGVVDRFSKRTHLDVLPSNYTAPKVATLFLNMVCKLHGFPRSLVFDRDPIFIGRFWWELFTIVGTKLRMSTSYHPETNGQTKVLNRTLEQFLRCFVLNCPSKWFSYLPLAEWCYNTSIHSATRVTPFDATYGKAPLSLTTCISGSSLVEIVDHFVEAKLHDKSTMIQRCFDDNNDDNKR

SEQ ID NO: 158701 - protein, 325 aa, Glycine max
  Coding DNA Sequence Number=SeqID_41923
  Gene Ontology: Mol. function=protein binding; Cellular component =membrane; Biological process=defense response
  Homolog annotation: Hit_ID=Q1T152; Match level="QueryCoverage=94%, HitCoverage=25%, E-value=6e-78, Identity=50%"; Hit description=IMP dehydrogenase/GMP reductase
  Pfam annotation: Domain name=LRR_1; Domain location=191-212; Score =1.8; E_value=1.3e+02; Accession=PF00560.23; Description=Leucine Rich Repeat
  Pfam annotation: Domain name=LRR_1; Domain location=27-48; Score =13.0; E_value=1.1; Accession=PF00560.23; Description=Leucine Rich Repeat
  Pfam annotation: Domain name=LRR_1; Domain location=278-301; Score =1.1; E_value=1.8e+02; Accession=PF00560.23; Description=Leucine Rich Repeat
  Pfam annotation: Domain name=LRR_1; Domain location=3-25; Score=8.1; E_value=8.8; Accession=PF00560.23; Description=Leucine Rich Repeat
  Pfam annotation: Domain name=LRR_1; Domain location=50-72; Score=9.5; E_value=4.9; Accession=PF00560.23; Description=Leucine Rich Repeat
  Pfam annotation: Domain name=LRR_1; Domain location=74-99; Score=6.1; E_value=21; Accession=PF00560.23; Description=Leucine Rich Repeat
  Pfam module annotation: Pfam domain module=LRR_1::LRR_1::LRR_1::LRR _1::LRR_1::LRR_1; Domain location=191-212::27-48::278-301::3-25::50 -72::74-99
MTRLRVLSMSHYNNITEVPDSLGKLTHLKYLDLSNTKIERLPDATWKLYNLQTLLLSKCWLLVELPEKIGNLVNLCHLDISGTKLKDMPVKEQDGLKVLELRKFPLLQGKHSISMLQNVTDPSEAFQANLKKKEKIDELELKWNYDNSEDSQVERLVLEQLHPSTNLKKLNIQSYGGTNFPNWLGDSSFGNMVYLRISDTEHCWSLPPLGQLLSLKKLIISGLKSVRTNGTKIYGSCCSSSSFLSFQPFPSLEILSFCEIQEWEEWNLIEGAYVAFRKLKCLSLCDCLKVKGNLANNIPLPIDPSLLKERIQHHPINIDCDENQF

SEQ ID NO: 158702 - protein, 179 aa, Glycine max
  Coding DNA Sequence Number=SeqID_41924
  Gene Ontology: Mol. function=RNA-directed DNA polymerase activity; Cellular component=chromatin; Biological process=chromatin assembly or disassembly
MVVWPCEEGRPGLKETRGPFGLILDLLASGTLADKLVNIAAHIGPVKIGLKAVQGFGKSHMASNRGAIVEYEVRVGTRVRSYLVNGILNSFIGAHVVTNDIEEHGVRHGENEALASGVLRYARESVCNNISLSGLVLDGIIITQELRQINLLLWRLYDLVHEFSGGDGVEFADISGCAL

SEQ ID NO: 158703 - protein, 47 aa, Glycine max
  Coding DNA Sequence Number=SeqID_41925
MSPSVNQKVLARCFKYASSWAIRDVFFNINKIGGEVDEMTSERMFPE

SEQ ID NO: 158704 - protein, 132 aa, Glycine max
  Coding DNA Sequence Number=SeqID_41926
  Gene Ontology: Mol. function=metalloendopeptidase activity; Cellular component=proteinaceous extracellular matrix; Biological process =peptidoglycan metabolic process
  Homolog annotation: Hit_ID=Q1SAT9; Match level="QueryCoverage=63%, HitCoverage=22%, E-value=9e-20, Identity=60%"; Hit description=H+ -transporting two-sector ATPase, delta (OSCP) subunit; Peptidase, metallopeptidases
  Subcellular localization annotation: CTP_CleavageSite=16; ConfidenceScore=5.04e-01
MSAQSRPPLKNLLFISEKAHANVPKLTSNSSPSLWSPLKNPILMLALKYDADSQKFSDITSAQRMNAAANTPLTVMLSSFLRKNAESKPFSPSKPLSARSHIGRQLSRASALSADPALSAWPLDPVGHAHLV

SEQ ID NO: 158705 - protein, 281 aa, Glycine max
  Coding DNA Sequence Number=SeqID_41927
  Gene Ontology: Mol. function=RNA-directed DNA polymerase activity; Cellular component=chromatin; Biological process=chromatin assembly or disassembly
MTTNRPITHQIHLLPNSKPVNIRPYRYTHFQKTKIERQVNEMLSTGLIQLIHSPFSPPVLLVKKKDGSWRFYVDYRALNSATLKDRFPMPTIDELMDELGNASWFSKLDLRQGFHQILMAEHDTAKTIFRTHLGYYEYKVMSFGLCNTPSTFQSAMKELLKPFLHRFVIVFFDDILVYSPCFADHLHHLEEVFDCLTQNHFYLKESKCSFAQQRLEYLGHIPTPSSTTTLHGFLGLTGFCRKFIRGYATIIAPLTTLLQKDNFHWSDDAQLAFDNLKQAMT

SEQ ID NO: 158706 - protein, 327 aa, Glycine max
  Coding DNA Sequence Number=SeqID_41928
  Gene Ontology: Mol. function=RNA-directed DNA polymerase activity; Biological process=RNA-dependent DNA replication
  Homolog annotation: Hit_ID=Q2HS45; Match level="QueryCoverage=39%, HitCoverage=23%, E-value=7e-33, Identity=47%"; Hit description=RNA -directed DNA polymerase
MALKIDINKAFDRVDWNYLLVVMIKMWFHQKWVDSMKLCLGSTQFSVMVNEDSLGPISPRRGLRQGDQLSPYLFIICTEGLSSLLKKSERSGELHGIKHIALKAILDSYGENSDQAINNLKSEIFFNSNTPPNLHISSYMGQNVEAEQPLEWEAYIYLKRDVIKEGVRWKIRRGDKINVWNQLWLCSNENSFVTTPPPRGLENMMKEIVYPPNLGYKQKEFNVLQCAPFAPTTLIIAGIVELIFKIVYSWQHNQDLTRPPEPIQENARIAQWHPPSPGWLKCNIDALIFRYQQAFSMGLCIWNECGHYLLAKAAWSFGTPNPTEAEA

SEQ ID NO: 158707 - protein, 72 aa, Glycine max
  Coding DNA Sequence Number=SeqID_41929
MLHEVAEGSSEDGGDEVKQEDLAMSNDAARDGPIKAVEEADMVRDTAKESMDGAWIAAQEASHKVRDNDNKG

SEQ ID NO: 158708 - protein, 137 aa, Glycine max
  Coding DNA Sequence Number=SeqID_41930
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=34%, E-value=8e-32, Identity=51%"; Hit description =Integrase, catalytic region
MKAQADNKRRDVSYSVGDWVYVKLIPYRQTSLSDSHYHKLSKRYYGPFQITETINVVTYRLALPPSSKIHNVFHYSILKPHHNPIIQTMNPLPPRANDNHPLVEPMNILDTKWDNTQDPSSLLFLVQWHDLPPKGTS

SEQ ID NO: 158709 - protein, 110 aa, Glycine max
  Coding DNA Sequence Number=SeqID_41931
MAKQVYYVNYLERPNDWLVVIKTKAQSINGSLESRNLEKYVSYQDESITQFPITIMDDNLEESLVDIRGQVEEAFVDSLDEVDFEDNGEVEIEEVIVLQEVEDMEEDDDE

SEQ ID NO: 158710 - protein, 86 aa, Glycine max
  Coding DNA Sequence Number=SeqID_41932
MWKLDGVMEVMDLENEYFLVRFQDWKGLCHVFEVSPWFGQHKEVWPMFQLKMNSKLEKGCMSFPWTIIKTHNGELDIKKERRGKAQ

SEQ ID NO: 158711 - protein, 72 aa, Glycine max
  Coding DNA Sequence Number=SeqID_41933
MAQKCPQEFKNPVICPEYLVFEHPPHLLSSEVASRDFSEVAATSCVSTILFHLIRGSGVEVSDDSSSLYCGT

SEQ ID NO: 158712 - protein, 97 aa, Glycine max
  Coding DNA Sequence Number=SeqID_41934
  Homolog annotation: Hit_ID=O48879; Match level="QueryCoverage=32%, HitCoverage=19%, E-value=2e-08, Identity=84%"; Hit description =Ribosomal protein L22
MAVNRPVLRVHENLPLALTVAPHQFLPFKFTSVGIRCSPFNDKTLISIKPNTSHLNHDTLACRFHAAQFAVFPNSLLCVKINPSQMLYCNPVFLEPG

SEQ ID NO: 158713 - protein, 66 aa, Glycine max
  Coding DNA Sequence Number=SeqID_41935
  Gene Ontology: Mol. function=hydroxymethyl-, formyl- and related transferase activity; Biological process=biosynthetic process
  Homolog annotation: Hit_ID=Q9M4F4; Match level="QueryCoverage=74%, HitCoverage=14%, E-value=1e-11, Identity=74%"; Hit description=Fmt protein
MSIHYLPTLYIFHHWAPDLLELLFHKGSKLLIGELPSILDGSAIVKAQPQDDSKATLAPKVCDCEP

SEQ ID NO: 158714 - protein, 112 aa, Glycine max
  Coding DNA Sequence Number=SeqID_41936
MESHEGGDNSNGEGGKRKKNETLFSEITKDTVSKIKRHCYRSRGGNEPKLCTIHDNTSPGYQWLLPGWVAEERHMMSGRVYRYYYDRQGRQYRSQSEVVAAWEKIGVVLIDD

SEQ ID NO: 158715 - protein, 408 aa, Glycine max
  Coding DNA Sequence Number=SeqID_41937
  Gene Ontology: Mol. function=structural molecule activity; Cellular component=cytoskeleton; Biological process=sperm individualization
  Homolog annotation: Hit_ID=P02581; Match level="QueryCoverage=91%, HitCoverage=99%, E-value=0.0, Identity=89%"; Hit description=Actin-1
  Pfam annotation: Domain name=Actin; Domain location=4-377; Score =794.0; E_value=8.4e-236; Accession=PF00022.9; Description=Actin
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDFLMKILTERGYSFTTSAEREIVRDMKEKLAYIALDYEQELETSKTSSSVEKSYELPDGQVITIGAERFRCPEVLYQPSMVGMEASGIHETTYNSIMKCDVDIRKDLYGNIVLSGGTTMFPGIADRMSKEISALAPSSMKIKVVAPPERKYSVWIGGSILASLSTFQQMWIAKAEYDESGPSIVHRKKNFSAYQFCTPMDMSTSSLIKDSPWNPKFGTSS

SEQ ID NO: 158716 - protein, 536 aa, Glycine max
  Coding DNA Sequence Number=SeqID_41938
  Gene Ontology: Mol. function=glutamine-tRNA ligase activity; Cellular component=soluble fraction; Biological process=tRNA aminoacylation for protein translation
  Homolog annotation: Hit_ID=Q6D7J7; Match level="QueryCoverage=82%, HitCoverage=79%, E-value=0.0, Identity=87%"; Hit description =Glutaminyl-tRNA synthetase
  Pfam annotation: Domain name=PTS_EIIA_1; Domain location=1-59; Score =10.4; E_value=1.2e-10; Accession=PF00358.10; Description =phosphoenolpyruvate-dependent sugar phosphotransferase system, EIIA 1
  Pfam annotation: Domain name=tRNA-synt_1c; Domain location=123-434; Score=611.5; E_value=7.4e-181; Accession=PF00749.11; Description =tRNA synthetases class I (E and Q), catalytic domain
  Pfam annotation: Domain name=tRNA-synt_1c_C; Domain location=436-536; Score=105.7; E_value=1.3e-28; Accession=PF03950.8; Description=tRNA synthetases class I (E and Q), anti-codon binding domain
  Pfam module annotation: Pfam domain module=PTS_EIIA_1::tRNA-synt _1c::tRNA-synt_1c_C; Domain location=1-59::123-434::436-536
MGLDTVALEGKGFTRLVEEGATVTAGQPILEMDLDFLNANARSMISPVVVSNSDDFAGLNLLAGGTVVAGVTPLALWIILRYFVVQITRYCFEDFEMSEAEARPTNFIRQIIDEDLASGKHNSVHTRFPPEPNGYLHIGHAKSICLNFGIAQDYQGQCNLRFDDTNPVKEDMEFVESIKNDVQWLGFEWSGNIRYSSDYFDQLFNYAVELINKGLAYVDELSPEQIREYRGTLTAPGKNSPYRDRSVEENLALFQKMRDGGFEEGKACLRAKIDMASSFIVMRDPVLYRIKFAEHHQTGNKWCIYPMYDFTHCISDALEGITHSLCTLEFQDNRRLYDWVLDNITIPVHPRQYEFSRLNLEYAVMSKRKLTQLVSEKIVEGWDDPRMLTVSGLRRRGYSAASIREFCRRIGVTKQDNIVEMASLESCIRDDLNENAPRAMAVLDPLKVVIENLPAGHEEIISMPNHPNKPEMGTREVPFSREVWIDRADFREEANKQYKRLVLGKEVRLRNAYVIRAERVAKDEAGNITCIYATCD

SEQ ID NO: 158717 - protein, 274 aa, Glycine max
  Coding DNA Sequence Number=SeqID_41939
  Homolog annotation: Hit_ID=Q01AC5; Match level="QueryCoverage=39%, HitCoverage=42%, E-value=2e-12, Identity=30%"; Hit description =Homology to unknown gene
  Subcellular localization annotation: CTP_CleavageSite=40; ConfidenceScore=5.37e-01
MAGMSGCSCRWQWAEAKSMGVGCWFPSSTTKRSFRPVIVSVSAISDNNSHSYTSSGRKLEEEGIKGSGTTARDRRLLRIRQEKRQREYDLLNNYPAWAKVLENACKDDAELRAVLGDSIGNPELMRKRVEDRVRKKGRDFQKSKTGSVLAFKVTFRDFNPLDSYIWFELFGSPSDRDVNLIGNVIQSWYVMGRLGAFNSSNLQSVRKPLCDGLFSYARHVSQSSWASCINFMTVNVRLLLGINALYGSSTMSNEQEVLHRLLDVVKSKQRFPLQ

SEQ ID NO: 158718 - protein, 335 aa, Glycine max
  Coding DNA Sequence Number=SeqID_41940
  Gene Ontology: Cellular component=microtubule
  Homolog annotation: Hit_ID=Q0WV51; Match level="QueryCoverage=90%, HitCoverage=41%, E-value=6e-83, Identity=48%"; Hit description =Katanin p80 subunit-like protein
MVNPGSADRTVKFWDLETFELIGSAGPETTGVRSLTFSPDGRTLLCGLHESLKVFSWEPIRCHDMVDVGWSRLSDLNFHEGKLLGCSYNQSCVGVWVVDISRIEPYALNNVNHLNGHSETKSSSGNMTVLNEITAKARLSVSQNPDQLLKETRSLGRLSVSQDSDPLKEGKCLASTGSAPSTPQRINLNSGPKTVPGGSTTVLNTTAQKKSSLKSHTTSSAPLINKSDIIPVIVPRTSMRSEPVADSRKEVGVSGRTMPFPSQSKAADVRKFPNNRDDVDKPLSPVIESAASKGSELSGFADKNNFPASVSSTQGISTSLKSLNYTRLLETGKYE

SEQ ID NO: 158719 - protein, 281 aa, Glycine max
  Coding DNA Sequence Number=SeqID_41941
  Gene Ontology: Mol. function=protein heterodimerization activity; Cellular component=microtubule; Biological process=cell division
  Homolog annotation: Hit_ID=Q8H0T9; Match level="QueryCoverage=93%, HitCoverage=29%, E-value=1e-58, Identity=49%"; Hit description =Katanin p80 WD40-containing subunit B1 homolog 1
MCLEFCLVPDEARGLKVNRDVCSVEVQKGGRMRSLLNLEKRERSLNYEGPRQGISHGRISSVHVLPFSGYVISLFLKVKQRAHSISTEKATVSATDEDSIADVMEQHDEFLSSMLARSAKLQMVFRCWERNDVKEVIGIMARMDDHAVIADVVSIIMEKIDIITLEICAGLLPLLTDLLQSEMERHLGISLEMLLKLVRIFGSVIYSTVSATQPVGVDIEAENRCAYSFIFCLLTRFRLERCNLCFTELEKVKRFLPSLSRRGGSIAKSAQELNLALQDVS

SEQ ID NO: 158720 - protein, 122 aa, Glycine max
  Coding DNA Sequence Number=SeqID_41942
  Homolog annotation: Hit_ID=O24097; Match level="QueryCoverage=86%, HitCoverage=26%, E-value=7e-36, Identity=62%"; Hit description=MtN19 protein precursor
  Pfam annotation: Domain name=SURNod19; Domain location=1-122; Score= -179.1; E_value=0.00022; Accession=PF07712.3; Description=Stress up -regulated Nod 19
AEYTIPAGGGGDSPHVQKANIPMENGGYLIYGTAHMHSGVVNATLYGQDGRTLCTSTPKYGTGKEAGNEKGYLIGMSVCYPQPGSIKIHDGEILTLESRYKNEFRTGAMGHFYIYLAEELPQ

SEQ ID NO: 158721 - protein, 206 aa, Glycine max
  Coding DNA Sequence Number=SeqID_41943
  Gene Ontology: Mol. function=protein heterodimerization activity; Cellular component=microtubule; Biological process=cell division
  Homolog annotation: Hit_ID=Q9FT96; Match level="QueryCoverage=98%, HitCoverage=32%, E-value=8e-77, Identity=52%"; Hit description =Katanin p80 subunit-like protein
  Pfam annotation: Domain name=WD40; Domain location=125-163; Score =49.7; E_value=9.9e-12; Accession=PF00400.22; Description=WD domain, G-beta repeat
  Pfam annotation: Domain name=WD40; Domain location=167-203; Score =36.8; E_value=7.5e-08; Accession=PF00400.22; Description=WD domain, G-beta repeat
  Pfam annotation: Domain name=WD40; Domain location=40-79; Score=30.8; E_value=4.8e-06; Accession=PF00400.22; Description=WD domain, G-beta repeat
  Pfam annotation: Domain name=WD40; Domain location=83-121; Score =30.8; E_value=4.9e-06; Accession=PF00400.22; Description=WD domain, G-beta repeat
  Pfam module annotation: Pfam domain module=WD40::WD40::WD40::WD40; Domain location=125-163::167-203::40-79::83-121
MTTKRAYKLRILHLLSISLYFVIMLESFFVCVCDLAGLDELCPEEFVAHASTVNCLKIGRKSSRVLVTGGEDHKVNLWAIGKPNAILSLSGHSSGIDSVSFDSSEVLVAAGAASGTIKLWDLEEAKIVRTLTGHRSNCTSVDFHPFGEFFASGSLDTNLKIWDIRKKGCIHTYKGHTRGVNAIRFTPDGRWVVSGGEDNTVKSQIS

SEQ ID NO: 158722 - protein, 204 aa, Glycine max
  Coding DNA Sequence Number=SeqID_41944
MTTNTVDKPTLILKADYYKGKEKMIEDAPSTRYVIARLGIGKLYRGITNLEPFVLVWNLRRSHHQMEFITRQRNFSFTIELPYSTFTFVHHIQTIIEEVYFDDEVPIVVVDMTMEVYNNPPPSQEYVRFLETTLLRTREALAEAFHDRVDAKREAKRWKVLRKHLFKKCVDALFDSSFDDEFGDKSFCKHEGEEEAAKQKGDKK

SEQ ID NO: 158723 - protein, 935 aa, Glycine max
  Coding DNA Sequence Number=SeqID_41945
  Gene Ontology: Mol. function=diacylglycerol kinase activity; Biological process=protein kinase C activation
  Homolog annotation: Hit_ID=Q5KR50; Match level="QueryCoverage=94%, HitCoverage=94%, E-value=0.0, Identity=77%"; Hit description =Sphingosine kinase
  Pfam annotation: Domain name=DAGK_cat; Domain location=312-578; Score= 68.2; E_value=2.6e-17; Accession=PF00781.14; Description =Diacylglycerol kinase catalytic domain
MLSQLAKHPDDGKGKLANKNPNIGNRGILKVAQPLRHALARVCQIDGSSMRDMHRNSTGSTNTNKISSSAIRLPSPQQSLRRLGLCSQIATGEHSSPIVFPEKRGKVKATSRKTSVPPTTIRPDDQDITKNFEHRIDIAGAGGGGGDEKSDLLGYVVFSGKLILDKRKLATINNAAADAQQSSSDITNQNAVDAKLTSKALAWGSHVLHLYDVISVSYNAGLRHFTVHSYPLKEASCGLSCCIKSRRSRKDFRFVASSIEEALQWVGGLADQHCFVNCLPHPLLSSKKQASSELLHTDTPPELLFRCKTPPKMLVILNPRSGRGRSSKVFHGIVEPIFKLAGFRLEVVKTTSAGHARNLASSVDISTCPDGIICVGGDGIINENTETDICISSSVLISDQWDWGLPSFPLLCRTGSWLSCGHNVSHAHVCSGAVSGCGWSSRYRSGAARVAERFFALLLRRKHWNFRFEGHSSSSSHPSLPLFLLLRHPPSSSPSRAAVAASSPPASPTTPSPRATSTVLNGLLSRDNQKEGISIPIGIIPAGSDNSLVWTVLGVRDPVSAAMAIVKGVTSSSYIEELFPNFAVSPTGFRGGLTATDVFAVEWIQTNKIHYGLTVSYYGFLSDVLELSEKYQKRFGPLRYFVAGFFKFLCLPHYSYEVEYLPASKTEGEGKLSGEKEVVDMSHLYTDIMSRSNKDGMPRASSLSSIDSIMTPSRISGGDLDTCSSTHASTEPSELVRGLDPKSKRLSSGRGNVTAEPEVIHPQLPLSTTPNWPRTRSKSRNDKGWTGLTTTHDTSRWGNTATNDREDISSTLSDPGPIWDAEPKWDAEPNNWDVENPIELPGPSDDTEIGSAKEVVPHFGDKWVVSKGQFLGILVCNHACRTVQSSQVVAPKAEHDDNTLDLLLVHGSGRLRLLRFFLLLQMGRHLSLPYVEYVK

SEQ ID NO: 158724 - protein, 65 aa, Glycine max
  Coding DNA Sequence Number=SeqID_41946
MDKLLYEKPRLDGDDKKALNTFLRTTNLTYMCRMIHSVLFSIVMHMVGSRDYISNINHLCIYKIM

SEQ ID NO: 158725 - protein, 289 aa, Glycine max
  Coding DNA Sequence Number=SeqID_41947
  Gene Ontology: Mol. function=pyridoxal phosphate binding; Cellular component=cytoplasm; Biological process=amino acid metabolic process
  Homolog annotation: Hit_ID=UPI00005F781E; Match level="QueryCoverage =96%, HitCoverage=75%, E-value=1e-123, Identity=84%"; Hit description= COG0626: Cystathionine beta-lyases/cystathionine gamma-synthases
  Subcellular localization annotation: CTP_CleavageSite=19; ConfidenceScore=5.06e-01
MALDAGDYSASACCRSAIRSSASSIPTDRRTSCGRNGGVRHAERLADQAFHAAQAFRQGEQARALDDPARIGVVAFQPHRDHAAEARHLARRQRVLRMARQAGIVDVFHLRLALQPLGDAQRAVAVALHAQCQGANAAQRQEAAERIENAADRVLQETELFRQRRVIPHRRDAGHHVGVAVEVFGGGVHHHVKAQIQRALQIRRGEGIVRHADKPMLFGDRGNGAQIRQLQQRVGRGFYPDHFGVRLDRLLQPGEIRRRHVSDAQAGGAAAHFFQQAIGAAVQIVYCDQ

SEQ ID NO: 158726 - protein, 122 aa, Glycine max
  Coding DNA Sequence Number=SeqID_41948
  Gene Ontology: Mol. function=lipid binding; Cellular component =cellular_component; Biological process=lipid transport
  Homolog annotation: Hit_ID=Q43681; Match level="QueryCoverage=77%, HitCoverage=95%, E-value=1e-23, Identity=51%"; Hit description =Probable nonspecific lipid-transfer protein AKCS9 precursor
  Pfam annotation: Domain name=Tryp_alpha_amyl; Domain location=32-97; Score=45.3; E_value=2.1e-10; Accession=PF00234.12; Description =Protease inhibitorseed storageLTP f
MHMMKKVCGFAIVVMAALFLVEMSPMAEAVTCSPVELSPCLGAITSSSPPSTTCCQKVREQRPCLCGYLKNPSLRPYVNSPGSRRVASSCGVPFPTFYGSKHLATVGSTSHGSFKLKEFRLN

SEQ ID NO: 158727 - protein, 246 aa, Glycine max
  Coding DNA Sequence Number=SeqID_41949
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9ZPL8; Match level="QueryCoverage=83%, HitCoverage=73%, E-value=5e-95, Identity=82%"; Hit description =Protein phosphatase type 2C
  Pfam annotation: Domain name=PP2C; Domain location=44-246; Score =108.0; E_value=2.7e-29; Accession=PF00481.12; Description=Protein phosphatase 2C
MLLYMWPTTFRVESTFIKLVKVGLGSSDPDSGKGKSKMSKNITHGYHLVKGKSYHDMEDYVVAQFKQIDNNELGLFAIFDGHAGQNVPNYLRSHLFDNILHEPDFWKEPADAVKRAYSKTDSNILDMSGELGRGGSTAVTAILVNCQKLIVANIGDSRAVLCKKGVAKQLSVDHEPTAEHEDIKNRGGFVSNFPGDVPRVDGRLAVSRAFGDKSLKKHLSSEPFVTVENIGDDAEFVILASDGLWK

SEQ ID NO: 158728 - protein, 101 aa, Glycine max
  Coding DNA Sequence Number=SeqID_41950
MLCSRVVGSCEHAHHEYKNYIHLVYTLENVSNVYRGLFGKLCNEAYWPCGSNAFQVQVEGTSTWFFKENKGGYIPCGSLACKGFYKVERNLKNHRLLGDWM

SEQ ID NO: 158729 - protein, 89 aa, Glycine max
  Coding DNA Sequence Number=SeqID_41951
MFLWFKLFIRNNKLFFLDEVISGRTASNTLVKGYKRRYGHALRVRISILQCSKICTHEIAHKVFSSSTKELRIVPIIFLMMMRLWREFI

SEQ ID NO: 158730 - protein, 237 aa, Glycine max
  Coding DNA Sequence Number=SeqID_41952
  Homolog annotation: Hit_ID=Q1S1N3; Match level="QueryCoverage=29%, HitCoverage=22%, E-value=5e-11, Identity=46%"; Hit description =Calcineurin-like phosphoesterase family protein, related
  Pfam annotation: Domain name=DUF1723; Domain location=160-209; Score =46.9; E_value=7e-11; Accession=PF08330.1; Description=Protein of unknown function (DUF1723)
MHGVHGVFLFPTTYLQGLMMPYTSKHNYCHHKLQLALLGNISLQRKSPSNVGLLHDPSYGCIQNLENWILLNFAFVVGLSSSLGKSSFVVNSGSFGLVDEQKCLGLHWMCVNNGTEDNIVVDEVLVEGLGWEVHSSPDPKIEPLFVQVEFSDVAMLGQFKIDHDLVTTLVERWRPKLRMFHLLVGECTITLENIALQQGLRVDGRPGMHFRTDWWGADARQVMEQSSPDVSTLVSRS

SEQ ID NO: 158731 - protein, 457 aa, Glycine max
  Coding DNA Sequence Number=SeqID_41953
  Gene Ontology: Mol. function=protein binding; Cellular component =cytoskeleton; Biological process=red or far red light signaling pathway
  Homolog annotation: Hit_ID=Q1RT71; Match level="QueryCoverage=84%, HitCoverage=97%, E-value=0.0, Identity=80%"; Hit description=Cyclin -like F-box
  Pfam annotation: Domain name=Kelch_1; Domain location=141-187; Score =29.0; E_value=1.7e-05; Accession=PF01344.15; Description=Kelch motif
  Pfam annotation: Domain name=Kelch_1; Domain location=189-236; Score =61.7; E_value=2.4e-15; Accession=PF01344.15; Description=Kelch motif
  Pfam annotation: Domain name=Kelch_2; Domain location=141-187; Score =2.7; E_value=17; Accession=PF07646.5; Description=Kelch motif
  Pfam annotation: Domain name=Kelch_2; Domain location=189-236; Score =28.9; E_value=1.9e-05; Accession=PF07646.5; Description=Kelch motif
  Pfam module annotation: Pfam domain module=Kelch_1::Kelch_1::Kelch _2::Kelch_2; Domain location=141-187::189-236::141-187::189-236
MRSSGKPNARTSLLTWTNRLRLEVDTTACLCRVDTGLKTVAGAKNNVPGTKFCLQPDINHPFTQLETKSAHGDRSRNQSPLLPGLPDDLAIAWLIQSLGVAEEWIYVIKRDQDGKISWHAFDPVYHLWQPLPPVPKEYSGALGFGCAVLNGCHLYLFGGKDPLKGSMRRVIFYSARTNKWHCAPDMLRRRHFFSSCVINNCLYVAGGENEGVHRSLRSAEVYDPNKNRWSFISDMSTAMVPFIGVVYDGKWFLKGLGSHRQVLSEVYQPENDNRYPIYDGMVSGWRNPSCTLNEKLYALDCKDGCKIRVYDEVADSWSKHIDSKMHSGSSRALEDAALVPLNGKLCIIRNNMSISLVDVSKLEDLKGSSPEQLWETIAGKGQFKTLVTNRWSSLAGRNRLKSHIVHCQLVTGYSISHLDGMFVRSWDKSCQNTMMQSIIAFHLKSLASWSSQEVKHR

SEQ ID NO: 158732 - protein, 83 aa, Glycine max
  Coding DNA Sequence Number=SeqID_41954
MAYQLSEIVVGDWLAQKSNMLGGRTFVAENCNKLKGLRIGRGLFNRQYTSLLASTLSLTQVDDQPPPCSHRTCFVQRWREEIE

SEQ ID NO: 158733 - protein, 79 aa, Glycine max
  Coding DNA Sequence Number=SeqID_41955
  Gene Ontology: Mol. function=DNA binding; Cellular component=nucleus; Biological process=regulation of transcription, DNA-dependent
  Homolog annotation: Hit_ID=Q0PJH6; Match level="QueryCoverage=80%, HitCoverage=65%, E-value=4e-23, Identity=71%"; Hit description=MYB transcription factor MYB142
  Pfam annotation: Domain name=Myb_DNA-binding; Domain location=7-56; Score=33.4; E_value=7.7e-07; Accession=PF00249.21; Description=Myb -like DNA-binding domain
MSSSSSTSRWTVQENKAFERALAVYDKDTPNRWCNIARAVGGKTPEEVRRHYDRLVEDIRRIESGQVPFPIYRNLQDGA

SEQ ID NO: 158734 - protein, 90 aa, Glycine max
  Coding DNA Sequence Number=SeqID_41956
  Gene Ontology: Mol. function=transcription factor activity; Biological process=regulation of transcription, DNA-dependent
  Homolog annotation: Hit_ID=Q48JC9; Match level="QueryCoverage=82%, HitCoverage=25%, E-value=6e-11, Identity=41%"; Hit description =Transcriptional regulator, LysR family
  Subcellular localization annotation: CTP_CleavageSite=71; ConfidenceScore=5.34e-01
MSKGCVRCAWPAAASLSFPSGMCGKSWHLANWWRWSWRTRSRRCWACGRCFPPRATCRRASAYLLRRSGRRCNSKAGPARDADVRKKAEG

SEQ ID NO: 158735 - protein, 139 aa, Glycine max
  Coding DNA Sequence Number=SeqID_41957
MPATRSGVSAPRSRIIAGNKKGFGQVAKSFFYVRHPAGVERGGCLLFSDDSRGADSQTPAGFRWCWPVAFTMSAAQRSSQMCLGGRRVKSGPRKLNSALLSEEKESDGTCSITPGPGPGDPANHRCPFATDRSGALTGT

SEQ ID NO: 158736 - protein, 285 aa, Glycine max
  Coding DNA Sequence Number=SeqID_41958
  Gene Ontology: Mol. function=methionyl aminopeptidase activity; Cellular component=cytoplasm; Biological process=proteolysis
  Homolog annotation: Hit_ID=Q56Y85; Match level="QueryCoverage=61%, HitCoverage=40%, E-value=2e-90, Identity=88%"; Hit description =Methionine aminopeptidase 2B
  Pfam annotation: Domain name=Peptidase_M24; Domain location=132-283; Score=7.9; E_value=2.1e-08; Accession=PF00557.14; Description =metallopeptidase family M24
WNPKATGLLPPSTIAPSRSFIAAPHRTAPENGTSSHVVEGAADADADAELSPPSQKGDDAKEVSKKKKKKSKSKKKKELLQQTDPPSISVINLFPSGDFPEGEIQQYKDDNLWRTTSEEKRELERLQKPLYNSVRRAAEVHRQVRKYIKGILKPGMLMTDICETLENTVRKLISEDGLQAGIAFPTGCSLNWVAAHWTPNSGDKTILQYDDVMKLDFGTHVDGYIVDCAFTVAFNPMFDPLLEASREATNTGIKHKAKYQYHYYKNVERTIPQKLGIVVGEPKAL

SEQ ID NO: 158737 - protein, 227 aa, Glycine max
  Coding DNA Sequence Number=SeqID_41959
MGEVFQNMSEEEEEEEGSVMDGVMEVTKWAQEKKTDPLIWSIQVSSALNSGGVSLPSVELAQRLVSHICFENHVPITWKFLEKAMSVRLLPPLLVLSLLSARVVPQRRLHPSAYALYMDLLSRHAFSPHIHFPNYLKVMASIHHSLSLPPSNHHPHPGVVLVHFLFSIVSQLLQSSLDDQGFLQHSPDPYNNNDALHRKNTAMAIEIIARFLHHKLTSRILALVQRN

SEQ ID NO: 158738 - protein, 140 aa, Glycine max
  Coding DNA Sequence Number=SeqID_41960
  Gene Ontology: Mol. function=structural constituent of ribosome; Cellular component=ribonucleoprotein complex; Biological process =translation
  Homolog annotation: Hit_ID=O48879; Match level="QueryCoverage=90%, HitCoverage=78%, E-value=1e-61, Identity=96%"; Hit description =Ribosomal protein L22
  Pfam annotation: Domain name=Ribosomal_L22; Domain location=24-128; Score=214.8; E_value=2e-61; Accession=PF00237.9; Description =Ribosomal protein L22pL17e
MESRCESDYESMKQESNKYVEAYAVGRNIRMSANKARRVIDQIRGSKYDETLMVLELMPYRACEAILKIVFSAGANASNNLGLSKGSLVISKAEVNEGKTMKRVKPVARGRAHPIKKRTCHITITVKGLPSESVEEAKPA

SEQ ID NO: 158739 - protein, 390 aa, Glycine max
  Coding DNA Sequence Number=SeqID_41961
  Gene Ontology: Mol. function=translation elongation factor activity; Cellular component=intracellular; Biological process=translational elongation
  Homolog annotation: Hit_ID=Q9SWW0; Match level="QueryCoverage=98%, HitCoverage=87%, E-value=1e-112, Identity=60%"; Hit description =Ethylene-responsive elongation factor EF-Ts precursor
  Pfam annotation: Domain name=EF_TS; Domain location=77-373; Score =240.0; E_value=4.9e-69; Accession=PF00889.9; Description=Elongation factor TS
  Pfam annotation: Domain name=UBA; Domain location=24-64; Score=31.2; E_value=3.6e-06; Accession=PF00627.21; Description=UBATS-N domain
  Pfam module annotation: Pfam domain module=EF_TS::UBA; Domain location=77-373::24-64
MAFYGGAKRVCVSIRHYCSNSASEKVNLIKQLRERTSAAMKDVKAALVDSNWDIEEAQKELRKRGKVLASKKSSRTASQGLLALAQSPTKLALIELNCETDFVARNDIFQHLALRLANQALSLSLDSSSSSSSSSFHLGPQSLQDMPFNLDHPKFNGQTTVHNAITELAAMMGENVRLRRGYVIPASPNGFISTYLHTSPQPGLGRIAGILSLQVDDGQTQLQALQRVGSELAMHVVAAKPLFLTKELVPSDALENEREILKSQAEASGKPKMAIEKMVEGRLRKYFEDVVFMDQKFIMNDTMNVKYHGRSVRDSEICKQLPHQMVGGCNLRIWCKVSIMMSSQLKQAVLDNLSKEVGSSVRVVDFLRMEVGEGIARQETDTSETVAQVA

SEQ ID NO: 158740 - protein, 1028 aa, Glycine max
  Coding DNA Sequence Number=SeqID_41962
  Subcellular localization annotation: CTP_CleavageSite=47; ConfidenceScore=5.08e-01
PAHWGPFLHQLQQLAANSTVLRSLKHVTPESLLPLDFNSTTGNGIKLLSSDWKTTPTLELNAVMADSCAVQSRHDSWSLLWLPIDLILEDAMDGNHVAEASAVEALTGLVKALQAVNGTAWHSAFLGLWIAALRLVQRERDPGEGPVPRLDTCLSMLLCITTLVVANLIEEEEGKLIEEAERSPANQRMDKQALGERHGALVTSLQLLGDYENLLTPPQSVIWGANQAAAKATLFVSGHSGYLEHTNVNDLPTNCSGNLRHLIVEACIARHLLDTSAYFWHGYVSTPFNQLPHSIPNHLPSWSSLMKGSPLTPPLVNVLVATPASSLAEIEKIFEFAINGSDEEKISAATILCGASLVRGWNVQVPLLAAVLMPICEAFGSSVPNVSWTAVTGEKLTCHAVFSNAFILLLRLWRFDRPPVEHVMGGAATPALGSQLGPEYLLLVRNCMLAAFGKSPRDRVRSRRFSKMIRFSLEPLFMDSFPKLNIWYRQHQECIASICNTLAPGGPVSQIVEALLTMMCKKINRSAQSLTPTTSGSSNSSLPSLDDALMKLKVPAWDILEATPFVLDAALTACAHGSLSPRELATGLKDLADFLPATLGTIVSYLSSEVTRCIWKPAFMNGTDWPSPAANLSIVEQQIKKILAATGVDVPSLAIDGNAPATLPLPLAALLSLTITYKLDKSCERFVILAGPSLIALSSGCPWPCMPIVGALWAQKVKRWSDFFVFSASATVFHHSRDAVVQLLRSCFASTLGLGSACIYNNGGVGTLLGHGFGSHYSGGFTPVAPGFLYLRVYRSIRDVMFLTDEIVSLLMLSVRDIANGGLPKGEVEKLKKTKYGIRYGQVSLAASMTRVKHAALLGASILWISGGSGLVQSLITETLPSWFLSAQGLEQEGGESGVVVAMLRGYALACFAVLGGTFAWGIDSLSPASKRRPKVLEIHLEFLANALDRKISLRCDCATWRAYVSGVMSLMVSCTPLWIQELDVGILKRMSSGLRQLNEEDLALRLLEIRGTSVMGEAAEMICQTRL

SEQ ID NO: 158741 - protein, 537 aa, Glycine max
  Coding DNA Sequence Number=SeqID_41963
  Gene Ontology: Mol. function=translation initiation factor activity; Cellular component=cytosol; Biological process=regulation of translational initiation
  Homolog annotation: Hit_ID=P48724; Match level="QueryCoverage=82%, HitCoverage=100%, E-value=1e-171, Identity=70%"; Hit description =Eukaryotic translation initiation factor 5
  Pfam annotation: Domain name=W2; Domain location=456-537; Score=73.7; E_value=5.9e-19; Accession=PF02020.8; Description=eIF4-gammaeIF5eIF2 -epsilon
  Pfam annotation: Domain name=eIF-5_eIF-2B; Domain location=94-224; Score=272.6; E_value=7.6e-79; Accession=PF01873.8; Description =Domain found in IF2BIF5
  Pfam module annotation: Pfam domain module=W2::eIF-5_eIF-2B; Domain location=456-537::94-224
MALPVMPRKGIYNDLNIRFEARRTIASMPASAAVADSKKKEQALAYKTHLYALPGIHQPLLLFLTTFATFASQAKGVCCDFSVFGTFLVQVVIMALQNIGAGNSDDAFYRYKMPKMITKIEGRGNGIKTNIVNMVDIAKALARPPSYTTKYFGCELGAQSKFDEKVGTSHVNGSHDTPKLAGLLEIFIKKYVQCYGCGNPETEILITKNQMIQLKCAACGFVSDVDMRDKLTSFIIKNPPETKKGSKDKKAMRRAEKERLKEGAAADEEQKKMKKETKKKSLSSTSKDETTKSNSTKKKASGSDEDCRSPDHSQVDDEKEEAPDEDDDGEVQWLTDTSLEAARQRIQEQLSAVTADMVMLSTDEPEKKETASSKKSDGSENGNTMHYKKLVGEVKAILNKGVVASELQSQMEAIPSPAQEKISALIEALFEGIEKGFAKEVVKKKRYFDAAVSMGEGSHLLLLRAIEAFCLKSTSNALKEIAIVLKALYDADLLEEEHIVQWYQEGLKGDNKHSQIWKNTKPLIEWLQSAESETEEE

SEQ ID NO: 158742 - protein, 143 aa, Glycine max
  Coding DNA Sequence Number=SeqID_41964
  Gene Ontology: Mol. function=nucleoside-triphosphatase activity; Cellular component=chloroplast
  Homolog annotation: Hit_ID=Q2PMM5; Match level="QueryCoverage=99%, HitCoverage=8%, E-value=3e-67, Identity=77%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGPIRSRRRSGGILTYRKRLQSV

SEQ ID NO: 158743 - protein, 134 aa, Glycine max
  Coding DNA Sequence Number=SeqID_41965
MEAIKEQMATMMEAMMSVKKIMEANAVATAATSTVAKVNPMPPSGLNQMNHPTSVMVGKDLGSTGGPHYVQSQNKHAFPPHGFPPNCTPPNVAYTPGENVNNSTPILIESRQPGLIMHMSLNPWVRHMKCPTTI

SEQ ID NO: 158744 - protein, 146 aa, Glycine max
  Coding DNA Sequence Number=SeqID_41966
  Homolog annotation: Hit_ID=Q1S7B1; Match level="QueryCoverage=63%, HitCoverage=61%, E-value=1e-11, Identity=47%"; Hit description =Transposase
MKKSMVKPKNILLTLKEHNVNSCTTIKQIYNARSAYRSSIRGSDTKMQYLIKFLERDQYIHWHRLKDEDMVQTPTARFCWGDTNWDDILCQFCISGSFHIKRNVKAKCKSLIGQRNAWEYVMDEWGTLVDCPSEQQFDEWLKKFEM

SEQ ID NO: 158745 - protein, 170 aa, Glycine max
  Coding DNA Sequence Number=SeqID_41967
  Gene Ontology: Mol. function=RNA-directed DNA polymerase activity; Cellular component=chromatin; Biological process=RNA-dependent DNA replication
MSFDLCNAPSSFQVTMNNIFEPYLRRFIIVFFDDILIYSKTFTEHLDHLAKAFGVLLEGHFFFKLTECTFSQQQIEYLDHIVSRHDVEPVPTKVEAIQEWPVPRRFGRRHGGCSYSTEPPHRILQQAFLHQTPPFIHLCPRTSNDHGGSEEVTPVSVGPSLHHLDRPPES

SEQ ID NO: 158746 - protein, 131 aa, Glycine max
  Coding DNA Sequence Number=SeqID_41968
ERKLGVSVFSSLFMWGGIPPVENEFEWQSERKNHQKMGFPLPAVTYLAKNLSGQGSKKSKVVSQWGLLSWEPDLDIWGKTNSCVKVLVSGRTSILFHKARATMMIWKQRAKLVMATARWALKHPVHGIVIL

SEQ ID NO: 158747 - protein, 91 aa, Glycine max
  Coding DNA Sequence Number=SeqID_41969
MQGEKNPSHDQDRERERSWECRLTWEANEARPQEENNPPETRLRGVINMILRGFAGGGSSNLEHKHYVYNLRIVYAVRVEKLPTRSMPLSL

SEQ ID NO: 158748 - protein, 62 aa, Glycine max
  Coding DNA Sequence Number=SeqID_41970
MPLRGRIASETLKIEQRKLSRNSNGHKFSHGGQIQAHNISRHSKLNNGSSQEIHMVITFHKE

SEQ ID NO: 158749 - protein, 86 aa, Glycine max
  Coding DNA Sequence Number=SeqID_41971
MARTKKTGQMTSEAAKEIAEKIESLEEQASYSFFVAIGRPEHRSRVGVVGVGVTIKKYFGLAPRTSHMSSSMGPKDLEQLMQQIRD

SEQ ID NO: 158750 - protein, 321 aa, Glycine max
  Coding DNA Sequence Number=SeqID_41972
  Gene Ontology: Mol. function=DNA binding
  Homolog annotation: Hit_ID=Q1S0F5; Match level="QueryCoverage=81%, HitCoverage=51%, E-value=1e-26, Identity=32%"; Hit description=IMP dehydrogenase/GMP reductase
MGSNQVPSFKKRFYHVKIKSLEVVDLQELGQQMGQLQLQAFYKTYGKIWDLAMIEVSVEAIASLVQYYNQPLRCFTFGDFQLVPTIEEFEEILGCPLGGRKRYLFSGLHPSMARMAKVVKVLAQELDRVKQNRNGVVRIPRKHLEEKAKALADQGEWALLIDVLVLLVFRAILFPNMDGLVDIVAIDAFLAYHHSKESPVVVALADAYDTFDWRCEKSGPRIVCYTPGLYVWLVSHLFRYESRPVCPLQGHCLCAEKGKANWEQLLAGMVGASINWFPRWKEGGAGVLSSCEGFSSVPLMGMRCLYCRNLSFGGRVTRESR

SEQ ID NO: 158751 - protein, 96 aa, Glycine max
  Coding DNA Sequence Number=SeqID_41973
MSKSFEFGMTGSLDEDLLLSHKDGPSGTSTLVFRGLHVLANRGLHALTLRGLCVLTIRGLHALTSRGLHVLALRGLHALTLGTSYPHRSEGYMSSP

SEQ ID NO: 158752 - protein, 266 aa, Glycine max
  Coding DNA Sequence Number=SeqID_41974
  Gene Ontology: Mol. function=thiamin pyrophosphate binding; Cellular component=intracellular; Biological process=organic acid metabolic process
  Homolog annotation: Hit_ID=Q2K4N7; Match level="QueryCoverage=96%, HitCoverage=41%, E-value=1e-109, Identity=79%"; Hit description =Probable phosphoketolase protein
  Pfam annotation: Domain name=XFP; Domain location=4-266; Score= -141.2; E_value=1e-21; Accession=PF03894.5; Description=D-xylulose 5 -phosphateD-fructose 6-phosphate phosphoketolase
MTNPSAADELALIDRYWRAANYLSVGQIYLMANPLLREPLQPGHIKPRLLGHWGTTPGLNFIYAHLNRIIRQREVDLLYVCGPGHGGPGMVANSWLEGSYSEIYPHVSEDAAGMQRLFKQFSFPGGIPSHAAPETPGSINEGGELGYSLSHAFGAVFDHPQLIVPCVIGDGEAETGPLAASWHGIKFLNPQRDGAVLPILHLNGYKIANPTLLGRSSDDDLQQLFSGYGGGFLARAPGAGGGVSRRCIASSAVRAVVAQLSAGRSV

SEQ ID NO: 158753 - protein, 96 aa, Glycine max
  Coding DNA Sequence Number=SeqID_41975
MPEILITRVCFHRMQHLRHVMYPEYATFPDKVRHRDAYQRIQIRCRTVNLFHVTSGTCISVQCCTGDNNSTPFSAVSENGPGYSSDRLPGVITLRE

SEQ ID NO: 158754 - protein, 99 aa, Glycine max
  Coding DNA Sequence Number=SeqID_41976
MDYKMFANRLQQWPQLHFTAIELQQREMACEIYATAAEHQTMSQLFICRVSDEKNAQELIRQYRSWLHKFNLGRSRRDNSRPPRSVSVNVPGAISAALK

SEQ ID NO: 158755 - protein, 200 aa, Glycine max
  Coding DNA Sequence Number=SeqID_41977
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-17, Identity=30%"; Hit description= UPI00006A17C9 related cluster
MLSHKGGPLGTSTPVFRGLHALNIRGLHVLTFRGLYVLTFRGLHVLTFRALHALTFRGLHALAFVWLHALTFRGLHVLTVRGLHVLTFRGLYILTFRGLYVLTFRGLHVLAIRELHVLAFRGLHVLTFRGLHAFAFRGLHVLTIRGLHVLAFRGLHVLTFRGLHTFSFVGLHALAFRGLRVLAFSGLYIHTIREFKVLFP

SEQ ID NO: 158756 - protein, 156 aa, Glycine max
  Coding DNA Sequence Number=SeqID_41978
MHERQSMHVALNKCGEWRIALGNHFAWLQTPWWRMHERQSIHGAPNKSGEWTFALGNHFAWLQTHWWKMHERQSIHGAPNKSGEWRIALGNHFVWLETHWWRMHERQSIHGAPNKSGEWRIALGNHFAWRKTHWWRMHKRQSIHGAPNKSGEWRMH

SEQ ID NO: 158757 - protein, 111 aa, Glycine max
  Coding DNA Sequence Number=SeqID_41979
MVEAMMSMKKIMEAKAVTVAATSIVAKVNPMPPSGLNQMNHPTSDMVGKDLGSRDDPHDVQIQNKHAFPPYGLPPNCTPPNVAYTPSENVNNSTPIPIESQQPQTDHAHVS

SEQ ID NO: 158758 - protein, 48 aa, Glycine max
  Coding DNA Sequence Number=SeqID_41980
MARLRVGVNTAEKTITGFVISGRGYLKLLQGKRRASTVQVAVDVPTST

SEQ ID NO: 158759 - protein, 94 aa, Glycine max
  Coding DNA Sequence Number=SeqID_41981
MVNMPSYATWGCYKEGKKEKKVRRRSRKEGREKRQNNLRWFWWLLSYPNFVRGLLFDDIQPWIGRFETLGVLGCTINDVPRRLRNQKEASLHDP

SEQ ID NO: 158760 - protein, 36 aa, Glycine max
  Coding DNA Sequence Number=SeqID_41982
MAKVKMIGWRVRNQWFYSIYEKWAKRFKEPRGISEC

SEQ ID NO: 158761 - protein, 115 aa, Glycine max
  Coding DNA Sequence Number=SeqID_41983
MGALQKVRKAWEMMQKKDKELRGSSNGPIGGYHGWLKAYTQDLDWLPNLRTTKGVEVEAPEEDEEVQEELVSAVMRDRDQHVSHHQQVPRRIKSSHGPRAQSGGRICPSVRGKGG

SEQ ID NO: 158762 - protein, 183 aa, Glycine max
  Coding DNA Sequence Number=SeqID_41984
MQDVEIIPHNEDAHVPKPANVDADDPLRGLIKYSFDIYEKPVEINFDGSCFGIADAPTSIFITYSDVSEIIAGDKTLNISVQQLWLMYMHEWSQTLGQGSMYAFLESQSLVVSKDRRSECQQYLERWLKESDREVYVGPYFHQAHWQLVLLCPRQHVVVWLCSLRRKLDMHIKAAINKLSHNI

SEQ ID NO: 158763 - protein, 220 aa, Glycine max
  Coding DNA Sequence Number=SeqID_41985
  Gene Ontology: Mol. function=transferase activity, transferring groups other than amino-acyl groups; Cellular component =mitochondrial inner membrane; Biological process=protocatechuate catabolic process
  Homolog annotation: Hit_ID=Q5NZY5; Match level="QueryCoverage=98%, HitCoverage=54%, E-value=2e-78, Identity=67%"; Hit description =Putative 3-ketoadipyl-CoA thiolase
  Pfam annotation: Domain name=Thiolase_N; Domain location=1-219; Score= 203.6; E_value=4.7e-58; Accession=PF00108.13; Description=Thiolase, N- terminal domain
MQQALICDAVRTPFGRYGGALSALRADDLAALPLKALLARLPQLDPQAIDDVILGCANQAGEDNRNVARMALLLAGLPHSVPGTTLNRLCGSGLDAVGMAARAIKCGEAEVIIAGGVESMSRAPFVTGKADSAFSRSLKMEDTTMGWRFINPQMRAQFGVETMPETAENVAREFAVSRADQDAFALRSQQRTARAQELGLFDEELIAVSIPQRKGEPLSM

SEQ ID NO: 158764 - protein, 95 aa, Glycine max
  Coding DNA Sequence Number=SeqID_41986
MRLGGIVCAEWVGGSECQCSGGARDLQRTCGGSGREGVACMNLVSIAASDVQTVEVLRATNGKVKGGATGKGKVKEGWGCREGGGTKKGKGEDLC

SEQ ID NO: 158765 - protein, 90 aa, Glycine max
  Coding DNA Sequence Number=SeqID_41987
MVTKMKRTTSERKNYQKSPGIETLLHRNRFLLRSFHYSQEAMRETLREPQRAALSSRNGRTWRVKVEEGEEGNVKRQSIGLRLGLVSVLS

SEQ ID NO: 158766 - protein, 519 aa, Glycine max
  Coding DNA Sequence Number=SeqID_41988
MWVDLTLEVKSGCVDTGDDEWFNTSHPFHQMSARELKSRFSHGEEILTSGVDSPELPSSVSRSRGKHYNNKKWEGIDLNSLLDKQKGLSRRGFQQGSSFGQEVKPKPNSNVNKPKGGKLGLAFERKSRGKTDSMVNCSNPPSSSSSNHKCEGSTARSTITSENTQKYREVSSKPFDQKRSSSIRRVSLGKSCVTRKVSSILPQKECLEVSSQPCDQKSRSSSVISVRRSYVSGKASKVEIGGDSTARSMITSENTRKYREVSSKPCAQQSSSVGRVSLGKSCVTRKVSSIQPQKKCLEVSSQPCDQKSRSSSVISVRRSYVLGEASKVESGGDSMRSRGRKSSSGKSSIGSCSNPGYEVKFVSRQQREKITIDKGEVTMNLAVKNRCKPSERSKTSTISVEEAKSGNRKRNSINFAKPAYHRTAKSLVQYSSASSKALLQHTVNKENTCIGGAKEKLRTTKVKSLTAKGKENVSRNVAVNQKCISRGASAGGLVRSHRTTEHNHPQKGDKAGSTALTIV

SEQ ID NO: 158767 - protein, 97 aa, Glycine max
  Coding DNA Sequence Number=SeqID_41989
  Homolog annotation: Hit_ID=O81071; Match level="QueryCoverage=73%, HitCoverage=58%, E-value=2e-24, Identity=69%"; Hit description =Expressed protein
  Pfam annotation: Domain name=Rab5ip; Domain location=15-87; Score =40.5; E_value=1.1e-09; Accession=PF07019.2; Description=Rab5 -interacting protein (Rab5ip)
MKEGKSVKLNHQQPHQNGHLTPSKFAKLFDPEASWDKDQLGDVLHWIRQVLGLACGFLWGSIPLVGGIWFIMKEWKMTMQIYERGLWVEKKCRGTKL

SEQ ID NO: 158768 - protein, 191 aa, Glycine max
  Coding DNA Sequence Number=SeqID_41990
MFRAPCLVLHFFCFFFSRILSDVVVGQEDLSMVFALASTWAMFLAFGSLACVGPVSYTVGMAYQNAFDSGLSLGSQTPGLGFLAVVNSLIFVGLGFVIGYPVASASAKVLQGLWRNDLVALKGACPNCGEEVFAFVRMDRNIESPHRADCHVCECILEFRTKVEQSVSRFGRQWVYGRIYLVSLRGRSRRK

SEQ ID NO: 158769 - protein, 56 aa, Glycine max
  Coding DNA Sequence Number=SeqID_41991
MASITDVEYLICSSARNLRSKASHHHQNSTFLIYVGVGSYSDYGVGSVMEKRKTGD

SEQ ID NO: 158770 - protein, 81 aa, Glycine max
  Coding DNA Sequence Number=SeqID_41992
MQGYFMVTRTFHQPGSNEPVDTRRLTSSYAPFVVLTRESIDMRGYPMVTCTIRQPGANETIEARRLTSSSAPFVVLTREVR

SEQ ID NO: 158771 - protein, 160 aa, Glycine max
  Coding DNA Sequence Number=SeqID_41993
  Gene Ontology: Mol. function=lysine permease activity; Cellular component=membrane; Biological process=amino acid transport
  Homolog annotation: Hit_ID=Q7WQU0; Match level="QueryCoverage=59%, HitCoverage=45%, E-value=5e-28, Identity=58%"; Hit description =Probable transporter
  Subcellular localization annotation: CTP_CleavageSite=54; ConfidenceScore=5.18e-01
MTPAADSDPGPALRPMPHPQSLPTVQPAQSCASFPHGKPDTLSGCTILGTTWVRGACAGSVDPAHRQREGQDAEDHGNGAVEHAPGTGLGEQRRQQACTQALRGQPQAAGGDHASGEGHAGVAEVLGDRTDHHHVQPEVRVDQRETDRGHQHPAAAAVVT

SEQ ID NO: 158772 - protein, 245 aa, Glycine max
  Coding DNA Sequence Number=SeqID_41994
  Gene Ontology: Mol. function=protein kinase activity; Cellular component=membrane; Biological process=protein amino acid phosphorylation
  Homolog annotation: Hit_ID=Q9LZF8; Match level="QueryCoverage=66%, HitCoverage=38%, E-value=2e-57, Identity=65%"; Hit description =Protein kinase-like
  Pfam annotation: Domain name=Pkinase; Domain location=1-155; Score= -68.0; E_value=0.00016; Accession=PF00069.15; Description=Protein kinase domain
  Pfam annotation: Domain name=Pkinase_Tyr; Domain location=1-155; Score=-111.7; E_value=1.3e-05; Accession=PF07714.7; Description =Protein tyrosine kinase
  Pfam module annotation: Pfam domain module=Pkinase::Pkinase_Tyr; Domain location=1-155::1-155
MWMLIFRDFKTSNILLDENFNAKLSDFGLARQGPSEGSGYVSTAVVGTIGYVAPEYVLTGKLTAKSDVWSFGVVLYELITGRRVVERNLPRNEQKLLDWVRPYVSDPRKFHHILDPRLKGQYCIKSAHKLAILANKCLMKQPKSRPKMSEVVESLGSIINDTVPHDEHIPQAAVAATGEEKEEKLSVEDTQPEPAAKQGNNYLKKVFELKDMVSLRNKSVGRLDWKSWAPGLFSLCEIDIVRHTG

SEQ ID NO: 158773 - protein, 150 aa, Glycine max
  Coding DNA Sequence Number=SeqID_41995
MSRFHPSSSCWTSLNEELEQLLANVPKLTIEEHEELRKMANMMQNVAGLPETYFQTVHARDQIFSEVSKVYGVRWKDVLDGSVTFKAYLAEQKVTSNSWTFQAACIIFLKTKIELICTWRTLQNDGLCSIIGGRHLKFELDENIYAKLCL

SEQ ID NO: 158774 - protein, 129 aa, Glycine max
  Coding DNA Sequence Number=SeqID_41996
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XGX7; Match level="QueryCoverage=99%, HitCoverage=100%, E-value=1e-33, Identity=59%"; Hit description =Mitochondrial import inner membrane translocase subunit Tim9
  Pfam annotation: Domain name=zf-Tim10_DDP; Domain location=68-121; Score=61.8; E_value=2.2e-15; Accession=PF02953.6; Description =Tim10DDP family zinc finger
MDKSMLADLDSLPEADKQRMTVMIDQLQIRDRLIQVVRIRLILPQGWEFESCRECEDLVGESFVNSFFLRMYNSLVERCFNDCVDTFKHKSLQKQEETCVRRCAEKFLKHSMRVGMRFAELNQGAATQD

SEQ ID NO: 158775 - protein, 126 aa, Glycine max
  Coding DNA Sequence Number=SeqID_41997
  Subcellular localization annotation: CTP_CleavageSite=34; ConfidenceScore=5.22e-01
MAFSQKKPWSREAWQGGSMVGKKNNTHNNTQNTKQATPMQTKTQNNTQYTISNGKEEQAPEEEEDSLTLKMGEEEAATTRKNLQEKRRKCGNEAKRGHRFSKMKREEEEDSRKNKLSLGGRRIENE

SEQ ID NO: 158776 - protein, 33 aa, Glycine max
  Coding DNA Sequence Number=SeqID_41998
MSQCGTFSPIEAFDIKLYILAESNTLRSQENEW

SEQ ID NO: 158777 - protein, 720 aa, Glycine max
  Coding DNA Sequence Number=SeqID_41999
  Gene Ontology: Mol. function=protein phosphatase type 2C activity
  Homolog annotation: Hit_ID=Q10NB9; Match level="QueryCoverage=62%, HitCoverage=63%, E-value=2e-90, Identity=62%"; Hit description =Protein phosphatase 2C containing protein, expressed
  Pfam annotation: Domain name=PP2C; Domain location=363-683; Score =52.0; E_value=2e-12; Accession=PF00481.12; Description=Protein phosphatase 2C
MGNGIGKLTVCFTGNGGGGRRKQDISFLITEPLDEGLGHSFCYVRPDPTRISSSKVHSEETTTFRTISGASVSANTSTPLSTAFVDLYSYSCIDRAAAFESSTSFAALPLQPIPRNLVNSGPFSGNLNGGGFPGSGPLERGFMSGPIERGFMSGPIDRGLFSGPMEREGNGIGNGSDQFQRSFSHGGLGLGLGMRVRTRKGRWIRVLQRAISKTLSRGQSSIVAPIKGVVMKEPEWMVMAAAEKHNENLSVNLSSEGSLEDDDSMESQNLQWAQGKAGEDRVHVVVSEEHGWVFVGIYDGFSGPDAPDYLLSNLYTAVHKELKGLLWDDRSAPENSMPKEDMLRDVTTDVADFTVADEDDACSHCVEQDNNDNNSKSGNKRGRNSRNKFQGAAKKWEENQRRWKCEWDRERLELDRRLKEQLNLSRSGSGGAASSINHSDVLEALSRALRKTEESYLDVADKMLMENPELALMGSCVLVMLMKGEDVYVMNVGDSRAVLAQKVEPDYWLGKIRQDLERINEETMNDLESWDVDTSNLVPSLSAIQLTKDHSTSVEEEIQKIKKDHPDDPFAVVNDRVKGSLKVTRAFGAGFLKQPKWNNALLEMFRIDYVGNSPYISCLPYLKHHRLGPKDKFLILCSDGLYQYLSNEEAVAEVELFITLQPEGDPAQHLVEEVLFRAAKKAGLDFHELLEIPQGDRRRYHDDVSIIVISLEGRIWRSCV

SEQ ID NO: 158778 - protein, 325 aa, Glycine max
  Coding DNA Sequence Number=SeqID_42000
  Gene Ontology: Mol. function=lipid binding; Cellular component =clathrin vesicle coat; Biological process=Golgi to endosome transport
  Homolog annotation: Hit_ID=Q9LW61; Match level="QueryCoverage=65%, HitCoverage=75%, E-value=7e-36, Identity=38%"; Hit description =Arabidopsis thaliana genomic DNA, chromosome 3, P1 clone: MLM24
  Pfam annotation: Domain name=ENTH; Domain location=31-155; Score =168.6; E_value=1.6e-47; Accession=PF01417.11; Description=ENTH domain
MSTPLFHEFKRQASFFFKEKIKTARLALTDVTPAELMTEEATSGNPWAPDARTLRSISRDAFELDDYWRIVEILHKRFLKFEKKNWRVSYNSLIVLEHLLTHGPESVAEEFKSDKDVISQMKGFQYIDDTGFNWGLTVRKKSERITKLLEEGTLLKEERKNARRLSRGIEGFGSFSHLSTQGQGVLRERSLPSTLRRYDSDLNNREDLENQSSCLNNGVDVDTVAVKFPSHQGGTFKSLGSVEAKGYQDDDLGNNNQMLQKSETSSKENMEPSKEEFHLWNLNGESKPILDWGEEDSKLGIIRTEDDHPFSSTEMHVTASLLSAC

SEQ ID NO: 158779 - protein, 222 aa, Glycine max
  Coding DNA Sequence Number=SeqID_42001
  Gene Ontology: Mol. function=metal ion binding; Biological process =defense response to bacterium
  Homolog annotation: Hit_ID=Q94B55; Match level="QueryCoverage=97%, HitCoverage=49%, E-value=6e-78, Identity=67%"; Hit description =Putative RING zinc finger ankyrin protein
  Pfam annotation: Domain name=zf-C3HC4; Domain location=95-143; Score =2.8; E_value=0.08; Accession=PF00097.15; Description=Zinc finger, C3HC4 type (RING finger)
RIPYVVALKHRHGACATLLNLSSAESLVWPSSLKIISELNPNAKELLERALMDANREREKNILKGSDYSLPSPSHSDGVDDNISEIIQVSETELCCICFEQVCTIEVQDCGHQMCAQCTLALCCHNKPNPSTSRVIPPVCPFCRSSIARLVVVKNESPDDINQDGVDITCSKPSKSRKLRNLNEDGSSSIKGLSNVNSFGKMGGRSSGKIAAENEWEDDKQQ

SEQ ID NO: 158780 - protein, 68 aa, Glycine max
  Coding DNA Sequence Number=SeqID_42002
MAVVVANWLPCDYVRWWFMVATPIGWRAGGVAVDKGGGAGLWCLVVRRIEKEKTVGVGRFLEERRDQR

SEQ ID NO: 158781 - protein, 122 aa, Glycine max
  Coding DNA Sequence Number=SeqID_42003
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=78%, HitCoverage=22%, E-value=1e-42, Identity=81%"; Hit description=TBC domain, putative
MWRDPGAPADSFYETRPECTDVPKSRFRIKAGKTLSARKWNAAFSPEGYLDIGKTLSRIHRGGIHPSIRGEVWEFLLGCYDPKSTFQERDEIRQRRRGVSTTSTAPNSPSTPPSTLSKITDL

SEQ ID NO: 158782 - protein, 111 aa, Glycine max
  Coding DNA Sequence Number=SeqID_42004
  Gene Ontology: Mol. function=Rab GTPase activator activity; Cellular component=intracellular; Biological process=regulation of Rab GTPase activity
  Homolog annotation: Hit_ID=Q1SC55; Match level="QueryCoverage=99%, HitCoverage=24%, E-value=4e-46, Identity=85%"; Hit description=TBC domain, putative
MVFYEKKDNLSKLWDILSVYARIDSDVGYGQGMSDLCSPMIILLNDEADAFWCFERLMRRLRGNFRCTDNSVGVEAQLSTLATITQVIDPKLHQHIAQNILVEATICLLFE

SEQ ID NO: 158783 - protein, 307 aa, Glycine max
  Coding DNA Sequence Number=SeqID_42005
  Gene Ontology: Mol. function=zinc ion binding; Cellular component =nucleus; Biological process=regulation of transcription
  Homolog annotation: Hit_ID=Q9M4G1; Match level="QueryCoverage=99%, HitCoverage=100%, E-value=1e-49, Identity=40%"; Hit description=Dof zinc finger protein
  Pfam annotation: Domain name=zf-Dof; Domain location=68-130; Score =138.0; E_value=2.6e-38; Accession=PF02701.6; Description=Dof domain, zinc finger
  Subcellular localization annotation: CTP_CleavageSite=23; ConfidenceScore=5.04e-01
MVFSSIPVFVDPPNWQQQPNHPQASNNGGDNSQLLPPLPPHQPHVGGSVGSIRPGSMADRARLAKIPPPEAALKCPRCDSTNTKFCYFNNYSLSQPRHFCKTCRRYWTSGGALRNVPVGGGCRRNKKNKRSRSKSPASSEKQTLSGSTSATPSGGTTHELVGQLPQPPNLPFMASLQNLNRYAVGNMGLGLREIHGQNENMGFQIGNSSAAGGGMDQWRIQQVPFLNGFESTSAGSYPFQNEGIETPSGFGGDIATNSRVSQMPSVKMEESGALNLSRSTLNVSENNQYYSWTDMSGLASSSATHLL

SEQ ID NO: 158784 - protein, 68 aa, Glycine max
  Coding DNA Sequence Number=SeqID_42006
MQRVEKGGGGGGGACDARKMRAQIDNANTKLMILDVCAINVPAASYYHIRSTKIYRPDSRGEVSECSC

SEQ ID NO: 158785 - protein, 327 aa, Glycine max
  Coding DNA Sequence Number=SeqID_42007
  Homolog annotation: Hit_ID=Q6X7K1; Match level="QueryCoverage=48%, HitCoverage=73%, E-value=2e-39, Identity=47%"; Hit description =WUSCHEL-related homeobox 2
  Pfam annotation: Domain name=Homeobox; Domain location=102-163; Score= 58.6; E_value=2e-14; Accession=PF00046.19; Description=Homeobox domain
MFSEMFCTKNNTHVNPLYQLSTILFLPTYLLLYKKSECFTSHGNNSKSIVVITSNNKIKYSSGIGIDNRIVMESGNNNDEELDMEMEMGGSNVNGNGGVAGSSSRWNPTKEQISMLENLYKQGIKTPSAEEIQQITARLRAYGHIEGKNVFYWFQNHKARQRQKQKQETFAYFNRFLHTPQPFFSPPICPNAMCAPYYIPQAQGEIGFYHPHPKVLVPVGFRRSPSEKVVPTGMHQMQQRISDCCNSHYSNQETLDLFPLHPTGILEGKTTTTTDQVPSLASVSADSSTDTPSAAASPDHINEDHDHASPLNQPFFDFFTTSGQGSY

SEQ ID NO: 158786 - protein, 436 aa, Glycine max
  Coding DNA Sequence Number=SeqID_42008
  Gene Ontology: Mol. function=nucleotide binding; Cellular component =integral to membrane; Biological process=protein insertion into membrane
  Homolog annotation: Hit_ID=Q9FY06; Match level="QueryCoverage=75%, HitCoverage=77%, E-value=1e-148, Identity=79%"; Hit description =Inner membrane protein PPF-1, chloroplast precursor
  Pfam annotation: Domain name=60KD_IMP; Domain location=127-328; Score= 277.7; E_value=2.2e-80; Accession=PF02096.11; Description=60Kd inner membrane protein
  Subcellular localization annotation: CTP_CleavageSite=69; ConfidenceScore=5.08e-01
MGIIRKIFIPSSLIRYEKLNLPLHNLLQKASHPWRKRSFRLHRSSARRSPRSLATTSPTAPAEGLLYTLADAAVAADPAVAADTAASTTDAAVQKSGGWFGFISEAMEFVLKVLKDGLSAVHVPYAYGFAIILLTVIVKAATLPLTKQQVESTLAMQNLQPKIKAIQDRYAGNQVRDVVGCLPTLATIPVWIGLYQALSNVANEGLLTEGFLWIPSLGGPTTIAARQSGAGISWLFPFVDGHPPLGWQDTAAYLVLPILLVVSQYVSMEIMKPPQTDPSQKNQLLILKFLPLMIGYFSLSVPSGLTIYWFINNVLSTAQQVWLRKLGGAKPVVNENAGGIITAGRAKRSDSQLARNGERFKQLKEEEKKKKVSKALPVEEVQSLASVSASDDGSDTESDNKGQEDAEEAYASKVGEEVQNYSRERRSKRSKRKRAV

SEQ ID NO: 158787 - protein, 65 aa, Glycine max
  Coding DNA Sequence Number=SeqID_42009
  Subcellular localization annotation: CTP_CleavageSite=33; ConfidenceScore=5.07e-01
MTSIAQSNTYRLRKNCWNPEDLTVSIRGARRARARARPAELPSTSIAPTPASTSAGPFVPVQTDF

SEQ ID NO: 158788 - protein, 107 aa, Glycine max
  Coding DNA Sequence Number=SeqID_42010
MDKCLLKLQTKFREDLMVNEGWAAFLPRQLHASSRSFIKRLLAHSRYLLKDPNGQIMDMCLAKLQTKFREDPTVNEGCAAFLPSQLHVAFSRSFIKRLPPEASSWLL

SEQ ID NO: 158789 - protein, 99 aa, Glycine max
  Coding DNA Sequence Number=SeqID_42011
MLCLQENKAEALTKEVCFRIWGDYEVQWLDNPTVGYMGGSICGEKVRTLEEKRGLTKIPIGGVDMDYFNSFIDDMEVEDVPLVGLKYTWFRGNNSLANS

SEQ ID NO: 158790 - protein, 88 aa, Glycine max
  Coding DNA Sequence Number=SeqID_42012
MEKAMNKLEKWKDRNLSFGEPGLWCNTSIESQQNEKDLEAVHVRDYTTKDDLKELIGTTNTNKMHLPFSNPSLKNFIVKRAWLGVVVG

SEQ ID NO: 158791 - protein, 47 aa, Glycine max
  Coding DNA Sequence Number=SeqID_42013
MYNFKVDFEKTFRGVKPMKELRQKNPLALFSLPYCGVLAGWLEETSG

SEQ ID NO: 158792 - protein, 184 aa, Glycine max
  Coding DNA Sequence Number=SeqID_42014
MGRIKRILRLCRFEFFDKGEGRHKRIQAVSPLFFWKREKRDTKRIQAVYLKDQTIAYPPGLHISRATDIKMVVNKMYSKKASTSSYDGSDNAKHHDAIQVLCPIRNYHFGDVCFCFTKDAESYPFIQCFLKLLIIQYEGKYNLKKMTEDQMIAHVTQLHEAQQSKKDEEEVIATAAEKDNAAFV

SEQ ID NO: 158793 - protein, 50 aa, Glycine max
  Coding DNA Sequence Number=SeqID_42015
GVVAREGEEEGKLGKGEDGVGDKQSVEIKGLPLWVGEVPKFGVEVRGVVK

SEQ ID NO: 158794 - protein, 131 aa, Glycine max
  Coding DNA Sequence Number=SeqID_42016
  Subcellular localization annotation: CTP_CleavageSite=65; ConfidenceScore=5.59e-01
MAESLKKHKGSSSTTVVVGHHCHGPSGAPTTPIPPFLSSPRSSTLFSLDGQRQRSFSIGVGAITSFGYRKDDDGRVDSSSLLKDVLTKIRGLQTFMGDRFDAMDTHLDAMDARFDGMDTRITHLEEDMSFI

SEQ ID NO: 158795 - protein, 204 aa, Glycine max
  Coding DNA Sequence Number=SeqID_42017
  Homolog annotation: Hit_ID=Q47522; Match level="QueryCoverage=25%, HitCoverage=71%, E-value=1e-14, Identity=70%"; Hit description=LacZ protein
VPPVQLLTGWCVTAKAPPDISAGKCSGHAARRVPFAIQAAQLLGRAIGAGLFAITPAGERGMCCKAIKLENVSSSSSERTIVLLPPREWSLSTSWLHFRPASSSPAASPLSVAASSSLPPLHFLADAASSLSIPSTSRGGPVPAFVPFSEVGKPVVPAALMNRPTRGERRFAYWALAECILAYYVGTDEGVSEVLHVAGEKRLH

SEQ ID NO: 158796 - protein, 185 aa, Glycine max
  Coding DNA Sequence Number=SeqID_42018
  Homolog annotation: Hit_ID=Q1RWK5; Match level="QueryCoverage=16%, HitCoverage=23%, E-value=8e-08, Identity=73%"; Hit description=Zinc finger, RanBP2-type
MYGGPDPSIYRYNKTKALAGNWFCNYGAHNYAMGEERVAIGSESVRERKGYEVARKDTKEGRIALGLEVSKSKARNENRMVALGEQEEPGHSERKRGNELSERKTKNCLRKHVFSHSHVDVACFNWASLDNPKSQFFFYVPSFFHSHFHHRERGREKKHRKSCKAHSTTPSSMHCIPTMPTTCHG

SEQ ID NO: 158797 - protein, 234 aa, Glycine max
  Coding DNA Sequence Number=SeqID_42019
  Gene Ontology: Mol. function=protein kinase activity; Cellular component=integral to membrane; Biological process=cell division
  Homolog annotation: Hit_ID=Q35ED7; Match level="QueryCoverage=95%, HitCoverage=22%, E-value=4e-51, Identity=49%"; Hit description =Probable RND efflux transporter
MAGGGAVFTADRQMAVAGHAKAAPRRKRAPQPVLSPPAEQRAAPPHADAGDGDAGAGEFFPASDRPELLVSLALPASASQQATLRQVQRLEQIVSASRDVDHYSSYVGTGAIRFYLPMDVLLDDENSAQLVVVAKSLAARERLQRSLDAVLARDFSDITTRVAPLELGPPVGWPIRYRISGPDYRQVQQLAERLAAALGSSALTRDVNQTAGEPERVITLQVNQTGSARSRPLF

SEQ ID NO: 158798 - protein, 260 aa, Glycine max
  Coding DNA Sequence Number=SeqID_42020
  Homolog annotation: Hit_ID=Q1SKD7; Match level="QueryCoverage=68%, HitCoverage=45%, E-value=9e-11, Identity=26%"; Hit description =Ankyrin
EIAPKKLLSKRARKDTTEEGSSAASQADMEFDKHRFQSEKHQCRFEAIKSWSFLKERRVKLRGGEYVEFQEEISRRQWTQLAGPMAKYDPEIVMEFYANAWPTEEGVRDKRSWVWGQWIPFDEDTINQFLGLLLVLEEGQRCKFSQRRSQASGFDEEAISQQLCVPGDHTSQTPNGPRKVQQSTGVSGLDHGPLPVLWGFGKAVRSGTTVARGGPVATSCRCTAATSTVATISRVHLCSPAKDRAPDARTYAACDRPASG

SEQ ID NO: 158799 - protein, 193 aa, Glycine max
  Coding DNA Sequence Number=SeqID_42021
MTLLLSNVLPSDHNSDLPLPKCQLVYVILTRMTVHVAQVIADAIYLFASMAPTRHPLDPDKSNRALGFPALITGLCQSYGVPVTPSKYCTPRQAQGDAHQAADAPPPPRQADPARSLGVERYLQHLVRQQAANHHGRCRYMSVSTGSASVSRGRVLPLLHALLRSSLGLRSHGLETGPMPRQGADKSHVWMRI

SEQ ID NO: 158800 - protein, 266 aa, Glycine max
  Coding DNA Sequence Number=SeqID_42022
  Homolog annotation: Hit_ID=Q47522; Match level="QueryCoverage=18%, HitCoverage=59%, E-value=2e-21, Identity=97%"; Hit description=LacZ protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLNSMVDQNLHLVAWNRRYLELFNYPDGLISVGRPIADIIRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 158801 - protein, 116 aa, Glycine max
  Coding DNA Sequence Number=SeqID_42023
MRFNCPVFKRRIEKSDKMNFKEKKEKKGYITWEDNVINYSSDSKKKIISLGIMMKDYENGEEQSRYIDSNFSKHMACIKLEVGSGSYWKLEVGNESYWKLKVENGGWKLEGEVTKS

SEQ ID NO: 158802 - protein, 134 aa, Glycine max
  Coding DNA Sequence Number=SeqID_42024
MEIYQQQTPRSYCSSSILMQHKIVEFLFMKASKENATSFPSKKRNMKKGGNYNHTFSTYYRIYAKNLPGKTIFSFAGNFLADLEWKQPIMEEKHKERSFEIIIVIVAVKVAEVGFAAGGIIGNEEGFAAVIPER

SEQ ID NO: 158803 - protein, 287 aa, Glycine max
  Coding DNA Sequence Number=SeqID_42025
  Homolog annotation: Hit_ID=Q1SWX1; Match level="QueryCoverage=51%, HitCoverage=32%, E-value=4e-14, Identity=33%"; Hit description=IMP dehydrogenase/GMP reductase
MGQLQRQAFRKAYGKIWDLARVEVSMEPIASLSQYYDQPLRCFTFEDFQLVPTVKEFEEILGCPLGGRKPYLFSGFYPSMTRVAKYQGSVWRKGQRPWQIKANGLSFIDILALLIFGVVLFPNMEGLVDLAAIDAFLAFHHGKESPVVAILAMYDTFDRGCEKSGEGCPMRGVPSDESITPFIARGFSDHNARDRELRGSSNEIIGGYHKWLRVRTQGLDWLPNLKTVRDDEVKASEESDEVQALKAELERAWVVEEKFKAAIVSSSSEEVKGIITGQRHDLEGRAK

SEQ ID NO: 158804 - protein, 454 aa, Glycine max
  Coding DNA Sequence Number=SeqID_42026
  Homolog annotation: Hit_ID=Q9FJ58; Match level="QueryCoverage=92%, HitCoverage=80%, E-value=4e-65, Identity=38%"; Hit description =Arabidopsis thaliana genomic DNA, chromosome 5, P1 clone:MTE17
  Pfam annotation: Domain name=C2; Domain location=35-122; Score=31.2; E_value=3.5e-06; Accession=PF00168.20; Description=C2 domain
MDSFNQSHQTTSFRYNPNSNTMNHADDDAEFSGILDIYVHHARNIHNICMYDNQDVYAKFSLTYNPDETLSTSIINGGGKNPIFNENLRMKITQMDAVLKCEIWMFSRSRNHLEDQHLGFALVQISQVVGKGKVTEDYSLSSTDLFHCPPGTVKLTLSLDTSFSINSTVNPISQSATNSSISSEVVLLDPKISQDMSDPVEYSRIEFPDVSVTKENQKMVSEYFNLESYGSSASRPNSVGLLPFLHLGASPRGDDYEMTVTAPDENHESTSPYESIQKSVFPSSTTTSLSDERNTGDSVEEKNNLRDNTSNSFNVSITVEGCQNSGASPDTPTSKKETGARDEKESKFTSRKEKEINSDRNTEATRFGQVFSAPLGNINMEAEQSAMQQQIVDMYTRSMQQFTESLAKMKLPMDLDKPESEGQGDVVQNHNSNKLETDKKKDGSRVFYGSRAFF

SEQ ID NO: 158805 - protein, 110 aa, Glycine max
  Coding DNA Sequence Number=SeqID_42027
  Gene Ontology: Mol. function=oxidoreductase activity; Cellular component=vacuole; Biological process=hydrogen peroxide catabolic process
  Homolog annotation: Hit_ID=P22195; Match level="QueryCoverage=74%, HitCoverage=33%, E-value=9e-17, Identity=43%"; Hit description =Cationic peroxidase 1 precursor
  Pfam annotation: Domain name=peroxidase; Domain location=26-110; Score=-85.5; E_value=0.01; Accession=PF00141.13; Description =Peroxidase
MLQLISANKLRSDFYNSQCPQALEAIKAEITSAGCDASNLLKDTANFTGEQSAIPSLDSRNGTDIIEKVKARVEKLCPGVVSCADILAVAARDSVVAVSIEITVWIVAAG

SEQ ID NO: 158806 - protein, 218 aa, Glycine max
  Coding DNA Sequence Number=SeqID_42028
MAESTRSKSFDRLEEAIAKLATSHLHVSQKLDNLINRVTALESNPYSPSSSSTNPSHHTQTPSPHRLKLDVPRFDGSDPSGWVFKISRFFEYHGVPDSERLTAIEACFALSPYKDPTGQLFKLVQKGTVREYLSQFESLANRITGLSPSSLLSCFISGLEPDIRRELPQQTFLHSLTFNLASPFSGFSSLPISLTSFPAQTLSLTNPTSQPGGACQPP

SEQ ID NO: 158807 - protein, 152 aa, Glycine max
  Coding DNA Sequence Number=SeqID_42029
  Gene Ontology: Mol. function=zinc ion binding
  Homolog annotation: Hit_ID=Q1SL48; Match level="QueryCoverage=55%, HitCoverage=68%, E-value=4e-13, Identity=41%"; Hit description=Zinc finger, GRF-type
  Pfam annotation: Domain name=zf-GRF; Domain location=75-121; Score =11.4; E_value=0.0012; Accession=PF06839.3; Description=GRF zinc finger
  Subcellular localization annotation: CTP_CleavageSite=55; ConfidenceScore=5.63e-01
MFFLFFLTSHSSSFSSLTLLCIFFLPIHRTSSSSSSSCSNPIIFIVLFLKPYHPSLMESSGYSHNTGSGLNRHCVHCECNLYAPLATAWTDNNAGVRFFGCGNYKDLWRQVCNFFEWYDPSLNPHVKKIIIGLMRNLEEFKNIENELRTKHI

SEQ ID NO: 158808 - protein, 187 aa, Glycine max
  Coding DNA Sequence Number=SeqID_42030
  Gene Ontology: Mol. function=sucrose transporter activity; Cellular component=integral to plasma membrane; Biological process=sucrose transport
  Homolog annotation: Hit_ID=Q9XHL6; Match level="QueryCoverage=34%, HitCoverage=12%, E-value=2e-19, Identity=68%"; Hit description =Sucrose transport protein SUT1
MASCKNMDNSCNILKIEFNLQRPQQWLTLELIKFEGATCKEGRAKSEIQVPRFRGKELRRKMKLGRLQERKKYHKVFVLSGKPIVVGTGRSPSSGVAEHVVKVGSVANKEDGDGDGEGASGDEEVAVGKTGGATIVVVSHDDLDEHARDWAAEPDEGGPNGLVVMSYMNRRNVADIIFVIAMQAFLE

SEQ ID NO: 158809 - protein, 181 aa, Glycine max
  Coding DNA Sequence Number=SeqID_42031
MKMMGFEQEEDEDDEEEEEEHKDGEEERGDTLGVRALGLSMPPQNLTWLDDDTWLHNVTDMRVLGLRLDMIFLEDKKIRVNTPRFKGAIHVLANDHTHRHWVDREFKASKVKAHTIAMIIKRDAKIQDPLMVFLHRWIRGVSQTSDSFLLQHKLQTKGWNPHFIDNEHLVSEKLYVVPLYT

SEQ ID NO: 158810 - protein, 311 aa, Glycine max
  Coding DNA Sequence Number=SeqID_42032
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=74%, E-value=3e-76, Identity=51%"; Hit description =Integrase, catalytic region
  Pfam annotation: Domain name=Chromo; Domain location=219-270; Score =19.0; E_value=0.0056; Accession=PF00385.14; Description='chromo' (CHRromatin Organisation MOdifier
MPKSLVSDRDPLFLSHFWQKLFKLSGTKLCMSSAYHPQFDGQTEAMNRVVEQYLRAFVHQKPSSWGHYLIWAEWSYNTLTHSATGASKVEAVEEWLTQRDRMLTSLVKKLSKAQQHMKEIANQQCRDVSYKEGDQVLVKLRPRRQTSVSGGVHSKLAKRFYGPFSIIKKIGKVAYQLQLPTGSQIHPVFHCSLLKPYHPSTEVNPATLPILSKDNQPCITPLVILDTKWVSSPAGQNLMVLVQWTGLLPEDSSWESWEILKRDYNLEDKVVLEACKDVMNNESAEAGDAEYGTGTKRKSQKPRYLRDYVAK

SEQ ID NO: 158811 - protein, 117 aa, Glycine max
  Coding DNA Sequence Number=SeqID_42033
  Gene Ontology: Mol. function=transporter activity; Cellular component= cellular_component; Biological process=defense response to Gram -positive bacterium
  Homolog annotation: Hit_ID=P83434; Match level="QueryCoverage=74%, HitCoverage=96%, E-value=2e-35, Identity=77%"; Hit description =Nonspecific lipid-transfer protein 1
  Pfam annotation: Domain name=Tryp_alpha_amyl; Domain location=29-113; Score=106.7; E_value=7e-29; Accession=PF00234.12; Description =Protease inhibitorseed storageLTP f
MASFTKLACMVLACMVVMVAHNTVQGIRCGQVQGNLAPCLGFLQNGGAVSRGCCNGVRSIVNNARTTGDRRAVCNCLKIAAGAVRKLNPYNAQALPGKCGVNIPYKISTSTNCNSIK

SEQ ID NO: 158812 - protein, 37 aa, Glycine max
  Coding DNA Sequence Number=SeqID_42034
MASTCLWCVNRLNNVDHNSCKGDPSSMEKCLSPPGLL

SEQ ID NO: 158813 - protein, 486 aa, Glycine max
  Coding DNA Sequence Number=SeqID_42035
  Gene Ontology: Mol. function=nucleic acid binding
MVFSIKVHHRGHVVHSIWNYVGGDVTSLADIDVDKWSYFEFVGILKEDVKLKECEALKVYVEVFNGGGNEVVVAGNEGNEDAHGGNERASKSDEGDSGSEFEEERDVIEDSEEERAISVDDGIENNDELLGYETEELDSVGSESDDGDKHKLGGACTTYRIKTCRPKHKCGKAFKNKNATPKWVSKVTIESLRIRNDVKLTQIMDDAYGEELKVVCKGSKLAFKKSCRPIIGLDGCHLKSKYGGQIAVGRDPNDQYLPLAFVVVENETGFGEVAFGVAKIGEHFKSNRSWHTFERPNDVVAKATFKEVWEDKMLQLKEIKQDAYEWLMKTVDTNAWYAGVKPESFVHEYYSMKFDDICYSNEISTMNDQRMWKDSRNPASVLPPEYKRGAGRQKKLRRREPNEECPIPPPVVKEPPASNNGATTDASTIADRNQANGNQNATVANQGPFGSIPGPKTRKQMRPPIENVFLRKMCKLFAKTSASTAP

SEQ ID NO: 158814 - protein, 216 aa, Glycine max
  Coding DNA Sequence Number=SeqID_42036
  Subcellular localization annotation: CTP_CleavageSite=80; ConfidenceScore=5.38e-01
MAKRTSTEANENPKATSKALKNAYLTVLCSISLSPNRVVFKLPSTKNPRKSMNYTINVQSRKLSPSTPMDQEVYPSTTTRESAMSPQVYENPKRCCAASDSNENACNGAAEEVAIRIIEAGKQESDSSPSSLRGRGGELGGEEAVVGRSEILSYRWRMAEERVSLVSLDDGARDSSSSSSSSTYQRYDIQQVAKWIEHILSFSLLLLIVFICQHLQ

SEQ ID NO: 158815 - protein, 180 aa, Glycine max
  Coding DNA Sequence Number=SeqID_42037
  Gene Ontology: Mol. function=metal ion binding; Cellular component =integral to membrane
  Homolog annotation: Hit_ID=Q941Y7; Match level="QueryCoverage=80%, HitCoverage=54%, E-value=7e-19, Identity=40%"; Hit description=RING finger-like protein
MTPHARPRTQQRRPSTRHSDGNGGGGNGATVCNGRIQDYMFEESVCLLLRASWFTPLSVEEHVVHEDAYEDLEDYYQYEDDDDDDDMDEVYYGGSSSLRVIGNRRWGDNGYVRAGRQEARPVHRPNFQDSGASSSSHEPKKKEAGKIITGRRAKRAQKREAADKAAEAKHQQHLVRLGRK

SEQ ID NO: 158816 - protein, 91 aa, Glycine max
  Coding DNA Sequence Number=SeqID_42038
  Gene Ontology: Mol. function=transition metal ion binding
MSKNWVLKKHNKTFCDWFKDTIFVDENASETLRKLADGPKRNVITWQGYDINRYSFYTKAQDDKSTMQNNGVTLRVESQHFATTSVCAPMI

SEQ ID NO: 158817 - protein, 95 aa, Glycine max
  Coding DNA Sequence Number=SeqID_42039
MCFVRRASRRWRLERLMARRWRLLGGVGIGVKRKRVGMFIWVREKKGLVDEGKEPYFFIIALELFEVVKLNLESSHLVDDGIEVEVFHGSKLMKT

SEQ ID NO: 158818 - protein, 81 aa, Glycine max
  Coding DNA Sequence Number=SeqID_42040
MLEKFWKLAWRFESIARQKSWGLHLNGSWVDDPLVVKIEAMRFFLERFKEIEDIDIGLDGDRFNSIDEGDNGMLIETFQKK

SEQ ID NO: 158819 - protein, 439 aa, Glycine max
  Coding DNA Sequence Number=SeqID_42041
  Gene Ontology: Mol. function=DNA binding; Cellular component =chromatin; Biological process=DNA integration
  Pfam annotation: Domain name=rve; Domain location=1-97; Score=-11.8; E_value=0.058; Accession=PF00665.16; Description=Integrase core domain
  Pfam module annotation: Pfam domain module=RVT_2::rve; Domain location=165-348::1-97
MEYVIHFLMGLNESYSSIRDFLASQGTLHQFSCVERPQQNSVIERKHKHLLNVARALFFQSKVPITFWGECVVTTAFLINRLPSPLLKQNTQYQVLYGSALDYSILRSFDCLAFAATLNSERNKFSPRAVPFVFVGYPQGIKGYSELAIPLPIPESISSTIQPRAIDTNISEPNSSPDTNNLPVQLSDSTVKFKPDGIVDRHKARLVAKGYTQQASIDFSDTFSPIAKFTSVRVLLVVVAAKNWSTLQLDVDNSFLNGNLFEEVYMELPKGYNSVDKNLVCILNKSIYGLRQASRQWCFLGSLKYFLGLGIAKSSKGIVPTPRKYALSLLEDTGFLGCKPSSLPMDPNLKLSMLNGELLLDPLMYRRLLGSLMYLTISRPDITFDVNKLSQYMQNPRKPHLYVMHHLLQYIKGTLGQGLHFPTSNSFNLSAYADADWGG

SEQ ID NO: 158820 - protein, 205 aa, Glycine max
  Coding DNA Sequence Number=SeqID_42042
  Gene Ontology: Mol. function=RNA-directed DNA polymerase activity; Cellular component=exocyst; Biological process=RNA-dependent DNA replication
  Homolog annotation: Hit_ID=Q2MGR1; Match level="QueryCoverage=74%, HitCoverage=45%, E-value=3e-29, Identity=41%"; Hit description=RNA -directed DNA polymerase
MDLLKGGEGNVDENFVEVFQHMRIDVRCLEMLGSLFEIEKGSWLNYFELPNYVAGRSILDGVVAENELVDLVKRGKRSCFIFNIDFVKAYNSVNWEFLDYMMTHLSCFEELQRKWVKVVVCSSRMLVLVNESPMKEFVAEKGLKQGDPLVPFLFFIVAKGVHGLVSRSVKLGTFRLLKVDDEVSFSILQYVDDSILFGETSWDNL

SEQ ID NO: 158821 - protein, 130 aa, Glycine max
  Coding DNA Sequence Number=SeqID_42043
  Gene Ontology: Mol. function=transcription regulator activity; Cellular component=nucleus; Biological process=regulation of transcription
  Homolog annotation: Hit_ID=Q10LR1; Match level="QueryCoverage=91%, HitCoverage=75%, E-value=5e-29, Identity=53%"; Hit description=BHLH transcription factor bHLH033, putative, expressed
MDSRRRGKNASMQRKLQQLRSVNKASIIVDATRYIEELKQKVDGLNSELGTAESSISQDELPMVTVETLERGFLINVFSERNCPGMLGAILDAFEELGLDVLDARVSCEDTFQLEAVGGEVREYTRIYNV

SEQ ID NO: 158822 - protein, 505 aa, Glycine max
  Coding DNA Sequence Number=SeqID_42044
  Gene Ontology: Mol. function=RNA-directed DNA polymerase activity; Cellular component=intracellular; Biological process=RNA-dependent DNA replication
MMLQLAERSITRPYSVVEDVLVKVRQFTFSVDLVIMDIEEDSDIPLILGRPFMLTTKCVVDIGNGNLEMSVKDQKVTFNLVEAIKHPSDSKTSFKVKEIPSGEHAFEDLKKDSLTEKLKVELKALPTHLKYVFLDENEAKPTVISNDLSSDEEARLIEVLRKHNEAIRWHISDLKGISPPYYMHKIMMEKECRPVRQPQRRLNPSMKEEVQKEVLKLLEAGLIYPIFDNAWVSPVQVVPKKEGMIVIRNEKNDLIPTRTVTGWRMCIDYCKLNDATRKDHFLCHSWIRCWSVDPKEQEKTVFTCLFGVFAYRRMTFKLCNTPATFQWCMLAIFANMLEKCINVFMDDFSVFGPSFDCCLTNLELVLRRYVEAILVLNWKNCRFMVQEGIVLGHKISARGIEVDKAKIYVFEKLPLPINVKGIRSFLGYAGFYRRFIKDFSKIARPLNKLLNKDVVFKLDEECLTTFHTLKNSLVSAPIIGAPDWSKEFKLMCDASDYAVGAVLGQ

SEQ ID NO: 158823 - protein, 137 aa, Glycine max
  Coding DNA Sequence Number=SeqID_42045
MELKSPTSMAISTNQIASQTGGWVCGFHCLSSSIGARRWWDQLSFKIVVVILHPHKGSSIKTYKLTSMVYKVVCEVQNLGSLSVSGKLENGKRVKCWCYCMFRGGWLGRTKLLTSEGVGEDRVEAIGLEELLSGRHR

SEQ ID NO: 158824 - protein, 175 aa, Glycine max
  Coding DNA Sequence Number=SeqID_42046
MKIVAPNGVTLLLLVECQGSDFQRWLFHHSASTWWTSSLIHQSHPPKNVLTTTTTTTTTPYPTRWGRLHGSTSAIMFYQIYKHSRSSREALKSVEETVIRLEKLLQELHVSSSSFGKEHLKAACSDLEKIQKLWKEAKFLEASFRAKADSLQEVQLLTLTNLLDQFFGTIFYKKI

SEQ ID NO: 158825 - protein, 92 aa, Glycine max
  Coding DNA Sequence Number=SeqID_42047
  Gene Ontology: Mol. function=metal ion binding; Cellular component =integral to membrane
  Homolog annotation: Hit_ID=Q94CL1; Match level="QueryCoverage=55%, HitCoverage=26%, E-value=1e-10, Identity=50%"; Hit description=RING finger-like protein
MYHILLANCSVTCILHWATYREKVTCPQCKHPFEFLNVHRSLDGRPHVFNAYEKRERLDSNDKVVKFNIGGFIQNFSVISYINQLMAISFYQ

SEQ ID NO: 158826 - protein, 148 aa, Glycine max
  Coding DNA Sequence Number=SeqID_42048
MDDQIVRKDYITRIFGCVAPNNGGLALRADVDRRIRGMDKEREGENAIEGGFPLLEILRLRMYSLESSESLLSLTAKRGGALSLACALSKLPHLQLFLQVFASIFLQSTCNLLLFNPTDGLEEAPNRIQPTTRGDSTWDSSRFASETA

SEQ ID NO: 158827 - protein, 48 aa, Glycine max
  Coding DNA Sequence Number=SeqID_42049
MGYEAEYMKCHIEFADRRLRSLNRQGHIVSVRKLVRERISETEKHLAR

SEQ ID NO: 158828 - protein, 361 aa, Glycine max
  Coding DNA Sequence Number=SeqID_42050
GSMEDFVEGLHHNCPNLECAFLFQPCSYLPHLRPQHGQGLPDIWAHDEDGHGCGRHDFSADYPNSPAKAGLNQSHSRCSTTTTSHSSFFHLIFCRPVFFFSARAALPHATKPPPWLVSLGPKPSSTISLTANDDTRSIPISGDDTSGVGDDDDADTGVDDDYVVDINAAQGAWDLWSGALSARIPPYLLSATIVLSAKAFYDNERLNPHLLGTQQPTVLDGSIRKRYSLRELGKDPVAIQLNGCDGDTDDNNSNWLDLCGLGTHDGIANTENHNLNHCPIVVANLDNTNLNILFVVEGLTVRFQRRKSLSVVVGLDVSNGVTISGGWKSDVGDAEEVVDNDGEVGSLRGRRKDGSGGDGEQ

SEQ ID NO: 158829 - protein, 194 aa, Glycine max
  Coding DNA Sequence Number=SeqID_42051
MGCKYQYPKFLVLLQGRISYFAAENIINTKGTLSKHNEINNLDYKIDLTTSEKLYLMTLIMIIMPLLRSYNLPNKGRNLLCISKTFMHDLWGWWCMVRHCHGHHLLLWDKEEDREGGEKGRREGDEVHIDGGANFARELLESEHPIIRGATVRAHGGAALEVVLRLTGMMKCLSSTMGVENVGKKKREKMRIKG

SEQ ID NO: 158830 - protein, 143 aa, Glycine max
  Coding DNA Sequence Number=SeqID_42052
  Subcellular localization annotation: CTP_CleavageSite=32; ConfidenceScore=5.21e-01
MAAPPLPLSPSQPVPLLRMAAPPIPPLSLAVQASHRTNNLLNGCEKEPGMDKVKWGRNSRGVSTKGEALSRRIVNSSAQRKALGETLHLHICDVKLLLFWLALSSLTGNGEYALFLKKRKASDKRVVEENGGEDDGEKVVDNG

SEQ ID NO: 158831 - protein, 377 aa, Glycine max
  Coding DNA Sequence Number=SeqID_42053
  Homolog annotation: Hit_ID=Q10BI5; Match level="QueryCoverage=51%, HitCoverage=57%, E-value=1e-39, Identity=45%"; Hit description =Oxidoreductase, 2OG-Fe oxygenase family protein, putative, expressed
MGKVVNSNTESSLSESSSAVADCAVRKDNQVMVDGPLADTPDDNEGFIMFGSIRTSLNRKNEKKHSVPWFPGCTPFVDKHSEFTSSSNHLKSTPTTTTTKFSNSMLTTSNDKSPQGSNSWKNKSASVNRTYNSASNSNFDNELPQGSNFWKKKPASVNRPYNSPNNSNYDAVGNKLDASVGSPMSKPFDICFSGRRNPALIGATLPGDNEKSCIEMQEEKIKGGILRPGMVLLKNYITLDEQVEIVKVCRELGLGPGGFYQPGYANGAKLRLKMMCLGMDWNPQSYKYGKKRVIDGSKPPSIPYHFSQLVIRAIQEAHSIIKKENRVFKVEDELPSMTPDICIVNFYTNNGKLGLHQVSSFTSYTTMVCIFNARKNS

SEQ ID NO: 158832 - protein, 88 aa, Glycine max
  Coding DNA Sequence Number=SeqID_42054
MLSTSSSITLLACTLCGLRKNASSAWSMRQPRGGSHVAARGEKGKKENHFTIDYDFNVVAAAANGSKLTVLKSQSSHKIEARYELGRE

SEQ ID NO: 158833 - protein, 319 aa, Glycine max
  Coding DNA Sequence Number=SeqID_42055
  Gene Ontology: Mol. function=oxidoreductase activity; Cellular component=vacuole; Biological process=response to oxidative stress
  Homolog annotation: Hit_ID=Q40372; Match level="QueryCoverage=91%, HitCoverage=91%, E-value=1e-104, Identity=63%"; Hit description =Peroxidase precursor
  Pfam annotation: Domain name=peroxidase; Domain location=43-283; Score=459.6; E_value=4.1e-135; Accession=PF00141.13; Description =Peroxidase
MAFHKYFSFVLYVFVFAAFPTTAFSKLSHDYYDYTCPNALSTIRSVVEAAVQKERRMGASLLRLHFHDCFVNGCDGSILLDPSSTIDSEKNALPNFQSARGFEVVDEIKEAVDEACGKPVVSCADILAVAARDSVVALGGPSWKVRLGRRDSTTASREAANANIPAPFFSLSELINNFKSHGLNERDLVALSGGHTIGNARCATFRDHIYNDSNINPHFAKELKHICPREGGDSNLAPLDRSAARFDSAYFSDLVHKKGLLHSDQELFNGGSTDALVKIYSHNTKGFHKDFAKSMIKMGNIKPLTGNRGEIRLNCRRVN

SEQ ID NO: 158834 - protein, 55 aa, Glycine max
  Coding DNA Sequence Number=SeqID_42056
MTLVSACYRALSLTDSERVFIRITTWSLPEDADISGKGADDHIGLRVSIGLGVPE

SEQ ID NO: 158835 - protein, 142 aa, Glycine max
  Coding DNA Sequence Number=SeqID_42057
PFHCHSSSKKQRNPFDEEDPRPTSSNGAYISELDRSEFGITYLLAGLRPLRERTRAWDDESQNLTEGELTYLHVIDMSLLSGAIYKKRGEQLRSIFTMEHNRNLQRSNMLLIAKLTFVPMLYVFLICYHCTEHNKGKGAASM

SEQ ID NO: 158836 - protein, 109 aa, Glycine max
  Coding DNA Sequence Number=SeqID_42058
  Subcellular localization annotation: CTP_CleavageSite=34; ConfidenceScore=5.30e-01
MSSIGIWMSGVKAWVMVPSMHSLSHSPCTFQRINVASANNILKDGLRNPNESAMNKLKTSSSGDTKPAAPKWIEAKWFGDDTPLDNDTITTIRKKWASYFLKNTNIGRV

SEQ ID NO: 158837 - protein, 139 aa, Glycine max
  Coding DNA Sequence Number=SeqID_42059
  Gene Ontology: Mol. function=unfolded protein binding; Cellular component=chaperonin-containing T-complex; Biological process =cellular protein metabolic process
  Homolog annotation: Hit_ID=Q653F6; Match level="QueryCoverage=52%, HitCoverage=13%, E-value=5e-29, Identity=85%"; Hit description =Putative t-complex protein 1 theta chain
MRSQKTATSRPTFEVQNLNPSCLSLFLLHLQPWQGKPQLVSNINACTAVADVVRTTLDPRGMDKLIHDDKGTVTISNDGATIMKLLDIVHPAAKILADIAKSQDSEVTLTSLRSHAMPLLSGSFHFRFIQMLYTVELEF

SEQ ID NO: 158838 - protein, 163 aa, Glycine max
  Coding DNA Sequence Number=SeqID_42060
  Gene Ontology: Mol. function=nucleic acid binding; Biological process= DNA integration
  Homolog annotation: Hit_ID=Q1T010; Match level="QueryCoverage=99%, HitCoverage=12%, E-value=4e-35, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKVILEYQEVLEIVEKRYSLLAEDATKEQKVAYNENKKNDCKALCLIYQSVDNAHFEKIIGAKTSSEAWKILEKGNEGVEQLKKVCLQTMHRQFELMQIEENERVAEFFNHVFTLTNAMKSCGEKVTDLTIVEKVLHTLNPKFDHIVVVIEESRNLERLALED

SEQ ID NO: 158839 - protein, 50 aa, Glycine max
  Coding DNA Sequence Number=SeqID_42061
MRANIVKKGPEKEDIGINVILNPEKSNVLNHGHNWGGFFVMIHDMMKNYG

SEQ ID NO: 158840 - protein, 72 aa, Glycine max
  Coding DNA Sequence Number=SeqID_42062
MREWQWSNVDDGYVVGGGVSVDDNDSDDDVMSIVMMMATVVLVAMTMDKMTVVILVLTLGKDYCQYGEMTLF

SEQ ID NO: 158841 - protein, 259 aa, Glycine max
  Coding DNA Sequence Number=SeqID_42063
MPRMNEVDDVDDGHANRIDHDEGLWIMATPPRSPPQSDGQSEVTSKKSRQTTRLRSLTHRFVDQPRPMVNVDPATRRGSRPQKEKFHGYLGVVAQEKAKFDIPEAPKVKRKGNKCRMSLQNMASILKPGKNLQQLDRHLTRSFISRGRDDILNTAIGRPDHGGRVRAVGSGVTITQYYGRTSCTFNNSSTSISHQQLHEVLARLREDMSSQIREELRRSLGSPPIESDIQQLGARVSTKGSNVETNVHPSGEDDVDAIP

SEQ ID NO: 158842 - protein, 109 aa, Glycine max
  Coding DNA Sequence Number=SeqID_42064
MKSKFLFVFLFLGILNCEAQHFNAIPYDYLQLALRWPNSYCLTHEGGCREIVPQYVTISYLHPMRRGGADLQNCPSPFNMPNSTVSISPAFPYIYFVLFASFLHGNFPY

SEQ ID NO: 158843 - protein, 87 aa, Glycine max
  Coding DNA Sequence Number=SeqID_42065
MLVQDPSKGNDVDEIFNQARQLGALLKGLLISFRSLQGQLTLLELAAKDSRPNITHRTWRNIQHNRDIVNSTCTLVEVAPLNNFIVP

SEQ ID NO: 158844 - protein, 109 aa, Glycine max
  Coding DNA Sequence Number=SeqID_42066
MEDVLVKVDKFIFLVDFVIMDMEEHVEVPFILGRLFMMTTLALIDVNNGKLKIRVQDKELNFNIKVQRWEKYLGEQSRSIETPKRINLDKQKFKKNEDSCLAQPKSIVE

SEQ ID NO: 158845 - protein, 201 aa, Glycine max
  Coding DNA Sequence Number=SeqID_42067
  Homolog annotation: Hit_ID=Q94AG6; Match level="QueryCoverage=24%, HitCoverage=15%, E-value=3e-12, Identity=76%"; Hit description =Putative mitochondrial carrier protein
  Pfam annotation: Domain name=Mito_carr; Domain location=1-77; Score =17.6; E_value=8.6e-05; Accession=PF00153.17; Description =Mitochondrial carrier protein
VVTGAVTTPLDVVIKTRLMVQGSQNHYKGISDCVRTIVKEEGSHALFKGIGSETSVYPELANFFTFALSMLYYFGFMCKIYKHNYFILGSCCRESACYYIGAYLTNNVENSSYNISALATTDVENPGYYIGAYLANDVKNPSYNIGASATTVVENPGYYIGAYLAKDVENLGYNIGASATTVVETKVSTSNKWVAPYSKTM

SEQ ID NO: 158846 - protein, 253 aa, Glycine max
  Coding DNA Sequence Number=SeqID_42068
  Gene Ontology: Mol. function=protein serine/threonine kinase activity; Cellular component=cytoplasm; Biological process=protein amino acid phosphorylation
  Homolog annotation: Hit_ID=Q9FGC3; Match level="QueryCoverage=67%, HitCoverage=46%, E-value=1e-33, Identity=44%"; Hit description =Serine/threonine protein kinase-like
  Pfam annotation: Domain name=Pkinase_Tyr; Domain location=81-253; Score=-128.1; E_value=0.00013; Accession=PF07714.7; Description =Protein tyrosine kinase
MNTKLYLEALEIEEGSPRNQGSETLSSRANTYDSKIKNVPKLTRRKSTRIKEDLIPSLNSLVLHASLDTEFGYFKSSWKNFTLVEIQAATDDFSHGGYAEVYMGKLEDGNFVSIKRLTRGCREEMIADFLSELGIIVHVDHPNIARLIGYGVEGEMFLVLHLSPHGPREKLNWSIRYKIAMGIAKGLHYICMRGEVSEEVAKYKAISYPTLIAAPHMFVNAYKNVLAVVVEIDYSFPETNKVKEYIKLLALTF

SEQ ID NO: 158847 - protein, 48 aa, Glycine max
  Coding DNA Sequence Number=SeqID_42069
MFVFNSTLKGLDDIPQSKFKAVARWIAVKYFNDTRLLEPERLKAFRIQ

SEQ ID NO: 158848 - protein, 81 aa, Glycine max
  Coding DNA Sequence Number=SeqID_42070
MLGWMFLRWAVEHHTSTLRVAFVKRIRGGTCRTKDSNAQVFDEAKYKQTRLLQETFRVKQIEIASRLIQGQANKIKKKIRP

SEQ ID NO: 158849 - protein, 65 aa, Glycine max
  Coding DNA Sequence Number=SeqID_42071
MEEKKKKQLEETAKSGSTDTIIDPPSPIRRHVKWKMTRTKKTGQMTSEAAKEIADQIDSLEEQAS

SEQ ID NO: 158850 - protein, 565 aa, Glycine max
  Coding DNA Sequence Number=SeqID_42072
TPDGPRGHFHWRHLSPPWEGATFRCFPDQGSRKNGGDVRASPHVRCNLSVGSPSSLLVVAGYEWVQDDVPKYKSSLTSMASVVDLQRQVKLANLEDSCKMVVQACRSDDFPFLRHLNVAPSQLHSNSWAMVKAFEILCLFFNIQPGVPVFLFFFQMKLIGKIGWVSLNNVSKKLFEFDSNIFHHFKDQFFKVLATDDLLTLVERVNKAILEQLSASLDMRAILSLPSVNNPLAALDSKMPNLVGPKDGTVPPFIVTPATVEKGQPAGEVGLVVVVVEVTPTAGVDIPATSANAVTASTSTIATPLLSASVTTTNAPMISSPPSPASTVLVVVSPSSSSSPHVSLDHLYTSSDADSLWGANYKLKQKTSVDFVSAFDRNLIRSRGENGQRHQEALGKVSSLETEVAKWRATACTIWRQERPKVAIATITFVEAVRSNHQLSSKEEKKNLAGKVEGIAVKRDELAKASKEREANKELEEELTMYKKEAMEQHEKGFQKAIRKVEFFTKDLDLGLFDPFKDAKEGVLLKEEEIVVKEEATDDKQGEIFDGTGSKTLLMWRQDFGGLVK

SEQ ID NO: 158851 - protein, 184 aa, Glycine max
  Coding DNA Sequence Number=SeqID_42073
  Gene Ontology: Mol. function=RNA-directed DNA polymerase activity; Biological process=RNA-dependent DNA replication
MSVDEGPLIRALTIYQASLDEEFDIDQHDDTSDKGPKPIEELVKLQLGAKPGQCTQLSRDLTSHEYKHVDLFTWQPSEMPGIHPNIIYHELSICPQAKPVSQKKRKIREERHKAIREEADKLLNANFIREVKYSTWLINVIMVKKANVKWHANDEEIHQRQRQSMRNTGNKEESGKWSPSAPKL

SEQ ID NO: 158852 - protein, 183 aa, Glycine max
  Coding DNA Sequence Number=SeqID_42074
VNYQGVCQFPLLVNMCRIWDEDFRDRVAYYRSMGPMKNKKNGPQNQGKPYPTPPKQHGNRPNNQRTAATRFTGGSGHKKMHTILENFKGINPINQDDPMVVSIIIANFMVSKVLINDGSSIDILYWKTFQKLKVSLDIVHPHASPLFGFANTSYSTLIDRNIVNELGAIVSELHLKRKFPTLI

SEQ ID NO: 158853 - protein, 116 aa, Glycine max
  Coding DNA Sequence Number=SeqID_42075
  Homolog annotation: Hit_ID=Q6I583; Match level="QueryCoverage=34%, HitCoverage=16%, E-value=2e-11, Identity=64%"; Hit description =Putative peroxisomal Ca-dependent solute carrier
VSSRVAQGKNSKDELNEVQNPHNIKYNGTIQGDGTNCARIVPNSAVKFFSYEQASKFRIHTTLNTMEQFKRLPNCAITHLNACSQHMTILRKFGPPLQWNVVVLDIGIGHRYVVQP

SEQ ID NO: 158854 - protein, 139 aa, Glycine max
  Coding DNA Sequence Number=SeqID_42076
  Gene Ontology: Cellular component=mitochondrion
MAMVAESPESDSDNNSSKTNNPQTLNETAPFLDYALAQAQLYHKAFNDAVDSTIDTAKSRFSQIRSTSSAHFHQTLDSLDDLKSQYTAYEGLLFGKIKEGVVVAASHPVITCGATASLGLLSWLELLQIIGFRVRFYAF

SEQ ID NO: 158855 - protein, 112 aa, Glycine max
  Coding DNA Sequence Number=SeqID_42077
  Homolog annotation: Hit_ID=Q9XF61; Match level="QueryCoverage=41%, HitCoverage=9%, E-value=7e-12, Identity=70%"; Hit description =Protein disulfide-isomerase precursor
MKTGVKILHASGISGSIAYNWSRPNMKTGVKIIHASSCYSQRIRVSVAQWYLSFYKCRYDVYLLRYRSEHSILSSHDPPIILAKVDANEEKTKDLASQYDVKGLPTINILRN

SEQ ID NO: 158856 - protein, 978 aa, Glycine max
  Coding DNA Sequence Number=SeqID_42078
  Gene Ontology: Mol. function=RNA-directed DNA polymerase activity; Cellular component=nucleus; Biological process=RNA-dependent DNA replication
  Homolog annotation: Hit_ID=Q1T5K4; Match level="QueryCoverage=69%, HitCoverage=89%, E-value=1e-77, Identity=26%"; Hit description=RNA -directed DNA polymerase
MERERESRERNNGWERVRTRRERRVSARLRTTEGSRLTIRGSTTGQHYSYMQANWTDHKDVTSFYFTRFPEDATAEELWYHFKQTGDVQKKLDSMLFGGMKMFVNVPKYGRAKNEEIQTAEGGRVEGVTRNTQRTEQRKAPAKIGYTRYNSTSEVNLDIQLMDQQWLKEAWVGRLKNLAGFDSIEDENEIWWDSGHNISLKYIGDDMVLIKRNGIQNYVGRHTHQSTQLVAFFAFGMRSFKVESRLVGAGFIMLSGKTPAERMGSSQRGQVDGSITEFNNWIEELEVEKAPWVGKRFTWFRPNGATKSKLDRFLVSPEWLAKWPGILDCWLSDKSFKKMIADSWSSTPQSGWGGFVLKEKIKALKQKIKVWNKEQYGDTFSKFKKIKEELNKLEEVTADKQLEDSERALEKQLQQELWEAAQTHKSLLRQKAKSRWIKEGDCNSRYFHLLINSKQRSNCLNGVAVDGVWKDEPAVVKEEVRRFFSQRFQEKDFDGPTLDGISFKTINSQQNDMLVERFQEEEIKRVFYVNGVFPRGLNASFIALIPKVMDPQVLNDYRPISLIGCTYKILAKVLTNRMKKVVEDAKRCQKPCIVFKVDYEKAPSSEFLPQKGLGQGDPLSPLLFNIAAEGLSGIMSKAIDRGFYRGYLVGTNKVEISLLQYVDDTIFLGETTMENVRTIKAILRAFELASGLKINIAKSSCGAFGVVLRQVVDKLVKLQRNFLWGVVYDQTRLPGFNGRRYGETWARVLESKYGGWRSLLGEQRASTESLWWRDLKLVYQHPHQGQQMNRATLWKVGRGDKFKFWEDKWTGGDSQLPEKYRRLYTISDQQHQSIQQLGAFNEEGWEWPFQWRRLLFDSEIEMAVAFLQEVEGFRISPDSQDQWVWAAEPNGSYSARSAYRVIREGISGEGQGEGYKELWKLRAPSKVAMFAWRECKPLILPLQQNYPLMVGIGVLGEFGGGFPTSSETALPPTFSWSS

SEQ ID NO: 158857 - protein, 145 aa, Glycine max
  Coding DNA Sequence Number=SeqID_42079
  Homolog annotation: Hit_ID=Q1S7C5; Match level="QueryCoverage=24%, HitCoverage=3%, E-value=5e-08, Identity=72%"; Hit description =Integrase, catalytic region
MKVDLRQKQSQEEYRKQKVSERKAIVKVKAQPKVLRKWKSRSLLKRVTKGIAKFRDAVGSLLIRKYPSISRKSINEGYIVFEARIACEIFPCNKKHKSLKTNFSTSLAFHRLTVLGGEFIELEATTELLLTVGDVIEAKVEVDNS

SEQ ID NO: 158858 - protein, 49 aa, Glycine max
  Coding DNA Sequence Number=SeqID_42080
MAAPWRSLRNCGVGLTRPNPTRISSAKGDSEREHEQNSSLQCDQQQSPA

SEQ ID NO: 158859 - protein, 118 aa, Glycine max
  Coding DNA Sequence Number=SeqID_42081
  Gene Ontology: Mol. function=nucleic acid binding; Cellular component= mitochondrion; Biological process=DNA integration
MSAIFRYAICHIFMVDFWLSAMNRHPSLTTLVKRILRYLKGTLSRGLLLQLASMMKPLALYAFCDADWALDVDDRCSTSGAAIFLGSNLISWWSHKQKVTARSSIEAEYRSLAQTSIE

SEQ ID NO: 158860 - protein, 111 aa, Glycine max
  Coding DNA Sequence Number=SeqID_42082
MTFPHAIKHDRPCLAEKNLKVKPAKIFKNNHNRMTNITPMKDKMEIKGDRRTKCQGDPHTGRGCSDKGFCRGKRGLRQERGITRGGRQERGITRGSSRKRYHSTNLNVNMF

SEQ ID NO: 158861 - protein, 179 aa, Glycine max
  Coding DNA Sequence Number=SeqID_42083
MKLSTLLSWFLRDFDTVVWDREPNYGDIEAKAKQQQEKLEFDEQFNNLHAHLEPPLFDITSQPPQVMEDTLPPLALPNTLESLLKSFNDSILYNVKLMMQQRLPPNLVPLHQSIVQHQYAPIPQPPLPPPTTVVKPHPGVPVPMVPTSEAAIPNDPMPEPPPTPPKSPPPIPQPLSTEG

SEQ ID NO: 158862 - protein, 150 aa, Glycine max
  Coding DNA Sequence Number=SeqID_42084
MISTGCVGVVPLRERRLNRGEFRKFLHQKIPPWIGTCARIGVVNRARYWGSRVLSGGPLWLSGCPLLDRRQNGRVSDAGRKAQLMLGILISVVSGLLGFRPSRSQSNSVGIFFFLLCLTCPESPIAHIGRSNTIELPPLQAYFDPLVRKY

SEQ ID NO: 158863 - protein, 189 aa, Glycine max
  Coding DNA Sequence Number=SeqID_42085
  Homolog annotation: Hit_ID=Q1T283; Match level="QueryCoverage=61%, HitCoverage=56%, E-value=1e-08, Identity=29%"; Hit description =Nucleic acid-binding, OB-fold
MAPFTCACDKYNKEVVLRYRLEVMINQGNESTKFLLWDRECSELIGQSADAVNKLKIEDGDVDLNVSPQALDKLLGHELAFKIKVQPKFRNFVVLKCSADSSLINAVMDMLANAEVMFNANYLTLTIVKNIFKNGYPGFWFQSSAQHESQSLSVTADHDPLLRLPLTPTKRQAFQDCDDEPGTSQISPA

SEQ ID NO: 158864 - protein, 166 aa, Glycine max
  Coding DNA Sequence Number=SeqID_42086
  Subcellular localization annotation: CTP_CleavageSite=42; ConfidenceScore=5.02e-01
MEAMMSMKKIMEANAVIVAATSVVAKVNPMLPSSLKQMNHPTSNMVRKDLGSTDDPMMCKFKTSTPSCHMACLPNYTPPNVAHIPNEDVNNSTPILIKSQQPQSDPAHVSRPMEETHEIPHHDLADFEPCLGYAAEGQAVGGIPLENTSEGPQYHPQPQPSCSTAV

SEQ ID NO: 158865 - protein, 97 aa, Glycine max
  Coding DNA Sequence Number=SeqID_42087
MAKFDPDIVLEFYANVWPTEKGVRDMRSWVRGQWIPFDADALSQFLGDPLVLEEGQECEFSQRRNRADGEAGADHVHQYDHLDTDVDDVATQQCPAQ

SEQ ID NO: 158866 - protein, 88 aa, Glycine max
  Coding DNA Sequence Number=SeqID_42088
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=96%, HitCoverage=14%, E-value=1e-34, Identity=80%"; Hit description =Indole-3-acetic acid-amido synthetase GH3.5
ESLNSVYRQGRVSESIGPLEIKIVENGTFDKLMDFALSQGASINQYKTPRCVTYAPILDLLNSNVVSSYFSPKCPNWVPGHKDWCSLH

SEQ ID NO: 158867 - protein, 58 aa, Glycine max
  Coding DNA Sequence Number=SeqID_42089
MTVRLRDNSNCDILITVWEDYAIQLHDVIDKNLLLQEPLIVMLTLGKIKDATGVSGVG

SEQ ID NO: 158868 - protein, 78 aa, Glycine max
  Coding DNA Sequence Number=SeqID_42090
MYVVVVKQGQDHLGLPSGVKTKHERQKPIKVLKDERKRGWGHDRPIVALLCAKQAGNVAARQPRILCILQLSFTICLF

SEQ ID NO: 158869 - protein, 43 aa, Glycine max
  Coding DNA Sequence Number=SeqID_42091
MRNGHPPLSQGTGTPMQKNPKHGLCFDVLVDGTGERDYFFRVL

SEQ ID NO: 158870 - protein, 138 aa, Glycine max
  Coding DNA Sequence Number=SeqID_42092
  Homolog annotation: Hit_ID=Q50MK9; Match level="QueryCoverage=34%, HitCoverage=56%, E-value=5e-12, Identity=95%"; Hit description=Beta -galactosidase, putative
MESEAPEMDCLALLVYPLLSNLIRSPRNGVDCLALFVYPPPSNLIRRPMKCLSFMHPPPSNSCSPGDPLVLERPPPRWSSNSPYSESYYNSLAVVLQRRDWENTGVTQLNRLAAHPPFASWPLNDYHFPIALPNSCAA

SEQ ID NO: 158871 - protein, 115 aa, Glycine max
  Coding DNA Sequence Number=SeqID_42093
MSLEEAHHHRRPWIRAWRKKKMNEGRGREEHEILCSKRALKSKISGLILSPWAPKSILRLMRILRSSLASLAPIFLEPSIQCPCRVGLHHSLPLEKDLTLNPEVLETLGFFPQHL

SEQ ID NO: 158872 - protein, 116 aa, Glycine max
  Coding DNA Sequence Number=SeqID_42094
MGSDQAPSFEKRFYHVKVKKLELASMRELGQRMDQVRRQAFSKIHRIPRSILRPVAQMLHFQGFLVGIDHRRVRRNLWMPARRKEAIPFFRVLSFYGKNSKSGHNLRTRARSIEAK

SEQ ID NO: 158873 - protein, 171 aa, Glycine max
  Coding DNA Sequence Number=SeqID_42095
  Subcellular localization annotation: CTP_CleavageSite=3; ConfidenceScore=5.11e-01
AVHVSSIFESGAVFHDCLREDPQGNPPFSSFSGATRMLLLRVVHVSSTFEAAHVSSTFEFGAEFHDCLSADPQGNPPYSTFVRSTMNIEEKEGVETRVVITERQGGRNQCPIFAFLLSPMRGPLGPSRRFLQKAVASGGSNPARLGELGGKLLPYFAINRGRSEEEKGSAP

SEQ ID NO: 158874 - protein, 127 aa, Glycine max
  Coding DNA Sequence Number=SeqID_42096
APTDPKRIKVIPDWPTPPTPLIELVRNHALSWEDVNEKGVEGRSPEYEEPRDLRVLDRRLQEDWARAAKEGPEVLMNLRADFLSPWAKEVSLVIRGVCVAKLLLFKEVFSKKLLKEVFSKKLLKEAT

SEQ ID NO: 158875 - protein, 242 aa, Glycine max
  Coding DNA Sequence Number=SeqID_42097
  Homolog annotation: Hit_ID=UPI0000DC1A9E; Match level="QueryCoverage =93%, HitCoverage=96%, E-value=9e-07, Identity=26%"; Hit description =UPI0000DC1A9E related cluster
  Subcellular localization annotation: CTP_CleavageSite=46; ConfidenceScore=5.59e-01
PMNSLPSAVHVSSTIESGAPRIHCLALFANSPFSTFIRRPMNSLSSAVHVSSTIESGAPRIHCLALFANSPFSTFIRRPMNSLPSVFHVSSTIESGAPRIHCLALPMNSLPSAVHVSSTIESGAPRIHCLALFANSPFSTFIRRPMNSLPSAVHVSSTIESGAPRIHCLALFANSPFSTFIRRPMNSLPSVFHVSSTIESGAPRIHCLALFANSPFSTFIQRLMNSLPSAVHVSSVIKRGTS

SEQ ID NO: 158876 - protein, 94 aa, Glycine max
  Coding DNA Sequence Number=SeqID_42098
  Gene Ontology: Mol. function=chromatin binding; Cellular component =chromatin; Biological process=chromatin assembly or disassembly
  Homolog annotation: Hit_ID=Q1SAV4; Match level="QueryCoverage=63%, HitCoverage=15%, E-value=2e-18, Identity=73%"; Hit description =Integrase, catalytic region
MSINKVATLYAKWRGGKAPKWAPLEKRSTTTKIEVKPWDWGSPMMKSIEMSTQIPFGIDRGGPVKWNIPGGHLDEAQPCSISPEKQGTAKVTFV

SEQ ID NO: 158877 - protein, 112 aa, Glycine max
  Coding DNA Sequence Number=SeqID_42099
GNTGSNKDRRKSLKVYQSHTVRGEKVTSTQDFVGNQRERTTLGRGFLFLVYLVTILYCSDIVWSKDLSGCFFCFLPLFDLGQGLTFSPWVKVYDKLGFWLKACRTAGHDICQ

SEQ ID NO: 158878 - protein, 137 aa, Glycine max
  Coding DNA Sequence Number=SeqID_42100
FVDHVFFRVFRRFPQINVGGDSARIPFLEDAPASHASSSRRRVRACSPLKGWTYSPLKMRVCNPLKARTCSPLKVRACSPTKARACCPQKVRACSPLKYPRVARACIPLKVRTCSPLKERVLVPKGPPDAILSHKGI

SEQ ID NO: 158879 - protein, 160 aa, Glycine max
  Coding DNA Sequence Number=SeqID_42101
MAAQLIHDRVEMECLEGAWETLEGNTRCQFRGTIRFTTTSLVHPDELVRTLQRTVEWILPTPTPYRLVEPVQVIEVTSSEEDPEEDPEELPPEPVVDALEFLEGDEDPLPEVDLPRTSCRHPRQTLRRIVALERWRSVEALHHSRQLIGLVLYTFEGGCI

SEQ ID NO: 158880 - protein, 93 aa, Glycine max
  Coding DNA Sequence Number=SeqID_42102
MPQHNASHNHYMKVKGVSLGFSSLVIDYTALVIDYQRPNSNHTASGHENLKKALCNRLHRLVIDYQRPPQSSNSLFKPGNRLHPLVIDYQKLS

SEQ ID NO: 158881 - protein, 119 aa, Glycine max
  Coding DNA Sequence Number=SeqID_42103
MRIPFFTGQGSKRSKVVFRWGLSSWEPNLDIWGKTNLGDEVSVSGRTSTLFHKARVTRMIWKQHAKLVMATVRWALKHPVYGIVILRSRIYTDRPNVSKLCSFISSMNSSILISVHSGK

SEQ ID NO: 158882 - protein, 74 aa, Glycine max
  Coding DNA Sequence Number=SeqID_42104
  Homolog annotation: Hit_ID=Q1S175; Match level="QueryCoverage=96%, HitCoverage=20%, E-value=1e-25, Identity=73%"; Hit description=MtN19- related
DGRTLCTSTPKYGTGKEAGNEKGYLIGMSVCYPQPGSIKIHDGEILTLESRYKNEFRTGAMGHFYIYLAEELPQ

SEQ ID NO: 158883 - protein, 240 aa, Glycine max
  Coding DNA Sequence Number=SeqID_42105
YPELRRSEFLIGGYVGAKASLLSTAPLFVTMTQELVARGDTLRLSAPRHSVTPSVIDEQRPMWSSAPFPEMSAFSDGDFSSLTSYPELRRSCDVHPLYHPEAAGPMTSRDQVWSFCTLVSSRGDGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 158884 - protein, 83 aa, Glycine max
  Coding DNA Sequence Number=SeqID_42106
MVNVTTAAIMLVVMMVLEAIMVVVAVVGDHDSGCSGGHDNCDRNDHDSGISHGDDRFEIFKDVINYIFNIFDFLLRVVIFILT

SEQ ID NO: 158885 - protein, 76 aa, Glycine max
  Coding DNA Sequence Number=SeqID_42107
MTSKLQMLITFATIVCLRPTIYHNAQNSEENPDKGIWIEPVSRAEALIPDDVNLTRSGSLDTSYGDLDDATSSEGR

SEQ ID NO: 158886 - protein, 73 aa, Glycine max
  Coding DNA Sequence Number=SeqID_42108
MVRDSVPHTGTVGICEIIFTEREKELHQDSTSGGFNPFSVSLTFGNSIRAVRGKNWRNLREPLEMLLSLSEDT

SEQ ID NO: 158887 - protein, 107 aa, Glycine max
  Coding DNA Sequence Number=SeqID_42109
MGGIFSIWLWFSRLWFWLGNNIGNWGPGNCIIVMFVGWFSNVSRKVVGWCGKEDSAINCKAIKLLSEELKYVIFRIITNCWLLLGVSPPLNLYNDSFSNSALIETRL

SEQ ID NO: 158888 - protein, 70 aa, Glycine max
  Coding DNA Sequence Number=SeqID_42110
MLNPPGICESLKISEKNCFREENPSRGASVTLPRCFRGRFREGFPPFFIVLRSSTGKFPKSNFSIHSLYP

SEQ ID NO: 158889 - protein, 88 aa, Glycine max
  Coding DNA Sequence Number=SeqID_42111
MEVEWRRKRERRRHFKEKMSLEEAHHHRRPWIRAWRKKDMNEGRGREEHEILCSKRALKSKLWFSPLIQDQFEDSPLSVLRWHEACKA

SEQ ID NO: 158890 - protein, 79 aa, Glycine max
  Coding DNA Sequence Number=SeqID_42112
MDLKENCTYVMHNFKVLKNNGQYRVCDHQFKLVFIGVTIVADQFKPGLLVDVIGVVEEVVFRQVSGKGRRVVFKLEDLR

SEQ ID NO: 158891 - protein, 106 aa, Glycine max
  Coding DNA Sequence Number=SeqID_42113
MEGTSLVDLCFTCPPNGRTCMTSIVNTRKQKTLSFWITIDNLLASRKLTKKERQREGERGDKGEMRGQELYATKINCRIDKAIPVTELQVANCSGVLLGICSCFWG

SEQ ID NO: 158892 - protein, 128 aa, Glycine max
  Coding DNA Sequence Number=SeqID_42114
  Gene Ontology: Mol. function=protein disulfide oxidoreductase activity; Cellular component=chloroplast; Biological process =glycerol ether metabolic process
  Homolog annotation: Hit_ID=Q95AH9; Match level="QueryCoverage=80%, HitCoverage=57%, E-value=7e-46, Identity=79%"; Hit description =Putative thioredoxin m2
  Pfam annotation: Domain name=Redoxin; Domain location=16-128; Score= -1.2; E_value=0.005; Accession=PF08534.1; Description=Redoxin
  Pfam annotation: Domain name=Thioredoxin; Domain location=24-127; Score=160.0; E_value=6.1e-45; Accession=PF00085.10; Description =Thioredoxin
  Pfam module annotation: Pfam domain module=Redoxin::Thioredoxin; Domain location=16-128::24-127
MYAIGISNFNVEVIDEASMAFVLVVAPITDANWQSLVLESESAVLVEFWAPWCGPCRMIHPIIDELAKQYAGKLKCYKLNTDESPSTATRYGIRSIPTVMIFKSGEKKDTVIGAVPKSTLTTSIEKFV

SEQ ID NO: 158893 - protein, 208 aa, Glycine max
  Coding DNA Sequence Number=SeqID_42115
MSKAVSECVTRATKLNGHGEEWVCDPHCGAIKGGVKDGGVDDGGGGGFGGGGGRDLAVTTGVGSERQRPQLDGLEVAVDVGMVQGGGAGGVGGGCIEEGNGGNGGSGSDGGGGCAEGGNNDGGGGGGGGCAEGGNSGGSGSSSDGGGGYAEGGNSGGGSGGGCTGEGDGERWREIRVKCMEIRIHCGEVGHGCLEPVQAGVERVGICH

SEQ ID NO: 158894 - protein, 258 aa, Glycine max
  Coding DNA Sequence Number=SeqID_42116
  Gene Ontology: Mol. function=DNA binding; Biological process=DNA integration
  Homolog annotation: Hit_ID=Q1SS72; Match level="QueryCoverage=91%, HitCoverage=18%, E-value=5e-43, Identity=34%"; Hit description =Integrase, catalytic region
MPPYHFLRQFPNNRRRVPVNASNPLYIHSNESPSTILVLPPLLDDNYHCWSRAIKMSMLTKNKLGFIDVMIVEPPKNHAVLPLWEQDVWKELREHFSHVDLFRISEIQEEIFSQRQGDNSISKFYTALKTLWDELDVLNPLPVCTCNPKCSRGAIKKIEEEKNKNQVVRFLRGLNDQYSGVRSQLMLLDNLPNVNRVFALIAQQERQFANENASVPKALLVAGDDTLDSKRNQGSGNGWNNKYTSKKCSYSRILKTLL

SEQ ID NO: 158895 - protein, 86 aa, Glycine max
  Coding DNA Sequence Number=SeqID_42117
MDFLDAVSMASIWEESSAADYSGKVMREEVLERAVVRGGRGRGKVTVGDHVVDADDDVFDLRNEGVEAVLALLRVREWKRRLLFGE

SEQ ID NO: 158896 - protein, 412 aa, Glycine max
  Coding DNA Sequence Number=SeqID_42118
  Gene Ontology: Mol. function=DNA binding; Cellular component =chromatin; Biological process=DNA integration
  Homolog annotation: Hit_ID=Q1SS72; Match level="QueryCoverage=98%, HitCoverage=32%, E-value=1e-37, Identity=46%"; Hit description =Integrase, catalytic region
MEPFDYTPPQSELEAETRQNPLSNNHTADEVVTPHNLILVRQCSTTRIRKPSSYLQDYHCNLAAATAMPHQSLGKGNLYPLSQVLSYDRLTLSYQSFFMNITTTPKPIRYFEVIKHECWRVAMDQELEVLARNNTWVLVDKPPDKNIISCKRRNLYGFTARSIDFQAYQEMTFLKSIKFILGLEIARSSKGIVLNQRKYALELLSDSSILCCKAATTPMDTSIKLGAVIGKPLSDISSYRRLIGRLLYLTTTRLDITFALNQLSQFLSAQIVIKQLLTEYFAISKAHLHVAFSTQHQTLTSSQPTMTLTWPVALILENPLLDIVYTLVFYLTTTRLDITCALNQLSQFLSAQIVIKQFLTEYFAISKAHLHVAFSIQHQTLTNSQPTVTLNWPVALILENPLLDIVYTLVLL

SEQ ID NO: 158897 - protein, 123 aa, Glycine max
  Coding DNA Sequence Number=SeqID_42119
MVAGENVAKQQCHPNLHESGHAGAHDPHPSPCYAQGKVQPQNAQQLVDSLLIEARGLTPPLAKLTMLAFLQDQWMPQKLIDGILIEGNPLAPHPGAFVSNSLLCRPSVGIKIHDYLWVVLSRG

SEQ ID NO: 158898 - protein, 74 aa, Glycine max
  Coding DNA Sequence Number=SeqID_42120
VPVLPNWIQKRSSSSSILVQELDLRSDMDKWFCFSGGKKKGGGKKEEDTVGRLNSEMKKWEVKEILVGVGKVNE

SEQ ID NO: 158899 - protein, 279 aa, Glycine max
  Coding DNA Sequence Number=SeqID_42121
  Homolog annotation: Hit_ID=Q8LG37; Match level="QueryCoverage=43%, HitCoverage=84%, E-value=2e-46, Identity=74%"; Hit description=AtPH1- like protein
  Pfam annotation: Domain name=PH; Domain location=28-126; Score=80.5; E_value=5.4e-21; Accession=PF00169.19; Description=PH domain
MTSLWCVTIGMTDNATDYDSVEFWSNPERTGGWLTKQGEYIKTWHHRWFVLKQGKLFWFKDSTVTSASRPRDVVPVVTYLTVKGAKDILNKPNAFELSTRSNTMYFIANSKKEKEDWINSMAGAEGFVEIYFVFHKRSSFSSFSISAQVESNDGSTIVATHGESVTEALKTKEREVGMFQNEVAASQGIRIRRRPPSRPPLHYVGPFQFKLQNEGNTPRNILEEIVWNKDTEVSHAANERTGLPGLIAEVKKVSPSREVGGFSVMKMHQLLGGFDGMSV

SEQ ID NO: 158900 - protein, 1369 aa, Glycine max
  Coding DNA Sequence Number=SeqID_42122
  Gene Ontology: Mol. function=RNA-directed DNA polymerase activity; Cellular component=chromatin; Biological process=chromatin assembly or disassembly
  Pfam annotation: Domain name=DUF784; Domain location=95-199; Score= -14.9; E_value=0.00016; Accession=PF05617.2; Description=Arabidopsis thaliana protein of unknown function (DUF784)
  Pfam annotation: Domain name=RVP_2; Domain location=505-624; Score= -55.8; E_value=0.022; Accession=PF08284.2; Description=Retroviral aspartyl protease
  Pfam annotation: Domain name=rve; Domain location=1029-1152; Score= -6.3; E_value=0.02; Accession=PF00665.16; Description=Integrase core domain
  Pfam annotation: Domain name=zf-H2C2; Domain location=970-1011; Score= 30.7; E_value=5.3e-06; Accession=PF09337.1; Description=His(2)-Cys(2) zinc finger
  Pfam module annotation: Pfam domain module=DUF784::RVP_2::rve::zf -H2C2; Domain location=95-199::505-624::1029-1152::970-1011
MARLSNYLILVAFFVATTIATISATENETLSQCGKYMGAHCGKQVADKLRGSHIDTAISSDCCYKLLQTGYPCHTKYTLYVLLNRPELKHSNWTELFAKSDQIYHECDELTSPGSIEFVAKCTENLGNECGEQVYNKLIHDGRITKPCCQELVKNGLQCHTAMVKSLIRIPEMRNANATELMKKNSLIFNHCLHGSIEGLLWAEKMKQRGKLAIERMGDAGNTGSTSINGAERRRDQEKSGCCPQSQHRPNPSPTPSSQPPPSPASIHKMKLDVPRFDGMDPSGWIFKINQFFEYHDTPAYERLTIASFYMEGKALAWFQWMTNPTDALFKLTQKGTVSAYLSEFEELANHVISLPTPFLLQCFISGLSPDIRREEDKILDTRPSHRPRPPFLSTQPSFRNPPPSPKPPTPSIAHPPSVPLLALPPRPPPPAMKRLTSKEIASRRERGLCFTCDEKYHRGHRCVSRVFIFLAEGDDPPDADIEPHDPQPEPPDPISPHTPSVLNDPVQAQISLNSLAGHVTPETLRLVGVITDRQVVLLVDDGSTHNFIQEELVTQLGLPCQSTPPLRVMVGNGQNLECSCVCIEITVEIQSVQFLVDLHVLPIFGANIVLGGGTMMLISDCFPHHSFVAYTDAKTLLLKFEALFQPQHSLPPARSTDHHIHLLPQTTLVNVHPYWYPHFQKQKIELQDGTWRFCVDYRALNAATVKDKFPIPTIDELLDELGASSGIFGTRRLAVRGGACGLEGFYRRFIRGYGTIAAPLVKATTIDPFQWSPSAQTAFECLKEALSTAPVLALPDFSKPFTLETDASGVGMGVVLSQQGLPIAFFSKPFTSKLLRSLTYVRELCAITTAVRKWRQYLIGHHFTILTDHRSLKELLGQVIQTPEQHMYMARLMSYDYDIQYRSGASNQAADALSRLPDQQPSMAMLLSVPCLSFLKELCAQLDANEEYGQLRRNILLTPHNYSDFSEFHATPTGGHAGVTKTTARLTENFYWPRLRDDVARFVANCRDCQVTKYEAKKTAGLLCPLPIPYWSWDDLSLDFIVGLSAYKGHTVILVVVDRFSKDIYLGMLPTAHTANMVASLFMNNVVKLHGFPRSLSDGQTEMLNRVIEQYLRAFVHSRQGTWGKYLPWVEWSHNSAWSTSTGSTLYEITYGRKPFTFPEYLAETSKIDAVDALLVDRKMTFQAIRKKLAKAQESMKKYADAKRRDVVYQPNDWVQVKLRPYRQSTAKSSATQGTKIHSVFHCSLLKPFTRPPTQPECPALPRQFVDGQPVITPLAILSCHEIPGSTPVAWKVLVQCHGLSPDETSWENWSQLCQDYHLQDKVNFRGAEDVMSKPRMPETQEAPASMVQRGEGTKRRVVKPVYLADYV

SEQ ID NO: 158901 - protein, 105 aa, Glycine max
  Coding DNA Sequence Number=SeqID_42123
MAETLSPNPKKVLHFVFLLKASGGGEDLEGRPRGRIQKAASSRAQPEKMQFQQNVKNPISVVSVYVRARAKVSSSTRVNHRRGFGGSGNGMSRFVGCGSVPGVGR

SEQ ID NO: 158902 - protein, 69 aa, Glycine max
  Coding DNA Sequence Number=SeqID_42124
MPLRGRIVSTSTRADEGRYGGHEGVDDNDEHKQDDAGLAFLDGTLILTNMDGEELPSSVNSNVDKRYYA

SEQ ID NO: 158903 - protein, 303 aa, Glycine max
  Coding DNA Sequence Number=SeqID_42125
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=9e-40, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HLQRTTRPTPSEWLHALTFRGLHVLAFRWHHALTFRGLQVLAFRGLHALTFNGLHVLAFRGLHVLAFRGLHGLTFRGLHVLTLIGLDALAFTGLHAVTFRGLHVLAFRGLHVLAFKGPLALPIRGLDALTFRGLHILAFRGLHMLAFRGPHVLAFRGLHVLAFRGLHVLPSKDYMSSRLEGYTSLPLEGLHALAFRGLHVLAIRGVHALTFIGLHVLSFRGLHVLSFRGLDALTFKRLHVLAFRGLHALTIRGLHVLAYRGLHVLTFRGLHALAFRGLHVLAFRGHHTLTFRGLHVFAFRGLH

SEQ ID NO: 158904 - protein, 113 aa, Glycine max
  Coding DNA Sequence Number=SeqID_42126
  Homolog annotation: Hit_ID=Q1SXA8; Match level="QueryCoverage=34%, HitCoverage=2%, E-value=9e-07, Identity=64%"; Hit description=Zinc finger, CCHC-type; Polynucleotidyl transferase, Ribonuclease H fold
KLVELLKGKSTIGAKWVFRNKVDETSKVMRNKARLVAKGYSQQEGLGSSSSMESFASRRSMVAEWRRKKDDWRRHFKEKMSQEQAHHHWNGNWSDSKVLDSTGLSCRTITRNR

SEQ ID NO: 158905 - protein, 169 aa, Glycine max
  Coding DNA Sequence Number=SeqID_42127
  Gene Ontology: Mol. function=nucleotide binding
  Homolog annotation: Hit_ID=Q6Z341; Match level="QueryCoverage=85%, HitCoverage=28%, E-value=9e-55, Identity=67%"; Hit description =Putative auxin-independent growth promoter
  Pfam annotation: Domain name=DUF246; Domain location=14-169; Score= -50.4; E_value=1e-11; Accession=PF03138.5; Description=Plant protein family
MSSNARDELGFVFIIFQNAGRAVSIRSFITSLRGEVQMMKILPPKVKKRVELGLLYSMPPISWSNISYYENKVIPLLLKHKVIQLNRTDARLANNGLPGEIQKLRCRVNFNALRFTTQIEELGRMMVKVLREKWPFLALHLRYEMDMLAFSGCAHDCYSKEEEELTRMR

SEQ ID NO: 158906 - protein, 93 aa, Glycine max
  Coding DNA Sequence Number=SeqID_42128
MMIHHRGTDLANGAQAKVGKILATKLITGGEEGAKPIRNLARGHNPAPPTLAKPTTGKNHEVDRGAKFQPTACQDLATGQNRPPGTWKNLSNG

SEQ ID NO: 158907 - protein, 192 aa, Glycine max
  Coding DNA Sequence Number=SeqID_42129
  Homolog annotation: Hit_ID=Q9AVH2; Match level="QueryCoverage=24%, HitCoverage=16%, E-value=6e-20, Identity=97%"; Hit description =Putative senescence-associated protein
MTEGCGERVLPCKPSRFSMCPVVGFGPWLGLGKPLVEILPPGQLRGFCPLLAWLGSAVLGYGPVLSFGLGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 158908 - protein, 164 aa, Glycine max
  Coding DNA Sequence Number=SeqID_42130
NSGMSDNRHKNKNPPSISEQSLPPITFTDRDFNGINPVKQDDPMVVSIIIANFMVSKVFIDQGNSTDILKTLNELGAIVSMPHLKMKFPTLIGEIVTVKVDQKQARKYYVESLKVAPYPPPRELAKPHPIATEGTQVMSVDEGPPIQALSVYQANLDDEFDVDP

SEQ ID NO: 158909 - protein, 915 aa, Glycine max
  Coding DNA Sequence Number=SeqID_42131
MESLALSFLLITLFLFTIISLNSFSSYASQLTYTDHCASMVPNSNPNESKFKDFPHGRFQVGYYLGGDKIVGADTFQKLRQKQVTLRIKSVYETDVFGIHKVGATLLVTTASSYYRVGNFTRGKRLKNRKRFPSSIMFSLDGFWSEYSGKICMVGTGSGYNMQLLEVVLKLYNVVNSSNTISTLAIGSLESLSSKNEVSYFEPISLFIFPRVDYEYSLDTIEAKTEFSNEGEVVLGLSINPVSFCANIFPMINGKYDLQYQSECNSAKYCSPVNGKYDFQLPYIVSLKELVCLDVKQRVRVLIGFRNSGDRWSFNPNTTLVGEGWWDEEKNQLSIVGCHFLGMEKSMTSVYVGDCSTRMILRFPKIWSIKDASSIVGQIWSNKTVGDSGYFKRMVLRKFEDQRVQISGTKYEYSQLDKVRKVSPRHEQLKNKGIRYPDVYSSDMRFDISVRISKRRVAWGYSVPLVVNDQIQQLNLEETFHSNSSNTLPSISPNSSSTGLYNVSYKINIKLLPNVKLGEEKSMLNTTTNVTEPVNVSAEGIYDAEAGILCMVGCRNLGSKNQIPSSNSLDCEVIVKFQFPPLDAKNNGGYIKGSIESVRKNSDPLYFKQLDVISAAFYTAEASQISKKVDMEVIMILLCTTLACVFVGLQLYHVKRNPDMLPLISFVMSLILTLGNMVPLVLNFESLFAQNHDKKRILLGSEWLEVNEIAVRLIVMVAFLLQFRLLQLTWSARKVYTKQKDLWIAEKKVLYVILTLYAAGFLIALLVHQSNTLQGDVVYSSSLSQQHSLWEDLKSFSGLVLDGFLLPQILLNLFMNSKGNALSCSFYFGISLVRLIPHAYDLFEALVYVDGSSLYEDEIADYYSTAWDIIIPLVSLMFAAIIHLQQQFGGCSILSWRINTKGVEEYKKVPVVTEA

SEQ ID NO: 158910 - protein, 97 aa, Glycine max
  Coding DNA Sequence Number=SeqID_42132
MKILNDSLTTVLKVTRLCPWKSWDRLLKNKAKVEKHINVAIFISRTSWVQKVEKHIKVAIYLKNFMGSAKVEEDTEAAIFYSKKLPFLSDFYVKRQG

SEQ ID NO: 158911 - protein, 49 aa, Glycine max
  Coding DNA Sequence Number=SeqID_42133
MALGTMAAFPGELMLHPKGSKDKDTNFILAILLFDRVTGENQGSETEKT

SEQ ID NO: 158912 - protein, 140 aa, Glycine max
  Coding DNA Sequence Number=SeqID_42134
  Homolog annotation: Hit_ID=Q9C920; Match level="QueryCoverage=26%, HitCoverage=12%, E-value=3e-11, Identity=91%"; Hit description =Putative deoxyoctulonosic acid synthetase; 116195-114393
MVALVLISLLIIIKINEAKLWMEHRRRKSTHTAKEDSNLKKNKRVMGRVEGKGVDLDHGLAQDLNERLSLKARGSESGGYDAHDPAPKLAESAIATPATMPWIIHAFAVFEEPNDDVEEEDDDDDDGEEQIAMTQTRGIS

SEQ ID NO: 158913 - protein, 71 aa, Glycine max
  Coding DNA Sequence Number=SeqID_42135
  Subcellular localization annotation: CTP_CleavageSite=51; ConfidenceScore=5.36e-01
MATLFDSLAVVRLPTAARRTSVMLPHCAGLRLRPAAASRLVASPARRIASRAARVACEAQDTAVEVPIKYM

SEQ ID NO: 158914 - protein, 74 aa, Glycine max
  Coding DNA Sequence Number=SeqID_42136
MAESSKKLKGTSSTTAAASHHRHRPSEAPTAPIPPSLLPSQGAPFEGTIVDDWKFNYSSHDARHMVCNDQADMT

SEQ ID NO: 158915 - protein, 294 aa, Glycine max
  Coding DNA Sequence Number=SeqID_42137
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6DB91; Match level="QueryCoverage=89%, HitCoverage=59%, E-value=6e-68, Identity=53%"; Hit description =Sensor protein
  Pfam annotation: Domain name=HAMP; Domain location=10-78; Score=30.1; E_value=7.7e-06; Accession=PF00672.15; Description=HAMP domain
  Pfam annotation: Domain name=HATPase_c; Domain location=193-294; Score=94.0; E_value=4.6e-25; Accession=PF02518.16; Description =Histidine kinase-, DNA gyrase B-, and HSP90-like ATPase
  Pfam annotation: Domain name=HisKA; Domain location=82-148; Score =53.8; E_value=5.7e-13; Accession=PF00512.15; Description=His Kinase A (phosphoacceptor) domain
  Pfam module annotation: Pfam domain module=HAMP::HATPase_c::HisKA; Domain location=10-78::193-294::82-148
MTRDLALSSLLPWLVAMPLMLLLLLALVWFELRPLKRLTASLQQRAPDDATPLTPQRLPLEVKPLVAALNGLFARMAQLVQRERRFTSDAAHELRSPLAALRVQSEVIQLAGDDEAMRNHALQQLDSGILRATRLVDQLLTLSRVEADDLRSEFQPVPLAPLLHQLVTEHQAQAAAQHTRLTLTADAEPVMIGHPLLLGLLLRNLLDNALRYTPSGSEIQLRLSARRLEVVDNGPGVSADQLTRLGERFWRPPGQAQTGSGLGLSIVKNVAQLHGIRLTFSAVQPQGLRVTLSW

SEQ ID NO: 158916 - protein, 97 aa, Glycine max
  Coding DNA Sequence Number=SeqID_42138
MKNREGFFRKKVFRKIFGRTVLPEVTKGHPEEHFFRKSSGTPSSGNFPEEVVLPENFRKKGTFGCPLNIPEELSGRATSSGKFPEELLLPKVCLFFF

SEQ ID NO: 158917 - protein, 148 aa, Glycine max
  Coding DNA Sequence Number=SeqID_42139
MERVMMGHLGDCAKGAKDSELDVTLASNAKNELLDVHTRVHIDDDDPHKWLTRLGHKEGNGLLLVLGAWWPAMSLLRRWGWEKEILLGLVCTNKWWCMVGALRGGVSVVSQNDVELEVKEEFWVWENAKELFVIVTQRCMELEKDKDM

SEQ ID NO: 158918 - protein, 40 aa, Glycine max
  Coding DNA Sequence Number=SeqID_42140
MNNFYVKSQEHDGLRKRITQDHQTYLRKMTISESFTVGSS

SEQ ID NO: 158919 - protein, 94 aa, Glycine max
  Coding DNA Sequence Number=SeqID_42141
MAMSPNTNTHRNVMRKIHWTQAYMQYDTIFSVKNLVGRLGVHDRTCLTMGRPIKVTLFCKNTPTMWDRHRLKGTLKSGDPQGLYSEESVRASPS

SEQ ID NO: 158920 - protein, 313 aa, Glycine max
  Coding DNA Sequence Number=SeqID_42142
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-51, Identity=30%"; Hit description= UPI00006A17C9 related cluster
SEGCTPFLFIRLHALTFRGLHVLTFRRLHALAFRGLHILAIKGLHVLAFRGLHALASRGLHVLTFRGLHVLTFKGLHALTFRGLHTLSFRGLHVLAYIGLHALTFRGLHALAFRRLHILRFRGLHVLDFRGLHTLTFRGLHVFAFRGLHVLTFKGLHVLTFRGLHVLAFRGLHVLTFRGLHALTFRGLDFLPFRRLHVLTFIGLHALTFRGLHVHAFRGLHALAFKGLHALAIIGLHVLTFRGLHVLAFRGLHVLAFRGLHTLAFRGLHALTFRGLHALAFKGLHALAFRGRHALDFRGLHALAFRGLCVLTF

SEQ ID NO: 158921 - protein, 56 aa, Glycine max
  Coding DNA Sequence Number=SeqID_42143
DSKKPLYMGCKNSLTLLLVVLSLVNVKARYGKILCPMGMEYQKIHACPNDCILYKH

SEQ ID NO: 158922 - protein, 91 aa, Glycine max
  Coding DNA Sequence Number=SeqID_42144
GNPKREKKNNYLRNLILVTSNIRDPPFVLHSKAIFNKPVAAHEGVKLVMLVAHHLNHCEGVNVVKMLYHLLAREGVKLCSEERRRWRVLLR

SEQ ID NO: 158923 - protein, 360 aa, Glycine max
  Coding DNA Sequence Number=SeqID_42145
  Gene Ontology: Mol. function=DNA binding; Cellular component=nucleus; Biological process=regulation of transcription
  Homolog annotation: Hit_ID=UPI00000529F6; Match level="QueryCoverage =97%, HitCoverage=25%, E-value=1e-41, Identity=33%"; Hit description =transcription factor
  Pfam annotation: Domain name=JmjN; Domain location=175-219; Score =93.5; E_value=6.3e-25; Accession=PF02375.7; Description=jmjN domain
MEADYGKDCTKSENRENLSVPPGFTSLTSFILKRDGNVKKSDKSTAFQIASEQEPIFMETIPEMNDISAYRQVLMHRPWIIADQSNHHKLEESHIKHLPMVKLGILHFFWCELGNISLLTLVEYTHPNTYMCDPPLNDGRPKGIIHGCPNCSNCVKVTARWHPEDAIREVLEEAPTFHPTEEEFKDTLKYIASIRSRAEPYGMCRIVPPTCWKPPCSLEKKNIWEKSEFVAQIQRIDGHQLQHAQEIMASASGNTKTKRKRDVKVALDSQLGNRNTSTPNNQNVQKCDCESEPGPKFSLKTLKKYADIFKSQYFDYKDKKKIIGSNIKLAIHQQWEPSVENIEGEYGRIVQNPTEEIKVY

SEQ ID NO: 158924 - protein, 97 aa, Glycine max
  Coding DNA Sequence Number=SeqID_42146
MAPRKLSTKRSRRDAAAEGTSAAPEFDSHRFRSAEHQQRFEAIKGWSFHRERRIQLRDDEYADFQEEIARRRWTSLVTPMANDYYIIILPLFGFQHG

SEQ ID NO: 158925 - protein, 567 aa, Glycine max
  Coding DNA Sequence Number=SeqID_42147
  Gene Ontology: Mol. function=acyltransferase activity; Cellular component=integral to membrane
  Homolog annotation: Hit_ID=Q8VWP9; Match level="QueryCoverage=98%, HitCoverage=98%, E-value=0.0, Identity=80%"; Hit description =Fiddlehead-like protein
  Pfam annotation: Domain name=ACP_syn_III_C; Domain location=458-542; Score=19.1; E_value=1.5e-07; Accession=PF08541.1; Description=3 -Oxoacyl-[acyl-carrier-protein (ACP)
  Pfam annotation: Domain name=Chal_sti_synt_C; Domain location=401 -544; Score=4.1; E_value=0.0008; Accession=PF02797.6; Description =Chalcone and stilbene synthases, C-te
  Pfam annotation: Domain name=FAE1_CUT1_RppA; Domain location=114-436; Score=672.0; E_value=4.6e-199; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=458-542::401-544::114-436
MANERDLFSAEIVNRGIESSGPNAGSLTFSVRVRRRLPDFLQSVNLKYVKLGYHYLINHGIYLFTIPVLLVVFSAEVGSLSKEDLWKKLWEDARYDLATVLASFGVFVFTLSVYFMSRPRPIYLIDFACYKPDDELKVSREQLMEVARKSGKFDEASLEFQKRMLMSSGIGDETYIPKAVVASTENTATMKEGRGEASMVMFGALDELFEKSRVRPKDVGVLVVNCSIFNPTPSLSAMIINHYKMRGNILSYNLGGMGCSAGIIGVDLAKDILQANPNNYAVVVSTEMVGYNWYQGKDRSMLIPNSFFRMGCSAVLLSNRRRDYSRAKYRLEHIVRTHKGADDRSFRVDILVPSSNRYLMTQQTNQIPPSNITEMELAKCVYQEEDEQKLKGLKISKDLIEIGGDALKTNITTLGPLVLPFSEQLLFFATLVWRHLFGSKNGGNSPSMKKPYIPDYKLAFEHFCVHAASKTILDELQRNLELSDKNIEASRMTLHRFGNTSSSSIWYELAYMEAKESVRRGDRVWQLAFGSGFKCNSVVWRAMRRVTKPSRNPWLDCINRYPAPLNN

SEQ ID NO: 158926 - protein, 373 aa, Glycine max
  Coding DNA Sequence Number=SeqID_42148
MELDRLSKLEEPPLSGACIRGLVKQLTTSRTKDFMNPKYQNCVVNGGVSHGQNSTKHGKVADTRQAQQSSQPQQQKKQVRRRLHTSRPYQERLLNMAEARREIVTALKFHRAAMKEASEQKQQQAQEQQQRPSVSLQPSQFPSFDQDGKFKSRRNPRIYPACTTKFSSYMDMDDLSQPPPLVPNSYTWPAASPITPPPLMAENPNFVLPNQTLGLNLNLQDFNNLDATLHLNNSSSSSSYSSATSSSPPQELPSVGISQGEGFSSLVDTIESNAATQVTGGLHTAMDDEGMAEMRSLGEQYQMEWNDTMNLVKSACWFKYLKNMEHRAHEANTVDVAYNNFDQLLEFPAWLNANESCLEQCSVDYFQESSLPW

SEQ ID NO: 158927 - protein, 418 aa, Glycine max
  Coding DNA Sequence Number=SeqID_42149
  Gene Ontology: Mol. function=structural molecule activity; Cellular component=intermediate filament; Biological process=chitin metabolic process
  Homolog annotation: Hit_ID=UPI00006A17C9; Match level="QueryCoverage =99%, HitCoverage=100%, E-value=6e-49, Identity=31%"; Hit description= UPI00006A17C9 related cluster
MHVLTFRGLRTLTFRGLHILTFKGVHALTIRGLHVLPFRVLHALTFTVLYALTFRGLHVLTFKALRARNFRGLHVLTLIGLHAVTFKRLHALDFRGLHSFTIIGLHVVTFRGLRAFTFRGLHVLTFIRLHVLTFRGLHVLAFRGLHPLTFIGLHVLTFRGLRALTFKGLHVVTLKGLPALTFRGLHVLTFSGLRALTIRRLHMLTFRMLHALTFKGLHFLTFRGLHALTFRGLHVLTFRALRALTFRGLHVLTLRGLHALTFKGLHVLAFRGMHALAFRGLHVLTFRALRALTIRGLHFLTFRGLNALTFGGLHVLTFSGLHALTFRGVHVLAFRGLHALTFRGLHVFTFRGLRTPTFRGLHILTFIGLHALNFRGLHVLAFRDLHAFTLRGLHVLTFRGLRALTFRGLHILALRGLH

SEQ ID NO: 158928 - protein, 189 aa, Glycine max
  Coding DNA Sequence Number=SeqID_42150
  Gene Ontology: Mol. function=transporter activity; Cellular component= integral to membrane; Biological process=transport
  Homolog annotation: Hit_ID=Q1RVU7; Match level="QueryCoverage=99%, HitCoverage=43%, E-value=7e-58, Identity=60%"; Hit description=IMP dehydrogenase/GMP reductase
  Pfam annotation: Domain name=Ank; Domain location=127-162; Score=8.7; E_value=1.7; Accession=PF00023.20; Description=Ankyrin repeat
  Pfam annotation: Domain name=Ank; Domain location=25-58; Score=7.1; E_ value=3; Accession=PF00023.20; Description=Ankyrin repeat
  Pfam annotation: Domain name=Ank; Domain location=59-89; Score=6.4; E_ value=3.7; Accession=PF00023.20; Description=Ankyrin repeat
  Pfam annotation: Domain name=Ank; Domain location=93-126; Score=19.6; E_value=0.011; Accession=PF00023.20; Description=Ankyrin repeat
  Pfam module annotation: Pfam domain module=Ank::Ank::Ank::Ank; Domain location=127-162::25-58::59-89::93-126
GDIDLLYKLIQMQPYVLEHTDFMPFVDTPLHVAAAAGHASFATEIMRLKPSSVWKLNQCGLSPMHLALQNKHYRMVCRFVNINKDLVRVKGREGLTPLHIATQTGRTDLVAKFLSACPGSIEDVTVRSETALHIAVKYDQFKALEVLVGWLQRNCQRLAEDREKRVLNWQDEAGNTALHLSVLKGFPQA

SEQ ID NO: 158929 - protein, 202 aa, Glycine max
  Coding DNA Sequence Number=SeqID_42151
  Gene Ontology: Mol. function=catalytic activity; Biological process =cellular metabolic process
  Homolog annotation: Hit_ID=Q6ZI86; Match level="QueryCoverage=59%, HitCoverage=46%, E-value=1e-10, Identity=33%"; Hit description =Dehydrogenase-like protein
MRTVLSRLIHSTPSISRINAVSIRGRDLFFPNVCFKVEEAVNVPPPPTEKVVLFGGDWFVGSHFFREALERGMSAGSPSRSGRSSLHDSWARNFAWYQGNLFSTASLRKHLNGATAVLQDVALDFKELVWIQNFICKYLFPCDDMPVVLTCVSFIRSHLWVVLAPTSKLLEQLQIKCKSLQEQQQVCFSPDRFLATPMQIQS

SEQ ID NO: 158930 - protein, 149 aa, Glycine max
  Coding DNA Sequence Number=SeqID_42152
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=73%, HitCoverage=11%, E-value=4e-24, Identity=51%"; Hit description =Cytokinin independent 2
MENDSIEDMDIEALPSMWPQDIGTEVGKQFNIEKAGRDQDMLEEVTIIEEPTIVDFKRLMELTDFTEKGSSQLAYLMKQWEYKQASVVRLLREELDNLSKQRQDAELRKLEILEEHRFEEEQYGGDKRPVSILDEVYDGYMARYTLAGK

SEQ ID NO: 158931 - protein, 53 aa, Glycine max
  Coding DNA Sequence Number=SeqID_42153
  Gene Ontology: Biological process=auxin mediated signaling pathway
  Homolog annotation: Hit_ID=P33080; Match level="QueryCoverage=58%, HitCoverage=34%, E-value=2e-12, Identity=100%"; Hit description =Auxin-induced protein X10A
  Pfam annotation: Domain name=Auxin_inducible; Domain location=1-30; Score=-28.8; E_value=0.049; Accession=PF02519.5; Description=Auxin responsive protein
EEEFGYDHPMGGLTIPCKEDEFLTVTSHLNDLDFYFLLKLKPVSLMRINAAQD

SEQ ID NO: 158932 - protein, 199 aa, Glycine max
  Coding DNA Sequence Number=SeqID_42154
  Gene Ontology: Mol. function=catalytic activity; Biological process =cellular metabolic process
  Homolog annotation: Hit_ID=Q6ZI86; Match level="QueryCoverage=73%, HitCoverage=55%, E-value=7e-22, Identity=39%"; Hit description =Dehydrogenase-like protein
MRTVLSRLIHSTPSIFRINATVVSISGRNLCTDSNKVHEPFKVEEAETVNVPPPPTEKLVVFGGNFFVGINILMEAQNRGMCAGSPTRDDGRSSLHDSWARNFAWYQGNLFSTATLRKHLNGATAVISFMSGFGSNINAIRAASDQVLLLGVARALPILIFLFELITTATEPYSTKWDLLNRSNDKTRLNKNLEKKLFN

SEQ ID NO: 158933 - protein, 53 aa, Glycine max
  Coding DNA Sequence Number=SeqID_42155
MEGVEWIKRESTVLIFSVELWNFLYETKLPRDMSLRIRPEYRNKLGMGTRRNH

SEQ ID NO: 158934 - protein, 186 aa, Glycine max
  Coding DNA Sequence Number=SeqID_42156
  Gene Ontology: Mol. function=transporter activity; Cellular component= integral to membrane; Biological process=transport
  Homolog annotation: Hit_ID=Q1RVU7; Match level="QueryCoverage=87%, HitCoverage=37%, E-value=3e-50, Identity=61%"; Hit description=IMP dehydrogenase/GMP reductase
  Pfam annotation: Domain name=Ank; Domain location=124-159; Score=8.7; E_value=1.7; Accession=PF00023.20; Description=Ankyrin repeat
  Pfam annotation: Domain name=Ank; Domain location=22-55; Score=3.6; E_ value=9.5; Accession=PF00023.20; Description=Ankyrin repeat
  Pfam annotation: Domain name=Ank; Domain location=56-86; Score=7.4; E_ value=2.6; Accession=PF00023.20; Description=Ankyrin repeat
  Pfam annotation: Domain name=Ank; Domain location=90-123; Score=19.6; E_value=0.011; Accession=PF00023.20; Description=Ankyrin repeat
  Pfam module annotation: Pfam domain module=Ank::Ank::Ank::Ank; Domain location=124-159::22-55::56-86::90-123
MGGFGSNIKAIRAASDQDFMPFVDTPLHVAAAAEHASFATEIMRLKPSSVWKLNQCGLSPMHLALQNKHYRMVCRFVDINKDLVRVKGREGLTPLHIATQTGRTDLVAKFLSACPGSIEDVTVRSETALHIAVKYDQFKALEVLVGWLQRNCQRLAEDREKRVLNWQDEVGNTALHLSVLKGFPQS

SEQ ID NO: 158935 - protein, 41 aa, Glycine max
  Coding DNA Sequence Number=SeqID_42157
MSLRIRPEYRNKLGMGTRRNQKTRVRSVYRSSIHSKNIGCS

SEQ ID NO: 158936 - protein, 642 aa, Glycine max
  Coding DNA Sequence Number=SeqID_42158
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=99%, HitCoverage=59%, E-value=1e-164, Identity=52%"; Hit description =Cytokinin independent 2
  Pfam annotation: Domain name=HATPase_c; Domain location=104-301; Score=141.3; E_value=2.5e-39; Accession=PF02518.16; Description =Histidine kinase-, DNA gyrase B-, and HSP90-like ATPase
  Pfam annotation: Domain name=HisKA; Domain location=1-58; Score=53.5; E_value=6.9e-13; Accession=PF00512.15; Description=His Kinase A (phosphoacceptor) domain
  Pfam annotation: Domain name=Response_reg; Domain location=494-635; Score=95.3; E_value=1.8e-25; Accession=PF00072.14; Description =Response regulator receiver domain
  Pfam module annotation: Pfam domain module=HATPase_c::HisKA::Response_ reg; Domain location=104-301::1-58::494-635
MSHEIRSPLSGVVSMAEILSNTKLDWEQRQLLDVMLSSGDLVLQIINDILDLSKVESGVMKLEATKFRPREVVKHVLQTAVVSLQKILTLEGHVADDVPIEVIGDVLRMRQILTNLISNAIKFTHEGRVGINLYVVPKPNFAKAEDIQMMTPNQSTMSVNGVKEEQHLSKPQSGNDGNLLDGCQKHDDHPSQNHAFNDECGSPAKSECSMNGDTEEQPYSAETTVWIRCDVYDTGIGIPEDAIPTLFKRYMQVSADHTRKYGGTGLGLAICKQLVELMGGQLTVSSKEHYGSTFTFILPYKVSIACDHSDDPDELSDLENNDVASDDTIESFFQFQPRTLGSLFSSNGSSRTQKLLTHKIGYTSSHKLGGFSESLYSFPSNDIMSKGTCSVDDASSVVDAPETSESASSSGHSLETKNKSLVRRDKQHQDKARAWSFNGYADSSEVTVSNGEMAGATKSSEPQQTCQGQGKANTTTQCVTSSSTSEVTKSTIKPKILLVEDNKINVMVTQSMMKQLGHSIDVVNNGVEAVRAVQRHTYDLILMDVCMPVMDGLQATKLIRTFEETGNCDAARSAGIEESLPDQDYECYVPFTKRVPIVAMTANALSESAEECFANGMDSFVSKPVTFQKLKECIEQYLVNFS

SEQ ID NO: 158937 - protein, 79 aa, Glycine max
  Coding DNA Sequence Number=SeqID_42159
  Subcellular localization annotation: CTP_CleavageSite=29; ConfidenceScore=5.06e-01
MPISPYGSINWGRAHKTPSGPGEVQQGPRVSSSGYGPLSVLQGARPPQQGIAPARHPVDPEKFNRVLGFLAVITGLCQF

SEQ ID NO: 158938 - protein, 312 aa, Glycine max
  Coding DNA Sequence Number=SeqID_42160
  Homolog annotation: Hit_ID=Q47522; Match level="QueryCoverage=20%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMSTNFLCQFHIAKNVRANCKMHVNNMEDWGKVLDAWNGLVQSHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 158939 - protein, 112 aa, Glycine max
  Coding DNA Sequence Number=SeqID_42161
MGNFGVNSHLNQVYNIELDLLKLILSSQNPTPPDFKREEVHPYLKLKVPRGRGRLLDSENSFSLQFGVEMKRNLELQKRQQWWIRRGRKATWREKEGLLEVSGEGERRFGFL

SEQ ID NO: 158940 - protein, 107 aa, Glycine max
  Coding DNA Sequence Number=SeqID_42162
  Subcellular localization annotation: CTP_CleavageSite=27; ConfidenceScore=5.28e-01
MAEPSKKQKGTSSRSQRHSGAQETPIPSSISSGSLFSSEEQPFENSNLIPFMSLKLPVYSELVKAFYSNLEIHEGTLMSEVYGTKMVIDQSLFYDLTQLPSEGVPFE

SEQ ID NO: 158941 - protein, 117 aa, Glycine max
  Coding DNA Sequence Number=SeqID_42163
  Gene Ontology: Mol. function=serine-type peptidase activity; Cellular component=outer membrane-bounded periplasmic space; Biological process=proteolysis
  Homolog annotation: Hit_ID=Q1SJV5; Match level="QueryCoverage=52%, HitCoverage=13%, E-value=2e-27, Identity=95%"; Hit description =Peptidase S41
  Pfam annotation: Domain name=Peptidase_S41; Domain location=2-82; Score=-5.0; E_value=1.1e-05; Accession=PF03572.8; Description =Peptidase family S41B
MDSWVVSGLRRNSTGDPMLKVASALHDNCRAVLVGKRTYGKGLIQSVFELDDGSGVVITVGKYVTPNHKDINGNGIEPDFQKLPAARWKLLCISQEFQVNIDICLNGLPSLLGYNGI

SEQ ID NO: 158942 - protein, 124 aa, Glycine max
  Coding DNA Sequence Number=SeqID_42164
MNHFFRKVPGRGFSGSLPEEVFFRKTFGYFRKNPSSGNFPENVLPELPEEPLTGLPEVSAVSLLSPFFPASSPLVFYPKVTILSKGELGRLTSFAEKKKTRFALALPEKKKQFAEKGEEASRKE

SEQ ID NO: 158943 - protein, 63 aa, Glycine max
  Coding DNA Sequence Number=SeqID_42165
  Gene Ontology: Mol. function=structural molecule activity; Cellular component=protein complex; Biological process=microtubule-based movement
  Homolog annotation: Hit_ID=Q53M52; Match level="QueryCoverage=70%, HitCoverage=9%, E-value=2e-11, Identity=77%"; Hit description =Tubulin alpha-2 chain
MGANCKVENFLLLSDTPYAFGKEIVDLCLGCIRKLADNYTGLQGFLVLNAVGGGIGSELASIR

SEQ ID NO: 158944 - protein, 250 aa, Glycine max
  Coding DNA Sequence Number=SeqID_42166
  Homolog annotation: Hit_ID=Q0B8G8; Match level="QueryCoverage=16%, HitCoverage=21%, E-value=8e-09, Identity=73%"; Hit description =Isochorismatase hydrolase
MKRALNLSSRSIVHEWSTVGLGGIPGYSTYVGNAAKAARFLKMGGYVGIAFSFAGATNDVMKACTVGRFEIWTLNRCGKKYYTLLEEFQKRHENIENRAGSASPGGKRSVQQREDFVSGAGFAEAREDALNAVVVSFGVQAAHCISRQRDATLLLQLLMQVVIVVVNACTRGRESECGKTAFKEYSKFASGTFAGITGGTLGASAGIGICFAVGIATAGAGGVACAAVGSLVGGTAASSASDYLMDLWLK

SEQ ID NO: 158945 - protein, 88 aa, Glycine max
  Coding DNA Sequence Number=SeqID_42167
  Gene Ontology: Mol. function=siderophore-iron transporter activity; Cellular component=outer membrane; Biological process=siderophore transport
  Homolog annotation: Hit_ID=Q5PHW8; Match level="QueryCoverage=98%, HitCoverage=12%, E-value=4e-21, Identity=63%"; Hit description =Probable TonB-dependent receptor
MLTIRCRLRASPRTAIATTAPRRRTSAMPRLGVRIDDVSTLTLLFNSVHVEAQDPGGLTPDQWHDNPRQVASNVTLYNARKTVDQTQA

SEQ ID NO: 158946 - protein, 794 aa, Glycine max
  Coding DNA Sequence Number=SeqID_42168
  Homolog annotation: Hit_ID=Q2RUD3; Match level="QueryCoverage=33%, HitCoverage=53%, E-value=1e-85, Identity=54%"; Hit description=Yeast 2-isopropylmalate synthase
  Pfam annotation: Domain name=3HCDH_N; Domain location=4-166; Score= -96.5; E_value=0.003; Accession=PF02737.8; Description=3-hydroxyacyl -CoA dehydrogenase, NAD binding domain
  Pfam annotation: Domain name=ApbA; Domain location=7-124; Score= -20.0; E_value=0.011; Accession=PF02558.6; Description=Ketopantoate reductase PanEApbA
  Pfam annotation: Domain name=AraC_binding; Domain location=281-408; Score=16.3; E_value=0.0017; Accession=PF02311.9; Description=AraC -like ligand binding domain
  Pfam annotation: Domain name=Cupin_2; Domain location=286-355; Score =17.7; E_value=0.0049; Accession=PF07883.2; Description=Cupin domain
  Pfam annotation: Domain name=DUF1817; Domain location=400-508; Score=- 84.7; E_value=0.091; Accession=PF08847.1; Description=Domain of unknown function (DUF1817)
  Pfam annotation: Domain name=F420_oxidored; Domain location=6-186; Score=-36.2; E_value=0.0061; Accession=PF03807.7; Description=NADP oxidoreductase coenzyme F420-dependent
  Pfam annotation: Domain name=HTH_AraC; Domain location=426-472; Score= 24.1; E_value=0.00051; Accession=PF00165.13; Description=Bacterial regulatory helix-turn-helix proteins, araC family
  Pfam annotation: Domain name=HTH_AraC; Domain location=478-521; Score= 27.6; E_value=4.3e-05; Accession=PF00165.13; Description=Bacterial regulatory helix-turn-helix proteins, araC family
  Pfam annotation: Domain name=IlvN; Domain location=1-129; Score= -81.2; E_value=0.014; Accession=PF07991.2; Description=Acetohydroxy acid isomeroreductase, ca
  Pfam annotation: Domain name=NAD_Gly3P_dh_N; Domain location=5-147; Score=-35.5; E_value=0.0011; Accession=PF01210.13; Description=NAD -dependent glycerol-3-phosphate deh
  Pfam annotation: Domain name=NAD_binding_2; Domain location=4-165; Score=160.7; E_value=3.8e-45; Accession=PF03446.5; Description=NAD binding domain of 6-phosphogluconate dehydrogenase
  Pfam annotation: Domain name=Shikimate_DH; Domain location=1-119; Score=-23.6; E_value=0.038; Accession=PF01488.10; Description =Shikimate  quinate 5-dehydrogenase
  Pfam annotation: Domain name=UDPG_MGDP_dh_N; Domain location=7-143; Score=-81.2; E_value=0.0098; Accession=PF03721.5; Description=UDP -glucoseGDP-mannose dehydrogenase family, NAD binding domain
  Pfam module annotation: Pfam domain module=3HCDH_N::ApbA::AraC _binding::Cupin_2::DUF1817::F420_oxidored::HTH_AraC::HTH _AraC::IlvN::NAD_Gly3P_dh_N::NAD_binding_2::Shikimate_DH::UDPG_MGDP _dh_N; Domain location=4-166::...
  Pfam module annotation: Domain location=7-124::281-408::286-355::400 -508::6-186::426-472::478-521::1-129::5-147::4-165::1-119::7-143
  Subcellular localization annotation: CTP_CleavageSite=54; ConfidenceScore=5.03e-01
MSQQPVVAVLGLGAMGHAFAANLLKKGFTVRGWNRTRAKGEDLVAAGLTLSDSAAQAVEGADVVIAMLADGATTRTTLNQVQNALQQGATVAQMGTIGVEATDALIAELAAARPDVVFIDAPVSGTKAPAENAQILVMASGDRQRAQAAEQVFAAIGKGTQWLGAAGASSRMKLVVNSWLIGLMQSLAESTRLAEQLGFTTDDLWQVLEGGPLAAPYAKMKLGMIASGDFTPQMHLVWALKDARLALDAAGDASLPALENIVDVWQQAVDAGYGEQDLAARPLVPYAHDYAHGDAEPWHYHHCAQLIHTLSGVVKVETQHGSWIVPPSRGVWLPAGTRHALHIVGSVAARTLFVDPLARADLPASCQVVQISPLLRELIVSALTLPEHYASGSRAERIYELILDEIRVMDVLPFGLPLPHSDRLLALCQQIQQAPGESWTLARAAAQLCVAERTLARHFSRETGLQFSDWLRRARLSVALTRLAQGDTVLAVALDLGYDSPSAFSAMFRRVLGVTPANYFPAAEKRPPPDIAHRTAVAAFAQRVFMVILNDYGQIARFNPRLALIIAIAFRLQQATPWLLQAVLLTEQLPQRVVRHLLAVSIGLLLHAAAEILLQAARQLQAVILFQQPGGTAFTGLAVHADHRFIAAADVQRIERQVGHLPYHFITRAAFGKAFANGILMRAGEGGKHQFAGVRMARMDRQLVTARHHFQHLAHIAKVQLRRHALGIEIQRQRHQIDVAGALAVTKQTAFNAIGPGQQRQLGAGGAGAAIVMRMDTDGHLRALAEVATEILDL

SEQ ID NO: 158947 - protein, 325 aa, Glycine max
  Coding DNA Sequence Number=SeqID_42169
  Homolog annotation: Hit_ID=Q10NR6; Match level="QueryCoverage=42%, HitCoverage=34%, E-value=6e-13, Identity=39%"; Hit description =Expressed protein
  Subcellular localization annotation: CTP_CleavageSite=17; ConfidenceScore=5.06e-01
MSSSSVCQGLQSCLEPRVMEPRVLRLKLALQQGSNFPQPSPSPTTNTFSLSPLSDSEENPPTNCQCDKNDTKSGEPSGWSFLQTLSQDKTEDQVYVHPTVKRSSSILSEKSLEMCTESLGSETGSNASENGDDMSLFSFDTNTRSTEHTTTTTATHANYESKRVNRTCNLPPPLTTITDFGGVHVRPHREGGRLVLEAVASPSPRPYFHIERGDGRLRLCLLESFSASDSDDEVCDAEEGVDEQQEEENESEKNRGEEEEKECGEEDIATGAEEEEEEECVENVEDGMGVKKLARPSRCKESGKRDIFGDALANLSFPRFLSVSE

SEQ ID NO: 158948 - protein, 150 aa, Glycine max
  Coding DNA Sequence Number=SeqID_42170
  Gene Ontology: Mol. function=GTP binding; Cellular component =intracellular; Biological process=small GTPase mediated signal transduction
  Homolog annotation: Hit_ID=Q6ATR5; Match level="QueryCoverage=88%, HitCoverage=20%, E-value=1e-37, Identity=54%"; Hit description =Expressed protein
MLYLKQEPKALTSFSDEHSWKKSRDLLEKVGRQGDLTGYRVPCLLIAAKDDLTPYPRAVQDSVKVTEELGIEAPIHVSMKLGDSSNVYHKIVNAAEHPHLSIPETEIGRKRKQYHRLLQHSLVFASVGTAMAFVGLAACRAYAVKKNSSG

SEQ ID NO: 158949 - protein, 296 aa, Glycine max
  Coding DNA Sequence Number=SeqID_42171
  Gene Ontology: Mol. function=protein binding; Cellular component =membrane; Biological process=ATP synthesis coupled proton transport
  Homolog annotation: Hit_ID=Q6D5Q8; Match level="QueryCoverage=62%, HitCoverage=100%, E-value=3e-63, Identity=62%"; Hit description =Phage shock protein A
  Pfam annotation: Domain name=PspA_IM30; Domain location=2-183; Score =109.2; E_value=1.2e-29; Accession=PF04012.3; Description=PspAIM30 family
  Pfam annotation: Domain name=PspC; Domain location=242-288; Score= -7.2; E_value=0.036; Accession=PF04024.3; Description=PspC domain
  Pfam module annotation: Pfam domain module=PspA_IM30::PspC; Domain location=2-183::242-288
MGIFSRFADIVNANINSLLERAEDPQKLAEIQQAEWQEKAELALSKEKEDLARSALIEKQKLTDLIAALQQEASHVEETLDRMKGEIGELEKKLSETRARQQALTLRHQAASSSRDVRRQLDSGKLDEAMARFESFERRIDHMEAEAESQRFGKSKTLDQQFADLKADDEISQQLAALKAKMNRSERVNERTISGHTVNDLRAVCGTDLVMAALQQQTQRRGAFVRDPRCRTPELEAAMMNGRKLWRIPQQGKVRGVCAGLADTGDRTIFILGYVLDEKPLDAPSERTPTARELLG

SEQ ID NO: 158950 - protein, 173 aa, Glycine max
  Coding DNA Sequence Number=SeqID_42172
  Gene Ontology: Mol. function=calcium ion binding; Cellular component =intracellular; Biological process=small GTPase mediated signal transduction
  Homolog annotation: Hit_ID=Q9LYA8; Match level="QueryCoverage=94%, HitCoverage=24%, E-value=6e-46, Identity=57%"; Hit description=Rac -GTP binding protein-like
  Pfam annotation: Domain name=EF_assoc_1; Domain location=7-77; Score =124.4; E_value=3.3e-34; Accession=PF08355.2; Description=EF hand associated
  Pfam annotation: Domain name=MMR_HSR1; Domain location=82-164; Score=- 22.0; E_value=0.1; Accession=PF01926.13; Description=GTPase of unknown function
  Pfam annotation: Domain name=Miro; Domain location=83-173; Score=4.9; E_value=0.0018; Accession=PF08477.3; Description=Miro-like protein
  Pfam module annotation: Pfam domain module=EF_assoc_1::MMR _HSR1::Miro; Domain location=7-77::82-164::83-173
MVVNCSPWDDALYKDAAERTNMGYISLNGFLAQWVLMTLLDPPCSLANLIYIGYSGNPAAALRVTRRRAVDRKKQATEKNVFQCYVFGSKNAGKSALLDSLLGRPFSNNYTPTTVERFAANSIELIGGTRKTLVLREIPESEVSNVLSNKGYLAACDVAVFVYDSIFMGSQYK

SEQ ID NO: 158951 - protein, 617 aa, Glycine max
  Coding DNA Sequence Number=SeqID_42173
  Homolog annotation: Hit_ID=Q9ZIB7; Match level="QueryCoverage=46%, HitCoverage=55%, E-value=1e-152, Identity=92%"; Hit description =Transcriptional regulatory protein tyrR
  Pfam annotation: Domain name=AAA_2; Domain location=6-148; Score= -50.0; E_value=0.058; Accession=PF07724.4; Description=ATPase family associated with various
  Pfam annotation: Domain name=AAA_3; Domain location=7-147; Score= -17.3; E_value=0.025; Accession=PF07726.2; Description=ATPase family associated with various
  Pfam annotation: Domain name=AAA_5; Domain location=7-153; Score= -3.9; E_value=0.0035; Accession=PF07728.4; Description=ATPase family associated with various
  Pfam annotation: Domain name=MR_MLE_N; Domain location=435-546; Score= 24.9; E_value=3.1e-05; Accession=PF02746.6; Description=Mandelate racemase  muconate lactonizing enzyme, N-terminal domain
  Pfam annotation: Domain name=Sigma54_activat; Domain location=1-205; Score=362.7; E_value=6e-106; Accession=PF00158.16; Description=Sigma- 54 interaction domain
  Pfam module annotation: Pfam domain module=AAA_2::AAA_3::AAA_5::MR _MLE_N::Sigma54_activat; Domain location=6-148::7-147::7-153::435 -546::1-205
LAMHDAPLLIVGDTGTGKDMLARACHLRSARGKKPFLALNCGSIPDDVAESELFGHAAGAYPNALEGKKGFFEQANGGSVLLDEIGEMSPRMQTKLLRFLNDGTFRRVGEDHEVHVDVRVICATQKNLIELVQRGEFREDLFYRLNVLTLNLPPLRERPLDILPLTEMFVARFADEQGLPRPRLSPQLTPFLTRYNWPGNVRQLKNALYRALTQLEGYELRPQDIVLPEQALDVSLGEEAMEGSLDEITSRFERSVLTRLYLSYPSTRKLAKRLGVSHTAIANKLREYGLAIALLQRCQCRFIVRLFGDFIHQLAVQHLIVLIQHHHRAGSQAFQRAIGNRDAVIFNKFCTAQCRQRHYVIDVLGAAEARLRKRQIGRDAQHHGVVSFARTLVEFAHRRGAHAGINAWENVQNFAFACILRKGHITEIFRYQVERLIQRGAAPARYDVMDLRSQYENSEKLSGSLAAALADGLKGIGEATPYARYGESEASVLQQIASQLGALQNGMTRAALQQALPAGAARNAIDCALWDLERQQQRTSLAALCEAVPAQEIVTAHTVSIDTPEAMASSALALWQHGARLLKIKLDNHLIIERLVAIRSAVPDATLIVDANESWHA

SEQ ID NO: 158952 - protein, 69 aa, Glycine max
  Coding DNA Sequence Number=SeqID_42174
MESSENLQLHPNGSVLQCRVIGIGDEGVEEGEEEKRHDELARIEQIDGLSRDEVAALLGDESASKEDKV

SEQ ID NO: 158953 - protein, 248 aa, Glycine max
  Coding DNA Sequence Number=SeqID_42175
  Gene Ontology: Mol. function=calcium ion binding; Cellular component =intracellular; Biological process=small GTPase mediated signal transduction
  Homolog annotation: Hit_ID=Q6ATR5; Match level="QueryCoverage=90%, HitCoverage=43%, E-value=4e-58, Identity=46%"; Hit description =Expressed protein
  Pfam annotation: Domain name=EF_assoc_2; Domain location=168-246; Score=92.6; E_value=1.2e-24; Accession=PF08356.2; Description=EF hand associated
  Pfam annotation: Domain name=MMR_HSR1; Domain location=14-127; Score=- 6.0; E_value=0.0036; Accession=PF01926.13; Description=GTPase of unknown function
  Pfam annotation: Domain name=Miro; Domain location=15-127; Score =117.0; E_value=5.3e-32; Accession=PF08477.3; Description=Miro-like protein
  Pfam annotation: Domain name=Ras; Domain location=15-177; Score= -44.6; E_value=6.2e-06; Accession=PF00071.12; Description=Ras family
  Pfam module annotation: Pfam domain module=EF_assoc_2::MMR _HSR1::Miro::Ras; Domain location=168-246::14-127::15-127::15-177
MANHSSSFGGRSGVRVVVAGDRSTGKSSLIAAIATESFAEAVPPVLPPTLLAPDLYPDTVPLTVVDTPSSLEKQRKRNEELKAADVVVLTYACNDTASFSRLSSYWFPELQKLEVKVPVIVVGCKLDLRDESQQVSLECVMTQLLQQFKEIVTCIECSAATQYQVRCFNAPLQSSEIAGVKRVVQQKVPEGFNSHGLTFPGFIYVHNMFLKKGRPETLWAVLRNFGYDNNLKLMDDFLPVPSKHAFDQ

SEQ ID NO: 158954 - protein, 261 aa, Glycine max
  Coding DNA Sequence Number=SeqID_42176
  Homolog annotation: Hit_ID=Q0YZJ2; Match level="QueryCoverage=36%, HitCoverage=4%, E-value=3e-32, Identity=71%"; Hit description =Excinuclease ABC, A subunit
DLPSQVLQWLLFLSAVPPVQLLTGWCVTAKAPPDISAGKCSGRVPFAIQAAQLLGRAIGAGLFAITPAGERGMCCKAIKLGIRCPNRSLQGVDARQHMHHALADLQRLGQLRAQFFFVGRRDLDAGHGQLDGVFLEAVQAREARGRQEGAVHAQVRIALGAGPVGQLGVHHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 158955 - protein, 231 aa, Glycine max
  Coding DNA Sequence Number=SeqID_42177
  Pfam annotation: Domain name=Transposase_23; Domain location=149-217; Score=-0.3; E_value=0.0012; Accession=PF03017.5; Description =TNP1ENSPM transposase
DELEEQSTQGTFVPHGRNDILNTALGREEHPGRVLAAGHGVTISSYFGQRSSASNSSAATITPDQLVQIIGNLKQEWTKEVEDASKQKMDMLQKELDAIKTELSQMQTQQSAPVQPANPNVLIARVSTKESCAEAVANVVAGDPSAVEENTMGLYVVCGDSKQLVALGKVYQVGGMIHNVPYADEVVRVSVVTVYDGDARVPIPTPEIEYVREAMNTFIGWPTNLVKPFSA

SEQ ID NO: 158956 - protein, 102 aa, Glycine max
  Coding DNA Sequence Number=SeqID_42178
MKLCSSLFGRVALRIKSWIFHGNFYMTVWQLKKTMIMKGQDIYSYQDEVTTSPSSSESEAKGEESSEEIDSQEERDLLMVRRLLGGQSCDLFLLNDSKVIFN

SEQ ID NO: 158957 - protein, 85 aa, Glycine max
  Coding DNA Sequence Number=SeqID_42179
  Homolog annotation: Hit_ID=P0ACW2; Match level="QueryCoverage=75%, HitCoverage=75%, E-value=3e-13, Identity=59%"; Hit description =Hypothetical protein ydbJ precursor
  Pfam annotation: Domain name=DUF333; Domain location=2-85; Score=5.0; E_value=0.0022; Accession=PF03891.5; Description=Domain of unknown function (DUF333)
  Subcellular localization annotation: CTP_CleavageSite=41; ConfidenceScore=5.19e-01
MKAATLLLAGAALLLSACSSNSDNEPPQQATAAHVQPHVVMSSMAEANCNSAGGTLAFSRQLDGSRIGMCQLANGRRCDEQALIG

SEQ ID NO: 158958 - protein, 218 aa, Glycine max
  Coding DNA Sequence Number=SeqID_42180
  Gene Ontology: Mol. function=amino acid binding; Cellular component =membrane; Biological process=metabolic process
  Homolog annotation: Hit_ID=UPI00005F76B8; Match level="QueryCoverage =89%, HitCoverage=89%, E-value=2e-66, Identity=63%"; Hit description =COG1285: Uncharacterized membrane protein
  Pfam annotation: Domain name=MgtC; Domain location=9-142; Score =199.0; E_value=1.1e-56; Accession=PF02308.7; Description=MgtC family
MLADMLIRIALAGILGGLIGLERQMRAKEAGLRTHILVGIGSAMFMLVSKYGFADMLTNEHVALDPSRIAAQVVSGMGFLGAGTIIIQKQIVKGLTTAAGLWVTAAIGLVIGSGMYEIGIYGTVLALMVLETFRRISHWLIGRHHTLIVHLKAKSVPLVLLVLQRENLRYGHIAVVNRNEESGLCELSVEVTLSRRFPMHSIYDKVMEIKGVQSLEMV

SEQ ID NO: 158959 - protein, 194 aa, Glycine max
  Coding DNA Sequence Number=SeqID_42181
  Subcellular localization annotation: CTP_CleavageSite=63; ConfidenceScore=5.07e-01
PALTVSAHAAGRCAGLYGCRLTAVSRKSLWRMVRITAPNSSTIYGFAGDALCAPRDRAMKNVVLSMLAKISQIDATTKQLTARVEAQSLLIGALVLAVSKKGGVTEVIESANKAINMVIESAEADDMLKSDAAILLSEFQDLLTISRAVDSADDVINQQALEGITGVPAGGAMLSGTGAARCRYRKRGAGQRVA

SEQ ID NO: 158960 - protein, 171 aa, Glycine max
  Coding DNA Sequence Number=SeqID_42182
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q8ZP91; Match level="QueryCoverage=99%, HitCoverage=51%, E-value=6e-78, Identity=83%"; Hit description=NAD -dependent fermentative D-lactate dehydrogenase
  Pfam annotation: Domain name=2-Hacid_dh; Domain location=3-135; Score= 95.5; E_value=1.6e-25; Accession=PF00389.20; Description=D-isomer specific 2-hydroxyacid dehydr
  Pfam annotation: Domain name=2-Hacid_dh_C; Domain location=110-170; Score=-100.3; E_value=0.07; Accession=PF02826.9; Description=D -isomer specific 2-hydroxyacid dehyd
  Pfam module annotation: Pfam domain module=2-Hacid_dh::2-Hacid_dh_C; Domain location=3-135::110-170
MKVAVYSTKHYDQKYLEHVNESYGFELQFFDFLLSETTAKNAAGCDAVCIFVNDDGSKAVLAELAALGVKYIALRCAGFNNVDLDAAAALGLQVVRVPAYSPEAVAEHAVGLMMTLNRRIHRAYQRTRDANFSLDGLTGFNMHNKTAGVVGTGKIGVATMRILKGFGMRLL

SEQ ID NO: 158961 - protein, 151 aa, Glycine max
  Coding DNA Sequence Number=SeqID_42183
  Gene Ontology: Mol. function=oxidoreductase activity
  Homolog annotation: Hit_ID=P52645; Match level="QueryCoverage=81%, HitCoverage=16%, E-value=4e-23, Identity=47%"; Hit description =Hypothetical protein ydbH
MTRGLRRLLAALLALILLLLGLLLTLTHWLPRLAGIWLPENTRVELHGAPHWQQGRLVFPDVRYLAGDCLLAQRLSAGAAAQCHARCAAQPRRVAADAARRGYPSATAQYFAMAAICRPLRSDLRQGPSAAALSGRQPARRRAPAGAAAAH

SEQ ID NO: 158962 - protein, 65 aa, Glycine max
  Coding DNA Sequence Number=SeqID_42184
  Subcellular localization annotation: CTP_CleavageSite=39; ConfidenceScore=5.48e-01
MQAVFLVSGQGSCGTGVFLPQKAGTKSTSKPACAPVLLPARVVQALNLKVHQLGLQISPSQGLVS

SEQ ID NO: 158963 - protein, 299 aa, Glycine max
  Coding DNA Sequence Number=SeqID_42185
  Gene Ontology: Mol. function=protein translocase activity; Cellular component=membrane; Biological process=protein secretion
  Homolog annotation: Hit_ID=Q9SIQ4; Match level="QueryCoverage=80%, HitCoverage=45%, E-value=3e-50, Identity=46%"; Hit description =Putative preprotein translocase SECY protein
  Subcellular localization annotation: CTP_CleavageSite=77; ConfidenceScore=5.05e-01
MEATRFSPNHFYPHCFLTKPNALRERRYVKCINGVGTRVYLFTNPAFNNAPNRSLFPKLNRTLSVSFSDRLRDDYVRVDAPRSKEVVPATRGGDGGEAILASSPSADNSGTLQLKPLMFRNRFLNFARLGSVINGAAESFFKSEIRRRLFVTAVLIVISRVGYFIPLPGFDRRLIPEDYLSFVAGSSVDELGDFTAELKLSIFQLGISPQIINRVHYCAAFYELHLYKIFMCRWWMSFGFAILEALIVACYSLPYSIYAATYRVKHVMVTSVLLVCGAMTITWICDTISESGFGIFLAT

SEQ ID NO: 158964 - protein, 493 aa, Glycine max
  Coding DNA Sequence Number=SeqID_42186
  Gene Ontology: Mol. function=transcription regulator activity; Cellular component=nucleus; Biological process=regulation of transcription
  Homolog annotation: Hit_ID=Q852P3; Match level="QueryCoverage=90%, HitCoverage=76%, E-value=1e-68, Identity=39%"; Hit description=F3G1
  Pfam annotation: Domain name=HLH; Domain location=330-379; Score =51.7; E_value=2.4e-12; Accession=PF00010.16; Description=Helix-loop -helix DNA-binding domain
MIVTAQHDHTVQGTTTRPFHGFPICFDEIPRLPGTAYARRQHLWLSGANEVDSKTFSRAILAKTVVCIPVLEGVVELGTTDKIEEDLNFIQHIKSFFIDQQPPPPTAKPALSEHSTSNLTSSYPLVIVPVTAAATANNVLIQNDMNIVDKGEAIILNNNNNNTEAELLADPNSNSFIPSELMELDHQLEEFGVGSPGDGSNHLDSFPKEESMALCAAGLELLQLQRPPAPAHPPTENLAQGDTDTHYSQTVSSILKKNSSRWWPDSPSVNHPTDSFQSAFNKWKSDTDNHHHYFHETVADGTSQGLLKYILFNVPYLHANRLKGTGASSYETNHVMAERRRREKLNERFLILRSMVPFMMRMDKESILEDTIHYIKQLREKIESLEARERLRGKRRVREVEVSIIESEALLEVECVHRERLLLDVMTMLRELGVEVMMVQSWVKDDGVFVAEMRAKVKENGNGKKASVVEVKNALNQIIPHHEPYTLCSNDHF

SEQ ID NO: 158965 - protein, 52 aa, Glycine max
  Coding DNA Sequence Number=SeqID_42187
MASPQFPTPSPEVNDKFREKDIRGYLLVHVKDESYDVVDGVKDGGAAQGIGL

SEQ ID NO: 158966 - protein, 111 aa, Glycine max
  Coding DNA Sequence Number=SeqID_42188
MRDIKVGTKRLDKLMNSLLNMQTAFKTMISEVPIVDGVVLALGASPLRPQHIYVLNFSSARLMMILRGVKRPTLFEKGPIKLFVLIKAPSSFNQPMHFPPKRDFRYNRKGM

SEQ ID NO: 158967 - protein, 121 aa, Glycine max
  Coding DNA Sequence Number=SeqID_42189
  Gene Ontology: Mol. function=transcription regulator activity; Cellular component=nucleus; Biological process=regulation of transcription
  Homolog annotation: Hit_ID=Q9FEA1; Match level="QueryCoverage=93%, HitCoverage=16%, E-value=2e-47, Identity=82%"; Hit description =Anthocyanin 1
MATPPNSRLHTMLRASVQSVQWTYSLFWQLCPQQGILTWGDGYYNGAIKTRKTVQAMEVSTEEASLQRSEQLRELYESLSAEETINTQTRRPCAALSPEDLTESEWFYLLCVSFSFHLGIG

SEQ ID NO: 158968 - protein, 63 aa, Glycine max
  Coding DNA Sequence Number=SeqID_42190
MEERRKRKGAAQGFLENVIFIEQDAWRRQPTGNRLHEYCNRLQAICSSVIDYSIHVIDYQNIK

SEQ ID NO: 158969 - protein, 264 aa, Glycine max
  Coding DNA Sequence Number=SeqID_42191
LPSDHREIEAALCIPGMGFILNVEGHPRRILKKDLTTLAQVWSVLSYSNLTPTSHTSDLIVDRVRLGFPTLLTTLCRARGVVSNNLTFERLSPAINLAYIRKNCWNIDDLTVAFPGARRARVRPVDIPSTFATPSPTPTSTFAAPSVPAHMVSSPESILSVDQFLEKVAWLGAHPSLDREGGGPTAQVAQQVQDASFETTIPEPFTLHHEVGEEQVRPKIDVTSERSLEGTSEPPTPTTPVLALNTSPPATPVLHLTDEEDAQT

SEQ ID NO: 158970 - protein, 80 aa, Glycine max
  Coding DNA Sequence Number=SeqID_42192
MGEVEEIQEKMKADMEAIKEKMATMMEAMMSVKKIMEANTVVIATTSVVAKVNPTSPSGINESSNLRYGRQRFGKYRRPP

SEQ ID NO: 158971 - protein, 53 aa, Glycine max
  Coding DNA Sequence Number=SeqID_42193
MGDRLADMIRDLGQKSFQQAHVPVYEGLQSDSKKPLYQGCKNSLTLLSTILSL

SEQ ID NO: 158972 - protein, 146 aa, Glycine max
  Coding DNA Sequence Number=SeqID_42194
  Homolog annotation: Hit_ID=Q40849; Match level="QueryCoverage=71%, HitCoverage=74%, E-value=3e-08, Identity=33%"; Hit description=EMB24 protein
  Pfam annotation: Domain name=DUF26; Domain location=80-137; Score =3.1; E_value=0.0025; Accession=PF01657.8; Description=Domain of unknown function DUF26
MGINPTKYATIAICLFCLWSVAECIPNTSIINVLCNNGVYTSGDPFAISLSYVFGDLEKETPAQKNYDYHNISPYPNAYAYGHATCNLNLTSSDCKTCLGAAKAALFSTCQTPRIGARSVLYDCAISARLELTSTSKVAHFQQKSV

SEQ ID NO: 158973 - protein, 452 aa, Glycine max
  Coding DNA Sequence Number=SeqID_42195
  Gene Ontology: Mol. function=electron carrier activity; Biological process=electron transport
  Homolog annotation: Hit_ID=Q9LS22; Match level="QueryCoverage=90%, HitCoverage=71%, E-value=5e-55, Identity=33%"; Hit description =Arabidopsis thaliana genomic DNA, chromosome 5, BAC clone:F10E10
  Pfam annotation: Domain name=UPF0005; Domain location=55-438; Score =280.0; E_value=4.5e-81; Accession=PF01027.11; Description =Uncharacterised protein family UPF0005
MESTHVLAITNEEENIARSKENKTFQFHLPPIISHLGKNEVHCVSITSNPRHKQMQSGGHDMRKIIHCIKVGISLVLVSLLYLLNPLFKQVGENAMWAIMTVVVMFEFSAGATIGKGFNRGLGTIIGGGLGCLAAVFAQSIGIGRLGNSIIIGASVFIFGSVATYLRLVPSIKKRYDYGVMIFMLTFNLVVVSGVRGDVKVWDLARERLLNILMGFIVCVCVTLFVFPLWASDELHDSTVSRFLDLANTIQVCFGECTKIVSGKENQPRASFNVCKSVLNSKSKDESLANFAKWEPWHGKFGFSYPWGRYLKIGEVLRELAAFILAAGRCLEASKEPMASLRRSKWVHLETCEAVESKVVFILRELGESMKQMRKCDAKGNISGQLKNAREDLSLIISTSKMVELEDCQVLAIASFVFLLMEVIGKVEELVKEVEELEDIAGFRTTTTSLSS

SEQ ID NO: 158974 - protein, 476 aa, Glycine max
  Coding DNA Sequence Number=SeqID_42196
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q2RAK5; Match level="QueryCoverage=78%, HitCoverage=75%, E-value=1e-131, Identity=56%"; Hit description =Expressed protein
  Pfam annotation: Domain name=DUF231; Domain location=291-455; Score =170.8; E_value=3.5e-48; Accession=PF03005.6; Description=Arabidopsis proteins of unknown function
  Subcellular localization annotation: CTP_CleavageSite=76; ConfidenceScore=5.37e-01
MSKSVTATKDSGDNTATHLNFFEKFKRFNPLESSLGVLAFFFVASLFIASFFYLDYKGFRSRGTATVLHLDFSSPSSSAPVQFLSQDGDKCDVFDGKWVWDETYPLYHSANCSFPDQGFRCSQNGRPDTFYTKWRWQPKDCNLPSACNYLLLTYILERKYNVGVYSCNRFDARKMLEKLRDKRLVFVGDSIGRNQWESLICMLSSAIANKARVYEVNGSQITRHMGFLAFKFEDFNCTIEYYRSRFLVVQGRPPFGAPDGVRMTLRVDHMDWISNKWRDADVLVLNAGHWWNFQKTVRMGCYFQIGEEVKMNMTIEDAFRKSIETVVDWIANKVDMNKTYVLFRTYSPVHFRGGNWNTGGGCHLETLPDLGSLPPVSDIHFRNVVDILSERMNKSEVLNLDLLNVTQMSIHRRDGHPSIYYLGPGRTSSMWRQDCSHWCLPGVPDSWNEILYALLLKREDFFERRQHTTKVSQVPL

SEQ ID NO: 158975 - protein, 65 aa, Glycine max
  Coding DNA Sequence Number=SeqID_42197
MEFTYDGSPEQMAHTEMKNLVGRLGVHDRTCLTMGLQEHSNRMTPKAYTPKSPSGPLPPDSVRLK

SEQ ID NO: 158976 - protein, 419 aa, Glycine max
  Coding DNA Sequence Number=SeqID_42198
  Homolog annotation: Hit_ID=Q1S7J8; Match level="QueryCoverage=81%, HitCoverage=93%, E-value=1e-160, Identity=81%"; Hit description =Cyclin-like F-box
  Pfam annotation: Domain name=F-box; Domain location=10-57; Score =27.5; E_value=4.7e-05; Accession=PF00646.23; Description=F-box domain
IIAMSVAPVDSIPSLSSDLFYDIFRRLDGATLASAACTCAALCSISKEENLWENVCSSMWPSTNREDVKSLISSIGGFRKFYADCFPLIVNKEVVEYQLNNYLEYPDNWTEAEYYGDMNESESISPSDFVSIVDIRFKGKPICSKVLWGIPNANGYDGWFYNCPFRIDILTYADRDDINDGAVHLSVTDGLPPITSLERERKDGKLWQVLHEGLQLSWIIVNKKIKQAANLASWSPLGGQRHWPTDKDFVIRFGSVLPARDILPCQVAECILIMKFRVVHTEEDGVQTTLKLTELSMQLEDMEGAHVNGRNSLHILKEALSSRRSKNYGEVLESCHMYLKVQNELKEEKMRNETGWTSPKPKEWNYARIWVLVASAGHHTDNDDSGRVNNDDGRDTNGGCTDSGDRGDGDSSSYVGGGG

SEQ ID NO: 158977 - protein, 113 aa, Glycine max
  Coding DNA Sequence Number=SeqID_42199
MVINEAGVECHRRRLNGSTQSCINTEKKRRVKRRRMGKAKEAAVVAGALAFAWLAIELALKPFLTKARASIDKSDPARDPDDDALPKTTADDVPEASADDVPVAADTKTTDDA

SEQ ID NO: 158978 - protein, 192 aa, Glycine max
  Coding DNA Sequence Number=SeqID_42200
  Gene Ontology: Cellular component=ribonucleoprotein complex; Biological process=mRNA metabolic process
  Homolog annotation: Hit_ID=Q9SY09; Match level="QueryCoverage=90%, HitCoverage=81%, E-value=2e-27, Identity=93%"; Hit description=Small nuclear riboprotein Sm-D1
  Pfam annotation: Domain name=LSM; Domain location=91-168; Score=15.0; E_value=0.0035; Accession=PF01423.12; Description=LSM domain
LVCDLKTLPSVTVFSAAMKLVRFLMKLNNETVSIELKNGTVVHGTITDSAKIIIAGALCVTESHCVTAVVSPVSGKVTSAVCTELQFRVVLGLRTRFLALLKLTSRILCLLSEIAERRSFSAVIEQSRGVDISMNTHLKTVKLTLKGKNPVTLDHLSVRGNNIRYYILPDSLNLETLLVEEAPKIKPKKPTA

SEQ ID NO: 158979 - protein, 246 aa, Glycine max
  Coding DNA Sequence Number=SeqID_42201
  Gene Ontology: Mol. function=protein tyrosine/serine/threonine phosphatase activity; Cellular component=nucleus; Biological process= protein amino acid dephosphorylation
  Homolog annotation: Hit_ID=Q2R8T5; Match level="QueryCoverage=88%, HitCoverage=31%, E-value=2e-76, Identity=65%"; Hit description=MRNA capping enzyme, C-terminal domain containing protein, expressed
  Pfam annotation: Domain name=mRNA_cap_C; Domain location=116-215; Score=139.4; E_value=9.5e-39; Accession=PF03919.6; Description=mRNA capping enzyme, C-terminal domain
  Pfam annotation: Domain name=mRNA_cap_enzyme; Domain location=5-113; Score=10.5; E_value=7.5e-09; Accession=PF01331.10; Description=mRNA capping enzyme, catalytic domain
  Pfam module annotation: Pfam domain module=mRNA_cap_C::mRNA_cap _enzyme; Domain location=116-215::5-113
MNACKLLVGFETTSDLWVISLLPFYERWKLLEKEVIEPRNMEREGLSKSINPYYRYDLEPFSVRRKGFWLLSTVSKLLHKFIPQLSHSSDGLVFQGWDDPYVPRTHEGLLKWKYPEMNSVDFLCEVVQVGAGDRPLLFLFERGRKKLMEENVIFKDASDISSYSGKIIECYWDSAEHHWVCMRIRIDKATPNDINTYRKVMRSIKDNITEDVLLNEINQIIRLPLYADRIQRDIKAHQHMISLRRK

SEQ ID NO: 158980 - protein, 308 aa, Glycine max
  Coding DNA Sequence Number=SeqID_42202
  Gene Ontology: Mol. function=tRNA isopentenyltransferase activity; Cellular component=intracellular; Biological process=tRNA processing
  Homolog annotation: Hit_ID=Q1W5W3; Match level="QueryCoverage=97%, HitCoverage=95%, E-value=1e-112, Identity=67%"; Hit description =Adenylate isopentenyltransferase
  Pfam annotation: Domain name=IPPT; Domain location=65-248; Score =13.6; E_value=8.4e-12; Accession=PF01715.8; Description=IPP transferase
  Pfam annotation: Domain name=IPT; Domain location=31-248; Score= -128.5; E_value=0.0085; Accession=PF01745.7; Description=Isopentenyl transferase
  Pfam module annotation: Pfam domain module=IPPT::IPT; Domain location= 65-248::31-248
  Subcellular localization annotation: CTP_CleavageSite=37; ConfidenceScore=5.10e-01
MSRVMCRPTQPLKNVPTNTSSGQNQIIRPKEKVVLVMGATGSGKTRLSIDLATCFPSEIINSDKMQVYSGLDVVTNKATKEEQRGIPHHLLGTQNPNKEFTASDFCDMASHAIESITNREKVPIIVGGSNSYMEALVDKFGTRYEWCCLWVDVSTPVLHSYVAQRVDQMIGGGMVNELRPFFSPNGDYSKGIRKAIGVPEFHEYFRREAFSSTEMRMRLLQDAVREVKRNTCHLACKQLGRIQWLRSVKGWKIHRVCATPVFQKRGQEANDAWKNVVAQPCASIVSQFLYSANAVSGRVPASLQQNSH

SEQ ID NO: 158981 - protein, 447 aa, Glycine max
  Coding DNA Sequence Number=SeqID_42203
  Gene Ontology: Mol. function=RNA-directed DNA polymerase activity; Cellular component=chromatin; Biological process=chromatin assembly or disassembly
  Pfam annotation: Domain name=rve; Domain location=174-326; Score= -3.3; E_value=0.011; Accession=PF00665.16; Description=Integrase core domain
MVQPLTTLMKKKGFYGRGARVSLPCLAFFPVLALPDFTQLYRCNTCGTTYWVVVLRSIQTIAACVICSNSGLQPLINSVGWRVRGISISPIWVDFPTICTEDQQDPELRKLSAQVQANPALVPQYVQRDGIIFFKGRMMLPKTSAMIPVLLADFHSTVRNKYQALSPILQPIPILEVVWGDISLDFISGLPRSQGFDVILVIVDRLSKYAHFLSLKHPYTAHTVAEVFIREVAKLHGFPKSIISNRNPLFLSKFCSELFCLQGTTLRMSTISITLKQMVKQRLLIDVWRPICIVSLLKNQRNGIFGSLGRSIGTILPSTQPRDRLPRLFMDETQFLLGETQVDSVASVLVDRDEAIHQLKFHLHRAQQSMKKAADKHCHAVSFAEGDWVFVKLCPHRQHTVACRINPKLSTCYFGPFKILSRVGEVAYKLKLPESARVHPVFHLSQL

SEQ ID NO: 158982 - protein, 447 aa, Glycine max
  Coding DNA Sequence Number=SeqID_42204
  Gene Ontology: Mol. function=protein tyrosine/serine/threonine phosphatase activity; Biological process=protein amino acid dephosphorylation
  Homolog annotation: Hit_ID=Q8GSD7; Match level="QueryCoverage=66%, HitCoverage=42%, E-value=1e-80, Identity=52%"; Hit description=MRNA capping enzyme-like protein
  Pfam annotation: Domain name=DSPc; Domain location=47-187; Score =16.8; E_value=7.8e-06; Accession=PF00782.11; Description=Dual specificity phosphatase, catalytic domain
MEMIVYVKCLTCSAWVGWLDCPPHGQEIGCIIPSKVPLGDSFNDYISSQKYTPKQAIHQQRVLGRELGLVIDLTNTTRYYRVSDWTKEGIGHVKIRCTGRDAVPDDESVKKFCDKVLDFCSQRTNTKKYILVHCTHGHNRTGYMIVHFLVRTESISVTEAINKFACARHPGIYKQDYIDALYMFYHEKKPEDLVCPQTPEWKRISDPDFRGTAVPAVDNCAHIPEQCCHWVEYLTSWHVIYFQQVCVSMSLPGTIVRNEVLTSDDALGDPIPPNQLRSMQELCYQLLKLGTGGRGCWQFPGSHPVSLNRTTSQRLDAIEVDLAAIKLILQSHESFISANLPSSIPLSPLSMRESHFSNSAGSFHHSSATSGASSNDVALYSKCVDLPPFVGDNPVGWLAKAETYFSVQNTPSETCISLAQICMEGKTWHWFKFLSNFDPNLHWDSFK

SEQ ID NO: 158983 - protein, 97 aa, Glycine max
  Coding DNA Sequence Number=SeqID_42205
MKSNYINCSLEIPNYGFLASHTRNPTTNETGSTKQLLLTQEEDPSSFSWHLIIAQTLSNLSKFPCHAKCSKDALSGGCVLIPQGLLSPTAPFSTSRF

SEQ ID NO: 158984 - protein, 86 aa, Glycine max
  Coding DNA Sequence Number=SeqID_42206
MEDWENFLHQILEEDFEDSTPIKVFLLISLSELVSLSWSPAFALSATIRARLVGQNSLSATPSRVGIALSAPLLAQGNPLSGWNCA

SEQ ID NO: 158985 - protein, 232 aa, Glycine max
  Coding DNA Sequence Number=SeqID_42207
  Gene Ontology: Mol. function=protein binding; Cellular component =integral to membrane; Biological process=xylan catabolic process
  Homolog annotation: Hit_ID=Q1SWI7; Match level="QueryCoverage=76%, HitCoverage=97%, E-value=7e-67, Identity=47%"; Hit description =Leucine-rich repeat
  Pfam annotation: Domain name=LRR_1; Domain location=120-141; Score =8.5; E_value=7.5; Accession=PF00560.23; Description=Leucine Rich Repeat
  Pfam annotation: Domain name=LRR_1; Domain location=48-70; Score=8.2; E_value=8.4; Accession=PF00560.23; Description=Leucine Rich Repeat
  Pfam annotation: Domain name=LRR_1; Domain location=72-94; Score =13.2; E_value=0.94; Accession=PF00560.23; Description=Leucine Rich Repeat
  Pfam annotation: Domain name=LRR_1; Domain location=96-118; Score =15.8; E_value=0.16; Accession=PF00560.23; Description=Leucine Rich Repeat
  Pfam module annotation: Pfam domain module=LRR_1::LRR_1::LRR_1::LRR _1; Domain location=120-141::48-70::72-94::96-118
MTLKNQSTDPRIYSQGKYSVSYSSTESIVSVLLWLKGRGDEYRNILGLVTSIDLSSNKLFGEIPREITYLNGLNFLNMSHNQLIGHIPQGIGNMRSLQSIDFSRNQLFGEIPPSIANLSFLSMLDLSYNHLKGNIPTGTQLQTYDASSFIGNNLCGPPLPINCSSNGKTHSYEGSDGHGVNWFFVSMTIGFIVGFWIVIAPLLICRSWRGRVAERKEGKDRRCGGMELRITK

SEQ ID NO: 158986 - protein, 485 aa, Glycine max
  Coding DNA Sequence Number=SeqID_42208
  Gene Ontology: Mol. function=protein binding; Cellular component =membrane of vacuole with cell cycle-correlated morphology; Biological process=mitochondrion organization and biogenesis
  Homolog annotation: Hit_ID=Q67XQ0; Match level="QueryCoverage=95%, HitCoverage=88%, E-value=1e-154, Identity=66%"; Hit description=MRNA, complete cds, clone: RAFL25-31-I24
  Pfam annotation: Domain name=CBS; Domain location=248-439; Score =28.4; E_value=2.5e-05; Accession=PF00571.18; Description=CBS domain
  Pfam annotation: Domain name=DUF21; Domain location=34-210; Score =149.2; E_value=1.1e-41; Accession=PF01595.10; Description=Domain of unknown function DUF21
  Pfam module annotation: Pfam domain module=CBS::DUF21; Domain location=248-439::34-210
MLLHELNLGMREFQPGNFVYDAEDIPFGTLWWFFYAGISCLLVLFAGIMSGLTLGLMSLGLVDLEILQQSGSSTEKKQAAAILPVVQKQHQLLVTLLLCNACAMEALPIYLDKIFHPFVAVVLSVTFVLAFGEVIPQAICTRYGLYVGANFVGLVRVLMIICYPIAYPIGKVLDVLLGHDHALFRRAQLKALVSIHSQEAGKGGELTHDEATIISGALDLTEKTAEEAMTPIESTFSLDVASKLDWMLLATSTNGYVWIDEKGWEAIGKILARGHSRVPVYSGNPKNIIGLLLVKNLLTVRAETETPVSAVSIRRIPRVPADMPLYDILNEFQKGSSHMAAVVKVIRERNNPQSPNDTEKSKDKEVIKHNSQLTIPLLSRFYEKSENVVNIDKPKLAADQQFQKDGPATNGVYHSLDNAEDGEEVIGIITLEDVFEELLQEEIVDETDVYIDVHRRIRVAAVAAATSVARVPSGRKLTGHKPIGN

SEQ ID NO: 158987 - protein, 57 aa, Glycine max
  Coding DNA Sequence Number=SeqID_42209
MEDGVKGICGGLEIVARGCRNRTCPTVHLRYLSDTYEFVSLSPNPVEKDFSSTSTKK

SEQ ID NO: 158988 - protein, 63 aa, Glycine max
  Coding DNA Sequence Number=SeqID_42210
MALNHCPYFRRAKICSKYALDVVSRFGAYYRARVWPGPARIEKRGESLRRNSQVQRSIYEVQS

SEQ ID NO: 158989 - protein, 79 aa, Glycine max
  Coding DNA Sequence Number=SeqID_42211
  Gene Ontology: Mol. function=glutathione peroxidase activity; Cellular component=chloroplast; Biological process=response to oxidative stress
  Homolog annotation: Hit_ID=Q9FEV2; Match level="QueryCoverage=70%, HitCoverage=33%, E-value=2e-17, Identity=73%"; Hit description =Putative phospholipid hydroperoxide glutathione peroxidase
MPNGKHVGIVVRVNGPDTAPVYKFLKANKTGFLGSRIKWNFTKFLVDKEGHVLARYGPTTSPLSIEVQSLSISLHGVHM

SEQ ID NO: 158990 - protein, 137 aa, Glycine max
  Coding DNA Sequence Number=SeqID_42212
  Gene Ontology: Mol. function=DNA binding; Biological process=DNA integration
  Homolog annotation: Hit_ID=Q1SRN1; Match level="QueryCoverage=41%, HitCoverage=3%, E-value=2e-11, Identity=58%"; Hit description =Integrase, catalytic region
MITLDLFHRIGYHYKAADKSLLQGKHDPSLFILHQGPHCIFILVYVDDTIVTGDSLCLIQDFIDKLHSEFAQQFGSINYFLGIQVQPLPDDLPLVPCTMLLLQFTRPEISYAGNKTSQFMSQSLEEHWKSGRQSSSF

SEQ ID NO: 158991 - protein, 829 aa, Glycine max
  Coding DNA Sequence Number=SeqID_42213
  Homolog annotation: Hit_ID=Q1S7H5; Match level="QueryCoverage=96%, HitCoverage=59%, E-value=0.0, Identity=51%"; Hit description=PWWP; Regulation of nuclear pre-mRNA protein
FCNPADVEVFTEEKKQSLAKRPGRGGEFARAVKEIIECYEKLRTENQDGDTGSKEQMDESYSPDPSANTGAKEQMDAPFTINSQMKSSNCVIDRPEDAVALKDESYNIEASLEEATDNAIMTATVKSLFSTTQRNAPVQRSRSTLQVQNFVLPYSDGGNNGSNSNDNISADAIEDTSIRRRKHIRKSPDLLGCDDTDSPAFAPNVSMEDNGSEIITIISDAFTLNEGSTIDSNLKLEQSEPIECPEGEDDLNKGLDLEIKAVINKKKRKPNRKKETNDSGAQNASQSLQNMGGNSKERCPDQDGDEHLPLVKRARVRMGKSSAEAELNSIAQVQVKCGEEDITDSPHQIITSSNCENGSLAEGGTSVLNSALVSVSPSNLIALCSENGSQICKIKKDQMFGCSVDDEAALPPSKRIHRALEAMSANAAEEGEACMESSSIMTSSGRCCISTIKRCPCMTVNNQGGNDLELQRLDSCGIDSSHVSMYSFSTRSNTIISTENESSTEVDKHLAKFQCETGKDVIPGDRQQGGEDLSDSVVCHPAKIDSQIQSHGKISPDLDVKCCQVGNSKDSPCPSLLPNGDYNVRPSNHSDASDTLEHGGISLDPVAGDGESDKLVPQNSINVPQNVVVACEDMGKQAVGGSSKINDTHEVVKEVKFKGQEEDMNSVSISNDYSGEKGNLVILSSPSLTDGRVFLPLGSPPNTSVCNISTSDSSNILQNGSCSPDVHQKNTLSGPTDGWKDGIVENGRSRSVGKSTEAGDAALLYFEATLRTLKRTKESIGRATRIAIDCAKFGIATKETAPLEKPDHFNVSNSEYGSKSFDGLDFGDR

SEQ ID NO: 158992 - protein, 140 aa, Glycine max
  Coding DNA Sequence Number=SeqID_42214
  Gene Ontology: Mol. function=glutathione peroxidase activity; Cellular component=mitochondrion; Biological process=response to oxidative stress
  Homolog annotation: Hit_ID=Q8L910; Match level="QueryCoverage=74%, HitCoverage=61%, E-value=1e-41, Identity=74%"; Hit description =Probable glutathione peroxidase 4
  Pfam annotation: Domain name=AhpC-TSA; Domain location=7-140; Score= -22.8; E_value=0.067; Accession=PF00578.11; Description=AhpCTSA family
  Pfam annotation: Domain name=GSHPx; Domain location=12-107; Score =166.1; E_value=8.8e-47; Accession=PF00255.10; Description =Glutathione peroxidase
  Pfam module annotation: Pfam domain module=AhpC-TSA::GSHPx; Domain location=7-140::12-107
MGASASVTEKSIHEFMVKDAKGRDVNLSTYKGKVLLVVNVASKCGFTNSNYTQLTELYSKYKDRGLEILAFPCNQFLKQEPGSSQEAEEFACTRYKAEYPIFGKLLLVAMSLFTVGEVHSWSRYDRAWAYLTKRNKVGME

SEQ ID NO: 158993 - protein, 44 aa, Glycine max
  Coding DNA Sequence Number=SeqID_42215
MGSGGFFVSVTIHLLRVKIEVSQNFKLLETSKQIGKLKSCYYLS

SEQ ID NO: 158994 - protein, 89 aa, Glycine max
  Coding DNA Sequence Number=SeqID_42216
MDCGSDGGLGFKKKEGQLHQSLCKGSDKLHDKELRWQISTYLMIDDKNQIGKEYTELQIILGVLNSMLQWCSSADWPLSAIGAAIAEQL

SEQ ID NO: 158995 - protein, 90 aa, Glycine max
  Coding DNA Sequence Number=SeqID_42217
  Homolog annotation: Hit_ID=Q1S7H5; Match level="QueryCoverage=42%, HitCoverage=2%, E-value=1e-12, Identity=84%"; Hit description=PWWP; Regulation of nuclear pre-mRNA protein
  Pfam annotation: Domain name=PWWP; Domain location=21-86; Score=20.2; E_value=8.5e-05; Accession=PF00855.8; Description=PWWP domain
MPPSRRKGGKKSAGGAAACRQFKLGDLVLAKVKGFPAWPATVSEPQKWGYSADRKKELNGHEVAIGMHMVFLFDKELNGHDKISKPGCLK

SEQ ID NO: 158996 - protein, 73 aa, Glycine max
  Coding DNA Sequence Number=SeqID_42218
MEKKQDVIARSSAKAEFRTMGLDICGLLRLQIIVDDLRIERKKLVDGILDLRSIRSEDQIADEITKRPLNLDV

SEQ ID NO: 158997 - protein, 267 aa, Glycine max
  Coding DNA Sequence Number=SeqID_42219
  Gene Ontology: Mol. function=protein kinase activity; Biological process=protein amino acid phosphorylation
  Homolog annotation: Hit_ID=Q1T5D4; Match level="QueryCoverage=91%, HitCoverage=22%, E-value=5e-86, Identity=67%"; Hit description =Protein kinase; Zinc finger, RING-type
  Pfam annotation: Domain name=Ank; Domain location=105-173; Score=5.7; E_value=4.8; Accession=PF00023.20; Description=Ankyrin repeat
  Pfam annotation: Domain name=Ank; Domain location=39-71; Score=33.9; E_value=5.8e-07; Accession=PF00023.20; Description=Ankyrin repeat
  Pfam annotation: Domain name=Ank; Domain location=72-104; Score=30.4; E_value=6.1e-06; Accession=PF00023.20; Description=Ankyrin repeat
  Pfam module annotation: Pfam domain module=Ank::Ank::Ank; Domain location=105-173::39-71::72-104
MSTALLMAAASKKDHESGERIGANFAFCGADPSAQHSQHGRTALHTAVMTDDVKLVKVILAAGVDVNIRNVHNGIPLHIALARGAKSCVELLLCIGADCNLQDDDGNTALHIAAGTAKMIRENLDWLIVCLGILMLIGKTLGDILDALPREWISEDLMEALMKKGVCLSPAIFEVGDWVKFRKTSMTPTNGWEGDRQKQVGFVQRVPDKDNLIVSFCSGEYYSVLANEVVKVIPLDKGQHVQLKEDYELQEEPSSKSELISPGTNHP

SEQ ID NO: 158998 - protein, 121 aa, Glycine max
  Coding DNA Sequence Number=SeqID_42220
MTTIMMMMIVSIAITIEISIVIMLMIVLSNVGDYIDDIDGDNDIGGDGNNNDNDNDNGDESGIHNGVNDDDNDNGVGGNSCGDGNGGDIGISGGDNDGLVVEVKVVTSTMVKFKKYVFFKS

SEQ ID NO: 158999 - protein, 261 aa, Glycine max
  Coding DNA Sequence Number=SeqID_42221
  Gene Ontology: Mol. function=protein serine/threonine kinase activity; Cellular component=intracellular; Biological process =protein amino acid phosphorylation
  Homolog annotation: Hit_ID=Q4IYW2; Match level="QueryCoverage=69%, HitCoverage=30%, E-value=2e-39, Identity=51%"; Hit description =Protein kinase
  Pfam annotation: Domain name=Pkinase; Domain location=2-180; Score= -108.2; E_value=0.041; Accession=PF00069.15; Description=Protein kinase domain
MGTQFYSGTTLKNLQAQQPEKIDEAWIRRLLPPLFSAINTIHQEGYLHRDISLDNIQIQESQLPVLLDFGSVRKEIGNLSDETEIMLKPGFAPIEQYTENSDGEQGPWTDIYALGAVLHTLIVGSPPPVSVVRSIEDSYQPLAERRPAGYSPELLRTVDRALALKPEDRPQTIDEMAELLHLPIADENEIISTPAAAPENLLVAANPAAAAAAAGAVTARSTQFSRPMMAGAGVAALLAIGAVAWLSGGEDDTPAVAQNSE

SEQ ID NO: 159000 - protein, 106 aa, Glycine max
  Coding DNA Sequence Number=SeqID_42222
  Gene Ontology: Mol. function=hydrolase activity, hydrolyzing O -glycosyl compounds; Biological process=carbohydrate metabolic process
  Homolog annotation: Hit_ID=Q47522; Match level="QueryCoverage=51%, HitCoverage=67%, E-value=1e-19, Identity=81%"; Hit description=LacZ protein
RVPFAIQAAQLLGRAIGAGLFAITPAGERGMCCKAIKLGNARVFPEFDPESQVEGAPTCQDVMKRTQGRLRGSVVERLPSAQVVIPGSWDRVPHWAPYGEPASPSA

SEQ ID NO: 159001 - protein, 55 aa, Glycine max
  Coding DNA Sequence Number=SeqID_42223
MPQVPDIHGQCQCSAQALERFSSAMALLNVGNRFYPGKLSRTMPLIEPVLESNKH

SEQ ID NO: 159002 - protein, 107 aa, Glycine max
  Coding DNA Sequence Number=SeqID_42224
MIESFQQQQQMSVLELYVEKDVAGGSMFHAANSVTSCGRNVSHHESELPRNISNLHDDEDDDDDDYLASNSYVEESFNEDDSDDGISDTDDEVTDIVEPVSIVHPTE

SEQ ID NO: 159003 - protein, 452 aa, Glycine max
  Coding DNA Sequence Number=SeqID_42225
  Gene Ontology: Mol. function=nucleoside-triphosphatase activity; Cellular component=membrane; Biological process=chlorophyll biosynthetic process
  Homolog annotation: Hit_ID=Q1CNN2; Match level="QueryCoverage=62%, HitCoverage=62%, E-value=9e-84, Identity=63%"; Hit description =Magnesium chelatase family protein
  Pfam annotation: Domain name=ABC_tran; Domain location=331-450; Score= -62.5; E_value=0.059; Accession=PF00005.17; Description=ABC transporter
  Pfam annotation: Domain name=Mg_chelatase; Domain location=310-452; Score=250.9; E_value=2.7e-72; Accession=PF01078.11; Description =Magnesium chelatase, subunit ChlI
  Pfam annotation: Domain name=Sigma54_activat; Domain location=314 -452; Score=-170.4; E_value=0.0027; Accession=PF00158.16; Description= Sigma-54 interaction domain
  Pfam module annotation: Pfam domain module=ABC_tran::Mg _chelatase::Sigma54_activat; Domain location=331-450::310-452::314-452
  Subcellular localization annotation: CTP_CleavageSite=30; ConfidenceScore=5.23e-01
MVSIANDDATPQMPPIATPYNTRNSKKTVSEGAAAESSSNTEKKTIFSIRIGLRPYFSAARPKISAPIGRTASVSRIANRGPTKHSVIPTVEYEVRRFSGCRAECGGGRAFSELLMGIAAGCEAARTTSFISMKISDYSAKCIEKPPIPPRNAQMNHASCRPQQGERYVTGGPFRDGGGAYQQWPARPDAGRPAGNHGGRYDLPIALAILAASEQLPLAPLARYEFLGELALSGSLRAVRGAIPAALAAADAGRQLILSTDNAAEVGLIAQSHSHTARHLLEVCAFLLGQGELPVAATPPAADTACDSADLRDIIGQEQAKRALEIAAAGGHNLLLIGPPGTGKTMLASRLTGLLPPLTEPEALESLAVASLQHHIPAALPWRQRPFRAPHHSASMAALVGGGSLPRPGEISMAHNGVLFLDELPEFERKVLDALREPLESGEIVISRAQRQ

SEQ ID NO: 159004 - protein, 160 aa, Glycine max
  Coding DNA Sequence Number=SeqID_42226
  Gene Ontology: Mol. function=transporter activity; Cellular component= integral to membrane; Biological process=transport
  Homolog annotation: Hit_ID=Q8ZRG4; Match level="QueryCoverage=96%, HitCoverage=37%, E-value=2e-53, Identity=65%"; Hit description =Putative inner membrane protein
MFGWTPLQRNAAIASFSSWTLDAFDFFVLVFLLSDIAQSFHVGLEQVTLAILLTLAVRPIGALIFGRAAEKYGRKPILMLNIVFFSVFELLSAAAPSLTVFLLLRVLYGVAMGGIWGVASSLAMETIPDRSRGLMSGIFQAGYPFGYLLAAVVYGLLFET

SEQ ID NO: 159005 - protein, 400 aa, Glycine max
  Coding DNA Sequence Number=SeqID_42227
  Gene Ontology: Mol. function=biotin-[acetyl-CoA-carboxylase] ligase activity; Cellular component=intracellular; Biological process =regulation of transcription, DNA-dependent
  Homolog annotation: Hit_ID=P06709; Match level="QueryCoverage=79%, HitCoverage=99%, E-value=1e-134, Identity=75%"; Hit description =Bifunctional protein birA [Includes: Biotin operon repressor; Biotin- - ...
  Homolog annotation: Hit description=[acetyl-CoA-carboxylase] synthetase (EC 6.3.4.15) (Biotin--protein ligase)]
  Pfam annotation: Domain name=BPL_C; Domain location=351-397; Score =51.1; E_value=3.7e-12; Accession=PF02237.7; Description=Biotin protein ligase C terminal domain
  Pfam annotation: Domain name=BPL_LipA_LipB; Domain location=163-260; Score=97.1; E_value=5.1e-26; Accession=PF03099.9; Description =Biotinlipoate AB protein ligase family
  Pfam annotation: Domain name=HTH_11; Domain location=85-139; Score =44.7; E_value=3.2e-10; Accession=PF08279.2; Description=HTH domain
  Pfam annotation: Domain name=MurB_C; Domain location=1-80; Score =115.9; E_value=1.2e-31; Accession=PF02873.7; Description=UDP-N -acetylenolpyruvoylglucosamine reductase, C-terminal domain
  Pfam annotation: Domain name=Rrf2; Domain location=88-174; Score= -38.7; E_value=0.093; Accession=PF02082.10; Description =Transcriptional regulator
  Pfam module annotation: Pfam domain module=BPL_C::BPL_LipA_LipB::HTH _11::MurB_C::Rrf2; Domain location=351-397::163-260::85-139::1-80::88- 174
MPHYPQQDGQVKLAAGWLIDQCELKGYRIGGAAVHRQQALVLVNIDNAHSQDVVALARHVRKTVADKFGVWLEPEVRFIGATDTKVPLKLIALLADGEFHSGEHLGESLGMSRAAINKHIQTIREWGLDVFTVPGKGYSLPGAIQLLEAERILSLLEDKRVSVLPVVDSTNQYLLDRIAELHSGDACVAEYQQAGRGRRGRQWISPFGANLYLSMFWRLEQGPAAAMGLSLVIGMVMAEVLQRLGAADVRVKWPNDLYLNDRKLAGILVELTGKTGDAAQLVIGAGINLAMRDTNASAITQGWINLQEAGIQIDRNELAATLLNELRQSLKQFEIDGLAPFIGRWRTLDNFIDRPVKLLIGERQIVGIARGIDSQGALLLEQDGEIKPFIGGEISLRSAE

SEQ ID NO: 159006 - protein, 117 aa, Glycine max
  Coding DNA Sequence Number=SeqID_42228
  Gene Ontology: Mol. function=metal ion binding; Biological process =ubiquitin cycle
  Homolog annotation: Hit_ID=Q10R22; Match level="QueryCoverage=83%, HitCoverage=37%, E-value=5e-25, Identity=59%"; Hit description=Zinc finger, C3HC4 type family protein, expressed
  Pfam annotation: Domain name=zf-C3HC4; Domain location=64-106; Score =29.1; E_value=1.5e-05; Accession=PF00097.15; Description=Zinc finger, C3HC4 type (RING finger)
MTYEVRCTYVLCVNADELLDLGEAVGTQSRGLSQELIDMLPTSKYKFDENVDTKKLNGGQAVYCIFEEDEMTYRRGDQQMKLPCSHVYHGECITKWLSINKKCPVCNTEVFGEESTH

SEQ ID NO: 159007 - protein, 410 aa, Glycine max
  Coding DNA Sequence Number=SeqID_42229
  Gene Ontology: Mol. function=inositol or phosphatidylinositol phosphatase activity; Cellular component=integral to membrane; Biological process=carbohydrate metabolic process
  Homolog annotation: Hit_ID=P0ADG4; Match level="QueryCoverage=58%, HitCoverage=90%, E-value=1e-121, Identity=88%"; Hit description =Inositol-1-monophosphatase
MAKEKLQENNINLDDLQNELQTTLRQTGKPELQPENLQQDVNSEANNAQNQAKQTAQNPQNADNDIANWIRGVLSRHADTLQAADRDALKNIIKARTGKSDQEAEQIVNQTEQSYQQAMQKYQQLKQEAEQKAREAAEKAAAATAKASWFAFFMMLIEAVLAAVLGGVALQRFAQFFAHAGQHRLHHTRVTGHQVARQHIAVVTGEIGHQTARFTHQQFTGSEIPWLQANLKETVNATCGHIGQIQRSRAGTAEISALGKQFCHDVDERRGVLLQLEREAGSQNGAVEVTRRAAAQAIAVKLRTLTAYRGEQFVTHWIVNHRHFGAAFDAHGDRNSKVGQTFDEVGGAIQGIDYPLNILIVARQLTAFFGDDGVLRVGFANHFDNQTFCVAVNIGNEVVAAFLAGFDGVR

SEQ ID NO: 159008 - protein, 53 aa, Glycine max
  Coding DNA Sequence Number=SeqID_42230
  Homolog annotation: Hit_ID=Q9MB42; Match level="QueryCoverage=59%, HitCoverage=4%, E-value=7e-07, Identity=68%"; Hit description=Beta -amyrin synthase
MKRATHYLSSLQTSDGHWPAHLGGSLFFTPPLKLLNKYVHLEWLHNLVMFSNG

SEQ ID NO: 159009 - protein, 143 aa, Glycine max
  Coding DNA Sequence Number=SeqID_42231
TCRKAWAEQMRPWGRQGDRALVIDYQLGVIDYTVLPATERKSLEKDIMTMRSRYAQLIHDRVVMECLEGVWETLEGNERCRFRGTIRLTATSLVHPEEPACTLQQPMEWILPTPTPYQLVKPVQVIEVSSSEEDHEEDPEELP

SEQ ID NO: 159010 - protein, 144 aa, Glycine max
  Coding DNA Sequence Number=SeqID_42232
  Homolog annotation: Hit_ID=Q8H6Q7; Match level="QueryCoverage=37%, HitCoverage=4%, E-value=4e-18, Identity=73%"; Hit description=CTV.22
  Subcellular localization annotation: CTP_CleavageSite=50; ConfidenceScore=5.51e-01
RQKHRRTSALASVAVTLRVTTTPAALNAPLQGASHSPFRLRNCWEGRSVRASSLLRQLAKGGCAARRLSWIKSMKESYLPELNEMYQKIASKLQQHDSLPQQPKSDQLEKLKVSKSNISPNFKEIKLIDTVDLEGGPGTSFCSL

SEQ ID NO: 159011 - protein, 334 aa, Glycine max
  Coding DNA Sequence Number=SeqID_42233
  Gene Ontology: Mol. function=chitin binding; Cellular component =extracellular region; Biological process=chitin metabolic process
  Homolog annotation: Hit_ID=UPI000044A8F0; Match level="QueryCoverage =67%, HitCoverage=99%, E-value=2e-35, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
YKGLHALAFKGLYVLTFSGLHALAFRGLHVLAFRGLHALAFRGLHVLAFRGLYVLAFRGLHVLAFRGLYVLTFRGLHILAFRGLHVLAIRGLHVLAIRGLHALTFRGLHVLTFRGLHVLTFRGLHVLTFRGLHVLTFRGLHALAFRGLNVLAVRGLDVLAFRGLQPLAFRGLQPLAFRWLHALSLRGLCVLTFRGLHVLALRGLHVLHFRGLHVLAFRGLHALAFNGLHIRTLREFKGSRPQDTQWTRRSPQGPGVSSLVYGPLSVLQGARPPQQGIAPARHPVDPKKSSRVLGFLALITGLCQFYEVPVAPNKVTRPPIKRAFIKKYCAPRQA

SEQ ID NO: 159012 - protein, 49 aa, Glycine max
  Coding DNA Sequence Number=SeqID_42234
MASYLALKDTCQPAMSTLLQECRRLTLSSRAPQPAGINLSISPHIIYKV

SEQ ID NO: 159013 - protein, 87 aa, Glycine max
  Coding DNA Sequence Number=SeqID_42235
MGWGGVAGGEDEERGSTPCPIDILSPQHKGSKQTNSLLVRWKRKSVRRSHVKKEKEKKKKCKKRSEVKKEKEKKKCKKMKVSAIVAT

SEQ ID NO: 159014 - protein, 96 aa, Glycine max
  Coding DNA Sequence Number=SeqID_42236
  Homolog annotation: Hit_ID=Q1SBC2; Match level="QueryCoverage=61%, HitCoverage=8%, E-value=3e-08, Identity=40%"; Hit description=Zinc finger, RanBP2-type
MFSDLTVLLPSRTQLVVLHSVQQPILELAHPWPEWVQLMKCLLDKGYFFREEGKMLCNAGMGMKDFNVIRTVCLNFGRDHFHLLRFGRDLELCDRL

SEQ ID NO: 159015 - protein, 154 aa, Glycine max
  Coding DNA Sequence Number=SeqID_42237
  Homolog annotation: Hit_ID=Q1SN43; Match level="QueryCoverage=85%, HitCoverage=25%, E-value=5e-24, Identity=41%"; Hit description =Nucleic acid-binding, OB-fold, subgroup
MANNHNTIVEIDATRENWKICVRVVRLWLVPDFKNKKLSHSLEMGDRIHAIAKRTLIYNFQNEIKKGKCYSFHLMGVASNTGGFKTNHHPYKLIFQFSTKVILLDDGVVQNIVYDLVPISTIMDGDLDVDYLVAKKLERERKGWQEDQDECDST

SEQ ID NO: 159016 - protein, 244 aa, Glycine max
  Coding DNA Sequence Number=SeqID_42238
  Gene Ontology: Mol. function=mismatched DNA binding; Cellular component=mitochondrion; Biological process=mismatch repair
  Homolog annotation: Hit_ID=Q11YS6; Match level="QueryCoverage=99%, HitCoverage=28%, E-value=3e-76, Identity=59%"; Hit description=DNA mismatch repair protein
  Pfam annotation: Domain name=MutS_I; Domain location=1-109; Score =186.0; E_value=8.9e-53; Accession=PF01624.10; Description=MutS domain I
  Pfam annotation: Domain name=MutS_II; Domain location=117-241; Score =102.9; E_value=9.2e-28; Accession=PF05188.8; Description=MutS domain II
  Pfam module annotation: Pfam domain module=MutS_I::MutS_II; Domain location=1-109::117-241
MAQYNTIKGKYPDALLLFRVGDFYETFGQDAIRASQVLGIVLTKRANGEGHIELAGFPHHSVDSYLPKLVRAGLRVAICDQLEDPKMVKGIVKRGVTELVTPGVTFNDQVLSSKKNNFLLSIHKEKEKFGIALVDISTGEFLVSEGTLEKLLHIVSTFDPSEIIYQRSVQIPEQLKNKSAFKLEDWAFQYNFAYEKLTGQFKTNSLKGFGIENLSLAITAAGAIFAYLVEDTHHNLLAHITKNQ

SEQ ID NO: 159017 - protein, 191 aa, Glycine max
  Coding DNA Sequence Number=SeqID_42239
  Homolog annotation: Hit_ID=Q40538; Match level="QueryCoverage=18%, HitCoverage=64%, E-value=3e-07, Identity=86%"; Hit description =Nicotiana tabacum (clone 5) activating factor DNA sequence
  Subcellular localization annotation: CTP_CleavageSite=60; ConfidenceScore=5.24e-01
MGPPSFSMIRRLLSHPNLQDLSTAATMGLLSRCFSGTTSISCPYPSRIPLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159018 - protein, 314 aa, Glycine max
  Coding DNA Sequence Number=SeqID_42240
  Gene Ontology: Mol. function=chromatin binding; Cellular component =chromatin; Biological process=chromatin assembly or disassembly
  Homolog annotation: Hit_ID=Q1SJF7; Match level="QueryCoverage=72%, HitCoverage=43%, E-value=2e-66, Identity=48%"; Hit description =Chromo; Polynucleotidyl transferase, Ribonuclease H fold
MAKDCNVTLNMKPTVKTVKLNKVRVKNKYLLPRIADLMDQLKGVLVFSKIDLSSGYHQIRVRDNDISKTAFQTRYGHYEYVLMPFEMQHRKVVAYALRKLKVHERNYPMHDHLEFPPIVFAFKIYRHYLYGARFDLFSVHKILKYLFDQKELNMKQRRWLEFIKGYDFQLMYHPGKANVAIDALSRKMIHMSSLMVKELELIEKFRDLNLYVIRGSNCLRCGMIKVNNNFLDMIKEKQLLDHHLCRNVYTPKGQELEKMILNEGDKTKVEHMRPGGMLQPLEVPKWKWESISMDFVVRLPKTTRNFDAILVIVD

SEQ ID NO: 159019 - protein, 379 aa, Glycine max
  Coding DNA Sequence Number=SeqID_42241
  Gene Ontology: Mol. function=subtilase activity; Cellular component =extracellular region; Biological process=proteolysis
  Homolog annotation: Hit_ID=Q54483; Match level="QueryCoverage=97%, HitCoverage=31%, E-value=3e-40, Identity=33%"; Hit description=SSP-h1
MNCSPSKFGSIDAGCTLYVVAVDGQRADRIAGRDDAVDVGAAERTDTLQQAVGTDRGGAAGLRTVEGHHATVDGQVAVLQQAAAADRAHAPGGVQRGGDQAAIEQELATLDLDRRRERVGAIQFQRTVLQYRAVESVVTAQAQPADAGLGQLAGATDVVGPVVPGIAFPDLQATGLLVHHHVGIHAQRAVAFDGLAQVDHAPAVDRIDACCTQVACGGQQHVADLGVVQIGEALHQQAERTGDVWRRHRRARLGAIDVLGVLAVDDQADIGGSVLDATLDITGHNGAQDVGAGCRDAPVGGNAADAGTAIDHVVGFARSSVGPADVGHGQPVRFKFRLPARHGGRDSGDGATAVTSRPHLDEGGGGGIAIVGVDAAIHA

SEQ ID NO: 159020 - protein, 150 aa, Glycine max
  Coding DNA Sequence Number=SeqID_42242
  Gene Ontology: Mol. function=transition metal ion binding
  Homolog annotation: Hit_ID=UPI000067E92F; Match level="QueryCoverage =84%, HitCoverage=38%, E-value=2e-07, Identity=29%"; Hit description =Conserved hypothetical protein 2284
MSTQSTIEHRLNDLIEIARDGKSFYEEAATKVKDAELSALFTRIAGVKGRIVAALSSSVAASGGKPAEHGTMVGSMQQFYGKVRAAFGDTNYGYVAELEESEDRLLGAFKDVLKDNELPPAVRQEVTQLLPEVQECHNVMRARKHAMKAA

SEQ ID NO: 159021 - protein, 272 aa, Glycine max
  Coding DNA Sequence Number=SeqID_42243
MGEVEEVQEQMKADTEALKEKMATMMEVMMTIMEVSAAYQTHARARVMGEVEEVQEQIKADMEEKMATMVEAMMSMKKIMEANTVAVAATSAVAKVNQMPPSDLKPNESSNLRYGGQRFGKYGRPHDVQIRNKHAFPPYGSPPKEDVNNSAPILIESQQPQVDHAHVSQPMGETHEIPHHNLADFEPCLGYATGGQAVGGIPMPNTLEGPQYHPQPHPLHSTAIKNLHAMTEMGKLDHIEERLKDIEGGEDCAFANLEELFPVPDMVIPKFK

SEQ ID NO: 159022 - protein, 131 aa, Glycine max
  Coding DNA Sequence Number=SeqID_42244
  Homolog annotation: Hit_ID=Q47522; Match level="QueryCoverage=36%, HitCoverage=59%, E-value=4e-22, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVTTLNSMAVLVTDMAGVPCTVVDAVALLLPVEGSATVVSVVANCTVA

SEQ ID NO: 159023 - protein, 151 aa, Glycine max
  Coding DNA Sequence Number=SeqID_42245
SPPEDAYISGEGADDDSRPEDAYISGEGADDNVRHYILLGFKSDRSQMRLFRSLCRKTQTSQGKSQLEDAYISGKGADDDSRPEDTDISRKGTHDDISRCMLPNLESDGSQLRLCRSHGRRTLTSPGKSRLEDADISGKGANDDVSHYMLS

SEQ ID NO: 159024 - protein, 217 aa, Glycine max
  Coding DNA Sequence Number=SeqID_42246
MRLFQSQPKEAYIIGEGADDDDTDISRNVARDDVSHCMLSGFESNGSQMRHCRSLGQKMLKSPGKVLVTTLVIACYRALSLTDCQRDFFALSTGRRLISREAADDNGHMTNDTLLQSRPEDADISRKGANDDCQPEDAYISGEEDVDISIKGTDDDVSRCMLPDMKSDGSQKRLLRSIGWKTLTSPGKSQPEDAYISGEGADDDVNHYMLLRFEPYG

SEQ ID NO: 159025 - protein, 81 aa, Glycine max
  Coding DNA Sequence Number=SeqID_42247
MTNVVICTFPEDVGVFRLRLLKSLICYPYRRLPVETVKKSHLRSVRLKARYHPVTNVVIFTFLRDVGIFRSRLQKRLICYP

SEQ ID NO: 159026 - protein, 78 aa, Glycine max
  Coding DNA Sequence Number=SeqID_42248
MTTLVIACYRALSLTDRKSDIFAVSAERHRHLRKTLTSPEKVANETFSQYRLEDADISGKGANDDVSHYMLSSLESYG

SEQ ID NO: 159027 - protein, 294 aa, Glycine max
  Coding DNA Sequence Number=SeqID_42249
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=P19366; Match level="QueryCoverage=99%, HitCoverage=84%, E-value=1e-120, Identity=62%"; Hit description=ATP synthase subunit beta
  Pfam annotation: Domain name=ATP-synt_ab; Domain location=23-168; Score=72.5; E_value=1.3e-18; Accession=PF00006.15; Description=ATP synthase alphabeta family, nucleotide-binding domain
  Pfam annotation: Domain name=ATP-synt_ab_C; Domain location=181-288; Score=178.2; E_value=2e-50; Accession=PF00306.17; Description=ATP synthase alphabeta chain, C terminal domain
  Pfam module annotation: Pfam domain module=ATP-synt_ab::ATP-synt_ab _C; Domain location=23-168::181-288
AVAMSATEGLMRGMEVIDTGAALRIKVVDLLAPYRRGGKIGLFGGAGVGKTVLIMELINNIAKAHGGVSVFGGVGERTREGNDLYMEMKESGMSMNKMYFYLSTISFASSKAGSEVSALLGRMPSAVGYQATLSTEMGSLPERITSTKEGGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 159028 - protein, 190 aa, Glycine max
  Coding DNA Sequence Number=SeqID_42250
  Gene Ontology: Mol. function=ribonuclease H activity; Cellular component=intracellular; Biological process=DNA integration
PQMNGAVEAANKNIKKIVQKMVVTYKDWHEMLPYALHGYRTSVRTSTGATPFSLVYGMEAVLPVEVEIPSMRVLMEAQLSEAEWCQSRYDQLNLIEEKRMKALCHGQLYQQRMKQAFNKKVRPRVFQEGDLVLKKVLSFQPDSRGKWTPNYEGPYVVKRAFSGGALTLTTMDGDELPRPVNADAVKKYFV

SEQ ID NO: 159029 - protein, 179 aa, Glycine max
  Coding DNA Sequence Number=SeqID_42251
  Gene Ontology: Mol. function=protein serine/threonine kinase activity; Biological process=protein amino acid phosphorylation
  Homolog annotation: Hit_ID=Q47522; Match level="QueryCoverage=31%, HitCoverage=76%, E-value=4e-17, Identity=72%"; Hit description=LacZ protein
VPPVQLLTGWCVTAKAPPDISAGKCSGHAARRVPFAIQAAQLLGRAIGAGLFAITPAGERGMCCKAIKLGNARNFLFASKDESSKLKAIDFGLSDFVKLDERLNDIVGSAYYVAPEVLSSLSIPSTSRGGPVPAFVPFSEVGKPVVPAALMNRPTRGERRFAYWALAECILAYYVGTDE

SEQ ID NO: 159030 - protein, 130 aa, Glycine max
  Coding DNA Sequence Number=SeqID_42252
  Homolog annotation: Hit_ID=Q1RXP4; Match level="QueryCoverage=68%, HitCoverage=6%, E-value=1e-22, Identity=58%"; Hit description=AAA ATPase
MVVIDVFHYELVYETKVSFVNPDGSGNLNPRPPFKIKLPRTLKPNNGALTGHAISNSGATNEINVVDANYQKEALIIETYTPPDPGPYPQDQPKQNSVRFTPTQLRRARKKALGSHILKNFEAFLFFLSL

SEQ ID NO: 159031 - protein, 204 aa, Glycine max
  Coding DNA Sequence Number=SeqID_42253
  Gene Ontology: Mol. function=RNA binding
  Homolog annotation: Hit_ID=Q6Z7B3; Match level="QueryCoverage=59%, HitCoverage=15%, E-value=6e-23, Identity=45%"; Hit description=Heat shock factor protein hsf8-like
MAHFDSPFVSPCLHRHPPLCRHRDPQHAVVLEALQNSLTVAPRHAPFVGLEQHEQRQLEFHEEPNDLCQLSDLKSDDSRVELSAEAALQAKPKRLDKYVKQTSKFVGEEGASRNIGGHTNNDDLGKIVDMSDFQESEDADWTRTRDLIKTGDREDVELVSCNTKGFIVSFGSLAGFLPYHNLASKWKFLASESWLKQKGLDPSI

SEQ ID NO: 159032 - protein, 67 aa, Glycine max
  Coding DNA Sequence Number=SeqID_42254
MEEMERVVLAVLGEEGDEGVKDRTKLVGAWYSKTVMIKPPSKTSFWSAYIYNNATVLLSKTVFSRPS

SEQ ID NO: 159033 - protein, 154 aa, Glycine max
  Coding DNA Sequence Number=SeqID_42255
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=87%, HitCoverage=57%, E-value=1e-30, Identity=44%"; Hit description =Protein ULTRAPETALA2
MLTKKGVEGGRAISDEDRDRVPLWKTPLTKYYTHQANEANWKDSAMRKRNFHWDEFLHCTSCRKECRFHLKSILDIKNYHEALDNKSWTCSLWPYQKIICDDDEERPSMRVSRGCSRSSTCQGCSTCYCEGCIKFRFEDCNCQECIDFMLYAEP

SEQ ID NO: 159034 - protein, 60 aa, Glycine max
  Coding DNA Sequence Number=SeqID_42256
MNKARLLQFIVFVDIGVVVFHCPCWWREHRVGTRTARAKSGIKVLPVVMVAVRVGEQDFD

SEQ ID NO: 159035 - protein, 171 aa, Glycine max
  Coding DNA Sequence Number=SeqID_42257
  Homolog annotation: Hit_ID=Q1SIS3; Match level="QueryCoverage=38%, HitCoverage=16%, E-value=2e-13, Identity=60%"; Hit description =Peptidase M14, carboxypeptidase A
MASSSLLPSRHSPQFTREFLLSFSYYNEREFDELSSQDRISHSRSTPNPHPPTPIVHKHTKSKKKRSDFEKDGFVSCNKCRPHSCDKIFILPLDPIIMASGYLVYLLSTIFLPFILYALLLHKFVMKKEFWRMAKAVQNQYFNEVRQLEAERFKALRIQWAQYYLKVRNQT

SEQ ID NO: 159036 - protein, 48 aa, Glycine max
  Coding DNA Sequence Number=SeqID_42258
MENWRTALRNNFAGLQTRREWRIGGQRYAITSRGSRLEGGGHMNSARQ

SEQ ID NO: 159037 - protein, 271 aa, Glycine max
  Coding DNA Sequence Number=SeqID_42259
  Gene Ontology: Mol. function=oxidoreductase activity; Cellular component=cytoplasm; Biological process=cell redox homeostasis
  Homolog annotation: Hit_ID=Q6AGN5; Match level="QueryCoverage=98%, HitCoverage=56%, E-value=1e-112, Identity=74%"; Hit description =Dihydrolipoamide dehydrogenase
  Pfam annotation: Domain name=Pyr_redox; Domain location=13-105; Score= 90.3; E_value=5.9e-24; Accession=PF00070.17; Description=Pyridine nucleotide-disulphide oxidor
  Pfam annotation: Domain name=Pyr_redox_2; Domain location=13-152; Score=30.5; E_value=3.3e-06; Accession=PF07992.4; Description =Pyridine nucleotide-disulphide oxidor
  Pfam annotation: Domain name=Pyr_redox_dim; Domain location=181-270; Score=46.6; E_value=8.6e-11; Accession=PF02852.12; Description =Pyridine nucleotide-disulphide oxidored
  Pfam module annotation: Pfam domain module=Pyr_redox::Pyr_redox _2::Pyr_redox_dim; Domain location=13-105::13-152::181-270
MDLLYDMKSLPEHLIVFGSGVTGAEFASAYMNLGAKVTLVSSRDQVLPGEDKDAASVLEKVFKRGGMQVLSKSRADKVEVTKDGVTVTLSDGRTVDGSHCLMAVGSIPNTAGIGLEEAGVELDDSGHVRVNKVARTSVPNVYAVGDCTNFFPLASVASMQGRTAVFHALGDIVIPLELIKITSNIFTAPEIATVGYGVKDVEDGVSDGMVYKLPLAANPRAKMMGIKDGFVKLIARKGSGTVIGGVIVAPKASELIYPIAVAVERRLTVDQ

SEQ ID NO: 159038 - protein, 94 aa, Glycine max
  Coding DNA Sequence Number=SeqID_42260
ALPKYFRSRVAYGGSNPARLGELGGNLLPHFPINRRREVVPNIPNPLGYAFQLFWVKKIISVKKIQVEVLPRRFCEKIREGFPSFFIRSSFFNG

SEQ ID NO: 159039 - protein, 78 aa, Glycine max
  Coding DNA Sequence Number=SeqID_42261
MVHVATDGDSIGNAGLGIIKKGVELIINEFRAEVAWPEDWPETQAGEAPAEAPGDVEEARMDEEMTYLLSFLGGSGAT

SEQ ID NO: 159040 - protein, 226 aa, Glycine max
  Coding DNA Sequence Number=SeqID_42262
MGEVEEVQERMKADMEAMKEQMDTMMEAMMSMKKIMEVYAAVVSATSTVAVVDRNPLSGLNQINPLALDMIAQGGKELGSTGGPHFVPIQNKHVFPPYGLPPNYTPPNVAHTPDENFLPQPQPLHFALGRVLLALAEKGKLDHIEERLRAIEGGRDHAFANMTELYLVPDIVILLKFMVPDFDKYKGTTCPKNHLKMYYQKMGVYVKDEKLLMHFFQESLTGAAVT

SEQ ID NO: 159041 - protein, 196 aa, Glycine max
  Coding DNA Sequence Number=SeqID_42263
  Gene Ontology: Mol. function=hydrolase activity, acting on ester bonds; Biological process=arginine catabolic process to glutamate
  Homolog annotation: Hit_ID=Q5PHC2; Match level="QueryCoverage=89%, HitCoverage=54%, E-value=6e-49, Identity=54%"; Hit description =Succinylglutamate desuccinylase
  Pfam annotation: Domain name=AstE_AspA; Domain location=53-196; Score= -52.8; E_value=0.0096; Accession=PF04952.5; Description =Succinylglutamate desuccinylase  Aspar
  Pfam annotation: Domain name=Peptidase_M14; Domain location=12-195; Score=-79.4; E_value=0.055; Accession=PF00246.14; Description=Zinc carboxypeptidase
  Pfam module annotation: Pfam domain module=AstE_AspA::Peptidase_M14; Domain location=53-196::12-195
MCCPLCQKGVNMQDFLQQTLSGRPPAQRQGSNAHLHWQWHDEGILSLTPHTPTQQALVLSAGIHGNETAPVEILNLLLTPLLQGEKPLAVRLLVILGNPAALRSGKRYQHYDINRLFGGRWQQVADVPEAQRALQLEQALENFWCECLDHEIRWHLDLHTAIRGSWHTRFGVMPLNSQPWPADFLHWLAAAELEAL

SEQ ID NO: 159042 - protein, 104 aa, Glycine max
  Coding DNA Sequence Number=SeqID_42264
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-10, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=81; ConfidenceScore=5.24e-01
MARTCSPLKMSAWSRLMARTCNPLKVREYSPLMARTYSPLMARTCSPLKVRACNPLIVKTCSPLKVGACRPLMARTCSPIKARMSSPLKVSACSPLMARTCTPL

SEQ ID NO: 159043 - protein, 70 aa, Glycine max
  Coding DNA Sequence Number=SeqID_42265
MVNDILTLSRHKENMVQPKPSAGLKGKPYQHALTHHAFLYFKKQKLGPPRPKSCFGIYPNSRKLAASKKW

SEQ ID NO: 159044 - protein, 135 aa, Glycine max
  Coding DNA Sequence Number=SeqID_42266
  Subcellular localization annotation: CTP_CleavageSite=31; ConfidenceScore=5.11e-01
PRAKPSLPELSAFHHGNYWAKRAWLQRSRYMASRKRARTEDIPSSSTPAPLSVTVGQDQVACPEAQLPLVRPNETALPEPTPVQVDPEPTDPQSLVVNPLSSPECEVVPPSPPLIIIFDASSDERLPLLIHQPEK

SEQ ID NO: 159045 - protein, 190 aa, Glycine max
  Coding DNA Sequence Number=SeqID_42267
  Gene Ontology: Mol. function=sodium:dicarboxylate symporter activity; Cellular component=membrane; Biological process=dicarboxylic acid transport
  Homolog annotation: Hit_ID=Q8ZPT9; Match level="QueryCoverage=99%, HitCoverage=41%, E-value=8e-70, Identity=71%"; Hit description =Kinase-like protein
  Pfam annotation: Domain name=SDF; Domain location=1-170; Score= -136.9; E_value=9.7e-05; Accession=PF00375.9; Description =Sodium:dicarboxylate symporter family
  Subcellular localization annotation: CTP_CleavageSite=34; ConfidenceScore=5.53e-01
MFGVHALLLSINGINPLRFFRKVWPVITFAFTSRSSAASIPLNVETQTRRLGVPESIASFSASFGATIGQNGCAGLYPTMLAVMVAPTVGINPFDPVWIATLVGIVTLSSAGVAGVGGGATFAALIVLPAMGLPVTLVALLISIEPLIDMGRTALNVNGSMTAGSLTSRWLGMTDKKVLESDEHAELAHR

SEQ ID NO: 159046 - protein, 285 aa, Glycine max
  Coding DNA Sequence Number=SeqID_42268
  Homolog annotation: Hit_ID=Q27TE8; Match level="QueryCoverage=11%, HitCoverage=47%, E-value=2e-11, Identity=100%"; Hit description=InsA
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRLAPALRSTAANSGVSHSGSRTSTAITPSGARLARGGRACRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159047 - protein, 147 aa, Glycine max
  Coding DNA Sequence Number=SeqID_42269
ITTHSSKLEGGGHMNENAIHGAPKSLRMENCTKQSLRIAPNSKGENGELHLAIPTHSSKLECGRQMNENAIHGTPKRLRMENCTKQSLRIAPNSKIENGELHLAIATHSSKLECGRQMNENAIHGAPKRLRIENCTKQSLCIAPNSK

SEQ ID NO: 159048 - protein, 38 aa, Glycine max
  Coding DNA Sequence Number=SeqID_42270
MAPYRILGCLAATFSACPAPGRDDDLSVVTPSSICIRP

SEQ ID NO: 159049 - protein, 111 aa, Glycine max
  Coding DNA Sequence Number=SeqID_42271
  Homolog annotation: Hit_ID=Q1SKD7; Match level="QueryCoverage=99%, HitCoverage=29%, E-value=4e-11, Identity=34%"; Hit description =Ankyrin
MAPKKLSTKRSRRDTAAEGSNVAPEFDSHRFRSVEHQQRFEAIKGWSFHRERRVQLREDEYTDFQEEIARRHWTSLVTPMAKFDPEIVLEFYANAWPTEEGVRDMYSWVRG

SEQ ID NO: 159050 - protein, 84 aa, Glycine max
  Coding DNA Sequence Number=SeqID_42272
MGDFISRLSFPENTETFSSLTSYPELRRSEFLIGGYVGARASLLSTTPPFVAMTQELVARGDTLRLFAPFCHPEAAGPMTSRDQ

SEQ ID NO: 159051 - protein, 121 aa, Glycine max
  Coding DNA Sequence Number=SeqID_42273
MVVEIRVEMMVAIVMMSMVTFVVVMEVVAVMGVVVVAVTMLVVVVAVTLVAMAIIGDISGGCSSIVGGDSSGSDGGSSGNGNDSGDRSGIDCGSSNNDHNDINSSGSGGDEVVIVVLSKMM

SEQ ID NO: 159052 - protein, 132 aa, Glycine max
  Coding DNA Sequence Number=SeqID_42274
MRHPLGNKPWKKELHHQDEPWIRSLEMMLQWRKRKRERKREGGARKKGLSLEVCWGVGLHQLRTSHMKTCFFCVVTIHDPVPHHASTSHRLLRSTLMWHCSASCTEPMRIIEIRINAVVNASSAPSLPSLGH

SEQ ID NO: 159053 - protein, 132 aa, Glycine max
  Coding DNA Sequence Number=SeqID_42275
MGHPSKTLLSFEFAQSFCFQLGASRYITGLSRTSELKVIAVCICYEHPFSISSVSIYNGTQSEIRVKSYCRLNLIRASVFNLERLDILRDAIEHPSKMLLSLEFDTSFRFQFGASRYITGLDWTSEKKVIVV

SEQ ID NO: 159054 - protein, 226 aa, Glycine max
  Coding DNA Sequence Number=SeqID_42276
MAGSDALAVSVKLDLSDLPFLLDQYRRLFEAELNAEDYQWVNNISTTKSAAVISVLENALEAKMAAGQFDGIWLSIPEIIEWTMVKGFMYSPYGGGILHPDINMEGFRGTVDGPITLEVLRARHVHCADADHKKVFKSWSVFKCLYAEIELNGVTHVLNDGKWFSIAKDFVERTNHDYAAIPPSNIKLPEYQGGGEGAYNAQVAALEPAIYDLLDDKKKVMHGGGH

SEQ ID NO: 159055 - protein, 78 aa, Glycine max
  Coding DNA Sequence Number=SeqID_42277
AGVFSSGFPTVSDPVEAYTYPEYLKSGWNLNNILSLSGSLLCFESSEASRKFAINFETIWKKYLPDLQAGQPDMHDNM

SEQ ID NO: 159056 - protein, 116 aa, Glycine max
  Coding DNA Sequence Number=SeqID_42278
MCISPYTCTPTHLPLKCEFLPHDSLPLEQKSLSFTSIVILATCGTCTTTLSVEHATILATCGTCTTAKSAGHAAPLSYSFEPVTKLTIDFDTNCWGDSRVHLWTMRYHIRRPDTIL

SEQ ID NO: 159057 - protein, 78 aa, Glycine max
  Coding DNA Sequence Number=SeqID_42279
MGGGGGEGTKVGQGEELEEDMVEKEVSEDGQGVVMVGEVVVGGKVGVGDDENGERGVVQEIDGEGCDGDKEGDELGEF

SEQ ID NO: 159058 - protein, 186 aa, Glycine max
  Coding DNA Sequence Number=SeqID_42280
  Homolog annotation: Hit_ID=Q1SI74; Match level="QueryCoverage=64%, HitCoverage=61%, E-value=7e-54, Identity=80%"; Hit description =Ribulose bisphosphate carboxylase, large chain
  Pfam annotation: Domain name=DUF640; Domain location=31-152; Score =252.5; E_value=8.9e-73; Accession=PF04852.3; Description=Protein of unknown function (DUF640)
  Subcellular localization annotation: CTP_CleavageSite=46; ConfidenceScore=5.40e-01
MDSNIQDFIDTCNSDNTCNLITNSTTTNLTAASAASSSPASTSITSSSRYENQKRRDWNTFGQYLKNHRPPLSLSRYLDQFGKTKVHTPICPFYGHPNPPAPCPCPLRQAWGSLDALIGRLRAAFEENGGKPEANPFGARAVRLYLREVRDLQSKARGISYEKKKRKRPPPQQQPMPIPHHPLPPP

SEQ ID NO: 159059 - protein, 49 aa, Glycine max
  Coding DNA Sequence Number=SeqID_42281
MVGTAAQGVPSAKYDDGDPDLAEEGKGFGSRGRSNFWRFRPSEMNAAKY

SEQ ID NO: 159060 - protein, 815 aa, Glycine max
  Coding DNA Sequence Number=SeqID_42282
  Gene Ontology: Mol. function=ubiquitin-protein ligase activity; Cellular component=ubiquitin ligase complex; Biological process =protein ubiquitination
  Homolog annotation: Hit_ID=Q6ZC56; Match level="QueryCoverage=90%, HitCoverage=97%, E-value=4e-94, Identity=44%"; Hit description =Putative arm repeat-containing protein
  Pfam annotation: Domain name=Arm; Domain location=537-577; Score =32.4; E_value=1.5e-06; Accession=PF00514.13; Description =Armadillobeta-catenin-like repeat
  Pfam annotation: Domain name=Arm; Domain location=578-618; Score =37.0; E_value=6.6e-08; Accession=PF00514.13; Description =Armadillobeta-catenin-like repeat
  Pfam annotation: Domain name=Arm; Domain location=619-659; Score =30.7; E_value=5e-06; Accession=PF00514.13; Description=Armadillobeta- catenin-like repeat
  Pfam annotation: Domain name=Arm; Domain location=660-699; Score =19.2; E_value=0.015; Accession=PF00514.13; Description=Armadillobeta- catenin-like repeat
  Pfam annotation: Domain name=Arm; Domain location=700-740; Score =20.6; E_value=0.0056; Accession=PF00514.13; Description =Armadillobeta-catenin-like repeat
  Pfam annotation: Domain name=U-box; Domain location=238-312; Score =108.7; E_value=1.8e-29; Accession=PF04564.6; Description=U-box domain
  Pfam module annotation: Pfam domain module=Arm::Arm::Arm::Arm::Arm::U- box; Domain location=537-577::578-618::619-659::660-699::700-740::238- 312
MTAYKGFLLMHKGLCVCLLFGLTEAGQINTSSVKCLVNSISRFMHLVCCQAVKPMPLQKNCNNMVGVLKRLKPVLDDIVDFKIPLDENLHRECEELDMQVLQSGELLIKLQNSSYKICHMIVKSLKAPASVLVLGNLQELQCLKKEPAMVYIEEALRNQRDNIEPCYDSLKEIIGLLKLTSNQELLKESIAVEKERSNAEVNKTKGNLDEINQIVNLVCNLRDYVMKFECPEVKSGVSIPPYFRCPLSLELMSDPVIVASGQTYERQSIQKWLDHGLTVCPNTHHRLVHTNLIPNYTVKAMIANWCEENNVKLPCNSKQSNSTRISSPSDHLLHQDLDRQCSFQSSDSSNSYSNQTANAFEKQKDDNSFGSGRGSHRSRNGQTEKFEQQSPAPSCSNRRSESFSSSISSTDYVLPVSKEVSVISNKHHNVELSGEITNGCPASPAYKESVIYPWLSGKQFHSPGSKIGRMEDENKYESNNNIITSHSKVASHPVSNLGSDELITTSHVHELIEDLQSQSNETRTAAAEQLRFCTKHNMENRIIVGQCGAIMPLLSLLYSDMKITQEHAVTALLNLSINEGNKALIMEAGAIEPLIHLLEKGNDGAKENSAAALFSLSVIDNNKAKIGRSGAVKALVGLLASGTLRGKKDAATALFNLSIFHENKARIVQAGAVKFLVLLLDPTDKMVDKAVALLANLSTIAEGRIEIAREGGIPSLVEIVESGSQRGKENAASILLQMCLHSQKFCTLVLQEGAVPPLVALSQSGTPRAKEKGYRISLLKDKKILHSNMLSSAFFTQPCPPKNEEVLTLFVWGGC

SEQ ID NO: 159061 - protein, 100 aa, Glycine max
  Coding DNA Sequence Number=SeqID_42283
THEPELGGHQREGLVLGIGVVRVRQGFHKVGEAKVRRWSSRGGWNPNFSPPKRARYGRMPSWGVITSTSLASPKTIIETTHSSSLPAASSPNLSRTITTT

SEQ ID NO: 159062 - protein, 241 aa, Glycine max
  Coding DNA Sequence Number=SeqID_42284
MRRQNLVIPHPFAIQTQSCSMARRDKIWSFCTLLSSRGGGPDDTRRQNFGHSAPLCHSDTVVSDDTQRQNLVILHPLSSRGGGPDDMRRQNLVILHPFAIQTQSCPMARRDKNWSFCTLLSSRGGGPDDMRRQNLVIPHPFAIQTQPCPMARRDKNWSFCTLCHPEAAGPMTCGDKIGHSAPLCHSDTAVSDGAQRQKLVILHPLSSRGGGPDDMRRQNLVIPHPYAIQTQPCPMARRDKN

SEQ ID NO: 159063 - protein, 224 aa, Glycine max
  Coding DNA Sequence Number=SeqID_42285
  Homolog annotation: Hit_ID=Q8L4E7; Match level="QueryCoverage=55%, HitCoverage=30%, E-value=5e-07, Identity=38%"; Hit description=SAP -like protein BP-73
MLQAMHLMANNVAGYDVASNADVECQKVGFFRVRVFLEEQLLRFLAPLRQGGPLNLFPGKTSIDFPEAGSGSMKRETALRTLKKTCYRPKMVQARLRKRATIEEIKKVEASQAQSKDNGSVDSLLKLLRKHSVEQYQSVSNDDKDVKAVPLSNVIIEKDQDQLGVKLDPEPEHDSELELDPKDELLFPEDQQVEQHQDLSTMKLSQLRALAKSRGLKGFSKMKK

SEQ ID NO: 159064 - protein, 275 aa, Glycine max
  Coding DNA Sequence Number=SeqID_42286
  Gene Ontology: Mol. function=nucleic acid binding; Cellular component= spliceosome; Biological process=mRNA processing
  Homolog annotation: Hit_ID=Q6ZK48; Match level="QueryCoverage=97%, HitCoverage=51%, E-value=4e-52, Identity=50%"; Hit description =Putative step II splicing factor SLU7
MGWLWSCVERPWKLGAKWTNKHIASDEKIETFELDYDGKRDRWNGYDASTYARVIERYEARKKYLKEQKLKKSEKSNQNDEDEEEENLMLDEAKVDESKQMEFAKVEKRVSTTGGRSTGTELNLFFFRNQLIREDTAKYPINAAVNSAHCDPKTRFTREDPLPDADPNEKFYGGDNQHRNSGVALEFNEIYIMLGKHLRKDKMFTCKQLHPKLNFHYKNFKTEKEKLKSQMKETIIEKYMAMQLMRTTLQENFCRVKAKCKLSMIMLVELLGARH

SEQ ID NO: 159065 - protein, 117 aa, Glycine max
  Coding DNA Sequence Number=SeqID_42287
  Homolog annotation: Hit_ID=Q1T493; Match level="QueryCoverage=93%, HitCoverage=20%, E-value=3e-09, Identity=28%"; Hit description =Nucleic acid-binding, OB-fold, subgroup
  Pfam annotation: Domain name=Rep_fac-A_C; Domain location=2-115; Score=-67.3; E_value=0.057; Accession=PF08646.1; Description =Replication factor-A C terminal domain
MGTISKIVMDNHSWCYPACVQCHRKTDIQTGPFTCGCGKENNQPVLRYRVEVMVTQNNKSSKFLLWDRECAELIGETADDVNRVKIEDGDLDLNASPQALDKLLGHVLAFKVRIQSK

SEQ ID NO: 159066 - protein, 70 aa, Glycine max
  Coding DNA Sequence Number=SeqID_42288
  Gene Ontology: Mol. function=transcription factor activity; Biological process=regulation of transcription, DNA-dependent
  Homolog annotation: Hit_ID=Q4KJ27; Match level="QueryCoverage=79%, HitCoverage=18%, E-value=5e-17, Identity=71%"; Hit description =Transcriptional regulator, LysR family
  Subcellular localization annotation: CTP_CleavageSite=37; ConfidenceScore=5.04e-01
DGARELGDGVRYGGQRPAGGVPAGGARTGRRVQRAVRAGARAASAGQGVSRLAAAGTAAGQWHEIKVLSS

SEQ ID NO: 159067 - protein, 34 aa, Glycine max
  Coding DNA Sequence Number=SeqID_42289
QGWIYVDSGNEMEHETFLATWLAEIDFSPNGLVS

SEQ ID NO: 159068 - protein, 156 aa, Glycine max
  Coding DNA Sequence Number=SeqID_42290
  Gene Ontology: Mol. function=actin binding; Cellular component =intracellular; Biological process=cell division
  Homolog annotation: Hit_ID=Q8SAG3; Match level="QueryCoverage=99%, HitCoverage=100%, E-value=6e-60, Identity=73%"; Hit description =Actin-depolymerizing factor
  Pfam annotation: Domain name=Cofilin_ADF; Domain location=29-156; Score=188.0; E_value=2.3e-53; Accession=PF00241.10; Description =Cofilintropomyosin-type actin-binding pr
MSFRGLSRAFDPDAFEFQPNASSGMGVADHSKNTFMELKQKKVHRYLIFKVDEKKREVVVEKTGDPAESYEDFAASLPENDCRYAVFDYDFVTSENCQKSKIFFIAWSPSTSRIRAKMLYATTKDRFRRELDGVHYEIQATDPTEMDLEVLRDRAH

SEQ ID NO: 159069 - protein, 91 aa, Glycine max
  Coding DNA Sequence Number=SeqID_42291
MAMLDPIIFERVPMSHSILFALKTHGLKKCLMIFTYACKVCPQREFSKRELGEITEISWSETPNAIWEQDKVLQFFDDAADVEESDFNDDD

SEQ ID NO: 159070 - protein, 253 aa, Glycine max
  Coding DNA Sequence Number=SeqID_42292
  Gene Ontology: Mol. function=transcription factor activity; Cellular component=nucleus; Biological process=regulation of transcription, DNA-dependent
  Homolog annotation: Hit_ID=Q1SZK5; Match level="QueryCoverage=54%, HitCoverage=54%, E-value=2e-34, Identity=55%"; Hit description =Pathogenesis-related transcriptional factor and ERF
  Pfam annotation: Domain name=AP2; Domain location=115-180; Score =139.2; E_value=1.1e-38; Accession=PF00847.10; Description=AP2 domain
MDLDFDSTFFLNQNLSFFSENSSVCGDPFSWDNNFVLDDIFNLSDNSSQSQTKETSSASNVSSSIGSVELQEVSSNTTYEEVKEGQSVSLSLSSSSSLSLPLSLPLLPSQQAKEQRMYRGVRKRPWGKFAAEIRDSTRNGVRVWIGTFDTAEAAALAYDQAAFSTRGSLAVLNFPEEVVSESLKDMPSKPWEEGSSPVLALKRKHTMRRKSNSKKKSKIDQREQLDFSSSSQNVLVFEDLGAEYLEQLLSLTS

SEQ ID NO: 159071 - protein, 66 aa, Glycine max
  Coding DNA Sequence Number=SeqID_42293
  Gene Ontology: Mol. function=DNA binding; Cellular component=nucleus; Biological process=regulation of transcription
  Homolog annotation: Hit_ID=O49461; Match level="QueryCoverage=86%, HitCoverage=23%, E-value=2e-16, Identity=59%"; Hit description=NAM / CUC2-like protein
  Pfam annotation: Domain name=NAM; Domain location=10-66; Score=-25.5; E_value=4.1e-05; Accession=PF02365.6; Description=No apical meristem (NAM) protein
MGLRDIGASLPPGFRFYPSDEELVCHYLYKKIANEEVLKGTLVEIDLHICEPWQLPAILNYTSSKG

SEQ ID NO: 159072 - protein, 106 aa, Glycine max
  Coding DNA Sequence Number=SeqID_42294
  Gene Ontology: Mol. function=DNA binding; Cellular component=nucleus; Biological process=regulation of transcription
  Homolog annotation: Hit_ID=Q8LB22; Match level="QueryCoverage=83%, HitCoverage=25%, E-value=1e-39, Identity=84%"; Hit description=NAM / CUC2-like protein
  Pfam annotation: Domain name=NAM; Domain location=3-88; Score=126.2; E_value=8.9e-35; Accession=PF02365.6; Description=No apical meristem (NAM) protein
MCCLVVEVAKLNANEWYFFSFRDRKYATGFRTNRATTSGYWKATGKDRTVVDPATQEVVGMRKTLVFYRNRAPNGIKTGWIMHEFRLETPHMPPKLCSWGTTCLVV

SEQ ID NO: 159073 - protein, 214 aa, Glycine max
  Coding DNA Sequence Number=SeqID_42295
  Gene Ontology: Mol. function=RNA-directed DNA polymerase activity; Cellular component=chromatin; Biological process=chromatin assembly or disassembly
LEEVMNRLTQGHNNLTQGQNTLTQNHVALAQAQSLTNSKIDSILERLAALTMIPSSPKSPPTSPPSTSPPSPFWPHMKLDIPRFDGQDPLWWIFKITQFFDYQNGFLTSWLAMLQALESCFASSYYDDPQGAIFKLQHLGTINDYLSEFEKLVNRVAKLALQFLLSCFISGLNPELCREVQAFQPMSLSQAVALEKLQEDKLNDKRRSLRSFTH

SEQ ID NO: 159074 - protein, 49 aa, Glycine max
  Coding DNA Sequence Number=SeqID_42296
MMYLKIVYVEPSRRGNWKYSNMNEAEAAEMGCEVKEANWKMQEVKAHAE

SEQ ID NO: 159075 - protein, 115 aa, Glycine max
  Coding DNA Sequence Number=SeqID_42297
  Subcellular localization annotation: CTP_CleavageSite=13; ConfidenceScore=5.00e-01
MARSLLSWRVPPVAQARCTPSLISSVLPARHEPMPPVRMAGHANMDNPVIGSCETKVAMTQAKLGHVLVLEETRELLLHWLGQSEACSRALAMTLSTCKILTLKRVTNSVKRGRK

SEQ ID NO: 159076 - protein, 34 aa, Glycine max
  Coding DNA Sequence Number=SeqID_42298
MAKLPLANTWQWTRHCNWRERQTVPADGEIAMRQ

SEQ ID NO: 159077 - protein, 512 aa, Glycine max
  Coding DNA Sequence Number=SeqID_42299
  Gene Ontology: Mol. function=structural molecule activity; Cellular component=protein complex; Biological process=microtubule-based movement
  Homolog annotation: Hit_ID=P14641; Match level="QueryCoverage=82%, HitCoverage=93%, E-value=0.0, Identity=93%"; Hit description=Tubulin alpha-2 chain
  Pfam annotation: Domain name=Tubulin; Domain location=111-308; Score =338.3; E_value=1.3e-98; Accession=PF00091.15; Description =TubulinFtsZ family, GTPase domain
  Pfam annotation: Domain name=Tubulin_C; Domain location=310-455; Score=264.2; E_value=2.6e-76; Accession=PF03953.7; Description =TubulinFtsZ family, C-terminal domain
  Pfam module annotation: Pfam domain module=Tubulin::Tubulin_C; Domain location=111-308::310-455
VFHRVDETERHNTNTTVGEIFSSKDSEAPLAMTMVVWLLKSRTKTERYYFGHITKMNNDENTEKHERGGEKYKAGIQVGNACWELYCLEHGIQPDGQMPSDKTVGGGDDAFNTFFSETGAGKHVPRAIFVDLEPTVIDEVRTGTYRQLFHPEQLISGKEDAANNFARGHYTIGKEIVELCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAHHEQLSVGEITNSAFEPSSMMAKCDPRHGKYMACCLMYRGDVVPKDVNAAVGIIKTKRTIQFVDWCPTGFKCGINYQPPTVVPGGDLAKVQRAVCMISNSTSVVEVFSRIDHKFDLMYAKRAFVHWYVGEGMEEGEFSEAREDLAALEKDYEEVGAEATEDGDEGEDYD

SEQ ID NO: 159078 - protein, 34 aa, Glycine max
  Coding DNA Sequence Number=SeqID_42300
MAKPSRANTWQWTLHCSWRERQTATADGEILMHQ

SEQ ID NO: 159079 - protein, 71 aa, Glycine max
  Coding DNA Sequence Number=SeqID_42301
MNPCYTALNPCSFCPLEHACPTSGNNEQKRKAHWRNQCNLDACCMGHWLDGWHGWMTCVSRQCQQPESLCW

SEQ ID NO: 159080 - protein, 366 aa, Glycine max
  Coding DNA Sequence Number=SeqID_42302
MTHAACIQVALIPPVGLAFLLIVTASRTGVYRVRVLEHTCNDSAIGKIDYQRKDSAAGTEGMHMPSIQPMIHAACIHVLILPLGKAITNQNIPAAGTGGIHMPSIQPMTHVACIKAACIQVALIPPVGLAFLLIDTASRTGVFQRAEGAGIQRSVAGRDTHAIHPANDPCRMHPSTDFAIGKSDHQPKDSGWVHLLGLLTENKRGYISCGSVLVEGTSTRLFKENKGGYIPCGSLLVKEFYKVEKKSQGPQVAWGLDVATGMYQRAEGAGIQRSVAEGSEHTCTNSVIGKSDYQPKDSAAGTGGIHMSSIQPMTHAACIQPVAYAACIQILIPPLGEAITNQKILVAGIGGIQIPSIHVIHPANDP

SEQ ID NO: 159081 - protein, 115 aa, Glycine max
  Coding DNA Sequence Number=SeqID_42303
MTHAACVQVVLILLVGLAFVLIDTASRTNVFQKAEGAWIQRSVAGVPACCMLCSFFRVSGTDSAIGKSDYQPKDSAAGTGGIHMSSIHAIHPANDPCSMHPGCTDSASEPGVFAH

SEQ ID NO: 159082 - protein, 77 aa, Glycine max
  Coding DNA Sequence Number=SeqID_42304
MASSSSCSSNISINSRLVDGDVLWMQDKHISQHIWNGEEDRKLHIRRVVPVYQGQEEIPEEIIPLLRQSGFYWIMKM

SEQ ID NO: 159083 - protein, 97 aa, Glycine max
  Coding DNA Sequence Number=SeqID_42305
MDTPFSKITHATMRNKKNRKKSEQMNEKNKWNEGGWFGISRSVKGSVVLSVVVVGLERSVIAVEVLSLPFAIAAVVVVDVFSSLGCCDGVAAVDSWW

SEQ ID NO: 159084 - protein, 87 aa, Glycine max
  Coding DNA Sequence Number=SeqID_42306
MTAIKVVFQHSSCSRLPAWSVANASGPAIDLWDCFLITSIFASNKERTCHWLTSEEEQLLCIVYEHSIRKAWILWGSVLEGRIFSDD

SEQ ID NO: 159085 - protein, 83 aa, Glycine max
  Coding DNA Sequence Number=SeqID_42307
  Subcellular localization annotation: CTP_CleavageSite=51; ConfidenceScore=5.52e-01
MTSLDSPLRSQKSTPFSAKARMCKLCRTLNFAPTPKHSDVKHTSLRWRLVSEVARRNEGGKKGGERARSGQSATTSERSLSMW

SEQ ID NO: 159086 - protein, 63 aa, Glycine max
  Coding DNA Sequence Number=SeqID_42308
MNSKNCKRQSRGEKEESTWNNRKQDLAERVGFEKRNGQNFMQPQKCDCREFPSIIVSAGIEAE

SEQ ID NO: 159087 - protein, 58 aa, Glycine max
  Coding DNA Sequence Number=SeqID_42309
  Subcellular localization annotation: CTP_CleavageSite=34; ConfidenceScore=5.28e-01
MAVGCISFTAMLGDGTIMHCSSQYGSGTTSSRPSCATSTSRLVLKAQSIDNDISQIFI

SEQ ID NO: 159088 - protein, 89 aa, Glycine max
  Coding DNA Sequence Number=SeqID_42310
MAITEVQEVKDAAPSLHLHPYPWSSCTRSLLPSLKLPVKPTGYVEKSTLTKLVLKGSYYGNKFAKVLPFGQFAARWLLGCQPSWMPLAI

SEQ ID NO: 159089 - protein, 184 aa, Glycine max
  Coding DNA Sequence Number=SeqID_42311
  Gene Ontology: Mol. function=RNA-directed DNA polymerase activity; Biological process=RNA-dependent DNA replication
MKKEFGGLGFRHLHTFNLSTLGKQDAQLGHNPSFVWRSIHASWVVVKEVHQTHQPSTSKNNTQWTPPPHNFLKCNLDAAIFNDNNLFGVGICLRDNNGCFFKAITLTANGKPTLKEVEAWALHKAIKWTQQLNIHNIIFEMDCKSIVDNLVVNFKGSIDYHALLQKCKANLSNLLNSKVSFVKM

SEQ ID NO: 159090 - protein, 671 aa, Glycine max
  Coding DNA Sequence Number=SeqID_42312
  Gene Ontology: Mol. function=translation initiation factor activity
  Homolog annotation: Hit_ID=Q9LIN5; Match level="QueryCoverage=99%, HitCoverage=99%, E-value=7e-56, Identity=40%"; Hit description =Eukaryotic initiation factor 4B
  Pfam annotation: Domain name=eIF-4B; Domain location=1-669; Score =650.3; E_value=1.6e-192; Accession=PF06273.2; Description=Plant specific eukaryotic initiation factor
MSKPWGNIGAWAADSERAEAEEAEAQAAAAAVEPQSFPSLKEAVNSKPKKKKGTTITLSEFNRGGFDQGLTRDEMLTLPTGPKERSAEEMQFNRLGGGFSSYDRSGGRSRDRDGGNNEGSWGGGGRRSYGGFDEERRGPNPRVSELDQPSRADEVDNWASVKKSLLPTIPVARIAMVVAEAAVFGGSSGGGGFGGSSGGGGFGGGGGFGGGGGGGGFGGASRADDVDNWAVGKKPAPVRSSNFGSSFRDSGVEPDRWTRGDPPREVEQRTERPRLVLDPPRGDGLVNESPVKAMDKANPFGAARPREEVLAEKGLDWKKLDSEIETKKTSRPTSSHSSRPSSAQSNRSEGPGLQGTDAVVKSRPKVNPFGDAKPREAVLGERGMDWRKIDLELERRSVASALQSGALLSSSRWPRGGCWSLQVTFGQPVGSSQRQNVRVPLELESLGELMLMVKGTSLPLQLMSRGILKEKGQKLLAAVYLGAEVLKLEGECQSIRITKFQCYLPGLVVVLPVLDTISSINRSIGLWPETMEEKLLKEEIDNLKKELEKESTINSNKESVDEAGGDQTSRHAILQQKEKELELLIHDLDGKVRFGQKAVERPGSSAGKSSTFSDRPPSRSGSFEDSRSVDFTDRPRSRGTGDMWMRPSDDRRQFQGGSRERGWFSSGSRNR

SEQ ID NO: 159091 - protein, 42 aa, Glycine max
  Coding DNA Sequence Number=SeqID_42313
MELAGAPLVEPELREHEEEEEEDYERRALVRNENEGQRSISV

SEQ ID NO: 159092 - protein, 784 aa, Glycine max
  Coding DNA Sequence Number=SeqID_42314
  Homolog annotation: Hit_ID=Q9LIN2; Match level="QueryCoverage=47%, HitCoverage=97%, E-value=1e-148, Identity=67%"; Hit description =Nodulin-like protein protein
  Pfam annotation: Domain name=HATPase_c; Domain location=615-772; Score=8.8; E_value=0.0096; Accession=PF02518.16; Description =Histidine kinase-, DNA gyrase B-, and HSP90-like ATPase
  Pfam annotation: Domain name=Lipase_GDSL; Domain location=37-367; Score=342.3; E_value=8e-100; Accession=PF00657.12; Description=GDSL -like LipaseAcylhydrolase
  Pfam module annotation: Pfam domain module=HATPase_c::Lipase_GDSL; Domain location=615-772::37-367
MELVGEKWIEIVTCLVISTTLMRSVSGSESECIFPAIFNLGDSNSDTGGLSAAFGQAPPPNGITYFHSPNGRFSDGRLIIDFIAESSGLAYLRAYLDSVASNFTHGANFATAGSTVRPQNTTISQSGYSPISLDVQFVQFSDFKTRSKLVRQQGGVFKELLPKEEYFSQALYTFDIGQNDLTAGYKLNFTTEQVKAYIPDVLGQFSNVIKGVYGEGGRSFWIHNTGPLGCLPYMLDRYPMKPTQMDEFGCAKPFNEVAQYFNRKLKEVVEQLRKELPGAAITYVDVYTVKYTLISHAQKYGFEQGVIACCGHGGKYNFNNTERCGATKRVNGTEIVIANSCKDPSVRIIWDGIHYTEAANKWIFQQIVNGSFSDPPHSLKRACYGIKLAFLKFELSDVEAEAEGIVILVGHFNIPAGLRAAKATLSNSQVNVVPECKAVVLPMVKHPFVVGFLVAELPLVEEKCQKSKSDGPENLMTVEEPYSFPPFLDLDKKSREIQNLQVKDEAVGMHNFTSEQRSNTVNISVSSYGICHGSGDVSANKMKKSSESLSLSAAVQDIEMPLPPLALAPLQHGIRSCNVSQVLEDLVDSVRPLAQGKKRVVELSELSSSPLLAAVEEPALHQAFSNLIEGALLITHVGGKVEIVSKAAPAGGTLVLIDDDGPVLKIMFSNPQLFPQVDDPLLRITPSKLTERRSGTGVRGHMELHPPVRRAAIAAYHTVETRMHSLTPHGRELLSDNMIEDSMTWKFVAGLTVAYAPLGAGGTRVELWLPSSIVQSDLSSHVQE

SEQ ID NO: 159093 - protein, 70 aa, Glycine max
  Coding DNA Sequence Number=SeqID_42315
  Subcellular localization annotation: CTP_CleavageSite=37; ConfidenceScore=5.05e-01
MAEPAFFFFFSFTNLARPTGGSMWISISNSATLTGGNCMMMDALMDAWVKKHVGMWAWGISPMGVAEPYA

SEQ ID NO: 159094 - protein, 132 aa, Glycine max
  Coding DNA Sequence Number=SeqID_42316
MVEIPVMVAVAITIVVVVKVALVVVVKVALVVMTINDIGGISGGGGSNVGGDGGMVVAMTIIVMEVVLLLLMVVVIVMLTMVVAMLMVMMVVAPSGSNVVIVVVVAITLAVVVVATVVVAMPVMMMMLVAMM

SEQ ID NO: 159095 - protein, 90 aa, Glycine max
  Coding DNA Sequence Number=SeqID_42317
MACSSCTPVIDFFRVVCIAWAAAINLMLLCLPLSSNYIVGWRFQVPMDYLKRSTMKSISGLMKVFVALVGIRFVNVQRIVIMMIIVIFEM

SEQ ID NO: 159096 - protein, 581 aa, Glycine max
  Coding DNA Sequence Number=SeqID_42318
  Gene Ontology: Mol. function=extracellular matrix structural constituent; Cellular component=proteinaceous extracellular matrix; Biological process=multicellular organismal development
  Homolog annotation: Hit_ID=Q67YL8; Match level="QueryCoverage=90%, HitCoverage=94%, E-value=7e-17, Identity=20%"; Hit description=MRNA, complete cds, clone: RAFL24-22-E06
MFRLSPRRSQRSKGFKVKHALQLCVLLGVCIWLIYQLKHSNEKKSSYVESTKTTSEVVKFGRKDLHPRAEETSVVDARHKEEDEEEEQQENKQEEQHKLDDVNGVQDEVLKHEQNDNEENSEHRQDSVDQETEENSENVTTQVEGEQHNEKFGEENDNIDNKENEENKSEGEDKETGENKEEKIEQENDNMDNKESDNTVKENEVENKETEETKEEKNQQENEEVKQNETEGMDNGEENHEKDSKEITDESNQREAEREEHDKIQEGTSSENQVQDGGKNEEEHREENYAGDNASSAVDNKSQDASDESSKTEEESDKKEKNEFELESQKNGTETTEVADSTATTNSQGNENDAENQTQSENDSQKSVMLESESQQQEQNDSTKDGVETHRTEASENENNPKVEDSSAQSTTQKTEDSSSNSDAWKDSATNGEYKDTSSNSAQDENINNNSVQEGNAASSNNDNKDASQDVQLTSSDTSSEQKKDESANMETNTGSAQNDNVNSDQSNTNSDGSANDKKDASQSDTSSEQNKEGSSNSDNSNDANQNGSNSNENANDNENDSQEAQNSADAGQGDNEVTVE

SEQ ID NO: 159097 - protein, 362 aa, Glycine max
  Coding DNA Sequence Number=SeqID_42319
  Gene Ontology: Mol. function=transporter activity; Cellular component= integral to membrane; Biological process=auxin mediated signaling pathway
  Homolog annotation: Hit_ID=Q5FV66; Match level="QueryCoverage=96%, HitCoverage=97%, E-value=1e-139, Identity=70%"; Hit description =Auxin efflux carrier protein
  Pfam annotation: Domain name=Mem_trans; Domain location=9-356; Score =336.1; E_value=6e-98; Accession=PF03547.8; Description=Membrane transport protein
MISLADVYHVVTATVPLYVTMFLAYISVKWWKLFTPEQCSGINKFVANFSVPILSFQVISSNNIYKMSLKLVYADVVQKLLAFLVFTAIIRIKDRGGLKWIITGLSLSTLPNTLILGIPLMKAMYRDEASLLLPQIIFLQSMVWYNLLLFLHELDAAIPARTMPVVAPPSQDTGDSETSLEIQSKEEEEEAEHRTQSKTRMLLILMKVGNKLIINPNTYATFIGLIWASIHFRWGVDMPDVVNQSIEILASGGLGMATFSLGLFMASSNRIIVCGPRMTLVAMGLKFLAGPAIMAVASIVIGLRDRMLKVAIIQAALPQGIVPFVFAREYNVNPGILSTGVLLGMLMALPVALTYYLLLSLY

SEQ ID NO: 159098 - protein, 953 aa, Glycine max
  Coding DNA Sequence Number=SeqID_42320
  Gene Ontology: Mol. function=RNA-directed DNA polymerase activity; Cellular component=chromatin; Biological process=chromatin assembly or disassembly
  Pfam annotation: Domain name=rve; Domain location=800-950; Score =56.9; E_value=6.6e-14; Accession=PF00665.16; Description=Integrase core domain
  Pfam annotation: Domain name=zf-H2C2; Domain location=740-782; Score =24.2; E_value=0.00022; Accession=PF09337.1; Description=His(2) -Cys(2) zinc finger
  Pfam module annotation: Pfam domain module=RVT_1::rve::zf-H2C2; Domain location=384-586::800-950::740-782
MKLEVPRFDGTEPLDWIFKINQYFEYHGTPDRDRLTIASFYMEGRVLAWFQWMSSNAQFTSWPWEVQANQPLTLVQAAGLAKLQEEKLIDSRNPPRARAPPLAPNLIRANNPNADVHALLPPLLPAPPRPPQPVMKRLTPEEITLRQEHGLCFTCDERYHQGHHCAARAFLLVTEEEEPTDPKIDANDPPPDPPDEPDPYPAQISLNSLSDHLAPEALRLVGIMANHRVVLLVDGVSIQIQDVHFTMDLHVLPIVGANVVLGVQWLKTLGPILTDYGSLRLQFFYQDRLIELKGDSTTDSGLITHHQLRWLYRTQTQASYFHIAMLSDNWDPPPHQALPQTIQALLERFSFLFQSPHGLPPTRDIDHHIHLLPQSNPVNVRPYQYPHYQKQEIEQQDGTWRFCVDYRALNIVTVRDRFPIPTIDELLDELGGAQYFSKLDLLQGYHQIRMHDSDIPKTAFRTHHGHYEFKVMSFGLCNAPSSFQATMNSIFRQHLRQFIIIFFDDILVYRTSLEAHLQHLATAFQTQVEYLGHVVSQKGVEPVASKVKAIQQWLTPRSTKAIKSFLGLAAVLTQKGHPVAFFSKPFTPKLIGASTYVRELFAITTARFTIITDHRSLKELLTQVIQTPAQHKYLARLMGYDYVIQYRSGHHNQVADALSRQPKHEPSQCMILSVPSLTFLEELRHQLEDHPEYRRRRQEIMEAPTNHPTFSVSMDLVLTEGHIWLPRGIPIASTLLKEYHTTPVGGGHAGVAKTMARISENFTWSGLREDVKQFVANCIECQVTKYEMQKVAGLLCPLPVPHRPWEDLSLDFIVGLPAYHGNTTILVVVDRFSKGIHLGMLPASHTAHMVASLFIDMVVKIHGVPRNLVFDRDPLFISKFWQELFKASGTHLRMNSAYHPQSDGQTEVLNRIVEQYLRASSTDDRTSGASFYLGSNGHITPLGTPAQAQLLMR

SEQ ID NO: 159099 - protein, 72 aa, Glycine max
  Coding DNA Sequence Number=SeqID_42321
MKQPRRKVGGMSTILFARSSNSDRIVVHARQRRGNGRCGVGEMLDKVVDFVRQGQLLSGEGYENFFELGRRG

SEQ ID NO: 159100 - protein, 74 aa, Glycine max
  Coding DNA Sequence Number=SeqID_42322
MVGLWLRGRKWGRTVEEFIEFQIHGLHGVSEAGKDGLKVTRGGRQHQAGRFVEDLKMSWQFHFLCRYPQTKSFK

SEQ ID NO: 159101 - protein, 119 aa, Glycine max
  Coding DNA Sequence Number=SeqID_42323
  Gene Ontology: Mol. function=transition metal ion binding; Cellular component=cytoplasm; Biological process=fucose metabolic process
MGDRLEDMIRDLGQESFQQAHAPVYEGLQSDSKKPLYTGCKNSLTLLSAVLSLVNVKARYGWSDKSFTSLLEVVHNLPPEDNMLPKTYYKAKKILCLMGMEYQKIHACPNDCILYKHEF

SEQ ID NO: 159102 - protein, 124 aa, Glycine max
  Coding DNA Sequence Number=SeqID_42324
MGRVKRRVRVRVQTGYKRGVRYGYGVTVFSEKEEYPRGTLVSSMVFLITVEAKTSFPAKGNLVREGEGKEGGQGERRGGAEKKGAEGGRGRLDNPNRATRGGRALESTRKATIANGERLRDYVE

SEQ ID NO: 159103 - protein, 171 aa, Glycine max
  Coding DNA Sequence Number=SeqID_42325
  Gene Ontology: Mol. function=RNA-directed DNA polymerase activity; Cellular component=chromatin; Biological process=chromatin assembly or disassembly
  Pfam annotation: Domain name=RVP; Domain location=5-109; Score=-14.6; E_value=0.1; Accession=PF00077.10; Description=Retroviral aspartyl protease
  Pfam annotation: Domain name=RVP_2; Domain location=4-123; Score= -47.8; E_value=0.0053; Accession=PF08284.2; Description=Retroviral aspartyl protease
  Pfam module annotation: Pfam domain module=RVP::RVP_2; Domain location=5-109::4-123
MAGHLAPETLRFIATIASNNVVLLVDGGSTHNFIQLQLVTQLSLPCRTTTPLRVMVGNGHQLECNTICEEIPVTIQAHNFHVDLYVLPISGANVVLGVQWLKSLGPVLTDYNTLLMKFFHNGGLITLQGDMDASLTSLSSFRRLSQKPDNAMYYHITLLLDLNSATHLHFK

SEQ ID NO: 159104 - protein, 62 aa, Glycine max
  Coding DNA Sequence Number=SeqID_42326
  Subcellular localization annotation: CTP_CleavageSite=56; ConfidenceScore=5.01e-01
MLQPCGIGTGLQEHSNRMTPKAYTPKSPSGPLPPDSVRLKWLTRRVPTVDLITTHRALTRRP

SEQ ID NO: 159105 - protein, 241 aa, Glycine max
  Coding DNA Sequence Number=SeqID_42327
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=2e-24, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSCGFGMTSPLEEPSPWVLVTLIFRGLHVLTFRGLRALTIRGLHVLTFRGLHVLANRGMHALTFRGLHILANRGLHVLTLRGLHVLAYRGLHVLTLRGLHVLTIRGLVAHTSRGLYILALRGLHALTIRGLHVLTFVGLHALTFRGLHVLPNRGLHTLTLRGLHVLANRGLHALTFRGLHVLIIRRLHALTSRGLHILALIGLHALALGTSYPHLQRTTRPHLQRATRPHHHRTARPHL

SEQ ID NO: 159106 - protein, 237 aa, Glycine max
  Coding DNA Sequence Number=SeqID_42328
  Gene Ontology: Mol. function=RNA-directed DNA polymerase activity; Biological process=RNA-dependent DNA replication
  Homolog annotation: Hit_ID=Q1RW99; Match level="QueryCoverage=94%, HitCoverage=36%, E-value=1e-31, Identity=34%"; Hit description=RNA -directed DNA polymerase
MEIGPLDPMTFVGFLSEGWILPYLNSDVIVLIPKLLNVDKIENYRPIALVNFQFKIITKVLTNRLSNIAPRIISSFHRGFIKGKHFSYYIACFDLSAFVKLLQLDPLYSSFGQALNLNKWKEALSKGLSALVDSHDLGPMTGPKQFQMPSHGTSVQIINAIKSSFYDGAIPLARVMSIANLLGFRVGITLFDYLGVLVFKGKPSKTTLQPLADKIGHKLGIWKGHLLSLMGHVQLVK

SEQ ID NO: 159107 - protein, 50 aa, Glycine max
  Coding DNA Sequence Number=SeqID_42329
MATYILPKSPKPVWKWRDAMCLIAVKLPVSLVVCVPRVTSAANAPVELAV

SEQ ID NO: 159108 - protein, 152 aa, Glycine max
  Coding DNA Sequence Number=SeqID_42330
MELIENIAVNDHAIFHDRAYTPTKRRLLELTTQDATLAQNKLLARQIEALTETLNKFPQQLQVVSPSHSSIMQIGGCHICGGEHEPGQCLAQEDSSREIFMSNYRSIESSIKNLEIQVGQLAKQMAERPTSSFGANIEKNPNEECKAMLTRS

SEQ ID NO: 159109 - protein, 214 aa, Glycine max
  Coding DNA Sequence Number=SeqID_42331
  Gene Ontology: Mol. function=tyrosine decarboxylase activity; Cellular component=cytoplasm; Biological process=metabolic process
  Homolog annotation: Hit_ID=Q9FNH8; Match level="QueryCoverage=99%, HitCoverage=98%, E-value=3e-88, Identity=77%"; Hit description =Lysine decarboxylase-like protein
  Pfam annotation: Domain name=Lysine_decarbox; Domain location=53-186; Score=247.4; E_value=3.1e-71; Accession=PF03641.4; Description=Lysine decarboxylase family
MEETKSKFKRICVYCGSSSGNKASYQEAAVELGKEMVERRIDLVYGGGSVGLMGLVSQAVHDGGRHVLGVIPKSLMPREITGDPIGEVRAVSDMHQRKAEMARQADAFIALPGGYGTLEELLEIITWAQLGIHSKPVGLLNVEGFYNSLLSFIDKAVDEGFISPKARRIIVSAPTAKDLVRELEEHVPERDEVVSKLVWEDRLNYVVPESEVAM

SEQ ID NO: 159110 - protein, 584 aa, Glycine max
  Coding DNA Sequence Number=SeqID_42332
  Gene Ontology: Mol. function=hydrolase activity, hydrolyzing O -glycosyl compounds; Biological process=carbohydrate metabolic process
  Homolog annotation: Hit_ID=Q2HU62; Match level="QueryCoverage=97%, HitCoverage=96%, E-value=0.0, Identity=72%"; Hit description =Glycoside hydrolase, clan GH-D; Ricin B lectin
MSNAGSPSLVNLENVSSQNISESGLQQASLPPRGWNSYDSFCWTISEDEFLQSAEMVSQRLKAHGYQFVVVDYLWYRKKVKGAYPDSLGFDVIDEWGRMIPDPGRWPSSIGGKGFSEVANKVHSLGLKFGIHVMRGISTQAVNANTPILDITKGGAYQESGRVWHAKDIAMPERACAWMPHGFMSVNTKLGAGRAFLKSLYEHYVDRFSAVPAVKHDCVFGDDLDLNEISYVSEVLSVLNRPIVYSLSPGTSVTPAMAKDVSGLVNMYRITGDDWDKWEDVKAHFDVTRDFSTANMIGGKGLKGNSWPDLDMLPFGWLTDPGSNEGPHRFSKLTLEEKRTQFPYITSSINLKHPGGKERRLKKGIHSLGLTSCSESKARGWSIESLNQDLERICWKKGLENKHQAPFCVHKRELQFRLDGVSMYQEDYRGKHQLVATDRMKFCLDASPRRKVTSKEFKRGTFSPCRWDSNQIWELNSNGTMVNSYSGLCATVEYIEANVNSGGIRSWIATGRTGEIYLAFFNLSEQKTEIYAKTSYLAKVLPDKSITSCKGEEVWSGTDVITTQGTISMNVEIHGCALFVLNCN

SEQ ID NO: 159111 - protein, 71 aa, Glycine max
  Coding DNA Sequence Number=SeqID_42333
MVAYLREKRARRTHKEAKDTEKHFIIAGRGANVSTTSKIVAIHSKIRICMHVSDDQRRTVWVIKKCTKVVV

SEQ ID NO: 159112 - protein, 350 aa, Glycine max
  Coding DNA Sequence Number=SeqID_42334
  Gene Ontology: Mol. function=protein tyrosine/serine/threonine phosphatase activity; Biological process=protein amino acid dephosphorylation
  Homolog annotation: Hit_ID=Q762M8; Match level="QueryCoverage=92%, HitCoverage=39%, E-value=1e-43, Identity=38%"; Hit description=MAP kinase phosphatase
MCCNARSAAAQVVRYERATEKIVSVFEDEEPKEFWIALSTKEVVVVENGEVKNVVERIEIDVGIRPRRVEEYDLDFGIFHKALAGGVVPPFSLSNAGSENCLPARENGWGRLTRKLASGIMKGLFTSSKCCESSVNIIEEGNQHKNVDPPLPPSSNNVGGSWSSFECFVDNGLERGKDSVQQVRDQFVVPSVGSSMPPPSPHSRAASDSFACFLSNSSKFSSKSPPLSPASSDYASSFTFSPSSTDLSIVSSRQSSPSGLESAEPNHVKDASSSESRSLVQKEGEAFLANHTLVGAKSSLPRKGSSLSIAERRGSNPPPRMMLPLASESSRVSKVRVRSRSFSLPALDDT

SEQ ID NO: 159113 - protein, 182 aa, Glycine max
  Coding DNA Sequence Number=SeqID_42335
  Homolog annotation: Hit_ID=Q5JMS6; Match level="QueryCoverage=51%, HitCoverage=32%, E-value=1e-29, Identity=63%"; Hit description =Membrane protein-like
FFGDIRLYVLAQGASCIAIPLMATLLPPMYTHSAYWLWASGFYVLAMLQEAADRVIYLLTFHIVSGHTLKHLSAAMVPIILTVMLAKRSVYSEKLLHSCPDLQFIASIKIEEVVQVDEEWNLDSFSHCSLICMEEPFSDLYGRTFVWQIFKVDYKHCNQDWSCIQNAEEKHASHLDLDKLIE

SEQ ID NO: 159114 - protein, 63 aa, Glycine max
  Coding DNA Sequence Number=SeqID_42336
MTNVHALRRKEKGKASAVSMVQVLSIDELEISIDEDEHVSVDDKGLGIKNGNGVQSLLEGDNC

SEQ ID NO: 159115 - protein, 86 aa, Glycine max
  Coding DNA Sequence Number=SeqID_42337
MPKSSPNMHVNQEVSTRVKPRLLCKKSMGQNTPNKIDDDGSKSHQGIIIRSSAIRTINKFGKCNKSKEGDRKRKLLKSWRKRSRVK

SEQ ID NO: 159116 - protein, 342 aa, Glycine max
  Coding DNA Sequence Number=SeqID_42338
  Homolog annotation: Hit_ID=Q9FKU2; Match level="QueryCoverage=55%, HitCoverage=67%, E-value=3e-26, Identity=33%"; Hit description =Genomic DNA, chromosome 5, P1 clone:MDA7
  Pfam annotation: Domain name=Hin1; Domain location=184-321; Score =117.5; E_value=3.8e-32; Accession=PF07320.4; Description=Harpin -induced protein 1 (Hin1)
MSRRETNPHFSRSSQPEYVDDHDTEPYPLVPRRKRHGKPSTQVAAPIPVALPPEHEDRVPLRTRPQHEDHVPLQPATKPIPQDHPHPPPPIPQEPRHGKQRSPRRQPTNQGFRPVKPKVNFQEPPPSADVPPEPRQQPHRDPRLSGIKLPKEQKSQPLTWLGACLCVIFWLIIIIGGLIVLIVYLVFRPQSPHFDVSSVTLNAAYLDLGYLLNADLTMLANFTNPNKKVHVDFSSVIIYLYYGSTLIATQYVEPFNAARLQSRFAYIHLVSSQVQLPLRESQRLVKQMEGNGVILEVRGVFRARSKLGSILRYSYNLYGRCSVMLTRPPDGILLKKKCRTKR

SEQ ID NO: 159117 - protein, 521 aa, Glycine max
  Coding DNA Sequence Number=SeqID_42339
  Gene Ontology: Mol. function=transferase activity, transferring hexosyl groups; Cellular component=mitochondrion; Biological process= metabolic process
  Homolog annotation: Hit_ID=Q7XIR4; Match level="QueryCoverage=97%, HitCoverage=76%, E-value=1e-119, Identity=41%"; Hit description =Membrane-associated salt-inducible protein-like
  Pfam annotation: Domain name=PPR; Domain location=11-45; Score=14.9; E_value=0.13; Accession=PF01535.11; Description=PPR repeat
  Pfam annotation: Domain name=PPR; Domain location=120-154; Score =31.7; E_value=2.6e-06; Accession=PF01535.11; Description=PPR repeat
  Pfam annotation: Domain name=PPR; Domain location=155-189; Score =38.8; E_value=1.9e-08; Accession=PF01535.11; Description=PPR repeat
  Pfam annotation: Domain name=PPR; Domain location=190-224; Score =12.5; E_value=0.25; Accession=PF01535.11; Description=PPR repeat
  Pfam annotation: Domain name=PPR; Domain location=225-259; Score =40.7; E_value=5e-09; Accession=PF01535.11; Description=PPR repeat
  Pfam annotation: Domain name=PPR; Domain location=260-294; Score =48.0; E_value=3.2e-11; Accession=PF01535.11; Description=PPR repeat
  Pfam annotation: Domain name=PPR; Domain location=295-329; Score =10.6; E_value=0.41; Accession=PF01535.11; Description=PPR repeat
  Pfam annotation: Domain name=PPR; Domain location=330-364; Score =48.4; E_value=2.4e-11; Accession=PF01535.11; Description=PPR repeat
  Pfam annotation: Domain name=PPR; Domain location=365-399; Score =35.2; E_value=2.2e-07; Accession=PF01535.11; Description=PPR repeat
  Pfam annotation: Domain name=PPR; Domain location=400-434; Score =40.2; E_value=7.3e-09; Accession=PF01535.11; Description=PPR repeat
  Pfam annotation: Domain name=PPR; Domain location=435-469; Score =47.2; E_value=5.4e-11; Accession=PF01535.11; Description=PPR repeat
  Pfam annotation: Domain name=PPR; Domain location=470-504; Score =25.1; E_value=0.00025; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=11-45::120-154::155 -189::190-224::225-259::260-294::295-329::330-364::365-399::400 -434::435-469::470-504
MYQSSIGAHRLAYRSQISKLVKAGLINQAIYLFDQMTESNCRVFSVDYNRFIGVLLRHSRLHLAHHYYRRHVIPRGFSLLPFTYSRFISALCSAPNNINLPLIHSLLLDMDSLGFVPDIWAFNTYLNLLCRQNRLETALELFHSMPSKGRDPDVVSYTIIIDALCNAKRFDEAAKVWRRLIDKGLSPDYKACVALVVGLCSGGRVDLAYELVVGVIKGGVKVNSLVYNALIDGFCRMGRVDKAMKIKAFMSRTGCVPDLVTYNILLNYCCEEGMVDEAVRLVETMERSGVEPDLYSYNELLKGFCKANMVDRAHLMMVERMQTKGMCDVVSYNTVITAFCKARRTRKGYELFEEMCGKGIRPDMVTFNILIDAFLREGSTHVVKKLLDEMTKMRVLPDCIFYTAVVDHLCKNGKVDVAHSVFRDMVENGVNPDVISYNALLNGFCKTSRVMDAMHLFDEMQSKGLYPDEVTYKLIVGGLIRGKKISLACRVWDQMMERGFTLNRHLSETLVNAIQSSDGTT

SEQ ID NO: 159118 - protein, 175 aa, Glycine max
  Coding DNA Sequence Number=SeqID_42340
  Gene Ontology: Mol. function=protein tyrosine/serine/threonine phosphatase activity; Cellular component=intracellular; Biological process=protein amino acid dephosphorylation
  Homolog annotation: Hit_ID=Q9M3C4; Match level="QueryCoverage=80%, HitCoverage=23%, E-value=1e-50, Identity=57%"; Hit description =Phosphatase-like protein
AHPIHPENRTRTRGHGVHALLTLQQLAREAHVGVRYATRDLDIVKGVLEALAFPPHEIRDDERGRARHALAAVDEHAPTLVPDILEVIEDVVENAGDVLRGSSTLFATVSLPRGRWKRPITEIVAAGAGPLQNAAFVDGERLKRTRRFPGNRRPGEERKRCKTEEAEGREEFGVC

SEQ ID NO: 159119 - protein, 261 aa, Glycine max
  Coding DNA Sequence Number=SeqID_42341
  Gene Ontology: Mol. function=protein tyrosine/serine/threonine phosphatase activity; Cellular component=intracellular; Biological process=protein amino acid dephosphorylation
  Homolog annotation: Hit_ID=Q762M8; Match level="QueryCoverage=94%, HitCoverage=30%, E-value=3e-95, Identity=67%"; Hit description=MAP kinase phosphatase
  Pfam annotation: Domain name=DSPc; Domain location=99-238; Score =133.2; E_value=7e-37; Accession=PF00782.11; Description=Dual specificity phosphatase, catalytic domain
MLGEESNNNNDRAGGHRRTTHSRSVSWTDRSPVTRKPPRPLQPLAIHKRSVLEWPSAGCDDLGDWSLPPTPRGSTKTPDSGSGQVFQFKKDYYAFYDKECSRIAEHVYLGSDTVAKSVELLRRHGITHVLNCVGFVCPEYFKTDFVYKTLWLRDSPSEDITSILYDVFDYFEDVRNQGGRVFVHCCQGVSRSTSLVIAYLMWREGQSFEDAFHYVKIARGVTNPNMGFACQLLQCQKRVHAMPASPSSVLRMYRMGSSFSL

SEQ ID NO: 159120 - protein, 39 aa, Glycine max
  Coding DNA Sequence Number=SeqID_42342
MAMVGVSPGDYWSDGRKLRLQGMTSGDMETDRDSDFSPL

SEQ ID NO: 159121 - protein, 431 aa, Glycine max
  Coding DNA Sequence Number=SeqID_42343
  Gene Ontology: Mol. function=ATP binding; Cellular component =ubiquitin ligase complex; Biological process=electron transport
  Homolog annotation: Hit_ID=Q1S771; Match level="QueryCoverage=78%, HitCoverage=87%, E-value=4e-81, Identity=45%"; Hit description=WD40 -like
  Pfam annotation: Domain name=WD40; Domain location=204-240; Score =24.2; E_value=0.00048; Accession=PF00400.22; Description=WD domain, G-beta repeat
  Pfam annotation: Domain name=WD40; Domain location=244-281; Score =38.7; E_value=2e-08; Accession=PF00400.22; Description=WD domain, G -beta repeat
  Pfam annotation: Domain name=WD40; Domain location=289-327; Score =31.3; E_value=3.4e-06; Accession=PF00400.22; Description=WD domain, G-beta repeat
  Pfam annotation: Domain name=WD40; Domain location=335-371; Score =35.5; E_value=1.8e-07; Accession=PF00400.22; Description=WD domain, G-beta repeat
  Pfam annotation: Domain name=WD40; Domain location=378-425; Score =28.1; E_value=3.1e-05; Accession=PF00400.22; Description=WD domain, G-beta repeat
  Pfam annotation: Domain name=WD40; Domain location=89-170; Score =11.6; E_value=1.6; Accession=PF00400.22; Description=WD domain, G -beta repeat
  Pfam module annotation: Pfam domain module=WD40::WD40::WD40::WD40::WD4 0::WD40; Domain location=204-240::244-281::289-327::335-371::378 -425::89-170
MRIQWWLNTCSSANCATATHHSTISLPKQKEHACDDSISYSSISEAPASSTTSNNSTSSLESNLSIQTLPSVPSLQSLSPQNFTFSVSHHCVTTLEPHLSRPVTSLAVNNNLLYAATDHEINVYDRHTCTTIHAFNTQPTSTSNSTKTIAFSNNNTVITTHQDCKIRVWQNHKNIHHRMLATLPTVNDRLHRFLLPKNYVAIRRHEKRLWIEHADAVTGLAVSNGAIYSVSWDRTLKIWRLSDFRCVESLKAHEDAVNAVAVSNDGTVYTGSADKRIRVWARPAGEKRHVLVATLEKHKSAVNALALNDDASVLFSGACDRSILVWEREDSANHMVVSGALRGHQKAILCLVNVSDLLFSGSADRTVRIWKRAYDGRYGCLAVLDGHRKPVKSLAAIPEEYDQTSPKCSVSVFSGSLDGEIKVWQVSITSQ

SEQ ID NO: 159122 - protein, 57 aa, Glycine max
  Coding DNA Sequence Number=SeqID_42344
MSRGLFWSDFAITISESHPRGNRYNFVTDVGETPPKLRPWHAFRQPCVRNRYNFSRA

SEQ ID NO: 159123 - protein, 679 aa, Glycine max
  Coding DNA Sequence Number=SeqID_42345
MVPRKMQSRPSRHIFSASDDTTMTKNIRATHAPVDGHIGVRPLLHVVQDIFHRAASLIPGIVQGKQVQMDAMKDSAYQSDLANICCKCSSGGDVHATTMGILGMLSSYSWDAKVVIALAAFAANFGEFWLVAQLYATNRLAKSVAKLKHIHETLEQVDDLGPKFQTVNNLLKAMLDVTNNIVQFHELPSQYIDPEAPEMLTASNLIPGAVYWTIRSIVSCASHILGITGLGQGLAHKLDNINSHLRKQLTVCRQHLDDNRQREAFATLRLLFETPHQDNSKVLKAMFCSKDDPLPLFDGSSKQRVSIEVLRRKIVLLYITDVHNVPDQELVIFEQMYQESRQDSTRLESQYELVWIPVVDKAIPWNDVKPKFEKLQSMMSCYSLYDPSLLEPATIRYIKEVWLFKTKPILVVLDPQGKVVNLNAIPMMWIWGSLAYPFSSSREEALWNAETWGLVLLADSIDPSLLEWISEGKYICLYGGDDIEWIRKFTNTAYSLARTLQLPLEMIYVGKSNPGKKVQEINNAVQTEKLSNVLPDLAISWFFWVRLESMWHSKSQQSKTVENDHIMHEVMRILTYDSGDPGWAVISQGTGKMAQGKGDTFLKCLNEHEQWKDAAKDKGLLPAMDDYIKELQTPHHCNRLILPGTSGGIPDKVSCAECGQTMEKFYMKSSALMPIETIG

SEQ ID NO: 159124 - protein, 574 aa, Glycine max
  Coding DNA Sequence Number=SeqID_42346
  Gene Ontology: Mol. function=hydrolase activity, hydrolyzing O -glycosyl compounds; Biological process=carbohydrate metabolic process
  Homolog annotation: Hit_ID=Q9LTN0; Match level="QueryCoverage=87%, HitCoverage=90%, E-value=1e-155, Identity=54%"; Hit description =Arabidopsis thaliana genomic DNA, chromosome 3, P1 clone: MTC11
  Pfam annotation: Domain name=Cellulase; Domain location=53-371; Score= 21.5; E_value=1.3e-08; Accession=PF00150.8; Description=Cellulase (glycosyl hydrolase family 5
  Pfam annotation: Domain name=Ricin_B_lectin; Domain location=419-541; Score=13.4; E_value=0.0018; Accession=PF00652.12; Description=QXW lectin repeat
  Pfam module annotation: Pfam domain module=Cellulase::Ricin_B_lectin; Domain location=53-371::419-541
MGRWRPSTLVFTILSAPIIIIIALLSSGGTTTVEDVDNDHTMAVTGLLHTDSRWILNQGGQRVKLACVNWVSHLEVAVAEGLSKKPVDAISKGIKSMGFNCVRLTWPTLLATNDSLASLSVRRSFQSLGLLESVAGVQTNNPSIIDLPLIQAFQAVVKSLGDNDVMVILDNHLTNPGWCCGYSDGNGFFGDKFFNPDQWIFGLTKMATLFNGVTNVVGMSLRNELRGPKQNVNDWYKYMVKGAEAVHAANPDVLVILSGINFDTSLSFIRDRPVSLTFKGKLVFEVHRYGFTDGGAWADGNPNQVCGKVTADIKQTSTFLVDQGWPLFVSEFGGDLRGTNVNDNRYLNCFLALVAELDLDWAYWTLVGSYYFREGVIGMEEFYGLLTWDWTQVRSTSFLNRISALQIPFRGPGIIEGSAYKLIFHPLTGLCVISKSQLTSLTLGPCSSSDAWTYTPQKTLLINNTNFCIHAEQEGKPATLSITCSDANSKWEMISDSNMHLSSKLSDGSNLCLDVDDNNIIVTTACKCLNQDKTCDPASQWFKLIDSGRRSISTTSTLSMLNSPDILWQPLSSI

SEQ ID NO: 159125 - protein, 91 aa, Glycine max
  Coding DNA Sequence Number=SeqID_42347
MWIVSEDKYGYLPILLFCLRVRKGFFTLRGVEGGQMLKKAEPTVFFDEGINPSAARPRQHSSEFLNSQALRSLSVTNAEGRVNESVYELQC

SEQ ID NO: 159126 - protein, 382 aa, Glycine max
  Coding DNA Sequence Number=SeqID_42348
  Gene Ontology: Mol. function=protein binding; Cellular component =cytoskeleton; Biological process=positive regulation of actin filament polymerization
  Homolog annotation: Hit_ID=Q6K908; Match level="QueryCoverage=99%, HitCoverage=89%, E-value=1e-171, Identity=74%"; Hit description =Putative arp3
  Pfam annotation: Domain name=Actin; Domain location=2-381; Score =273.4; E_value=4.6e-79; Accession=PF00022.9; Description=Actin
MGFAGNVEPCFIVPTVVAINESFLNQSRNSSKGNWVAQHNAGVMADLDFFIGDEALSKSRSSSTYNLNYPIQHGQVENWDAMERFWQQCIFNYLRCDPEDHYFLLTESPLTSPESREYTGEIMFETFNVPGLYIGVNSVLALAAGYTTSKCEMTGVVVDVGDGAAHVVPVADGYVIGSSIKSIPISGKDITLFVQQLMRERGENVPLEDSFEVARKVKEMYCYTCSDIVKEFNKHDKEPAKYIKHWRGIKPRTGAPYSCDIGYERFLGPEIFFNPEIYGSDFTTPLPVVIDKCIQSAPIDTRRSLYKNVVLSGGSTMFKDFHRRLQRDLKKIVDARVLLSESRLNGEIKSQPVEVNVLSNPIQRFAVWFGGSVLASTPEFFT

SEQ ID NO: 159127 - protein, 71 aa, Glycine max
  Coding DNA Sequence Number=SeqID_42349
MIGTITHTTRFSEQGMGRTEQPAKCKQRQARTEKRMQTEVLTLARKYKATIHTMLGVPCSDWQLQCSTIAQ

SEQ ID NO: 159128 - protein, 137 aa, Glycine max
  Coding DNA Sequence Number=SeqID_42350
MEDSIGKITKITFPSQEGLLLTVKNTLENGGFNRENNKDHISQSRGSALDGEEHIGEWRIQSGNNKDHISQSRGNTLENGFNRENNKDHISQSRGSTLDSEEHIGLEDSIGKITKITFPNQEGPLLTVKNTLENGFN

SEQ ID NO: 159129 - protein, 48 aa, Glycine max
  Coding DNA Sequence Number=SeqID_42351
MTTAGREVEGSMRKNERVSEREAEDHGREKRNKEEGKYDDGERGFNPK

SEQ ID NO: 159130 - protein, 143 aa, Glycine max
  Coding DNA Sequence Number=SeqID_42352
MTEARQKGVRKVNENENKIEDRRKRRMNAKYRRTVENLRIITHENITEAPRLGFSSRKQFSLAILREYEVPRRLAPFLFTPPIYSKIGEELATQLAQASKVASSRSNRLLRKKLEGPSGPDGYSHPPFLLNAPPVLFLVILFP

SEQ ID NO: 159131 - protein, 523 aa, Glycine max
  Coding DNA Sequence Number=SeqID_42353
  Gene Ontology: Mol. function=ubiquitin-protein ligase activity; Cellular component=anaphase-promoting complex; Biological process =regulation of mitotic metaphase/anaphase transition
  Homolog annotation: Hit_ID=Q2QTS8; Match level="QueryCoverage=99%, HitCoverage=99%, E-value=0.0, Identity=67%"; Hit description =Regulator of chromosome condensation, putative, expressed
  Pfam annotation: Domain name=RCC1; Domain location=151-200; Score =5.5; E_value=0.18; Accession=PF00415.9; Description=Regulator of chromosome condensation (RCC1)
  Pfam annotation: Domain name=RCC1; Domain location=203-255; Score =10.1; E_value=0.057; Accession=PF00415.9; Description=Regulator of chromosome condensation (RCC1)
  Pfam annotation: Domain name=RCC1; Domain location=258-308; Score =3.3; E_value=0.31; Accession=PF00415.9; Description=Regulator of chromosome condensation (RCC1)
  Pfam annotation: Domain name=RCC1; Domain location=313-365; Score =1.8; E_value=0.45; Accession=PF00415.9; Description=Regulator of chromosome condensation (RCC1)
  Pfam annotation: Domain name=RCC1; Domain location=368-417; Score =29.3; E_value=1.4e-05; Accession=PF00415.9; Description=Regulator of chromosome condensation (RCC1)
  Pfam annotation: Domain name=RCC1; Domain location=420-484; Score =21.6; E_value=0.0027; Accession=PF00415.9; Description=Regulator of chromosome condensation (RCC1)
  Pfam module annotation: Pfam domain module=RCC1::RCC1::RCC1::RCC1::RCC 1::RCC1; Domain location=151-200::203-255::258-308::313-365::368 -417::420-484
MDATTSETPTIQFHNIPDQPITTIVATQLPTLQGQQEQQHHCFGDSSPGEFPLSANPSIVLHATCSFFKQPANFAPDFDLSLSELAALDMCQKRAIFKPMTTEQRQHLKQRCGGSWKLVLRFLLAGEACCRRREKSQVIAGPGHSIAVTSKGVVYSFGSNSSGQLGHGTTEDVWQPRPIRALQGIRIIQATAMTGRTMLISDSGQAYVFGKESFGEVETIVNRGSKIVTTPQLVESLKNIFVVQAAMGNYFTAVLSREGRVYTFSWGCVGKLCHQTDQNDVEPRPLLGALEHIPVVQIAAGFCYLLCLACQPSGMSVYSVGCGLGGKLGHGTKTNEEYPRLIEQFQLLNLQPMAIAAGSWHAAVVGQDGRVCTWGWGSYGCLGHGNEECELVPKVVEELRNVKAVHVATGDFTTFVVSDSGDVYSFGYGESGSLGHVPENHEQEDMHENVLTPKLVTWMKQINERVVQISLTNFIYWNAHTFALTESGKLYAFGAGDKGQLGVELGAHQTEKGKPERVDIDLG

SEQ ID NO: 159132 - protein, 105 aa, Glycine max
  Coding DNA Sequence Number=SeqID_42354
MARASRVVVLALVMFAMIGLACAAPAPEASDDDYEGDDYSIGALTSGAASSPNGVAAAPIGGPVPPGAFDNAKGGLAPSAASSSLAHFSTVAGAASAALAGFFYF

SEQ ID NO: 159133 - protein, 133 aa, Glycine max
  Coding DNA Sequence Number=SeqID_42355
MAPLSSLQNGQGGPLGTRTLTFRGLHASPSEDYTSSPSEGYMHALRGLRVLTFRGLHALTFRGFHALTFKGLHALTVRGLHVLTFRGLDVLAVRGLDVLAFRGLHVLAFRGLRSLTFSGIHIRTLREFKVLCP

SEQ ID NO: 159134 - protein, 41 aa, Glycine max
  Coding DNA Sequence Number=SeqID_42356
MLSEVSPCEDEPSEKWWACNNSIESHQNERDPELYMYETIQ

SEQ ID NO: 159135 - protein, 104 aa, Glycine max
  Coding DNA Sequence Number=SeqID_42357
MADPTNQHDTFQCALSSLTCFLGDFPKGHPSHNYSKPSMLNYEILRVLHAHQLLPGLSSSHIVLGERFALIPFVTPPDFQLLRGSHTTTCGDTSLNILVGQNTP

SEQ ID NO: 159136 - protein, 101 aa, Glycine max
  Coding DNA Sequence Number=SeqID_42358
  Gene Ontology: Mol. function=protein binding; Cellular component =cytoskeleton; Biological process=actin filament polymerization
  Homolog annotation: Hit_ID=Q6K908; Match level="QueryCoverage=60%, HitCoverage=14%, E-value=2e-24, Identity=80%"; Hit description =Putative arp3
MTGVVVDVGDGATHVVPVADGYVIGSSIKSIPIAGKDITLFVQQLMRERGENVPPEDSFEVARKVKEMYCYTCSDIVKVVFISILSTLTALFEEFVVCLCQ

SEQ ID NO: 159137 - protein, 248 aa, Glycine max
  Coding DNA Sequence Number=SeqID_42359
  Gene Ontology: Mol. function=methyltransferase activity; Biological process=metabolic process
  Pfam annotation: Domain name=Methyltransf_11; Domain location=106 -187; Score=52.2; E_value=1.7e-12; Accession=PF08241.2; Description =Methyltransferase domain
MNISLTKPFILRCFLISLFLSLPFLFLFLHLLSPPPHVTTTTNDLRIRPGYSSYDSYIQRQLNKTLNPRLRKIWTTRDWNRKIPVFARFFEDLKDKKLLNNASKALCIGARVGQEVEALRRIGVSDSVGMDLVPYPPLVVKGDFHNQPFDDGTFDFEFSNVFDHALYPERFVGEIERTLKPNGVCVLHVALSRRADKYSANDLFSVEPLVAMFKNSALVHVRSVDGFGLDTEVAFRKNRCGGGRCGGL

SEQ ID NO: 159138 - protein, 119 aa, Glycine max
  Coding DNA Sequence Number=SeqID_42360
  Gene Ontology: Mol. function=protein binding; Cellular component =cytoskeleton; Biological process=actin filament polymerization
  Homolog annotation: Hit_ID=Q6K908; Match level="QueryCoverage=52%, HitCoverage=22%, E-value=1e-20, Identity=57%"; Hit description =Putative arp3
NIVLSGGSTMFKDFHRRLQRDLKKIVDARALSSEARINGEIKACHTKAEYEEYGASICRTNPLLDKQLNEYPVILILNSPPGLSSHPYSWWQDLEIDEVLYFLSFSVGTDNSIKDSFGA

SEQ ID NO: 159139 - protein, 207 aa, Glycine max
  Coding DNA Sequence Number=SeqID_42361
  Gene Ontology: Mol. function=oxidoreductase activity; Cellular component=endoplasmic reticulum; Biological process=metabolic process
  Homolog annotation: Hit_ID=Q0VH87; Match level="QueryCoverage=95%, HitCoverage=64%, E-value=4e-68, Identity=64%"; Hit description=3 -ketoacyl-CoA reductase 2
  Pfam annotation: Domain name=adh_short; Domain location=48-207; Score= 24.1; E_value=1.4e-07; Accession=PF00106.15; Description=short chain dehydrogenase
VVDGCYLTLLIISCLGLIVTLNRFISFFTWIFRTCFRSEKNLLRSYGSWALVTGATNGIGKAFAHQLAQRGLNLILVSRSFQKLKTVAGEIKAKHPGTRVKIVEMDFAGDLTEGLRRVEEASEGLDVGVLINNVGITYPRAMFFHEVEEKVWRNIVRVNIEGTTRVTKIVLRGMLQRRKGAIVNIGSGASVVVPSHPLFTIYAASKA

SEQ ID NO: 159140 - protein, 180 aa, Glycine max
  Coding DNA Sequence Number=SeqID_42362
  Subcellular localization annotation: CTP_CleavageSite=91; ConfidenceScore=5.10e-01
MKSGGRRRYPSGYPYKYSFAIRQTQNSEFGSMQRLTSSSASFVILTREVKRRYPSGYPYKHSFTIYQTQSPAGYRMVICTFRQPGANEPVDAQRVTSSSAPFVIQGQRVRWQAEIPFGCPHLSSTKANEFDGIRMIHSSPTTHEILLCWAGTIKFDSVWKRHGPTDWDIGRPNDVPLERN

SEQ ID NO: 159141 - protein, 67 aa, Glycine max
  Coding DNA Sequence Number=SeqID_42363
MKNKGKHVQLMDSSYSDSSKNQSESWYPHYTKKRLIPDSTVISTRPASLRSAKKLIETRGTSVQAQV

SEQ ID NO: 159142 - protein, 321 aa, Glycine max
  Coding DNA Sequence Number=SeqID_42364
  Homolog annotation: Hit_ID=Q110I6; Match level="QueryCoverage=55%, HitCoverage=86%, E-value=3e-19, Identity=30%"; Hit description =Abortive infection protein
  Pfam annotation: Domain name=Abi; Domain location=179-270; Score =70.7; E_value=4.6e-18; Accession=PF02517.7; Description=CAAX amino terminal protease family
  Subcellular localization annotation: CTP_CleavageSite=37; ConfidenceScore=5.39e-01
MATLSLTLNCWSTVELAHTRFSSTFTSLGRRSRYSICSFAKKSLKKSRRDVTEAAGDLLDDKFVQNDNLDTSLNPAAPNSNPLPSRSAVLQACIITCGLIAALGIVIRQVSHVASVEGLPVFDCSTEVSFGFEMWHLELITGLVVLISSCRYLLLKTWPDFAKSSEAANQQVLSSLQPLDYIVVAFLPGISEELLFRGAILPLLGMNWNSIGIAALIFGVLHLGNGRKYSFAIWATFVGLAYGYATILSSSVAVPMASHAVNNLIGGLLWRHHISIHLTLPAPSLMLYKNCDTEVIELETNPRSMFANAATNGSTALSSIV

SEQ ID NO: 159143 - protein, 977 aa, Glycine max
  Coding DNA Sequence Number=SeqID_42365
  Gene Ontology: Mol. function=dopamine beta-monooxygenase activity; Biological process=histidine catabolic process
  Homolog annotation: Hit_ID=Q9FFU6; Match level="QueryCoverage=88%, HitCoverage=98%, E-value=0.0, Identity=61%"; Hit description=Genomic DNA, chromosome 5, P1 clone:MBG8
  Pfam annotation: Domain name=Cytochrom_B561; Domain location=729-932; Score=-52.0; E_value=0.0011; Accession=PF03188.6; Description =Cytochrome b561
  Pfam annotation: Domain name=DOMON; Domain location=257-401; Score =9.9; E_value=0.0066; Accession=PF03351.8; Description=DOMON domain
  Pfam annotation: Domain name=DOMON; Domain location=595-714; Score =34.0; E_value=5.2e-07; Accession=PF03351.8; Description=DOMON domain
  Pfam module annotation: Pfam domain module=Cytochrom_B561::DOMON::DOMO N; Domain location=729-932::257-401::595-714
MQKRLRKFELTATEGGEGRRKSGVSKFHGTPTVESERERSHTYNEYESIDLRRTGEGREDFVALVTQNGKEGKMILGFVTVDSDPQNLRDSAAIAPVMLRRSLIVVPFLLHLLFSFGYADPAPNCTRLSSIVNSESEFEMVQHQLRGSLKINDDCSFRVSQFDMLPGSDVHWWGAQASDFVNLTAGFIVSNDGLNGTYNNSTFDVHLLSNVSWSKINVLAVWDRATASDFGHVVLRNEAPATTPPPTVFENCKVLSKNFRLRWTLNVSEDSIEIGLEAATGITNYMAFGWANSSAEDSDLMIGADVAVAGFMEDGMPFVDDFFITKYSECVRNSDGVAQGVCPDSFYEGPDGVGLVNNSMLIYGHRKDGVTFVRYRRHLTKVDEKYDHPVNHSANMKVIWALGRIKPPDSINPYYLPQNHGAVNYGHLVLNVSEHVNECTGPLDAEDKEDQSLITADAKVPLVVSSAPAMHYPNPPNPEKVLYINKKEAPVLRVERGVPVKFLIQAGHDVALYITSDPLGGNATTRNLTETIYAGGPEAHGVQASPTELVWAPDRNTPDHVYYHSLYDQKMGWKVEVVDGGLSDMYNNSVILDDQQVTFFWTLSKDSISIAVRGEKKSGYIAVGFGSGMVNSYVYVGWIDDTGIGHVNSYWIDGKDASSIHRTKENLTHVRCKTENGIITFEFTRPLDPSCRLEKRVECKNIIDPTTSLKVVWAMGAKWANDHLTDRNMHSSTSNRPILVHLMRGSAEAEQDLLPVLAVHGFMMFIAWGILLPGGILAARYLKHLKGDGWYRIHVYLQYSGLVIVLLALLFAVAELRGFYFSSAHVKCGFATILLACIQPVNAFLRPQKPANGEQASSKRVIWEYFHGIVGRCAVVVGIAALFTGMKHLGDRYDVENVHGLKWAMAIWFLIGALIVIYLEYHERQRIERQISGRGNWVLGNLEEDDSVDLLRPTRTTADKQLQPSARMEVQLEPLNR

SEQ ID NO: 159144 - protein, 48 aa, Glycine max
  Coding DNA Sequence Number=SeqID_42366
MSTSSNSSIIPVFKASLYVDDMLVIRSNFTFAGQLKMEMQDIFDFDMS

SEQ ID NO: 159145 - protein, 114 aa, Glycine max
  Coding DNA Sequence Number=SeqID_42367
  Gene Ontology: Mol. function=oxidoreductase activity
  Homolog annotation: Hit_ID=Q9LSQ5; Match level="QueryCoverage=65%, HitCoverage=35%, E-value=6e-24, Identity=80%"; Hit description=1,4 -benzoquinone reductase-like; Trp repressor binding protein-like
MLGTPAIMLGAPSNTLKLEVQPGRIGCTDYATCNNDPEPALTAIARLVHHGMLFVPIGYTFSAGMFEMEELKGGSPYGSVVQKLMLVMVQDTQLSLSWSKHSTKASTSPTSQRS

SEQ ID NO: 159146 - protein, 353 aa, Glycine max
  Coding DNA Sequence Number=SeqID_42368
  Gene Ontology: Mol. function=nucleic acid binding; Cellular component= nucleus; Biological process=red or far red light signaling pathway
  Homolog annotation: Hit_ID=Q6QNU4; Match level="QueryCoverage=99%, HitCoverage=30%, E-value=1e-164, Identity=81%"; Hit description=DNA damage-binding protein 1
MGDVSDRIGRPTDNGQIGIIDPDCRLIGLHLYDGLFKVIPFDNKGQLKEAFNISASNYEPMTLIKDYQLPLPKPWLEELQVLDIKFLYGCSKPTIVVLYQDNKDARHVKTYEVALKDKDFVEGPWSQNNLDNGADLLIPVPPPLCGVLIIGEETIVYCSANAFKAIPIRPSITKAYGRVDPDGSRYLLGDHTGVTGLKIEPLGETSIASTISYLDNAFVYVGSSYGDSQVGHNILTISDGKMQLIKLNLQPDAKGSYVEVLERYVNLGPIVDFCVVDLERQAQGQVVTCSGAYKDGSLRVVRNGIGINEQASVELQGIKGMWSLRSSTDDPFDTFLVVSFISETRILAMNLED

SEQ ID NO: 159147 - protein, 117 aa, Glycine max
  Coding DNA Sequence Number=SeqID_42369
  Gene Ontology: Mol. function=hydrolase activity; Cellular component =membrane; Biological process=carbohydrate metabolic process
  Homolog annotation: Hit_ID=Q6ZLQ2; Match level="QueryCoverage=50%, HitCoverage=45%, E-value=4e-21, Identity=74%"; Hit description =Putative glycosyl hydrolase
MHHHYGTKRERMLRRHQNKNGKELLKAKDAWETSVSGSKHGPPCWMAVQSAIPSPQAQSRAFCKSAWETPARATHQVVPSMNVVLPSGGDNVVTGIAASDFCCTTIPLAVAIYFCQT

SEQ ID NO: 159148 - protein, 548 aa, Glycine max
  Coding DNA Sequence Number=SeqID_42370
  Gene Ontology: Mol. function=nucleic acid binding; Cellular component= nucleus; Biological process=red or far red light signaling pathway
  Homolog annotation: Hit_ID=Q9M0V3; Match level="QueryCoverage=97%, HitCoverage=55%, E-value=0.0, Identity=73%"; Hit description=DNA damage-binding protein 1a
  Pfam annotation: Domain name=CPSF_A; Domain location=270-487; Score =260.0; E_value=4.8e-75; Accession=PF03178.5; Description=CPSF A subunit region
MKDRFPEDSSKGWRTPDSDILKLQTTVYKVLLATGGGHLVYLEIGDGILQEVKHAQLEYEISCLDINPIGENPNHSNLAAVGMWTDISVRIFSLPDLSLITKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 159149 - protein, 217 aa, Glycine max
  Coding DNA Sequence Number=SeqID_42371
  Gene Ontology: Mol. function=calpain activity; Cellular component =intracellular; Biological process=proteolysis
  Homolog annotation: Hit_ID=Q1S671; Match level="QueryCoverage=90%, HitCoverage=49%, E-value=3e-23, Identity=36%"; Hit description =Cyclin-like F-box; F-box protein interaction domain
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLEHLQLMKNVCLGSIPEIHMESCDVSSLFHSLQIETFLFNFANMPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLKGFPVLGTLPKVGG

SEQ ID NO: 159150 - protein, 102 aa, Glycine max
  Coding DNA Sequence Number=SeqID_42372
MNEERTNGEEQGKIFTYWLTEMSRKRYGSTSAWIFFTETRKVTEILQKPIRLVSYPNFVRGLLLDNMQPLIGRFEILGILCFTICEVPRHAGNQKEAGLRDP

SEQ ID NO: 159151 - protein, 109 aa, Glycine max
  Coding DNA Sequence Number=SeqID_42373
  Subcellular localization annotation: CTP_CleavageSite=38; ConfidenceScore=5.12e-01
MPISPCGSISWSVSFRHRDRARKTPSGPGEVQQGLGVSSSDYGPFSVLRSACRPQQGHQAPTNQAFIKKYCAPRQAQGETPQQHGDGWQRATNAPPPPLEFISAHPQKG

SEQ ID NO: 159152 - protein, 196 aa, Glycine max
  Coding DNA Sequence Number=SeqID_42374
MSITERIAVRLQQLRSLFSNKEKIMSDQTVINPTSAAAQQALSPLESFANETASTSAVPAAADSAADSVAQPATPPAAATPAAQPAAPASAEQPFHADAPVDLDQQLATQDTLANGSASAGASAAATPGVRNAQTAAPVVAPDAPVAATAASDAVAQDISAGVKDFVQAFSFVEQGVLKLGSAAKDELIALAKKYL

SEQ ID NO: 159153 - protein, 268 aa, Glycine max
  Coding DNA Sequence Number=SeqID_42375
MCVDYRIGRLRMLSNLIVSDDKRDFDSLRIGRVWATICCLHASSDLSSLDDEGADNYEVSPHAIGPSSHDSRIETFLRSRPEDVDISGKGADDHIGADNHKVRPRATGPLGHDSRIETFSRLACLWLTKVQIATRCVRVLPNPWVTIAELRLFHGLSRKTLTSPGRVQMTTLVSACQRARLPLVDKGADNHEMTTLVSACQWARLPLVDKGADNQEVSPHAIGPSSHDSRIETFLRSRLGDADISGNGADDHIGLCVSTSSLASGCQK

SEQ ID NO: 159154 - protein, 115 aa, Glycine max
  Coding DNA Sequence Number=SeqID_42376
MKEVVHRLLCICTHVIKRNRRNMSKDTKNVSWEAAMKAPLELEGLGSSSSMYSFASWKIRKREMRHHFKEKMSLKEAHYHRRSQIRAWRKKEMNEARGREEHEILCSKRALKSEV

SEQ ID NO: 159155 - protein, 101 aa, Glycine max
  Coding DNA Sequence Number=SeqID_42377
MNSFTSQDQNFSLIAMIKQEEDTIGTNSGAERVYTKYMPGASEKVVDPTLSDEMDEDKLNRMEDEYRVPEYVSIDTMTKSLEKKKKVDLAIGWSSANKLGP

SEQ ID NO: 159156 - protein, 197 aa, Glycine max
  Coding DNA Sequence Number=SeqID_42378
MASIGGSHTSSQSNQNQGIINTHEDVASLKRLFEDEHIEREKLKAQMAKLMAAVSNLSSTDHGSENHDHAGCHNHDYIDRELKWQNLEIPIFDGEDPSMNQSPYELLLSLKHEGMVEEYCKKFELYESPLRGIEPEYLKGIFLNGRKKVGTSFVVQVEGTSTWVVVTENKRGYISCGSVQVESVEAKLHGESKGDSK

SEQ ID NO: 159157 - protein, 101 aa, Glycine max
  Coding DNA Sequence Number=SeqID_42379
  Gene Ontology: Mol. function=racemase and epimerase activity, acting on carbohydrates and derivatives; Biological process=carbohydrate metabolic process
  Homolog annotation: Hit_ID=Q9STI6; Match level="QueryCoverage=61%, HitCoverage=14%, E-value=7e-09, Identity=47%"; Hit description =Nucleotide sugar epimerase-like protein
MVASLVLSRAPPLIVLLGFLCEALEGALERGGVVVTEIIEAEDVVAIMLEGEGDMGADKDSKVDDEDGEVGKGGATSKLGNALLLVGVTPKVADGATIRGS

SEQ ID NO: 159158 - protein, 602 aa, Glycine max
  Coding DNA Sequence Number=SeqID_42380
  Gene Ontology: Mol. function=amino acid transporter activity; Cellular component=integral to membrane; Biological process=amino acid transport
  Homolog annotation: Hit_ID=Q2QM92; Match level="QueryCoverage=96%, HitCoverage=96%, E-value=0.0, Identity=63%"; Hit description=Amino acid permease family protein
  Pfam annotation: Domain name=AA_permease; Domain location=79-513; Score=40.9; E_value=4.4e-09; Accession=PF00324.11; Description=Amino acid permease
  Pfam annotation: Domain name=Aa_trans; Domain location=73-481; Score=- 135.3; E_value=0.01; Accession=PF01490.8; Description=Transmembrane amino acid transporter protein
  Pfam annotation: Domain name=DctM; Domain location=93-481; Score= -244.0; E_value=0.075; Accession=PF06808.2; Description=DctM-like transporters
  Pfam module annotation: Pfam domain module=AA_permease::Aa _trans::DctM; Domain location=79-513::73-481::93-481
MGRDGEIDGGVRRRGCTFRRNDFFPEESFKSWGNYARAVLETPWRLKDRVVTRSEDQTELVEMKARSNHEMKKTLNWWDLMWFGIGAVIGSGIFVLTGLEARTAVGPAVVLSYVVSGVSALFSVFCYTEFAVEIPVAGGSFAYLRVELGDFVAYIAAGNILLEYVIGGAAVARSWTSYFATLCGKHPDDFRIIAHNMNPNYGHLDPIAIGVLIAITILAVYSTKGSSIFNFIATIFHLIVIVFIIIAGLTKANTENYANFTPFGVRGVFKASAVLFFAYVGFDAVSTMAEETKNPARDIPIGLVGSMVITTLAYCLLAVTLCLMQNYTDIDKDAPYSVAFSAVGMDWAKYIVAFGALKGMTTVLLVSAVGQARYLTHIARTHMMPPWFAHVDERTGTPMNATISMLAATAVIAFFTDLGILSNLLSISTLFIFMLVALALLVRRYYSSGLTTKENQVKLIVCLMLILGSSCAISAYWASSDGWVGYAVSVPLWILGTGGLWLFVPQAKQPKLWGVPLVPWLPSLSIAINIFLLGSIDKDSFIRFGVWTGFLLVYYVLLGLHASYDTAKVFESKKSSVDVDKQWNKVEEGAKGEVSLTAVSND

SEQ ID NO: 159159 - protein, 76 aa, Glycine max
  Coding DNA Sequence Number=SeqID_42381
  Homolog annotation: Hit_ID=Q69KM5; Match level="QueryCoverage=49%, HitCoverage=8%, E-value=2e-07, Identity=71%"; Hit description =Putative uridine diphosphate galacturonate 4-epimerase
MELERAQTTNGLGVLGGKVHNVGEGDDIEELAKESRVVKVEVHGEDADTIEENAPTTWDQHGLKGALKPSIFTPKA

SEQ ID NO: 159160 - protein, 56 aa, Glycine max
  Coding DNA Sequence Number=SeqID_42382
MDIQAQPKVSAQEGTQKTLTEHRTQTNNVQIRTKPMIRVRRHDQSKKEEVQQAQGN

SEQ ID NO: 159161 - protein, 131 aa, Glycine max
  Coding DNA Sequence Number=SeqID_42383
MDNEGDEVNSVGQSSSLDTVEVEGYQVRPDWSPSLEEILEARQILNQSSMLKEKKHISKKIIETVKRELEECVEEKNAVAAKFQILCDKETACKESLARAEDEYAKISQTFTDATSKVRQFANCSLANGLL

SEQ ID NO: 159162 - protein, 103 aa, Glycine max
  Coding DNA Sequence Number=SeqID_42384
  Gene Ontology: Mol. function=RNA-directed DNA polymerase activity; Biological process=RNA-dependent DNA replication
  Homolog annotation: Hit_ID=Q1S4N5; Match level="QueryCoverage=70%, HitCoverage=14%, E-value=2e-16, Identity=56%"; Hit description =Peptidase M, neutral zinc metallopeptidases, zinc-binding site
MWMSSVDQHLRNNFEKDITYTDGSKVPNGCKRINLRDKSLHKRNVNLTRPKSRGHQIQNILNNYIPISFKENWLALSVTNHIIILRMRDPGCLKVERFDFFTS

SEQ ID NO: 159163 - protein, 170 aa, Glycine max
  Coding DNA Sequence Number=SeqID_42385
MGTKHLTRTKERSHVIKQRSPDEIREHLTRTWKRGFDILDIGNNFYMAKFDLEADRTKVIQEGSQLEWILTPQMQGRVPLLEECPSNIKVVAQGNATTNNTLLTEEEPAVAPVTENEIINQKSVTNVNIMGNHGKNIEEIKANEETNQLHGDWLVVKRKSSNKSTKNHGK

SEQ ID NO: 159164 - protein, 423 aa, Glycine max
  Coding DNA Sequence Number=SeqID_42386
  Gene Ontology: Mol. function=tetraacyldisaccharide 4'-kinase activity; Biological process=lipid A biosynthetic process
  Homolog annotation: Hit_ID=Q6D438; Match level="QueryCoverage=60%, HitCoverage=79%, E-value=1e-91, Identity=67%"; Hit description =Tetraacyldisaccharide 4'-kinase
  Pfam annotation: Domain name=ABC_tran; Domain location=2-168; Score =114.2; E_value=3.8e-31; Accession=PF00005.17; Description=ABC transporter
  Pfam annotation: Domain name=LpxK; Domain location=178-409; Score =163.5; E_value=5.3e-46; Accession=PF02606.5; Description =Tetraacyldisaccharide-1-P 4'-kinase
  Pfam module annotation: Pfam domain module=ABC_tran::LpxK; Domain location=2-168::178-409
MASLLTRFYDINEGEILLDGHDLREYTLRSLRNQVALVSQNVHLFNDTIANNIAYARNGEYTREQIEQAATMAHAMDFINKMDNGLDTVIGENGVLLSGGQRQRIAIARALLRDCPILILDEATSALDTESERAIQSALDELQKNRTSLVIAHQGRLCAAAQTAVRSMIERIWSGRSPLWLLLWPLSLLYGAITWLIRLSYQRGWRIRWRAPCPVIVVGNLTAGGNGKTPLVIWLVQALQQQGLRPGVVSRGYGGKAERYPLLVNQDSATEQAGDEPVLIAQRTQVPVAVAPQRRLAIKALLAAHPLDVIVTDDGLQHYALERDREIVVVDGVRRFGNGWWLPAGPMRERASRLEQRAGWRDRHDAAAGSGGQSADRRTGCADAAAANCRDGRHRSSAAFLHYAAAAGRAAGGRDRLCRSPRL

SEQ ID NO: 159165 - protein, 94 aa, Glycine max
  Coding DNA Sequence Number=SeqID_42387
  Homolog annotation: Hit_ID=Q8W194; Match level="QueryCoverage=98%, HitCoverage=44%, E-value=1e-26, Identity=61%"; Hit description=Zinc finger protein LSD2
  Pfam annotation: Domain name=zf-LSD1; Domain location=65-89; Score =57.3; E_value=5.2e-14; Accession=PF06943.3; Description=LSD1 zinc finger
  Pfam annotation: Domain name=zf-LSD1; Domain location=7-31; Score =43.3; E_value=8e-10; Accession=PF06943.3; Description=LSD1 zinc finger
  Pfam module annotation: Pfam domain module=zf-LSD1::zf-LSD1; Domain location=65-89::7-31
MQSQVVCNGCRSLLLYPRGATNVCCALCNTITSVPPPVRLHFDVYSEDLCHNNGPAGMEMSQLYCGGCRTLLMYTRGATSVRCSCCHTVNLVPP

SEQ ID NO: 159166 - protein, 194 aa, Glycine max
  Coding DNA Sequence Number=SeqID_42388
  Gene Ontology: Biological process=response to brassinosteroid stimulus
  Homolog annotation: Hit_ID=Q9FI10; Match level="QueryCoverage=85%, HitCoverage=84%, E-value=3e-44, Identity=48%"; Hit description =Arabidopsis thaliana genomic DNA, chromosome 5, P1 clone:MFC16
  Pfam annotation: Domain name=DUF588; Domain location=20-176; Score =143.4; E_value=6.3e-40; Accession=PF04535.3; Description=Domain of unknown function (DUF588)
  Subcellular localization annotation: CTP_CleavageSite=56; ConfidenceScore=5.22e-01
MASENGDKLELAFSVVPDPKPKKDWVNLSLRVVAFLATASATLVMAFNKQTKSMVVATIGTNPVTITLTAMFQHTPAFTFFVIVNAIASFYNMVVIGVEILGPQYDYKELRLGLIAILDVMTMALAATGDGAATFMAELGRNGNSHARWDKICDKFEAYCNRGGVALIASFVGLILLLVVTVMSITKMLKLNRI

SEQ ID NO: 159167 - protein, 401 aa, Glycine max
  Coding DNA Sequence Number=SeqID_42389
  Gene Ontology: Mol. function=DNA binding; Cellular component=nucleus; Biological process=regulation of transcription
  Homolog annotation: Hit_ID=Q2L3A9; Match level="QueryCoverage=80%, HitCoverage=55%, E-value=1e-106, Identity=57%"; Hit description =Jumonji family protein
  Pfam annotation: Domain name=JmjC; Domain location=312-399; Score =74.5; E_value=3.4e-19; Accession=PF02373.13; Description=JmjC domain
  Pfam annotation: Domain name=JmjN; Domain location=72-116; Score =84.3; E_value=3.8e-22; Accession=PF02375.7; Description=jmjN domain
  Pfam module annotation: Pfam domain module=JmjC::JmjN; Domain location=312-399::72-116
MWMVFICYMTSFVFWGLERLEISHPGGGLDNPLRHKPEMENTLESPGSSRHRKISARWDPVDACRPIVDEAPVFYPTIEEFEDTLGYIAKIRPQAELYGICRIVPPACWVPPCPLKEKDLWENAKFPTRIQQIDLLQNREPMRKKIRGRKRKHRKQSKMGMGRRTAKSGSEANVASEPEEKFGFQSGSDFTLKDFQQYASVFKDCYFGLNDANEHEKVSDNSHQQRWKPSVEEIEGEYWRIIEQPTDEVEVYYGADLETGSLGSGFPKISSLTKNESDRYTLSGWNLNNFPRLSGSALCFEGSDISGVVVPWLYVGMCFSSFCWHVEDHHLYSLNYLHWGDPKVWYGIPGSHAPGLEDAMRKHLPDLFEEQPNLLNELVYYSQLYFPPKFQFFGCFHSVSI

SEQ ID NO: 159168 - protein, 67 aa, Glycine max
  Coding DNA Sequence Number=SeqID_42390
  Subcellular localization annotation: CTP_CleavageSite=58; ConfidenceScore=5.35e-01
MSLPSAVHVSPLSSAKLLVTGKHVILLFSRSVPSPKEKRRSRDESRHHGKGRTDEISVLSLLSSYLR

SEQ ID NO: 159169 - protein, 97 aa, Glycine max
  Coding DNA Sequence Number=SeqID_42391
  Homolog annotation: Hit_ID=Q1T254; Match level="QueryCoverage=55%, HitCoverage=13%, E-value=2e-12, Identity=64%"; Hit description =Peptidase aspartic, catalytic
MEEHKQQLAPKPALEPVSDFVELEEINEETEDDKEEETPIKEIVVEGNCSVVIQHIPPPKHKDPRVVTIPCSIGEVAVGKALIDLGASINLMPLSMC

SEQ ID NO: 159170 - protein, 245 aa, Glycine max
  Coding DNA Sequence Number=SeqID_42392
  Homolog annotation: Hit_ID=UPI000038CAEF; Match level="QueryCoverage =86%, HitCoverage=24%, E-value=4e-07, Identity=26%"; Hit description =COG2319: FOG: WD40 repeat
  Subcellular localization annotation: CTP_CleavageSite=82; ConfidenceScore=5.18e-01
MNCVFVHVSSTHELGARCSDSLVQFSILNLFRSPMHCVFVHVSSTFKFGAMRSDCLVQFSIVNLFRSPMNCVFVHVSSTHAFAAMRSDCLVQFFIVNLFRNPMNCVFVHVSSTFEFGAMRSDCLVQFCIVNLFRSPMNCVFVHVSSTHAFAAMRTDCLVQFSILNLFRSPMNCVFVHVSSTHELGARCSDSLVQFSILNLFRSPMHCVFVHVSSTFKFGAMRSDCLVQFSIVNLFRSPMNCVFVH

SEQ ID NO: 159171 - protein, 39 aa, Glycine max
  Coding DNA Sequence Number=SeqID_42393
KSGAAAIPVGDFRSLDVADGIVVVDHTVELSVSGLAMVS

SEQ ID NO: 159172 - protein, 133 aa, Glycine max
  Coding DNA Sequence Number=SeqID_42394
MNSWGSSLDGGGCMNDNQFMGLGIRFEVGGWMNSARQSIYGALDSMAINSWGSRLDGGGCMNDYQFMGLRERFKVEDRRTTLGNEFVGSSLDGGGCMNYNHFVGLEIRFEVGGWMNSARQSIYGAPDSMVEDA

SEQ ID NO: 159173 - protein, 611 aa, Glycine max
  Coding DNA Sequence Number=SeqID_42395
  Gene Ontology: Mol. function=DNA binding; Cellular component=nucleus; Biological process=regulation of transcription
  Homolog annotation: Hit_ID=UPI00000529F6; Match level="QueryCoverage =83%, HitCoverage=51%, E-value=1e-35, Identity=41%"; Hit description =transcription factor
  Pfam annotation: Domain name=FYRC; Domain location=419-514; Score =88.0; E_value=2.8e-23; Accession=PF05965.4; Description=FY rich C -terminus
  Pfam annotation: Domain name=FYRN; Domain location=367-415; Score =56.3; E_value=1e-13; Accession=PF05964.4; Description=FY-rich N -terminus
  Pfam annotation: Domain name=zf-C5HC2; Domain location=71-123; Score =30.6; E_value=5.4e-06; Accession=PF02928.6; Description=C5HC2 zinc finger
  Pfam module annotation: Pfam domain module=FYRC::FYRN::zf-C5HC2; Domain location=419-514::367-415::71-123
MWLLLTGFCMARMLPSFTVRSAEAVHALADLTLHGKEDLKYIKWRSACGKDGVLTKAVKIRITMEKERLDCIPTHLKMLKMDSCKCSPDCYSCLKHSNLFCSCEMNNRFILFRYTMDELSTLVEALEGESHAIEVWANRNTVMVSADAEDACIYKQDVESAICQTQSYKEGKNSTYCAGTNDKSNSTIPSSSYSQISAELVHSEFHHETLSAPSDTKDCHKDSLNEKDLAMDNKIMVGTGGSVDLNIDVMSGEPENYFLHAADYHHNKGVPYVEKVCFAETRKEQDNMEPGADCIASLEKEFSSCSRDVQNSCTLDGYKLFGVDLQMHSDSGEQLNSVSKMGVVETSNTSISLTNQSSLMNNFGISVEPVNLGSVMCGKLWCSKHAIYPKGFKSRVKLFSILDPPRICNYVSEVYGAGFLGPIFKVTMEERPNEAFTNTSADKCWETVLDRLNHEIKRRRSRGEIELPPLELLQSINGHKMFGFLSPSIIQAVEAADPKHQCVEYWNHKEVVSESSGSAIDDCKFSHGSSNSLGDVKTKLFGAGLIKQEQDSIIGNCDSFEEMKLVLQGFLKKASPNELSAMHKLFSSDALFTQWRTAFVSLIEEIQKACA

SEQ ID NO: 159174 - protein, 87 aa, Glycine max
  Coding DNA Sequence Number=SeqID_42396
MAKEPDSSYYHFFFVSTNPVLLRWGRVAWEREGGADGRHGDLDLDGVEWVMRRNPKERLGWGGAGEKSEGKVCRDLGKRRISQGMVV

SEQ ID NO: 159175 - protein, 244 aa, Glycine max
  Coding DNA Sequence Number=SeqID_42397
MHCEAEAVEHTNKRDTGHQNVALDNKTGDSTMLKMGDSAKVVIKQDMKGRRHKYGFNNNERTKEFKIASNKRDLFFGFSEHQERLCKKFALEEGRIFAANEQHEDLSEIAHGGQYLSISVLQLWILHLTETCMRAGNSDIYGFLEPQSIQRSGQSQFESESYIKSWMQSSQRDVYLGAYLNGFHCSGHWQMVVILPKEHLVVWFCSLHNRPDNYLKGIVNSAIKGLDDAPHPKSMAPARWIVVK

SEQ ID NO: 159176 - protein, 944 aa, Glycine max
  Coding DNA Sequence Number=SeqID_42398
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=96%, HitCoverage=91%, E-value=1e-176, Identity=36%"; Hit description =Receptor protein kinase-like protein
  Pfam annotation: Domain name=LRR_1; Domain location=112-134; Score =5.5; E_value=27; Accession=PF00560.23; Description=Leucine Rich Repeat
  Pfam annotation: Domain name=LRR_1; Domain location=136-158; Score =8.2; E_value=8.5; Accession=PF00560.23; Description=Leucine Rich Repeat
  Pfam annotation: Domain name=LRR_1; Domain location=16-38; Score =13.0; E_value=1.1; Accession=PF00560.23; Description=Leucine Rich Repeat
  Pfam annotation: Domain name=LRR_1; Domain location=160-183; Score =1.4; E_value=1.6e+02; Accession=PF00560.23; Description=Leucine Rich Repeat
  Pfam annotation: Domain name=LRR_1; Domain location=185-207; Score =9.6; E_value=4.6; Accession=PF00560.23; Description=Leucine Rich Repeat
  Pfam annotation: Domain name=LRR_1; Domain location=209-231; Score =13.6; E_value=0.71; Accession=PF00560.23; Description=Leucine Rich Repeat
  Pfam annotation: Domain name=LRR_1; Domain location=263-285; Score =8.6; E_value=7; Accession=PF00560.23; Description=Leucine Rich Repeat
  Pfam annotation: Domain name=LRR_1; Domain location=288-310; Score =10.9; E_value=2.6; Accession=PF00560.23; Description=Leucine Rich Repeat
  Pfam annotation: Domain name=LRR_1; Domain location=312-334; Score =17.1; E_value=0.062; Accession=PF00560.23; Description=Leucine Rich Repeat
  Pfam annotation: Domain name=LRR_1; Domain location=336-358; Score =16.0; E_value=0.13; Accession=PF00560.23; Description=Leucine Rich Repeat
  Pfam annotation: Domain name=LRR_1; Domain location=360-382; Score =14.0; E_value=0.55; Accession=PF00560.23; Description=Leucine Rich Repeat
  Pfam annotation: Domain name=LRR_1; Domain location=384-406; Score =12.7; E_value=1.2; Accession=PF00560.23; Description=Leucine Rich Repeat
  Pfam annotation: Domain name=LRR_1; Domain location=40-62; Score =15.8; E_value=0.16; Accession=PF00560.23; Description=Leucine Rich Repeat
  Pfam annotation: Domain name=LRR_1; Domain location=432-454; Score =9.0; E_value=5.9; Accession=PF00560.23; Description=Leucine Rich Repeat
  Pfam annotation: Domain name=LRR_1; Domain location=456-478; Score =14.5; E_value=0.4; Accession=PF00560.23; Description=Leucine Rich Repeat
  Pfam annotation: Domain name=LRR_1; Domain location=480-502; Score =17.9; E_value=0.036; Accession=PF00560.23; Description=Leucine Rich Repeat
  Pfam annotation: Domain name=LRR_1; Domain location=504-527; Score =11.3; E_value=2.2; Accession=PF00560.23; Description=Leucine Rich Repeat
  Pfam annotation: Domain name=LRR_1; Domain location=64-86; Score =14.7; E_value=0.34; Accession=PF00560.23; Description=Leucine Rich Repeat
  Pfam annotation: Domain name=LRR_1; Domain location=88-110; Score =9.4; E_value=5; Accession=PF00560.23; Description=Leucine Rich Repeat
  Pfam annotation: Domain name=Pkinase; Domain location=613-905; Score =156.3; E_value=8.1e-44; Accession=PF00069.15; Description=Protein kinase domain
  Pfam annotation: Domain name=Pkinase_Tyr; Domain location=613-905; Score=91.9; E_value=1.9e-24; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::Pkinase::Pkinase_Tyr; Domain location=...
  Pfam module annotation: Domain location=112-134::136-158::16-38::160 -183::185-207::209-231::263-285::288-310::312-334::336-358::360 -382::384-406::40-62::432-454::456-478::480-502::504-527::64-86::88 -110::613-905::613-905
  Subcellular localization annotation: CTP_CleavageSite=47; ConfidenceScore=5.03e-01
FGLSGHLSPYVGNLSSLQSLQLQNNQFRGVIPDQIGNLLSLKVLNMSSNMLEGKLPSNITHLNELQVLDLSSNKIVSKIPEDISSLQKLQALKLGRNSLYGAIPASLGNISSLKNISFGTNFLTGWIPSELGRLHDLIELDLILNNLNGTVPPAIFNLSSLVNFALASNSFWGEIPQDVGHKLPKLIVFNICFNYFTGGIPGSLHNLTNIQVIRMASNHLEGTVPPGLGNLPFLKMYNIGYNRIVSSGVRGLDFITSLTNSTHLNFLAIDGNMLEGVIPETIGNLSKDLSTLYMGQNRFNGSIPSSIGRLSGLKLLNLSYNSISGEIPQELGQLEELQELSLAGNEISGGIPSILGNLLKLNLVDLSRNKLVGRIPTSFGNLQNLLYMDLSSNQLNGSIPMEILNLPTLSNVLNLSMNFLSGPIPEVGRLSGVASIDFSNNQLYDGIPSSFSNCLSLEKLSLARNQLSGPIPKALGDVRGLEALDLSSNQLSGAIPIELQNLQALKLLNLSYNDLEGAIPSGGVFQNFSAVNLEGNKNLCLNFPCVTHGQGRRNVRLYIIIAIVVALILCLTIGLLIYMKSKKVKVAAAASEQLKPHAPMISYDELRLATEEFSQENLLGVGSFGSVYKGHLSHGATVAVKVLDTLRTGSLKSFFAECEAMKNSRHRNLVKLITSCSSIDFKNNDFLALVYEYLCNGSLDDWIKGRRKHEKGNGLNLMERLNIALDVACALDYLHNDSEIPVVHCDLKPSNILLDEDMTAKVGDFGLARLLIQRSTSQVSISSTRVLRGSIGYIPPEYGWGEKPSAAGDVYSYGIVLLEMFCGKSPTDECFTGGLSIRRWVQSSLKNKTVQVIDPHLLSLIFYDDPSEGSNVQLSCVDAIVGVGISCTADNPDERIGIREAVRQLKAARDSLSNQSDESPTLTRKSQRELAPYDPLHFAAMFDK

SEQ ID NO: 159177 - protein, 309 aa, Glycine max
  Coding DNA Sequence Number=SeqID_42399
  Gene Ontology: Mol. function=aspartic-type endopeptidase activity; Biological process=proteolysis
  Homolog annotation: Hit_ID=Q8H6Q8; Match level="QueryCoverage=80%, HitCoverage=6%, E-value=3e-11, Identity=25%"; Hit description=CTV.20
MAIPFKTNDVSEEITSKDIKSLMEQANYTNKYLQALGETIKTKVVPKQKSIEETSPKIPIEKPLFKPFKVSEKAKRKIRELRKNKSLIEGVGDNHSELLNKIGSLLKVIPDTPQASENTSKMVTRSTSKLINVINEDSDQNSDNTTEIGSVSEKNINPINSKHWKTPSKLYYQRPTAPDLLLEERGENNFKSFSANNIYEWNIDAQTEYNIMNTLQHMTMVATAYQTSHECSEETIIDILVAGFSGQLKGWWDNYLTNEEKSKIYSAVKTDLNGKVITNDDDKEIPDAVNTLIFTIAQHFIGDPSLWKD

SEQ ID NO: 159178 - protein, 308 aa, Glycine max
  Coding DNA Sequence Number=SeqID_42400
  Gene Ontology: Mol. function=oxidoreductase activity; Cellular component=membrane; Biological process=electron transport
  Homolog annotation: Hit_ID=Q2MJ20; Match level="QueryCoverage=48%, HitCoverage=33%, E-value=6e-37, Identity=46%"; Hit description =Cytochrome P450 monooxygenase CYP716A12
  Pfam annotation: Domain name=p450; Domain location=1-295; Score= -167.6; E_value=0.0024; Accession=PF00067.12; Description=Cytochrome P450
MKTQRRFFNIPDQTHSPMPKPTQEAAPSAAPVKTLGILKPEGISRYIGNKIEPTMHQHFTTHWEGKKEVKALMNQNARKFEDLYFGIHSVPVNFTGFIYHRALKAAAAIRKKIQFLMPRLEISNIIMGLMNFSHMPIAITQAFMIKHIGQRPAIYQKILSEYADIKKSKGSNAALDWDSRQKLKYTWVVAQETMRLYPTAPGALREAITDITYEGFTIPKGWENPKYFDEPESFDPSRFEGNVPVPYTWIPFGAGPRTWPGKDYARNVQLTKRTERSTHHHLLILLRHNNYYTTPLTRKEFKDEKPYK

SEQ ID NO: 159179 - protein, 476 aa, Glycine max
  Coding DNA Sequence Number=SeqID_42401
  Gene Ontology: Mol. function=ATP binding; Cellular component =cytoskeleton; Biological process=transport
  Homolog annotation: Hit_ID=Q94IP9; Match level="QueryCoverage=99%, HitCoverage=83%, E-value=0.0, Identity=75%"; Hit description=WD-40 repeat protein
  Pfam annotation: Domain name=WD40; Domain location=120-158; Score =28.5; E_value=2.3e-05; Accession=PF00400.22; Description=WD domain, G-beta repeat
  Pfam annotation: Domain name=WD40; Domain location=259-298; Score =30.4; E_value=6.5e-06; Accession=PF00400.22; Description=WD domain, G-beta repeat
  Pfam annotation: Domain name=WD40; Domain location=302-340; Score =46.1; E_value=1.2e-10; Accession=PF00400.22; Description=WD domain, G-beta repeat
  Pfam annotation: Domain name=WD40; Domain location=350-433; Score =4.6; E_value=11; Accession=PF00400.22; Description=WD domain, G-beta repeat
  Pfam annotation: Domain name=WD40; Domain location=437-475; Score =27.2; E_value=6e-05; Accession=PF00400.22; Description=WD domain, G -beta repeat
  Pfam module annotation: Pfam domain module=WD40::WD40::WD40::WD40::WD4 0; Domain location=120-158::259-298::302-340::350-433::437-475
MIELRELDTARAILRQTQVMGVMKQEQPERYLRLEHLLVRTYFDPNEAYQDSTKEKRRAQIAQALAAEVTVVPPSRLMALIGQALKWQQHQGLLPPGTQFDLFRGTAAMKQDVDDMYPTTLSHTIKFGTKSHAECACFSPDGQFLVSCSVDGFIEVWDYISGKLKKDLQYQADTLAEIQKCLHLGLKMERLKILGLESLHLYRKASHPHPVFAPPYSSLIFSGYQVLPNNLSVFWPLAKPVLFFGGQSFCTQVWRIRTGQCLRRLERAHSQGVTSVSFSRDGSQLLSTSFDSTARIHGLKSGKMLKEFRGHTSYVNDAIFTNDGSRVITASSDCTIKVWDVKTTDCIQTFKPPPPLRGGDASVNSVHIFPKNTDHIVVCNKTSSIYIMTLQGQVVKSFSSGKREGGDFVAACVSPKGEWIYCVGEDRNIYCFSYLSGKLEHLMKVHEKEVIGVTHHPHRNLVATFSEDCTMKLWKP

SEQ ID NO: 159180 - protein, 189 aa, Glycine max
  Coding DNA Sequence Number=SeqID_42402
  Homolog annotation: Hit_ID=Q10NR2; Match level="QueryCoverage=77%, HitCoverage=87%, E-value=4e-34, Identity=46%"; Hit description =Expressed protein
  Pfam annotation: Domain name=Mago-bind; Domain location=38-64; Score =51.9; E_value=2.2e-12; Accession=PF09282.1; Description=Mago binding
GSLTAKVSDTETQHSIRKMSDDERKKQIAELSKSLKEGERLVGPTRRPDGTLRKPIRIRAGYTPQDEVAIYQPKGALLKKEMGSAGPPGYEPDADSKPKTKSVKRNERKKEKRIQAALEKEKNVSEVEDSGKQESLEALTSQIRLTEALEQKSAEQDLKPEQLEKLAKLEDWRRELKLLEDEKGETTVS

SEQ ID NO: 159181 - protein, 293 aa, Glycine max
  Coding DNA Sequence Number=SeqID_42403
  Gene Ontology: Mol. function=RNA-directed DNA polymerase activity; Cellular component=exocyst; Biological process=exocytosis
  Homolog annotation: Hit_ID=Q1S1D5; Match level="QueryCoverage=99%, HitCoverage=49%, E-value=6e-84, Identity=55%"; Hit description=Exo70 exocyst complex subunit
  Pfam annotation: Domain name=Exo70; Domain location=24-293; Score= -201.2; E_value=0.0015; Accession=PF03081.6; Description=Exo70 exocyst complex subunit
  Subcellular localization annotation: CTP_CleavageSite=13; ConfidenceScore=5.27e-01
MPKMGLKNLFFFKASPSPPSSPPTRTFSDSLMDQNIETARAIISKWELISPSDQTAPLFSNTRQEAKQYLNAVMSLQSTMQHLVALDSSSDTLVQAHFLMQLAMKRLQAEFYRILAQNRDNLHPESVASTDHRSSSVSDDGSDFSDDEFRFAGDSVSTVAMADLKAIAECMVSAGYSEECVKIYILMRKSIVDESLYHFGVERLSSSQIQKMDWEALESKIKSWLNAVKIAVGSLFHGERTLCDYVFGSPERKTAESCFAAICSEGATSLFGFPEKVAKCSKKTPEKMFRTLD

SEQ ID NO: 159182 - protein, 289 aa, Glycine max
  Coding DNA Sequence Number=SeqID_42404
  Gene Ontology: Mol. function=protein binding; Cellular component =apoplast; Biological process=response to biotic stimulus
  Homolog annotation: Hit_ID=Q9CA24; Match level="QueryCoverage=82%, HitCoverage=67%, E-value=1e-74, Identity=53%"; Hit description =Thaumatin-like protein; 12104-13574
  Pfam annotation: Domain name=Thaumatin; Domain location=36-241; Score= 243.8; E_value=3.7e-70; Accession=PF00314.8; Description=Thaumatin family
MANPHIALLKLTSIFIVIFASAPELCGSNKTFTLVNYCKETIWPGITRSDNHSGDGFALKSGQTTVYTAPDGWSGRIWARTGCDFDNNGNGKCKTGGCGTSINCTGPGSPPATSADFTLGEPDFYDVSLVDGFNLPIVVKAINGTGNCSTVGCDGDLRQNCPSELASKDNDKVIACRSACDVFNTDDYCCRGTYGNPATCLASNYSKIFKQVCPAAYSFALDDPTSLITCSKADFVVIFCGSRNQTACSYQDKQVVCNRPNKAYKAIPQSWWVLMLLPLTYGFNLRITP

SEQ ID NO: 159183 - protein, 112 aa, Glycine max
  Coding DNA Sequence Number=SeqID_42405
  Gene Ontology: Mol. function=nutrient reservoir activity
  Homolog annotation: Hit_ID=Q9SIA7; Match level="QueryCoverage=98%, HitCoverage=76%, E-value=4e-18, Identity=73%"; Hit description =Legumin-like protein
MASAVLFERNSCSTSGSTLKAACRTEGDKAFHTEELPAKWLSRLSPKPYGEDSIGTSQKKVSEFTCLVSLGSVPKEQNNQLSFFLVVPPRHTTPKGSAKASITLLDCNNLLF

SEQ ID NO: 159184 - protein, 248 aa, Glycine max
  Coding DNA Sequence Number=SeqID_42406
  Homolog annotation: Hit_ID=Q67UA7; Match level="QueryCoverage=99%, HitCoverage=57%, E-value=6e-49, Identity=42%"; Hit description=F-box protein-like
MDSLPDAILQCILSRITNARDVSSCNCVSKRWKDSTPYVRTLYFPRSSFDTPSSSSEGADNIIKRMVSRVVKLEELIVYNPFSSNGLASWLSLAGQTLLQLELRMENLADNQGFHESPSKLDYIGAAKNLESLKLWGVLMVRSPKWDVFPNLRNLEIIGARLEDPVLSVVLCSCPVLTSLLLLGCEGVRSLSIELPCLEQCKLDFYGRGDCSLTLTSPNIESLEVQGCSWIRVSETKHLRKLFISHSA

SEQ ID NO: 159185 - protein, 271 aa, Glycine max
  Coding DNA Sequence Number=SeqID_42407
  Homolog annotation: Hit_ID=Q3J9Y5; Match level="QueryCoverage=70%, HitCoverage=45%, E-value=2e-24, Identity=37%"; Hit description =Hypothetical protein precursor
MALSLSAHALDYQETILGKTTTINAANYGELSEAIKEANKNGGVIVLAPDVPRGEMPVKPNDNTRIVDQRYNGGIDIVRGNHPRLEGQWPQYSNLGVGLGKNFVISDVVPYDAKVESWKGEPMNPNADNPNRHQDSHEYSNSHNHYQNFLSEVWTFSPTVNGVSIWGDSGAFYPGAKTWGGFLSARSWPVHWEKYVPDGTPSFEDKDFDAQLVGLEIDVLNGGLPNGQVSEKIGRPLSKSGLQIVGFGNTNTAAIELRSEDSDDMSKKPGE

SEQ ID NO: 159186 - protein, 165 aa, Glycine max
  Coding DNA Sequence Number=SeqID_42408
MPPTMHPLNLDTSNRALGFPVLITGLCQSFGVPVTPSKVIRPPITRAFIEKYCTPRQAQGDAPQAADAAPPPHQADPAGSFGTERYLQHLVRQQAANHRGQVQIHECLYQLSLNQQSQGFTPFACPTLDQFRAEVAWSGDWPEAQAGRRMQRLPAMQRRPAWMRR

SEQ ID NO: 159187 - protein, 189 aa, Glycine max
  Coding DNA Sequence Number=SeqID_42409
  Gene Ontology: Mol. function=transporter activity; Cellular component= membrane; Biological process=transport
  Homolog annotation: Hit_ID=Q7VW01; Match level="QueryCoverage=100%, HitCoverage=34%, E-value=3e-55, Identity=71%"; Hit description =Putative membrane transport protein
PRDHIGQPADLGHRQQHHVRAHADFAELDTPSRLMSVTSSSANAGAMKYSNRMNSSDQHTERRASSTDEVAQHQRQEIDAHVAALVRIAGRERFRMRGRRRGPGLESGLGLRPGDARLFHRRRKCRQLAFVRADLDHGRIAGVELGQATAQLVLFQRPGLGQVMDPLRHLVGALMPQAARLDFGGVVAQ

SEQ ID NO: 159188 - protein, 87 aa, Glycine max
  Coding DNA Sequence Number=SeqID_42410
MIDGGVDAKRVVAAEEVETAVSRLHYYGLINVLISCRNGLNSGYCLHREKEWCNISTASHVLKRIDQESGLLRILLINANREEWYNM

SEQ ID NO: 159189 - protein, 108 aa, Glycine max
  Coding DNA Sequence Number=SeqID_42411
MVRQKNVVDVDSCSVRDRRISSRLHGVKGKVDNRFMVVGCGYKVRITASIIVLDFMVMNCWGSEGGQGESKRVSLGMQGRETILERGVSEVKQETLTDSEGPAVESIT

SEQ ID NO: 159190 - protein, 84 aa, Glycine max
  Coding DNA Sequence Number=SeqID_42412
SVEADPIACADVKGSGVTGVGVVNNNGGGGGGSSQQDTLASDDDRIGDGERVEVCERREWNWRELIRKWSEEKVRVHGIGGVQK

SEQ ID NO: 159191 - protein, 101 aa, Glycine max
  Coding DNA Sequence Number=SeqID_42413
  Subcellular localization annotation: CTP_CleavageSite=59; ConfidenceScore=5.71e-01
MVPKSTLRLMRTLGPSVASLAQSTWSLLSNALVGLLKRTLWAQRASTVKRSFSALSVIRESRRAQGSRLSAKREISSLSKTLVSCQAQHTIGAKPKSTNSR

SEQ ID NO: 159192 - protein, 35 aa, Glycine max
  Coding DNA Sequence Number=SeqID_42414
MDDQECLWPGEVTSIALRRGVFLRVAGRAQGTASN

SEQ ID NO: 159193 - protein, 137 aa, Glycine max
  Coding DNA Sequence Number=SeqID_42415
  Gene Ontology: Cellular component=integral to membrane; Biological process=transport
  Homolog annotation: Hit_ID=Q8RWM6; Match level="QueryCoverage=78%, HitCoverage=38%, E-value=1e-25, Identity=57%"; Hit description =Transmembrane protein-like protein
  Pfam annotation: Domain name=EMP24_GP25L; Domain location=78-132; Score=29.6; E_value=1.1e-05; Accession=PF01105.14; Description =emp24gp25Lp24 family
MGNRAMLTLLLLLFFSTNLVPSALAIWLTLPTTGTKCVSDEIQHNVVVLADYVVIPSDHAHNLTIAVKGVTCAVVLCNSGWLLNDNLLISAVIEVTSPYGNNLHHKENTTHGSIAFTTQEAGNYLACFWVDSPSQEW

SEQ ID NO: 159194 - protein, 138 aa, Glycine max
  Coding DNA Sequence Number=SeqID_42416
  Subcellular localization annotation: CTP_CleavageSite=21; ConfidenceScore=5.05e-01
MGSVVENAASFVASKSCIEFEAAVNSGIASSNDCTASISFTTQGSTSKIPSSIVFTLTSAYSSSILLLPLRVYHSPISLPPRSQSSSIFSFRVATTLFDSSSTAVAIATFFGSSPSAVCSIGILNDFVSSPMKEREKE

SEQ ID NO: 159195 - protein, 184 aa, Glycine max
  Coding DNA Sequence Number=SeqID_42417
MDNSSTIEETEVNREFEEVLEAFNEMHEEAQRFVVLNIKMKSDLKLHITKLASTPSELDKLKQENEKLVSKYKATGCDCNSTSFNMDDYKSLQTEFENLKKDHYAECMKLQTELSYLKDLFGKLNKGKSDLNHMLSVQKHTKDKTGLGYNKQATFSKKTKFVSSKGVNPNKVSKKKNIVHSKRN

SEQ ID NO: 159196 - protein, 855 aa, Glycine max
  Coding DNA Sequence Number=SeqID_42418
  Gene Ontology: Mol. function=1-phosphatidylinositol-4-phosphate 5 -kinase activity; Cellular component=cellular_component; Biological process=phosphatidylinositol metabolic process
  Homolog annotation: Hit_ID=Q8RY89; Match level="QueryCoverage=98%, HitCoverage=98%, E-value=0.0, Identity=57%"; Hit description =Phosphatidylinositol-4-phosphate 5-kinase 8 (EC 2.7.1.68) (AtPIP5K8) ...
  Homolog annotation: Hit description=(1-phosphatidylinositol-4 -phosphate kinase 8) (PtdIns(4)P-5-kinase 8)
  Pfam annotation: Domain name=MORN; Domain location=110-132; Score =31.9; E_value=2.2e-06; Accession=PF02493.10; Description=MORN repeat
  Pfam annotation: Domain name=MORN; Domain location=133-155; Score =36.5; E_value=9e-08; Accession=PF02493.10; Description=MORN repeat
  Pfam annotation: Domain name=MORN; Domain location=156-178; Score =34.3; E_value=4.2e-07; Accession=PF02493.10; Description=MORN repeat
  Pfam annotation: Domain name=MORN; Domain location=179-200; Score =28.1; E_value=3.2e-05; Accession=PF02493.10; Description=MORN repeat
  Pfam annotation: Domain name=MORN; Domain location=18-40; Score=23.4; E_value=0.00083; Accession=PF02493.10; Description=MORN repeat
  Pfam annotation: Domain name=MORN; Domain location=41-63; Score=34.2; E_value=4.6e-07; Accession=PF02493.10; Description=MORN repeat
  Pfam annotation: Domain name=MORN; Domain location=64-86; Score=31.5; E_value=3e-06; Accession=PF02493.10; Description=MORN repeat
  Pfam annotation: Domain name=MORN; Domain location=87-109; Score =21.0; E_value=0.0043; Accession=PF02493.10; Description=MORN repeat
  Pfam annotation: Domain name=PIP5K; Domain location=431-848; Score =435.9; E_value=5.3e-128; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=110-132::133-155::156 -178::179-200::18-40::41-63::64-86::87-109::431-848
MEDSERFEEKSFSNGDVYIGKIKGMLPHGKGKYTWSDGAVYEGDWVNGKMTGKGLITWPTGAKYEGEFSGGYLHGHGTFTHSTGCIYTGGWRMDAHHGIGRKEYSNSDVYEGLWKEGIREGCGRYSWENGNTYIGNWKSGKIDGRGVMKWANGDIFDGCWLNGLKHGSGVYRFADGGLYIGTWSKGLKDGKGTFYPAGSKQPSLKKLCSLNSDDSRLLLNMEKHTAPKQKFTRSFSEKISVSGRSKSSRQISHRTSSLDANCILQDPAGGCICRDSSPTLSQTFNESQSEATSVNSLVYEREYMQGVLIMERIRNYSEMPHKNKRQNKYSVKQVKKGSWIDIFGGSRSYYLKLNLQLGIRYTVGKITPVPAREVRSSDFGDRARIRMYFPKEGSQLTPPHCSIDFYWKDYCPMVFRNLREMFKLDAAEYMMSICGDSGLRDISSPGKSGSIFFLSQDDRFVIKTLKKYELKSIFDNPSTLVGLASASNLTLIPCQKMDYESNSTLQIRLVMLNMLPKYYHHVGSYENTLITKFFGLHRITLRGGKKVRFVVMGNMFCTELHIHRRYDLKGSTQGRYTKEDKINSNTTLKDLDLKYEFHMDKKLRESLFKQISLDCMFLESQHIIDYSLLLGLHFRAPENLKALVEPPRLMQLPHSLPSEDGIFKFVFQLSSSLQTDSILSIFLHLCLSFFLLIEHFSTCFALLDAHKQGEQLIIPKGLLLVAHEPSFVNTAPGPHIRGNTLRAYSIGDKQVDLLLPGTARLRVQLGVNMPAQATRKLQGDKVEESEVELFEVYDVVLYMGIIDILQEYTVKKKLEHACKSLQYDPMTISVVEPKTYAERFINFMEKKVFPEPETS

SEQ ID NO: 159197 - protein, 650 aa, Glycine max
  Coding DNA Sequence Number=SeqID_42419
  Gene Ontology: Mol. function=protein serine/threonine kinase activity; Cellular component=cell surface; Biological process =protein amino acid phosphorylation
  Homolog annotation: Hit_ID=O04086; Match level="QueryCoverage=84%, HitCoverage=91%, E-value=1e-172, Identity=54%"; Hit description =Ser/Thr protein kinase isolog; 46094-44217
  Pfam annotation: Domain name=Pkinase; Domain location=286-574; Score =143.7; E_value=4.9e-40; Accession=PF00069.15; Description=Protein kinase domain
  Pfam annotation: Domain name=Pkinase_Tyr; Domain location=286-574; Score=81.8; E_value=2.1e-21; Accession=PF07714.7; Description =Protein tyrosine kinase
  Pfam module annotation: Pfam domain module=Pkinase::Pkinase_Tyr; Domain location=286-574::286-574
  Subcellular localization annotation: CTP_CleavageSite=19; ConfidenceScore=5.65e-01
MESIFVILLIFMVASNPCSAAPSPSPSASPTISTTNSSTCPVSMNYVQTVPWNSSSCQNFQPLASQYQTKTSPCCQTLLSLFGIALSQNLKKSSLFQLPNLPTSSSCLQHFQSNLTSLSLPNNLVSSCFDPSQFVISPNICAGIQNIEDWHTRLGPTPELNTACGPDLTDPNQCRTCVAEGDKVQQRLLSIDGNDSHSLDCFYFATLYLAGVVNELGPESKGVMSCILILLLNSQVDSRDGHYALVLGLILASLAFLEQSFSLRLRPNAVLTWFEFEDLMRATDNFSPQNFIGRGGFGLVYKGILPDGSMVAVKRLEESDSQGDALFCSEVEIVSNLKHRNLVPLKGCCVVDEGNENHNFEYRRRYLVHEYMPNGSLEDHLFPTKLDNQNTKKSLTWSQRKSIILDVANALVYLHFGVQPAVFHRDIKATNILLDADMRARVGDFGLARQSSESRSQLNTRVAGTRGYVAPEYALYGQLTEKSDVYSFGVVILEIMCGRKALELSPSGTPIFLITDCVWSLMKSGNIGEALDASMLGDENCARNIMERFLLVGILCSHVTVASRPTILNALKMLEGDIEVPPIPDRPLSHGNYVLYSGDCSGMSSGCGFGEAGGCEVQDTKSHALWDKSAPLVGRSCLWDMYDRYLPGGD

SEQ ID NO: 159198 - protein, 83 aa, Glycine max
  Coding DNA Sequence Number=SeqID_42420
  Gene Ontology: Mol. function=chromatin binding; Cellular component =chromatin; Biological process=chromatin assembly or disassembly
  Homolog annotation: Hit_ID=Q1SAV4; Match level="QueryCoverage=59%, HitCoverage=13%, E-value=9e-09, Identity=54%"; Hit description =Integrase, catalytic region
MVEMDSAIEIGRQAEDKVAKSASRPLEVVLELAKSPCPQDDKLTSIVSNLSKKFLVAKDLPIGPTPEVWSSCLGGTQKSLREQ

SEQ ID NO: 159199 - protein, 584 aa, Glycine max
  Coding DNA Sequence Number=SeqID_42421
  Homolog annotation: Hit_ID=Q9FFU7; Match level="QueryCoverage=61%, HitCoverage=75%, E-value=5e-37, Identity=32%"; Hit description =Similarity to heat shock transcription factor HSF30
  Pfam annotation: Domain name=F-box; Domain location=6-53; Score=24.5; E_value=0.00038; Accession=PF00646.23; Description=F-box domain
  Pfam annotation: Domain name=FBD; Domain location=495-547; Score =17.2; E_value=0.0038; Accession=PF08387.1; Description=FBD
  Pfam module annotation: Pfam domain module=F-box::FBD; Domain location=6-53::495-547
MENNTDKLSSLPELLCLFIISLLPFKDAVRTCILSKYWLHIWKNSPKIEFSENFDGNFIGRFEPFSSIKARRSVFMKFLKLWLDFRKEGDVEKFSLKFSKPKNDHREIIEGCIAFVTQHGVKELELDFSDPFWEEEVIPNKREALFELPKLAYENKPNIESLKLSSCSFRENDLSNWQALKEVTFGWMEVTLDAMTIVLSNCKMIESLVLNKCWNLSHFEIGSEALSLKRLVVDKCSFRNALFKVSAPNLCFFKYFGKLCFFEMKNTLAIEEAHLHFYLGYDNVGTGARVLYDLVKDLYNARVLTVCPYLIQVICTGEKIRMERDMNARHLILRMNMLRCELRAVSFFLLSCPMLECLTFELGSEIILPVKKREVGEGEGERKVQKKGEKERRALKCQCKRIYGEIVEVDYQAMWIDSDEEQDDLPLWIDSDEDQDDQAMWMDNISQSTLCFIQSKVYADHDFENYDDDDEYNIDDEDNIYDDYCTDFINMVDNQIKGMKNVINYNCLESSLKLVEVKDFVGSKNGLVFLGYLIRYGKVLKNVSINVLKTELEGSSNVAFYSAIEEYLMTTPRASSNLQISMCY

SEQ ID NO: 159200 - protein, 496 aa, Glycine max
  Coding DNA Sequence Number=SeqID_42422
  Gene Ontology: Mol. function=ATP-dependent helicase activity
  Homolog annotation: Hit_ID=Q1S5T4; Match level="QueryCoverage=70%, HitCoverage=45%, E-value=1e-110, Identity=64%"; Hit description =Helicase, C-terminal
  Pfam annotation: Domain name=Helicase_C; Domain location=158-234; Score=119.7; E_value=8e-33; Accession=PF00271.21; Description =Helicase conserved C-terminal domain
MAAPWRFFEKTPPNSGGVAGLGWRRHGGRHSHGGRGSYGGVAENGVPPAPHTRTQPRHPQPHAHAAATTSGSDAPAQTAATSSGSDASVTNGGLQRGVLAEKTKLLSRRRRRRRVVRIRRMREVNQEAVLLAMCSKTFTSKVIIFSGTKQAAHRLKIIFGLAGLKAAELHGNLTQAQRLEALEQFRKQQVDFLVATDVAARGLDIIGVQTVINFACPRDLTSYVHRVGRTARAGREGYAVTFVTDNDRSLLKAIAKRAGSKLKSRIVAEQSIHKWSHIIEQMEDQISEVLHEEREERVLRKAEMEATKAENMIAHREEIFSRPKRTWFVTEKEKKLAAKASKASMDKCKSSGKEVISAEQAEDLRMKEKRKREREKHLPRKKRRKLEAAREMLEEEEDDKQVETKGRNKKEKGGMSLVDLAYRRAKAVKAVKKALDSGKIVEKNKKKSNNNSRKTPSRTEEMRELFQTDMKDKKSKRRGVGGGKKSKSSFKSKSRY

SEQ ID NO: 159201 - protein, 272 aa, Glycine max
  Coding DNA Sequence Number=SeqID_42423
MALLARLRVLVQQILLDVVSLFNMVSSLSISKQSIKITHNGIEVFRDFYPVSDDFVTLECVWKSDKFILLERKHKTNDESHVEDSGGNVSVQTSDVNYNSIESFLGDDQLFHERVEADVVAKEDPNHIDDMNTDLLTGSSQIDDKETRYSDQDTTKAFINESSQEAGLPASSRSSTNDKLQSCPKKVPFLWNFFVFDLYEEMIHSELDSENIDFTVIDDVGSESLGPGIRRELSFSRWCDDDGRIHLDQQLGNEDVSVEDDSDFELPFPEKT

SEQ ID NO: 159202 - protein, 319 aa, Glycine max
  Coding DNA Sequence Number=SeqID_42424
  Gene Ontology: Cellular component=integral to membrane
  Pfam annotation: Domain name=DUF793; Domain location=3-316; Score= -229.3; E_value=0.039; Accession=PF05633.2; Description=Protein of unknown function (DUF793)
  Subcellular localization annotation: CTP_CleavageSite=63; ConfidenceScore=5.15e-01
MMSSSSCTNSSVNGFYNFLTQGLNELHQSFLSHDFMSIQFISEVFSSLQSFHSQLTILVQRLCLSVGGKWLNEYMDESSRLWDICHVLKSAISGIENYSSTGSNIASSVDGYHNLTPELSHQVIRAINICQRESLGLVEENKSLMETRTQALSQCLNQNMCMESKLNEFNGFRGVLCAMRSVSSLLLMILLCGVAYCWSSSCFDQQGYEGHMVFGSGFVVSMARLQQKVAQEIDQNNGQQGILLLEFQQAKISMEELKVELERMVGYDAQHEIQAKVDNLKRCFGLLRCGVETITGQLDDFFDEIVEGRKKLLNMCSHK

SEQ ID NO: 159203 - protein, 94 aa, Glycine max
  Coding DNA Sequence Number=SeqID_42425
  Gene Ontology: Mol. function=protein serine/threonine kinase activity; Biological process=protein amino acid phosphorylation
  Homolog annotation: Hit_ID=Q8RXH5; Match level="QueryCoverage=94%, HitCoverage=25%, E-value=7e-28, Identity=67%"; Hit description =Osmotic stress-activated protein kinase
MAVQYKFPERVCISQDSKNLISRIFVANPAMRITMKEIKSHPWFLKNLPKELRDGAQDVYYNEENTKYPLQSIEEIMNIVNEAKTTTATSSPYL

SEQ ID NO: 159204 - protein, 204 aa, Glycine max
  Coding DNA Sequence Number=SeqID_42426
MSRERNREWVGERNRERGKVWMREDPRFNYAETKDGQQPRFKRTNWRDKADISSFYFTRFPEDVNEKDLWYQFKRWGDVREIFICKQRNKSGRRYGFVRFKGEMKIRDQRTKYRDIRSNTKWKQNDKGNPSKCQYQHHMRRWWRQTPETRGKCGHIGTVEDELSWDKGVDISPKYLGDDMGRNHERIIPASLVGEVESEVANWL

SEQ ID NO: 159205 - protein, 174 aa, Glycine max
  Coding DNA Sequence Number=SeqID_42427
  Gene Ontology: Mol. function=DNA-directed DNA polymerase activity; Cellular component=intracellular; Biological process=DNA replication
  Homolog annotation: Hit_ID=Q3LHS9; Match level="QueryCoverage=99%, HitCoverage=15%, E-value=5e-69, Identity=73%"; Hit description=DNA polymerase
MLNFSIAYGKTPVGLSKDWKVTVTEARRTVDLWYNDRKEVLKWQKERKKEACESQRVHTLLGRARRFPKIDLANNYHKGHIERAAINTPVQGSAADVAMCAMLEISNNMKLKELGWKLLLQVHDEVILEGPTESAEVAKAIVVECMTKPFNGENFLRVGLSVDANCAQNWYAAK

SEQ ID NO: 159206 - protein, 897 aa, Glycine max
  Coding DNA Sequence Number=SeqID_42428
  Gene Ontology: Mol. function=DNA-directed DNA polymerase activity; Cellular component=intracellular; Biological process=DNA replication
  Homolog annotation: Hit_ID=Q3LHS9; Match level="QueryCoverage=72%, HitCoverage=53%, E-value=0.0, Identity=52%"; Hit description=DNA polymerase
  Pfam annotation: Domain name=3_5_exonuc; Domain location=341-565; Score=-35.1; E_value=0.031; Accession=PF01612.11; Description=3'-5' exonuclease
MKGEGSEGEVIVSTDVSEVRRGPEGMREVGSEGVETAFSLKVAHCDFVIVNVRFMDGSGIAGLEQGFHSKGRKIQSIQIASNILQHSALSFRKGLSCLKRTPFGLNKCDDMEYSHKYPVHISVNKFSDMSCGMLEERRYEEDLGSLHSCNSQVRMAGLAQFPTSPANGKAFGYNKQAWAEASNKLSKNKKEIQADNKFRVASNAVTSTGQEQAVSMNHDHAQQDLDEPASSSVKDSKVLTDTKRVGTQLKVPPSEICKEKSDKVNDNHGLDTTAKDATSVEKARSTEHTNVKRATNATTGKKARSTKQTTAKGETNATFKKAHSTEQSKLRGRLCSIYEDILVVNNISLAEEVAKMLTVNYRHLIHACDTEVAKINVKQETPVDHGEIICFSIYSGPEADFGGGKSCIWVDVLDGGGKEILIKFAEFFQDSSIKKVWHNYSFDCHVIQNYGFMVSGFHADTMHMARLWDSSRRWVGGYSLEGLTGDQEVMSRAKLDHEKDLIGKVSMTTIFGQKKVRIDGSAGKMVTIAPVDVLQRDERIPWICYSVLDARSTLKLYESLKSHLSDMPWNLDGVPVLQKNMYDFYQEYWKPFGELLIKMESVGMLVDQSYLKDIENVAKAEQEAAVNRFRKWASRYCPDAKYMNVGSDAQLRVLLFGGTVNRGRVRQRLPERRPAWGSPVVAGGCRSNGNGMAAKQQMEVVRKNHNEAIPTERVFKIPNVDKVIKEGKKAPTKLRDIKLNSIGYNLNVDMYTPSGWPSVSGDVLKVLAGKVSAEYDFYEACNMDLDDEDGNPSQSEFLPVEIDKSTYGTAFSCFPTEEEGRDACHAIAALCEVCSIDSLISNFILPLQGHNIAGKDHRVHCSININTETGRLSARRPNLQVLQTCKTSLAVGLLEIF

SEQ ID NO: 159207 - protein, 606 aa, Glycine max
  Coding DNA Sequence Number=SeqID_42429
  Gene Ontology: Mol. function=binding; Cellular component=integral to membrane; Biological process=phagocytosis
  Homolog annotation: Hit_ID=Q1RUQ0; Match level="QueryCoverage=92%, HitCoverage=96%, E-value=0.0, Identity=79%"; Hit description =Nonaspanin
  Pfam annotation: Domain name=EMP70; Domain location=73-564; Score =929.6; E_value=1.3e-276; Accession=PF02990.7; Description =Endomembrane protein 70
  Pfam annotation: Domain name=MFS_1; Domain location=242-589; Score= -50.5; E_value=0.065; Accession=PF07690.6; Description=Major Facilitator Superfamily
  Pfam module annotation: Pfam domain module=EMP70::MFS_1; Domain location=73-564::242-589
MHVKKEEQCLEKMKRVPADITAMFFESRSLLFPLLFSLFLSSAFASDSDHKYQHDEPVNLWVNKVGPYNNPQETYNYYSLPFCHPSSSASAAHKWGGLGEVLGGNELIDSQIEIKFQRNVDKTVFCQIDLDEAKVKQFKDAIENNYWFEFFMGYVGELHPDKNSDNGKHVIYTHKNIIVKYNNDQIIHVNLTQDIPKPLEVGKHLDMTYSIKWDSTNVTFGRRFDVYLDHPFFEHQIHWFSIFNSFMMVIFLTGLVSMILMRTLRNDYAKYAREDDDLESLERDVSEESGWKLVHGDVFRPPRNLVILSAVVGTGAQLALLVLLVVLLAIVGMLYVGRGAIITTFIVCYALTSFISGYVSGGMYSRNGGKHWIKSMILTASLFPFMCFGIGFILNTIAIFYGSLAAIPFGTMVVVFVIWAFISFPLALLGTVVGRNWSGALNNPCRVKTIPRPIPEKKWYLTPSVVSLMGGLLPFGSIFIEMYFVFTSFWNYKVYYVYGFMLLVFVILIIVTICVTIVGTYFLLNAENYHWQWTSFFSAASTAVYVYLYSIYYFYVKTKMSGFFQTSFYFGYTLMFSLGLGILCGAVGFLGSNLFVRRIYRNIKCD

SEQ ID NO: 159208 - protein, 84 aa, Glycine max
  Coding DNA Sequence Number=SeqID_42430
MSLGNYFLKIPSESTASFILPHYEVVKTRQQLVPLSPTLGRRKALCKNFKRTYGQIRSSHPIGSLLQGHDERQRLMPQSLTLGQ

SEQ ID NO: 159209 - protein, 517 aa, Glycine max
  Coding DNA Sequence Number=SeqID_42431
  Gene Ontology: Mol. function=phospholipase D activity; Cellular component=membrane; Biological process=phosphatidylcholine metabolic process
  Homolog annotation: Hit_ID=Q1RUP7; Match level="QueryCoverage=96%, HitCoverage=61%, E-value=0.0, Identity=75%"; Hit description=C2
  Pfam annotation: Domain name=C2; Domain location=29-140; Score=72.6; E_value=1.2e-18; Accession=PF00168.20; Description=C2 domain
  Pfam annotation: Domain name=PLDc; Domain location=340-375; Score =27.7; E_value=4e-05; Accession=PF00614.12; Description=Phospholipase D. Active site motif
  Pfam module annotation: Pfam domain module=C2::PLDc; Domain location =29-140::340-375
MDCHGGICQSSPNREHEGLNEHVFLHGDLDLLIVEAKSLPNLDLSTEAVRKCITMGNMCHPPFIKGLKTHSGKDKMITSDPYVSVCIAGATIAQTRVIANCENPLWDEQFIVPVAHPAQKLEFLVKDNDLLGAELIGVVEIPVQKIIAGNTINDWFPIIGQYGNCLKPYPELHISVQYRQIGVNRSESISSGDGKALGVPKTYFPLRKGGSVTLYQDAHLPDGMLPEIPLEGGKVFQQNKCWEDICHAILEAHHLIYIIGWSVYHPVRLVREATKPLPSGGELSLGELLKYKSQEGLRVVMLIWDDRTSHDKFLLKTIWLHNNFALTPASQGFRDKVVGTLFTHHQKCVLVDSLGSGNNRKITAFMGGLDLCDGRYDTPEHRLFRDLDTVFHNDFHNPTFQLNSNSCAPRQPWHDLHCKIEGPAAYDILTNFEQRWRKAKKWRDFRLKKVTNWHDDALLRLDRISWIVKPSPCSKGDKSVHVTDEKDPESWNVQIFRSIDSGSVKGFPKDVDKAKSQ

SEQ ID NO: 159210 - protein, 208 aa, Glycine max
  Coding DNA Sequence Number=SeqID_42432
MSFGGFLLYIESESLVLYPLAVNLAVSALGAMFLLEGGGNGLGMGSGRVCSRSRSEVSGVRVGVRLDGPVPLKDDVLEKEVVFEQCVTRTLSPALTLEEGLEKLKEALQILNSPSPSSPTVLRPSLCFAPNPTPPRSFLSFMFPRTTPTLNHSMSIWMIIRSQIELDELESVSILSMTLAWDEFSFSTFQEAHYSLQDSLDQVPDMPF

SEQ ID NO: 159211 - protein, 214 aa, Glycine max
  Coding DNA Sequence Number=SeqID_42433
  Gene Ontology: Mol. function=nucleic acid binding; Biological process= DNA integration
  Homolog annotation: Hit_ID=Q0KIN0; Match level="QueryCoverage=79%, HitCoverage=10%, E-value=4e-25, Identity=35%"; Hit description =Integrase core domain containing protein
MASASDPPEQSLSNNTSSFQFPANASLTPEKFNGKNYLSWEGYVNLWFKGQGLHDHLTMKPNEIPENERNQWMRIDNQLVPLLWQSIDPNLLVHFRSLRTCFDVWNQVRSFYSTNLRRFYDVVVELLTLRMRDRDLLGYLNKALGVVQEVRFFLGGKALQEVPEKFDTFLMCFVLQGLSKDFDAVRNQILLDSQVTTTEGLYNRLMPFLLFKKY

SEQ ID NO: 159212 - protein, 102 aa, Glycine max
  Coding DNA Sequence Number=SeqID_42434
  Gene Ontology: Mol. function=phospholipase D activity; Cellular component=membrane; Biological process=phosphatidylcholine metabolic process
  Homolog annotation: Hit_ID=Q1RUP7; Match level="QueryCoverage=98%, HitCoverage=12%, E-value=3e-40, Identity=82%"; Hit description=C2
MELALKIAGKIGANERFCVYIVIPMWPEGVPTSAAVQEILFWQGQTMSMMYKIIADALEKAGLSDKYHPQDYLNFYCLGKREPQSTNISPTPNPSENRALVC

SEQ ID NO: 159213 - protein, 80 aa, Glycine max
  Coding DNA Sequence Number=SeqID_42435
  Gene Ontology: Mol. function=catalytic activity; Biological process =metabolic process
  Homolog annotation: Hit_ID=Q1RUP7; Match level="QueryCoverage=83%, HitCoverage=8%, E-value=1e-26, Identity=85%"; Hit description=C2
  Pfam annotation: Domain name=PLDc; Domain location=22-49; Score=41.1; E_value=3.7e-09; Accession=PF00614.12; Description=Phospholipase D. Active site motif
MAITYLHLRSNQLVSVKKFRRFMIYVHAKGMVIDDEYVIIGSANINQRSLDGSRDTEIAMGAYQPNYTWTEKNAHPRGQV

SEQ ID NO: 159214 - protein, 72 aa, Glycine max
  Coding DNA Sequence Number=SeqID_42436
MVRVKGIMHASIVDQYRYKYLFRLFSFGIFTASSKLEVQIALQASNEQYGTSKQSNAIPILGYYPTTKQKLC

SEQ ID NO: 159215 - protein, 75 aa, Glycine max
  Coding DNA Sequence Number=SeqID_42437
MILRVPYCYPKNQENNKKLNGKDEVGIGKCSIGTWEQLKAEFLPGSVSWMAHHSLMNVRQTRAVRHYKKGLFCAD

SEQ ID NO: 159216 - protein, 85 aa, Glycine max
  Coding DNA Sequence Number=SeqID_42438
MVINPYFMHHMVKEQVAIMNKRQDGSLWLTCTSSSTCDWQHIRTSMTTSIRSTKEAVNGVAMVVVKGADSATLVVCTSKGAKKIL

SEQ ID NO: 159217 - protein, 142 aa, Glycine max
  Coding DNA Sequence Number=SeqID_42439
QKNVYTDNHSGISARQRDSNVSMTDLVSAEDDTAKKNVYTDNHSGISARQRDSNVSMTNLVSAEDDINLRMLTDLSAAIDEGRRRRHLVSVEDDVNLRVSTGLSAAIDEGRRRRHLVSAEDDVNLRVSTGLSAAIDEGRRRR

SEQ ID NO: 159218 - protein, 56 aa, Glycine max
  Coding DNA Sequence Number=SeqID_42440
MAAGGAESDVSAVVGGGSRSGVLVELAEVRRSQGTDVVGEAPMINNLEIDIQSSYH

SEQ ID NO: 159219 - protein, 234 aa, Glycine max
  Coding DNA Sequence Number=SeqID_42441
  Homolog annotation: Hit_ID=Q8LRM1; Match level="QueryCoverage=33%, HitCoverage=18%, E-value=3e-16, Identity=55%"; Hit description=Nam -like protein 4
MKKAIGVNLELTIIVFWDTQSFNKAPFDVNKLPIETQNLLAVCKRESMAEYPSPEKDDNNCKHMDDYPSPQTDNPKPFSQIYKRRRHNLNSNNSNVSGDSVRTSQDPCSSTITTAATALPTATVAGTATNTAPKKHFLSALVEFSLLESLESKDNLASIKAPDFDTENLESSMPPSCAKFIKQMQSEMQKLSVEKETIRFEMMSAQAMINILQSRIDVLSKENEDLKRMVAQNP

SEQ ID NO: 159220 - protein, 106 aa, Glycine max
  Coding DNA Sequence Number=SeqID_42442
  Homolog annotation: Hit_ID=Q9LKZ6; Match level="QueryCoverage=44%, HitCoverage=4%, E-value=2e-12, Identity=75%"; Hit description =Receptor-like protein kinase 1
  Subcellular localization annotation: CTP_CleavageSite=49; ConfidenceScore=5.03e-01
MAKASCSRNYYSLFGTATSTPLLIPSPSSPTPDSIQIQTTGEHVVGEVVAGKLVAEKGKVLEVLPGVILERDLTGEEVVAEVKVAEEGHGSKGEKNFQIHSLKDRI

SEQ ID NO: 159221 - protein, 106 aa, Glycine max
  Coding DNA Sequence Number=SeqID_42443
MSSDAIGNNGVGRFEWSWNSSVSFLYGGLAPIFGVIVVALLLVARQGCRPRWPETTTTTTIESLRDVDVNNSRGVANTTQVDEGHNILVIVAGEEHPTHLAKPLSL

SEQ ID NO: 159222 - protein, 175 aa, Glycine max
  Coding DNA Sequence Number=SeqID_42444
MEPFGAEGCHSSESGWTMYIGSPIDDAGHSSDNDDNNKKGTQAHPQDDDDDDDESDDSMASDASSGPSHHHGFADFRRDAEEENDENKYCLEKKAGKTQHKQMEGKKVEKNGMLIVDSKDKSPVQGCGKPREELEWESFVKKQEIFICSSSKDQDYVEKMMARKIQNNFDSFRLS

SEQ ID NO: 159223 - protein, 145 aa, Glycine max
  Coding DNA Sequence Number=SeqID_42445
MECNEDDELHVAPYYASLRQCLPYHSPTQKPIFTSTNLLNMEAGESHTLNHMDPPHGLHHIPFYCSQNLPSNSNNPIQVPLHKPSPNTSSNSNNNNSDEAKALLDDRKKRMFSNRESARSAEQPHLIPNDFLAEPLTRPVASSRT

SEQ ID NO: 159224 - protein, 63 aa, Glycine max
  Coding DNA Sequence Number=SeqID_42446
MECQGDPESEASKQWNSRLSEGTTVIVFNEPSTYIYHFPKLCKISGAMPLADEGCVNSYHENG

SEQ ID NO: 159225 - protein, 284 aa, Glycine max
  Coding DNA Sequence Number=SeqID_42447
MGNPIEQPNLPQEQPVVEVQQNVSAEEIPSWARTSPAPEADAVNVEEWGEGQGIGSSSPHGWAEVDDHHEPNQSDNTIPHESSQKSSSEGNFFDEDAIKEAEAGGSDIYPVSSTSKLSASIGIAEDTFIQMQNEDPAAALRLLLNTSQANTSSEKIPGASTPSDAEINSSVRQDSLLLKLSTEYALKDVLKSIEENPSAAFGHLNFLKKLHNPLTSDETLGKVIQIEAIIDQFASAVQKKRENGTRLDAQKQAHTLLLEKARAAQHEVERLTKEAKEGSSEIKD

SEQ ID NO: 159226 - protein, 197 aa, Glycine max
  Coding DNA Sequence Number=SeqID_42448
  Gene Ontology: Mol. function=transcription factor activity; Cellular component=nucleus; Biological process=regulation of transcription
  Homolog annotation: Hit_ID=Q1SRF6; Match level="QueryCoverage=98%, HitCoverage=42%, E-value=9e-80, Identity=79%"; Hit description=GRAS transcription factor
  Pfam annotation: Domain name=GRAS; Domain location=1-197; Score=3.5; E_value=1.7e-08; Accession=PF03514.5; Description=GRAS family transcription factor
MEQLLVHCANAIETNDVTLAQQILWVLNNIAPPDGDSNQRLASGFLRALTARAAKTGTCKMLVPAGGTNLSIDTHRFNVIELANFVDLTPWHRFGFTAANAAILEATEGFSVIHIVDLSLTHCMQIPTLVDAIASRNYHEVPPPIIKLTVAADASFRDNIPPMLDLSYDELGAKLVNFARSRNMVMEFRVVSSSYRD

SEQ ID NO: 159227 - protein, 145 aa, Glycine max
  Coding DNA Sequence Number=SeqID_42449
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=92%, HitCoverage=32%, E-value=5e-55, Identity=72%"; Hit description =Protein kinase APK1B, chloroplast precursor
  Pfam annotation: Domain name=Pkinase; Domain location=1-145; Score= -51.8; E_value=1.8e-05; Accession=PF00069.15; Description=Protein kinase domain
  Pfam annotation: Domain name=Pkinase_Tyr; Domain location=1-134; Score=-85.4; E_value=3.1e-07; Accession=PF07714.7; Description =Protein tyrosine kinase
  Pfam module annotation: Pfam domain module=Pkinase::Pkinase_Tyr; Domain location=1-145::1-134
MQSEINFLGRISHPNLVKLLGYCCDDIEFLLVYEFMPKGSLENHLFRRNTNSEPLSWDTRIKIAIGAARGLAFLHTSEKQIIYRDFKASNILLDEDYNAKISDFGLAKLGPSGEDSHVSTRIMGTYGYAAPEYIATGDNLIFTCI

SEQ ID NO: 159228 - protein, 347 aa, Glycine max
  Coding DNA Sequence Number=SeqID_42450
  Gene Ontology: Mol. function=protein binding; Cellular component =outer membrane-bounded periplasmic space; Biological process=cell wall organization and biogenesis
  Homolog annotation: Hit_ID=Q7CIW8; Match level="QueryCoverage=53%, HitCoverage=79%, E-value=5e-43, Identity=43%"; Hit description =Putative pilus assembly chaperone
  Pfam annotation: Domain name=Pili_assembly_N; Domain location=35-148; Score=-23.5; E_value=0.00017; Accession=PF00345.11; Description=Gram -negative pili assembly chaperone
MMSLRALLLWFFLALSPASFAANSLMIWPIDPAINPQEKASELWLENRGNATTIMQVRIFNWQQIDGQEQYQTQQQVVASPPMVRLEPGQKQLVRLIRQSAPPAGVEQAYRVVLDEIPTPRSPGENQAGLTFQMRYSVPLFVYGDGLTRDSAKADLSWRQVSRDGKRWLELTNRGDGHARLSNVTVGGRALGNGLFGYVLANSSHRWPLNSPVSGELAAELPPPPAVSHSASGQQYMLELVVNQRERGEIVPVERRDGEFWLRSGDLQRAGIPAAKLAGEQVAPGQLGEVKVEYDERRQRLLLTGTARLAARADARSAAKWPALSRPGQQRRAAQLRPFTPRAPTTP

SEQ ID NO: 159229 - protein, 217 aa, Glycine max
  Coding DNA Sequence Number=SeqID_42451
  Gene Ontology: Mol. function=RNA-directed DNA polymerase activity; Cellular component=intracellular; Biological process=RNA-dependent DNA replication
MVQELDGHMQGPIMSLALDGHLLISKGEAIVGGNIVDDGPEALHGYVLGDVGLIQDLDLKCPMRLGVHDGVLLRCSITLNSLCWMIRRNSFASSADIFFLLKSSSPLANLAAEIASSRIGFALSLSSMPTFAFPFMSLDRTNGLGAAKIHPLRVILLVPEMLVTLAEDRFLRGVPPWDRLGTLVRGKGRLLTQDRLEASGLLGGSISGEVDHQCGIL

SEQ ID NO: 159230 - protein, 146 aa, Glycine max
  Coding DNA Sequence Number=SeqID_42452
  Subcellular localization annotation: CTP_CleavageSite=29; ConfidenceScore=5.13e-01
MEDLISVMSNSRNFSNTIVSDTSLDVSLLQMAPKKLTTKRAWKMTTGEGSSTSPPAYFVFDGHRFQSEEHQGHFELIKDFSFLKEMRVELAEIDYPEFIEEGTKRNYRQLAKPMPKYDPEVVLEFYMNAWPTKEGVHDKRSKVRGQ

SEQ ID NO: 159231 - protein, 125 aa, Glycine max
  Coding DNA Sequence Number=SeqID_42453
MKFDVDADNYSFINCLNKLPTIFHETTYDLTKMDEREFTDHVTQLHNSQKEKRARMEEELISTIAVREQVVKVQAEAFAKAMDNNIVNEVIIDLASTVVMDETLEVSKVAQANEIVHQEKELLSK

SEQ ID NO: 159232 - protein, 145 aa, Glycine max
  Coding DNA Sequence Number=SeqID_42454
  Gene Ontology: Mol. function=DNA binding; Cellular component =intracellular; Biological process=DNA integration
  Homolog annotation: Hit_ID=Q1S3H4; Match level="QueryCoverage=97%, HitCoverage=25%, E-value=9e-40, Identity=59%"; Hit description =Integrase, catalytic region
MSKALEAFQDMMGSKVVVFTDHAAIKYLLVKDDSKPTLIRWILLLQEFDLEIKGKNGIENHVADNLSRLTINEVTTQGIEIQEEYPDEKLLNIAESPWFAKMANFKVVGALPDDLTWHQKRSFSWAPNTLCGMILILLCLEQIIS

SEQ ID NO: 159233 - protein, 103 aa, Glycine max
  Coding DNA Sequence Number=SeqID_42455
MEITTIHTDNEPFIHVEHFFYIVELEKVGLKLNKTLLFYGVRLFFNMPQTIYPELVKKFWRNVEFLNIKVIVSKVLGVRVTLSSDSIAKATSYLHEGSTHHKG

SEQ ID NO: 159234 - protein, 254 aa, Glycine max
  Coding DNA Sequence Number=SeqID_42456
  Subcellular localization annotation: CTP_CleavageSite=42; ConfidenceScore=5.31e-01
MGKSFVKGIQILTFFLNSTVATYHSTGVWAKSQRSVFQNGKRAGVATDVYSRKTLEKPKRGYANFEKKGSGVVYARGRSVFQKGKRAGVATDVYSRKTLEKPKRGSANFEKKGSGVVYARGSNWLAQASSNLPYLTWKSFGGLGEPEASLGKLGVPPMFLKQIPRNIVLGALLVFGLLKVSPHYLRCDLSGWMNTLLDDKALKALDVVCSHASSILGLELKRIFWRWVLLELLQRKEIRIEGVWGMEEDVVLLY

SEQ ID NO: 159235 - protein, 43 aa, Glycine max
  Coding DNA Sequence Number=SeqID_42457
MRKLIKERMENKVVNFVGLNKVKWWLDRNIEVTITQVTGLQMR

SEQ ID NO: 159236 - protein, 147 aa, Glycine max
  Coding DNA Sequence Number=SeqID_42458
  Pfam annotation: Domain name=zf-CCHC; Domain location=82-99; Score =22.2; E_value=0.00021; Accession=PF00098.13; Description=Zinc knuckle
MKLASTFLSLHSSPSSSKLLSMASYGEAKESIDEEDPRPTSSNGAYIKIQEESKGCGSSGLENTCSTIKSFKERKDKEKCSIICYECKKLGHFKLECPDLDSPDLDRTNDKEDLEDSSADEGTEEEANFYLMADTTSEESKSESDVE

SEQ ID NO: 159237 - protein, 101 aa, Glycine max
  Coding DNA Sequence Number=SeqID_42459
MAGGTKNEKNDEEHQWLDDGGGGISLEFARAGRENNYFLLDKSDFMRLCNLNGLMDGDAIFPRRGPITRAMARRLQVDWARDAGEGPRILMSLRVDFEPMG

SEQ ID NO: 159238 - protein, 350 aa, Glycine max
  Coding DNA Sequence Number=SeqID_42460
  Gene Ontology: Mol. function=transferase activity; Cellular component= oxygen evolving complex; Biological process=DNA integration
  Homolog annotation: Hit_ID=Q2HT85; Match level="QueryCoverage=86%, HitCoverage=23%, E-value=1e-78, Identity=42%"; Hit description =Integrase, catalytic region; Zinc finger, CCHC-type; Peptidase aspartic, catalytic
ENLEKFDSKSDIVTLLGCSETSKAYRVYNSRTLVVEEAIHMKFNDTKPDTEISELEESCADLKLDDGIMPLTTRQTPEADTPDQALDNPQENAMEVEHWVKVTQEELDQFQKNDVWKLVELPKGKKVVGTKWVFKNKLDEAGKVVKNKARLVAKGYSQQEAHNRMKLYQMDAKSAFLNGLIQEKVYVEQPPRFESDTLPNRVFNLNKVMYGLKQAPRAWYENLSSFLLENDFERGKDFSNLIETKFEMSVMGELKFILGLKIKQTNLGIYIHQTNYVKELLKKFHMHDAKEMKTSMHPTTNLRLDEESNKQGKTFRLISYCDADYASDKLERKSTNGSGHFIDGNLASWI

SEQ ID NO: 159239 - protein, 193 aa, Glycine max
  Coding DNA Sequence Number=SeqID_42461
GTSTWVVVIENKRWYIFCGLVQVEGTSTWLFKENKGGYIPCGSLLVKAVGSLSPSTMQDGQVTRKEGRTFELEEGILAFTKTLFEEHKSKANEDVHLATLAGKADEEILDEVVLDSLKTLSTEEVQRKVVEEDTMMDINGQPMREAVILESIVAYLDPAEKEALEEAMLESLIKSSILKPGIKDVVETNPGVP

SEQ ID NO: 159240 - protein, 72 aa, Glycine max
  Coding DNA Sequence Number=SeqID_42462
MPRTPRHLRLGIAAREWVCQFLLTLVEYDGQSNIRQYNVERVHLVDVKDDRRDHLDMSSEEIEEYQELLQYS

SEQ ID NO: 159241 - protein, 119 aa, Glycine max
  Coding DNA Sequence Number=SeqID_42463
  Gene Ontology: Mol. function=isomerase activity; Cellular component =endoplasmic reticulum; Biological process=cell redox homeostasis
  Homolog annotation: Hit_ID=Q1T4Z3; Match level="QueryCoverage=93%, HitCoverage=62%, E-value=8e-24, Identity=69%"; Hit description =Thioredoxin domain 2
  Pfam annotation: Domain name=ERp29; Domain location=26-118; Score =98.7; E_value=1.7e-26; Accession=PF07749.3; Description=Endoplasmic reticulum protein ERp29, C-te
MVMLRIGINTVKIATAPSNVVVLTSENFNEVVLDETKDVLVEFYAPCLTRMEEEVENLKGSASRHEKIYLKAAKNYLEKGSDYAKNEIQCLQRILDKPISPAKADELTLKKNILSTYAA

SEQ ID NO: 159242 - protein, 383 aa, Glycine max
  Coding DNA Sequence Number=SeqID_42464
  Gene Ontology: Mol. function=binding; Biological process=protein folding
  Homolog annotation: Hit_ID=Q852A6; Match level="QueryCoverage=86%, HitCoverage=89%, E-value=1e-112, Identity=62%"; Hit description =Putative Hsp70 binding protein
  Pfam annotation: Domain name=Arm; Domain location=127-168; Score =24.4; E_value=0.00039; Accession=PF00514.13; Description =Armadillobeta-catenin-like repeat
  Pfam annotation: Domain name=Arm; Domain location=212-252; Score =22.5; E_value=0.0015; Accession=PF00514.13; Description =Armadillobeta-catenin-like repeat
  Pfam annotation: Domain name=Arm; Domain location=82-125; Score=3.6; E_value=4.3; Accession=PF00514.13; Description=Armadillobeta-catenin- like repeat
  Pfam annotation: Domain name=HEAT; Domain location=138-170; Score =14.7; E_value=0.34; Accession=PF02985.12; Description=HEAT repeat
  Pfam annotation: Domain name=HEAT; Domain location=222-254; Score =16.6; E_value=0.089; Accession=PF02985.12; Description=HEAT repeat
  Pfam annotation: Domain name=HEAT; Domain location=96-127; Score=4.9; E_value=11; Accession=PF02985.12; Description=HEAT repeat
  Pfam module annotation: Pfam domain module=Arm::Arm::Arm::HEAT::HEAT:: HEAT; Domain location=127-168::212-252::82-125::138-170::222-254::96 -127
MAVTGRQRSKCREEEKETTPRKEEKTKQMERRKDETMQSQTIDVVKRMKEITLVMQTPEQVLKDQGVTPADIEDMLDELQEHVESIDMANDLHSIGGLVPLLGYLKSSHANIRAKAADVVTTIVQNNPRSQQLVMEANGFEPLISNFSSDPDVTVRTKALGAISSLIRHNKQGITVFRLANGYAALKDALASENVRFQRKALNLTHYLLHENNSDCNIVNELGFPRLLMHLASSEDSDVREAALRGLLELARNTQDGKDGNEEDSEKMKQLLQERINNISLMSAEDLGVVREERQLVDSLWSTCFNEPSSLREKGLLVLPGEDAPPPDVASKFFEPPLRSSTANPSSKKDSNNEKKEIPLLLGSGPSLADTNNQGSNRENANS

SEQ ID NO: 159243 - protein, 91 aa, Glycine max
  Coding DNA Sequence Number=SeqID_42465
MRIPFLQAKVQKGVGLGPNFHITPQGTCDNDDLKTTCKISHGYSQVGPQASRLWHCDTMVGNLHKQTQRFQVMFFHQFNEFIHPYLGYSGK

SEQ ID NO: 159244 - protein, 135 aa, Glycine max
  Coding DNA Sequence Number=SeqID_42466
MSLRTPREAIEIIENMVAIANKFQEDRAIVPSNRLLEVNTQDRGHATNEYGMIQEEVQYKKNQRQGNYQNYNNQGYKLHPIIGQEHGSSFNAMSRKIVMSSQEQVNWRKPSHSSCKYLFPTIRILKPPLKAWSSK

SEQ ID NO: 159245 - protein, 52 aa, Glycine max
  Coding DNA Sequence Number=SeqID_42467
MDLSLENGSLSLKVRTVSHLAMAKMDLAILKLNRRGKALSTCVPELSLQIDS

SEQ ID NO: 159246 - protein, 116 aa, Glycine max
  Coding DNA Sequence Number=SeqID_42468
MVAWPGTQPSLHREDGGPTAQPIIIEEEAEETQVRQVVAATPERSLEATSDPSTQGEDIPSPQPAVDPSTPLLEMSEDPTTSFLAMDTSPPATLVLHLTDKEDVQTQDTQDQSQEF

SEQ ID NO: 159247 - protein, 144 aa, Glycine max
  Coding DNA Sequence Number=SeqID_42469
MINNGQDGGVTLVWWKAEMKSNERPVQWMFFDMRAKVLVTLAWPPVGVSWYSVSKMEGELPVVDEVRQGRSTMVLIESRTEMRLSQASMVSEDDEAVNEKKAMVCPCCERTTPMPIPKASISTVNGTIKLGKARIGAKDRACLS

SEQ ID NO: 159248 - protein, 185 aa, Glycine max
  Coding DNA Sequence Number=SeqID_42470
  Subcellular localization annotation: CTP_CleavageSite=18; ConfidenceScore=5.60e-01
MATPPRSPPPPPPPTDPSASPSTVKWTRKATRLRSLATRQLSAGRLVVNIDPDTGKADGPHKKKLRTYLGIVACDKVDVTYETWKEAEFEIPEASDSRTKKKILQTVSERWRQFKSDLTRKWALVTNQDGVDDIVCKKYDISKDKWAQFCETCIDPSWEDVRKKAQVIQKQNTAPTCCLVGVANI

SEQ ID NO: 159249 - protein, 251 aa, Glycine max
  Coding DNA Sequence Number=SeqID_42471
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=90%, HitCoverage=96%, E-value=5e-61, Identity=48%"; Hit description =Protein ULTRAPETALA2
MEVYPNYVFGSSKRRKQFRVGDDGKILFDEEELKMILGFNRGEDYIEVLCGTTNKVYGDYVGRLKINNNGEYFITCECCPGCPLVNVTPEAFEKHALKEGTGRWKSNIWVHCEDEDRVPLWKTPLTKYYTHQANVANWKDTAMRKRNFHRDEFLHCTSCRKERRFRLKSRPDIKNYHEALNNKSWTCSLWPYHKITCDDDEERPSLRASRGCSRSSTCQGCSTCYCEGCIKCRFEDCNCQECRDFMLYAEP

SEQ ID NO: 159250 - protein, 201 aa, Glycine max
  Coding DNA Sequence Number=SeqID_42472
  Gene Ontology: Mol. function=RNA-directed DNA polymerase activity; Cellular component=chromatin; Biological process=chromatin assembly or disassembly
MFDPSKHEGSLTHLEDFLTRLGDTMHSLTLKMDKLLHRVSPVTLVSVATLAQAHHHQPFFLATNHKMKLEVPRFDGTKPLGWIFKINQYFEYHNTPDKDRLTIASFYMEGRALAWFQYMTNNAQFTSWATLLQALQTRFVPSQYDDPTRTLFKLTQTGTFVEYMSEFEDLANRIIGLSPPFLLAYFISGLSPEIRREVQAY

SEQ ID NO: 159251 - protein, 240 aa, Glycine max
  Coding DNA Sequence Number=SeqID_42473
MVICGSCRRLSMWLLEEKRELSERLRHHRNVEVGSFGLVAIKTAELVLSKGPQIGVVLALELNQAVLIKKLHGQSIIVGQHWTQGLKPLDTQYDIGARKLVKCRGPGRRYCPECPRPQLHKCLYTPSIGRYLQLHRVVVRRVGCRVWVALLYIRPRRTLGVQRFPLWYFSSQLKHNPRSWRLVSSFGVKRFTGGGGGRRGDGKRGGSEVERRGRGASGSGHARVGGDSPRAFPPGGGQGR

SEQ ID NO: 159252 - protein, 463 aa, Glycine max
  Coding DNA Sequence Number=SeqID_42474
  Gene Ontology: Mol. function=transporter activity; Cellular component= membrane; Biological process=oligopeptide transport
  Homolog annotation: Hit_ID=Q9M817; Match level="QueryCoverage=97%, HitCoverage=75%, E-value=1e-120, Identity=48%"; Hit description =Peptide transporter, putative
  Pfam annotation: Domain name=MFS_1; Domain location=2-404; Score= -40.3; E_value=0.022; Accession=PF07690.6; Description=Major Facilitator Superfamily
  Pfam annotation: Domain name=PTR2; Domain location=1-388; Score =210.9; E_value=2.8e-60; Accession=PF00854.12; Description=POT family
  Pfam module annotation: Pfam domain module=MFS_1::PTR2; Domain location=2-404::1-388
MLWLTAMFPDLKPSCESYMLDCNSGTPAQQALLFLSMGLISIGAGCVRPCSIAFGADQLNIKERSNDEKLLDSYFNWYYTSIAISTVIALSVIVYIQENLGWKIGFGLPALLMFISAVSFILGLPFYVKVKPSHSLLTTFVQVAVVAVKNRKLSLPDSNFVQYYQDHDSELMVPTDSLRCLNKACIKIPETVSISNPDGSVSDPWSQCTVEQVESLKSLLRILPMWSTGVLMMVSQGSFSTLQANTMDRRLFGNFKMPAGSFNLIMVLTLSIVIPLYDRIMVPLLAKYRGLPRGFGCKTRIGIGLLFVCSAKATSAVVETMRRNAAIEQGFEDQPNAVIDMSVLWLFPEFVLLGIGEAFNSVAQVEFFYTCIPKTMSSFAMALFTLELAAANVVGSVLVSIVDKVTSVGGNESWIATNINRGHLNYYYALLTCLGLINYLYFLAISLAYGPPPGQKLEARREI

SEQ ID NO: 159253 - protein, 563 aa, Glycine max
  Coding DNA Sequence Number=SeqID_42475
  Gene Ontology: Mol. function=RNA-directed DNA polymerase activity; Cellular component=chromatin; Biological process=chromatin assembly or disassembly
MVDIFASLTGKVCPVYTHTKRDSCRVPVGVRRPGQQDNRTVATLSLGLLHLWPVLEDSSRGAGSPTSHAGPGYRPHPPPGGEALGLSPPSRACLLPLAPLPLRSTPLPPLLSSPPRPPPPPMKHLTPEELTSRREHGLCFNCDEKYQRGHRCTSWVLLLIGEKDNPSLPNIEQGDPHPTPDLPDNPDPYQAQISLNSLSGHLAGLLPSHRVTVLVDGGSTHNFVQPSVVTCLCLPCWTMSTPLRVMADTFYFHITVMPEVSIVPNAQVIPKGIQHLLTKFTLLFQQPHALPPARTIDHHIHLLPHSLPGLIQPSTSPFSSSVLLVTKLDGTWRFCMDYHALNAVTVRDRFPIRTIDELLDELGGAQCFLKLNLRQGYHQIQMNDADIPKTAFRTHHGHYRFKVMSFGLCNAPSSFQATMNVEYLGHLVSKRVRSFLGLTGFYRRFIRGYTNILAPLVKASTVEPFQWTPQAQAAFDQLKHTLSLAPVLALPNIVVPFIVEMDASGVGMGVVLSQQGHSSAFFSKPSSQKLLRASTYVRELCAITTVVKIMETIPSRSLLHHPH

SEQ ID NO: 159254 - protein, 284 aa, Glycine max
  Coding DNA Sequence Number=SeqID_42476
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=79%, HitCoverage=96%, E-value=4e-60, Identity=47%"; Hit description =Protein ULTRAPETALA2
MAEEKSGYSPQLKRNQKIEIKKEFNNFTQGENCRRELNGNNGGSSKRRKQFRVGDDGKILFDEEELKMILGFNRGEDYIEVLCGTTNKVYGDYAGRLKINNNGEYFITCECCPGCPLVNVTPEAFEKHALKEGTGRWKSNIWVHCEDEDRVPLWKTPLTKYYTHQANVANWKDSAMRKRNFHRDEFLHCTSCRKERRFRLKNRPDIKNYHEALNNKSWTCSLWPYHKITCDDDEERPSLRASRGCSRSSTCQGCSTCYCEGCIKCRFEDCNCQECRDFMLYAEP

SEQ ID NO: 159255 - protein, 104 aa, Glycine max
  Coding DNA Sequence Number=SeqID_42477
MPRRHSNAHKHDITKICMVVAPNFQRCLEISFPLISNIVAVGTTSDNVLSKRKTLDEVSLSSSKSETYHDHIFSSASYVPMDPGIGPLITHRVCKKCRCRVCIK

SEQ ID NO: 159256 - protein, 259 aa, Glycine max
  Coding DNA Sequence Number=SeqID_42478
MVGAISQNIVTLTGHPMILLSESDLTNPWCGVSCYVLLSALGWFFTDMGVTHILKPSKSSAFHVEEGNGEMILVWVGVGAIVETGVTGGSRIPRACLGRTWRQQEHQMLGMQQAGFRGTSTSNNSIRKKKNKEGKSEEQIISSKEILEGSLSWSHPSSKNVVFEVKSSYQHVSDPDEAWTCSRKGDKNNWDEVLNKVEMQKCHKHNWDEVLNKVEMKQNPSCSVMVDNWYGEFLESIEPSMVKQIPFCEAVQRSSPVGS

SEQ ID NO: 159257 - protein, 172 aa, Glycine max
  Coding DNA Sequence Number=SeqID_42479
  Gene Ontology: Mol. function=RNA-directed DNA polymerase activity; Cellular component=chromatin; Biological process=chromatin assembly or disassembly
MGSFDPREELPPQAWPRMDEGSQILFNYAIQNLCLSINLWVIREAHSQKCPTQTEEFLQESADENRVSIEDQAPENPMDFDDNVDPFGKMINDDQDGGVTLVWWKADDEVQREVLPGPVQWKFSDMRAKVLVTLAWPPVGVAWYSVSKVEYRKWIGEGPCTQGELLAVDEFP

SEQ ID NO: 159258 - protein, 97 aa, Glycine max
  Coding DNA Sequence Number=SeqID_42480
  Subcellular localization annotation: CTP_CleavageSite=25; ConfidenceScore=5.26e-01
MTSASVSNIVSTVAMPLYSNADVIASMRGWRAFLHFNPCPCWGRTFVSRRPSDVAPCGACGPWIFFINGQNGEGRKMIGDATSRIQGEDESRRSSPP

SEQ ID NO: 159259 - protein, 339 aa, Glycine max
  Coding DNA Sequence Number=SeqID_42481
IAVGTHIDRRRVRKQVNMVICGSCRRQSMWLLEEKHELSERLGHHHNVEVGSVGVATTKTVELVLIKGPQIGVVLALELNQAVEDAGIVLNVHGHNFTNACTLQVLVATYHYTEWCRDRPTRQAQAGPLSVALLVLGGPKVSLNLFGPGMDPGCRHNPCSRREVSSSGVRRFTGGGSGRGGDDKRGGSGVGRIGSGASGGRHACEGGDNPRASPPEGGPEMKQAKRKGGNSSIILLASIVGHILKPSKSSTFHVEGGNGETILVWGIVGQRVGGDELVLELQWRPGRLVKRGEGVCPSSRSWDMEAMRAPNVRDAVSWFSRNQYLQQFNKEKEQQRGKE

SEQ ID NO: 159260 - protein, 134 aa, Glycine max
  Coding DNA Sequence Number=SeqID_42482
  Gene Ontology: Mol. function=RNA-directed DNA polymerase activity; Cellular component=chromatin; Biological process=RNA-dependent DNA replication
MAVRSFLGLAGFYRRFIRGYTTIVAPLVKATTVEPFQWTPQAQATFDQLKHTLSLAPVLALPNFVVPFIVRMDASGVGMGVVLSQQGHPSAFFSKPSSQKLLRASTYVRELCAITTVVKIMETIPFRSPHHHPH

SEQ ID NO: 159261 - protein, 92 aa, Glycine max
  Coding DNA Sequence Number=SeqID_42483
  Gene Ontology: Mol. function=chromatin binding; Cellular component =chromatin; Biological process=chromatin assembly or disassembly
  Homolog annotation: Hit_ID=Q1SAV4; Match level="QueryCoverage=63%, HitCoverage=15%, E-value=2e-10, Identity=49%"; Hit description =Integrase, catalytic region
MAGITWHKELLNDQPLVFPLAILDYRRASTEDPWEVFMQWNGISPDDTSWEDWNQLCENYHLEDKVVLQGPREDTSLQIEVRAGVTKSKEGV

SEQ ID NO: 159262 - protein, 197 aa, Glycine max
  Coding DNA Sequence Number=SeqID_42484
MVIYGSCQRQSMWLLEEKRELSERLGHHRNVEIGSVGLVAIKTAELVLSKGPQIGVVLALELNQARSSSRASTSGRPPRIVTRWLGRRPAKRSAFTARWPKSEFKLIWAWYGSGLLGGSGDGCGSPYSILGKEGSSFSAMSRRTQEVQRCPLWYFSSQLKHNPCSRHEVSSSGVRCFTGGGGGRGGDDKRGGSGVER

SEQ ID NO: 159263 - protein, 89 aa, Glycine max
  Coding DNA Sequence Number=SeqID_42485
MVVLPWYGGRPTMKSNEKSSQGQHAKYDLSVAPSLEREKIGGICGEYRKWIGEGPCTQGELPAVYEFPQGRSTMVLTESRTGMSLSQVI

SEQ ID NO: 159264 - protein, 235 aa, Glycine max
  Coding DNA Sequence Number=SeqID_42486
  Gene Ontology: Mol. function=3-methyl-2-oxobutanoate dehydrogenase (2- methylpropanoyl-transferring) activity; Cellular component =mitochondrial alpha-ketoglutarate dehydrogenase complex; Biological process=branched chain ...
  Gene Ontology: Biological process=family amino acid catabolic process
  Homolog annotation: Hit_ID=Q9LDY2; Match level="QueryCoverage=75%, HitCoverage=63%, E-value=2e-84, Identity=71%"; Hit description =Branched chain alpha-keto acid dehydrogenase E1 beta subunit
  Pfam annotation: Domain name=Transket_pyr; Domain location=34-174; Score=109.0; E_value=1.4e-29; Accession=PF02779.14; Description =Transketolase, pyrimidine binding dom
MSTKFGRLVPLVFSKRGFSTSTSIQKGGSEEGLKSLNLCSAINQALHIALDTDPRSYVFGEDVSFGGVFRCTTGLADQFGKKRVFNTPLCEQGIVGFGIGLAAMIVNEAAKFRYRSGNQFNCGGLTVRAPYGAVGHGGHYHSQSPEAFFCHVPGIKWLYRLAVEEVPEDDYMLPLSEAEVIRQGSDITLVGWGAQLSIMEQACLDAEKTQFFHKGTELGCNLLCVIALDMEGKPS

SEQ ID NO: 159265 - protein, 263 aa, Glycine max
  Coding DNA Sequence Number=SeqID_42487
  Gene Ontology: Mol. function=DNA binding; Cellular component=nucleus; Biological process=regulation of transcription, DNA-dependent
  Homolog annotation: Hit_ID=Q8S8I2; Match level="QueryCoverage=85%, HitCoverage=96%, E-value=6e-61, Identity=48%"; Hit description =Protein ULTRAPETALA2
MAQCWDPQMLGLLKRNHIQATGSSKRRKQFRVGDDGKILFDEEELKMILGFNRGEDYIEVLCGTTNKVYGDYVGRLKINNNGEYFITCECCPGCPLVNVTPEAFEKHALKEGTGRWKSNIWVHCEDEDRVPLWKTPLTKYYTHQANVANWKDSAMRKRNFHRDEFLHCTSCRKERRFRLKSRPDIKNYHEALNNKSWTCSLWPYHKITCDDDEERPSLRASRGCSRSSTCQGCSTCYCEGCIKCRFEDCNCQECRDFMLYAEP

SEQ ID NO: 159266 - protein, 200 aa, Glycine max
  Coding DNA Sequence Number=SeqID_42488
MAQTSGDGPTYVVSSSRRSFVNNKKSKIPAAQLDNWYGEFLESIEPSMVKQIPFCEAVQRSSPVGQIFADMKPSWMGIQLSFRGMDLLESHLLYFATKNQRNTRIENNPRFTKLRILLWKIQLRVIKFQQIQSQNNKSISEQVTKALETNNNPFLFHDVIMNSSYMGTKKMSSFNNLDGGADTIYRIWSVCHLYFHHTGY

SEQ ID NO: 159267 - protein, 114 aa, Glycine max
  Coding DNA Sequence Number=SeqID_42489
MPKGLYNVIYCEFFVKNWKDIGVAVSPVFRTGCGCYTMIGPVDANIKQRKVYNGRKRVGPTELTRPKEGSKPEAKILFYDTLESDLSLPPPWLRRDFSQIIPTTDLSLITSSAK

SEQ ID NO: 159268 - protein, 58 aa, Glycine max
  Coding DNA Sequence Number=SeqID_42490
  Subcellular localization annotation: CTP_CleavageSite=29; ConfidenceScore=5.08e-01
MRRAQGHGDGGGSMATRPDLPKQQFLRPSSATKVPMSTAKATLTAQPMYDIWRGKFKK

SEQ ID NO: 159269 - protein, 65 aa, Glycine max
  Coding DNA Sequence Number=SeqID_42491
MQDIYILNIAANVYIFRNNQIFKRISHNWLSTLTKYSQDTLMNISVGTSANTKAEVLLSNWSPHE

SEQ ID NO: 159270 - protein, 177 aa, Glycine max
  Coding DNA Sequence Number=SeqID_42492
  Gene Ontology: Mol. function=endonuclease activity
  Homolog annotation: Hit_ID=Q9FHU7; Match level="QueryCoverage=96%, HitCoverage=19%, E-value=7e-16, Identity=32%"; Hit description =Similarity to nonsense-mediated mRNA decay trans-acting factors
MGSPWDRKDKIFGHTTFALLKMKYRVLVCAPTNIAIKEVASRVVTLVKESHAKESGDLFCSMGDLLLSGNNERLKIGEDIKDIYLDHLAQQLAECLAPSTGLSSCLKSMIGFLENCTSYYHIVKDEYELGKRKRLEMLFTYPELPEILSWSFDYAIYQLHKKRAECLTALITVKGFT

SEQ ID NO: 159271 - protein, 153 aa, Glycine max
  Coding DNA Sequence Number=SeqID_42493
  Gene Ontology: Mol. function=sulfotransferase activity; Cellular component=membrane; Biological process=chromatin silencing at silent mating-type cassette
  Homolog annotation: Hit_ID=Q8LNN4; Match level="QueryCoverage=83%, HitCoverage=9%, E-value=3e-31, Identity=49%"; Hit description =Putative helicase
MSPYAGQVTAIQENLGKMYDRHNHDGFNVNVKSIDGFQGGEQDVIILSTVRTNNRASLEFIASLQRTNVALTRARHCLWILGNERALTSNENVWKAIVLDAKSRKCFFNVDRDNEMTKAILDAMKESDQFDDLLDTNSVHFKNAFWKICGSWT

SEQ ID NO: 159272 - protein, 504 aa, Glycine max
  Coding DNA Sequence Number=SeqID_42494
  Gene Ontology: Mol. function=transcription regulator activity; Cellular component=nucleus; Biological process=regulation of transcription, DNA-dependent
  Homolog annotation: Hit_ID=Q9LSE2; Match level="QueryCoverage=59%, HitCoverage=57%, E-value=8e-97, Identity=64%"; Hit description =Transcription factor ICE1
  Pfam annotation: Domain name=HLH; Domain location=316-363; Score =36.8; E_value=7.6e-08; Accession=PF00010.16; Description=Helix-loop -helix DNA-binding domain
MTWLKALYVIREKRWLVVEGTNSPKQKKASLRRSEAKQNKKSMMSRINNNGVAWMGEREDENSRNHNIIPTDTTTTNTGFVETTNNDLGSLCAFKPMLDVDDEWYNNITNHHHHHHHHHDMTFDPDNLLLHAATAVDSSSSCSPYFFPPNPKPPFLVNPFDMGFLDPQASSSPSLPLLPESTHFTPPHTTTTAFAGFQSRLQESGSSKSLFLRPLESLPPSGAQPTLFQKRAALRKNMEGSDNNKKKRKEKEKDEEVEDLSFDGSGLNYDSDDLTESNYNNVSEGNTGKNGGVSSNANSTVITGLDQKGKKKGMPAKNLMAERRRRKKLNDRLYMLRSVVPKISKMDRASILGDAIEYLKELLQRINDLHNELESTPVGSSLTPVSSFHPLTPTPPTLPSRIKEELCPSSLPSPNGQPARVEVRLREGRAVNIHMFCARKPSLLLSTMRALDNLGLDIQQAVISCFNGFAMDIFRAEQCKEGQDVHPEQIKAVLLDSAGYNGMM

SEQ ID NO: 159273 - protein, 437 aa, Glycine max
  Coding DNA Sequence Number=SeqID_42495
  Gene Ontology: Mol. function=protein dimerization activity; Cellular component=nucleus; Biological process=regulation of transcription, DNA-dependent
  Homolog annotation: Hit_ID=Q94JM3; Match level="QueryCoverage=100%, HitCoverage=49%, E-value=0.0, Identity=72%"; Hit description=Auxin response factor 2
  Pfam annotation: Domain name=Auxin_resp; Domain location=303-385; Score=198.6; E_value=1.4e-56; Accession=PF06507.4; Description=Auxin response factor
  Pfam annotation: Domain name=B3; Domain location=176-281; Score =110.7; E_value=4.4e-30; Accession=PF02362.12; Description=B3 DNA binding domain
  Pfam module annotation: Pfam domain module=Auxin_resp::B3; Domain location=303-385::176-281
MASSEVTMKGNCLNHNDGGATEPHSPSTAKDAEAALFRELWHACAGPLVTVPREKERVFYFPQGHIEQVEASTNQVADQHMPVYDLPPKILCRVINVQLKVVLVRSVSLFFVINKKISHAFEQSNPQKEHASFFQAEPDTDEVFAQVTLLPEPNQDENAVEKEPPPPPPPRFHVHSFCKTLTASDTSTHGGFSVLRRHADECLPPLDMSKQPPTQELVAKDLHANEWRFKHIFRGQPRRHLLQSGWSVFVSSKRLVAGDAFIFLRGENGELRVGVRRAMRQQGNVPSSVISSHSMHLGVLATAWHAILTGTIFTVYYKPRTSPAEFIVPYDQYMESLKNSYSIGMRFKMRFEGEEAPEQRFTGTVVGIEDSDPKRWRDSKWRCLKVRWDETSNTPRPERVSPWKIEPALAPPALNPLSMPRPKRPRSNAVPSSPDSS

SEQ ID NO: 159274 - protein, 55 aa, Glycine max
  Coding DNA Sequence Number=SeqID_42496
MVSFGSTKRVAARTEQTIQFPFVHVTNSTNIFTPYAAVIGVDGGGGGDGVVLLWP

SEQ ID NO: 159275 - protein, 543 aa, Glycine max
  Coding DNA Sequence Number=SeqID_42497
  Gene Ontology: Mol. function=zinc ion binding
  Homolog annotation: Hit_ID=Q1SM34; Match level="QueryCoverage=98%, HitCoverage=100%, E-value=1e-160, Identity=56%"; Hit description =Zinc finger, RING-type; RINGv
  Pfam annotation: Domain name=PHD; Domain location=489-533; Score= -1.0; E_value=0.072; Accession=PF00628.19; Description=PHD-finger
  Pfam annotation: Domain name=zf-C3HC4; Domain location=490-530; Score= 29.4; E_value=1.2e-05; Accession=PF00097.15; Description=Zinc finger, C3HC4 type (RING finger)
  Pfam module annotation: Pfam domain module=PHD::zf-C3HC4; Domain location=489-533::490-530
MGFEANKQLMDEYSGKRGVDGMVFPRKGMSHVFRDTANTRDRNRQICSRLGCSSRANLPKVAQVRCSEKGKSLRPSYQSSSSSKGAIGSSSRTTSNPAKRLLEPRKTLSSQFEADSSETSSVQDGPEFSELIPPTEEIRRGPLAEGENTESSNAILMEVGSSSAVSNTRSQRNLNQRAGLRGQEIKSTGAVRQAVSSSYGLRNLKCNSISDVVRSGCSSSDSSLNRRKDTIKKGNCEGGDSSTGRGKNITGSSLEGRNFGSRNGISISNSRRSRNIPSHRNTSVASVRTPRSISGQARARFSSQGNENPLPTSESPVIVPLSPHSGDLNAPGFSYHTSMETPLSGSSSYGRPGNSSEQLSGVMPVSPAEDDITHSLINRDSFGHYNMGGIAEVLLALERIEQDAELTHEQILLLETNLFLNGLNFYDHHRGMRLDIDNMSYEELLALEERMGTVSTALPEEAFAECLKRSIYQSAYTHECCNEDKDDIKCCICQEEYVVGDEVGDLQCEHRFHVVCIQEWLRHKNWCPICKVSAAMSNSSSPH

SEQ ID NO: 159276 - protein, 156 aa, Glycine max
  Coding DNA Sequence Number=SeqID_42498
MDAPTQQHPPPTLIASKVPGIESDDDRPLVFKKRKVAPPSFETYVPQVKKDPPTGIEVPPPPTWKRLHPKVSKPSSPTIKHKIIYKIPSRACREKVSYDKDTIGWFHKIDAQQFDPSSDDFLPPFLCTKHVQLFTPMSKFVPLDYGHQALPFTKDD

SEQ ID NO: 159277 - protein, 210 aa, Glycine max
  Coding DNA Sequence Number=SeqID_42499
MSVKGSLSRELVGSESKVLGFDNKVFDVSFCPMWLKKVRESIAVLVVAAAIEAGKSFQPRRRPVLKEKCLPPPITLPEYTKDHRGKQKHKKQSHQDHRSGLGEYFEHSEGTSRDKRLKQSTLEIQPSIVSTLGNLVALTNQSFFNNNFQLDRLVQSKMILEDGHQGSSNTEGLKDQLLKAKDSMNMALRANMKLAGDNYNLGQISASEFQ

SEQ ID NO: 159278 - protein, 293 aa, Glycine max
  Coding DNA Sequence Number=SeqID_42500
HTEPAAPTSAPWSHLGRPSTDARVPNLLLPDVDDLASGTPVPVPVDEEELGRWVTDPTISVIDLTDAPVSQYIPPKPKPADPGVPGPGPDDGEQPTLSPGVTSPVDATVYVAPLITGQTAPGNAVAIDFASQRYAIDVASDGSWSFDTRALAFDPGSYDYSVWAFTPTQQSLATTGTIVLQAPTVQGFEQIDGPIPLDEARTTGVVISITGPPNGTVWVSTPKTDATITLDDAGHAIRRIRMLADGWYPFGIAVIDAEWYAGPGFGATVDVLDADRDPTLPRGSGGVFEIVDP

SEQ ID NO: 159279 - protein, 54 aa, Glycine max
  Coding DNA Sequence Number=SeqID_42501
DSIENIIDVKADGGCGYCAIATLLGYHREVDEYYGYEVFFMRSLSFTTIGVVME

SEQ ID NO: 159280 - protein, 221 aa, Glycine max
  Coding DNA Sequence Number=SeqID_42502
  Gene Ontology: Mol. function=protein kinase activity; Cellular component=cell surface; Biological process=protein amino acid phosphorylation
  Homolog annotation: Hit_ID=Q1S8T9; Match level="QueryCoverage=85%, HitCoverage=29%, E-value=1e-65, Identity=65%"; Hit description =Protein kinase
  Pfam annotation: Domain name=Pkinase; Domain location=3-199; Score =29.0; E_value=2.7e-10; Accession=PF00069.15; Description=Protein kinase domain
  Pfam annotation: Domain name=Pkinase_Tyr; Domain location=5-199; Score=-47.1; E_value=1.4e-09; Accession=PF07714.7; Description =Protein tyrosine kinase
  Pfam module annotation: Pfam domain module=Pkinase::Pkinase_Tyr; Domain location=3-199::5-199
MAGGFKDKLGEGGYGSVFKGKLRSGSCVAIKMLVARGIAYLHYGCEMQILHFDIKPHNILLDENFTPKVSDFGLAKLYPIDNSIVPRTAARGTIGYMAPELFYNNIGGISHKADVYSYGMLLMEMASKRKNLNPHAERSSQLFFPFWIYNHIGDEEDIEMEDVTEEEKKMIKKMIIVALWCIQLKPNDRPSMNKVVEMLEGDIENLEIPPKPTLYPSETIT

SEQ ID NO: 159281 - protein, 93 aa, Glycine max
  Coding DNA Sequence Number=SeqID_42503
MKNKALFRLLVILLALFFVVFVAAVPATRSSMIGKIDPLVQDHLAKEDLVMWLRNSEDEMKEGTLETRMLMDVVDYPGTRPNPAHYPKSPGKP

SEQ ID NO: 159282 - protein, 308 aa, Glycine max
  Coding DNA Sequence Number=SeqID_42504
  Gene Ontology: Mol. function=protein serine/threonine kinase activity; Biological process=protein amino acid phosphorylation
  Homolog annotation: Hit_ID=Q1S8T0; Match level="QueryCoverage=83%, HitCoverage=41%, E-value=1e-19, Identity=31%"; Hit description =Protein kinase
MTEPPSVLPLQIMIILLLIKSGSSNNECGEWSCGSGQPPIRFPVKLIKGIKDECGYPGFCLYCTQKHETMLVLSSVKLQVSYINYENHEIVLNDPENCLPHKFLQINDSLIHPYKFDDEAKTSKLSFFNCSSVEHQHLRNYQQSLSDSQDMISCPIYVSDLHDSVLSLDLTSCTKMFDIVTPVSAYGMQRNSLDLRWSEANCSQCKAKGKKCKWKNNRGDIECFDCKDKRKTIHVPKSFIYSAPGSILLGFAVIVVFKIIYHFRQKQEDQARVEKFLEEYRAEKPARFTYAGLIYLFDKNSCMTYIPF

SEQ ID NO: 159283 - protein, 213 aa, Glycine max
  Coding DNA Sequence Number=SeqID_42505
MSANIAGEEEADDVHANRKWLHHPVLLFLLLLRTRKATRLRSLATKPVRIERPLVHVDPTIGKTDGPHKKKNWKQVPVAQKDLIWEDIKAEFDILEASDVRIEKKILQTVGEQWRQFKSDLTSKWVLAANKDSVNDTVCEKYGINNEKWTQFCQSHRDPSWEDMRKKAQAIQKQNTAPHMLSRGGYEYLEKKLMDEKKKRNLEEAAQSESTDT

SEQ ID NO: 159284 - protein, 95 aa, Glycine max
  Coding DNA Sequence Number=SeqID_42506
  Subcellular localization annotation: CTP_CleavageSite=31; ConfidenceScore=5.29e-01
MGMSPPPLGPLNHSQTQLTLSRRLPFPAQVSADLHSTKSLKLSGIWTSLSRTEDMQELLKKNGQTPPLNLISGLNKWFCSCSYAYRNSDPLSAHY

SEQ ID NO: 159285 - protein, 724 aa, Glycine max
  Coding DNA Sequence Number=SeqID_42507
  Gene Ontology: Mol. function=oxidoreductase activity; Cellular component=nucleus; Biological process=electron transport
  Homolog annotation: Hit_ID=Q9LID0; Match level="QueryCoverage=95%, HitCoverage=97%, E-value=0.0, Identity=58%"; Hit description =Similarity to amine oxidase
  Pfam annotation: Domain name=Amino_oxidase; Domain location=170-550; Score=197.1; E_value=4.2e-56; Accession=PF01593.14; Description =Flavin containing amine oxidoreductase
  Pfam annotation: Domain name=DAO; Domain location=162-530; Score= -21.1; E_value=0.00013; Accession=PF01266.14; Description=FAD dependent oxidoreductase
  Pfam annotation: Domain name=SWIRM; Domain location=52-145; Score =79.2; E_value=1.3e-20; Accession=PF04433.7; Description=SWIRM domain
  Pfam module annotation: Pfam domain module=Amino_oxidase::DAO::SWIRM; Domain location=170-550::162-530::52-145
METPSSNGSVSKRSLRRKVNLRNYDEDLMDEMFEKQLGGGLKKRSRTKEDLEKETETEAMIAMSLGFPIDALLEEEIKAGVVRELGGKEQNDYIVIRNHILALWRRGNVRLWLSKGMVRETVSNEYDHLINSAYDYLLYNGYINFGVSPAFTSQLPESTEGTAVVIGAGLAGLAAARQLLSFGYKVVVLEGRSRPGGRVYTQKVGREGKFASIDLGGSIITGIHANPLGVLARQLSIPLHKVRDDCPLYKPNGAPVDKETDASVEFVFNKLLDKVMELRQIMGGFASDTSLGSVLEMLRRLYNVTRSTDEKQLLDWHLANLEYANAGCLSNLSAAYWDQDDPYEMSGDHCFLAGGNMGLIKALCEGVPVFYGKTVNTIRYGNEGVEVIAGEHVFQADIALCTVPLGVLKKKAISFEPELPAGNWKQLRGWVSGGPALIALVAGEAAQAFESTDASILLHRVLTVLKGIFHPKGIIVPDPIQSICTRWGSDPLSYGSYSHVSVNSSGADYDILAENVGNRLFFAGEATSRQYPATMHGAFLSGLREASHIYRSARIQNNPRKCMPKNIVSNDILGDLFKWPDLEFGKFAFIFYPSPENLQSTGLLQVTIGDAEEIYEELFSSYPNAAKWPLQLYTIISREQAQQLQKVEGGNESLLSFLVKTLGLKLMGPNALLTAGNTLIASIAHSRKGRLDWRDDSISEGNLQSHFEMFLLADHSVIEPRKIS

SEQ ID NO: 159286 - protein, 226 aa, Glycine max
  Coding DNA Sequence Number=SeqID_42508
  Homolog annotation: Hit_ID=Q1SZ89; Match level="QueryCoverage=29%, HitCoverage=25%, E-value=2e-07, Identity=43%"; Hit description=WRKY DNA-binding domain, putative
VKNLHFEGIDRKSFDDGFKNNLVEVEKKEAEITHMEGKVAKQEQPLAKKAEKLKEKEIEYLPMTEENNTLRMMLQVLSSKYTKLETHLQEINKTQHKDMSSNEIGLVTVPPMFHTNNRARVDFTSWITTLTSSLEITLMETCSLNATQCCVIELGLSTLPISRPELGFEVETVAMGRFAAPDFDGHNMHELEVQGKARIRDTMCVTLTERMLELQQKFAETMTEEF

SEQ ID NO: 159287 - protein, 97 aa, Glycine max
  Coding DNA Sequence Number=SeqID_42509
EGEGGEIIREDYKSENKNNGEEAIEEQKEAVEKVEENKVEATPSKQQSGERRHGKMEAQVSNDEIEKTAKLLEARKNKVRALAGAFQTVIDHQTTSK

SEQ ID NO: 159288 - protein, 96 aa, Glycine max
  Coding DNA Sequence Number=SeqID_42510
MYCKEGPTTRKGGTKTEQGSSWSDAAFITQQFFLKATCQLEWRVFSLQRANSNGDFLHLTCSPATLQTSPLAYAWNSPVKLATPLAWPNRQWGWRH

SEQ ID NO: 159289 - protein, 72 aa, Glycine max
  Coding DNA Sequence Number=SeqID_42511
  Subcellular localization annotation: CTP_CleavageSite=29; ConfidenceScore=5.11e-01
MSGLKLQDLRTKQTKQEYFFLSSPQARPRAKGVLSTIPTQERIALSEPSCRGSCAEREFARRVGKVDSRLAR

SEQ ID NO: 159290 - protein, 76 aa, Glycine max
  Coding DNA Sequence Number=SeqID_42512
MEKSDKKNFKDKKEEKAYITWEDDDMDLSSDSEIEIINLGLMAKDYESGEEGEATQGVFKVCKGFIEIVKNLKWVA

SEQ ID NO: 159291 - protein, 203 aa, Glycine max
  Coding DNA Sequence Number=SeqID_42513
  Gene Ontology: Mol. function=nucleic acid binding; Biological process= DNA integration
  Homolog annotation: Hit_ID=Q1S4N1; Match level="QueryCoverage=52%, HitCoverage=9%, E-value=1e-25, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGHEAVICKNRNQSHREAAKGVNPEEEYLFTATCFSNIESNQNWLLDSGCTNHMTNNKDLFKELSNISTLKGTVAISINRGTKLISDVLYVPKIDQNLLSVGKLVEKEENATELSHKRQKDEEKQANSKIAVPKSQSSSTEEKCAAIAQEHTNKKIHLREKDGRIELNKRCLKSLTKNLKAQNDKAQSHVKEAIAFQQCKSTG

SEQ ID NO: 159292 - protein, 449 aa, Glycine max
  Coding DNA Sequence Number=SeqID_42514
  Gene Ontology: Biological process=regulation of GTPase activity
  Homolog annotation: Hit_ID=Q1SD19; Match level="QueryCoverage=96%, HitCoverage=60%, E-value=1e-119, Identity=55%"; Hit description=Arf GTPase activating protein
MRTASSSSLASSNGTPAEVKLETIKSLIDFDDDPEPPVASAAPQAQQTTVAQHGMPANSNDNNWASFDVAPEAKAPQGPSNVNPLESMLTQLSVPVSLPSHVSGAQGDSRVATANSGSCVTILLIFNDPSVSPAGLVMGSALTATAAGTPIISSFSTFPASGASVTSFGLTPASTHNNAGQWATLQYQQQQPLFTAAASQPTIQQSTSPVGGALNNQPWTVPLVQGNPSTPMPHTSHLVPKPANEAKSRVVLQPSTADIKPSGRSELPEDLFTVKYSPFPAPVPGWQMGPPPSMGISIQYNNVVPMPNYAQPSKSTNPFDVSNEPTPVQASTFPSMSSLQGALPSVTPSATMHPSNMGNISHAWNPPSSSSYVSPPQVQTLAPAMGPGAYMGQQMATNMPMPRHQGIGSFATEATAFGFSNPDQQLTGKMKGKICLGGEGEITETLLWR

SEQ ID NO: 159293 - protein, 48 aa, Glycine max
  Coding DNA Sequence Number=SeqID_42515
MAKFSAQEVSALQEGGNQELLLLAGNSKTESEKLIRHVQQHSSLPWRL

SEQ ID NO: 159294 - protein, 434 aa, Glycine max
  Coding DNA Sequence Number=SeqID_42516
  Gene Ontology: Mol. function=heat shock protein binding; Cellular component=integral to membrane; Biological process=protein folding
  Homolog annotation: Hit_ID=Q8LQ03; Match level="QueryCoverage=50%, HitCoverage=61%, E-value=2e-42, Identity=34%"; Hit description=DNAJ heat shock N-terminal domain-containing protein-like
MALNSCLGKCYSNGCWDMHPIPEAKENMEELNLNQKKVEALQEKWVAAIFMHNEDYTDARNKLLSAQLLYPQLDNINLMLTICNILLFASSVRLSNNDIDFHCILDLIHPSATYSAAINSLHDFVTSVSGVKDEFPGAESALEIVQSALNMLSDRGKHLHDGFSHGKDPISSIEIVSASTSERWCSDNSSDPDDVPFEDRILEESIEGDDISQNILRGGKFLSADDFATGQVWAIYCGEDTMPRQYALVNSVVSDRQVWVTILEHEQLVGEDKNKWREDLPVACGTFKPGNGNVVLDMSQFSHLLKYEQGTTRPHYMIYPQEGEVWAMYKNWSRKWEHTDYENCQYWIVEIVSNFSGENGIEVAKLEEVHNWLTFFRRQRYEGVDLSRSICETELPSFSHQVVAYRVPGIEKYGIPEDSWHLEPNAIPIPKLNQ

SEQ ID NO: 159295 - protein, 488 aa, Glycine max
  Coding DNA Sequence Number=SeqID_42517
  Gene Ontology: Mol. function=binding; Cellular component=chloroplast thylakoid membrane; Biological process=metabolic process
  Homolog annotation: Hit_ID=Q69MJ7; Match level="QueryCoverage=81%, HitCoverage=65%, E-value=1e-117, Identity=55%"; Hit description =Pentatricopeptide (PPR) repeat-containing protein / CBS domain- containing protein-like
  Pfam annotation: Domain name=CBS; Domain location=341-478; Score =27.7; E_value=4.2e-05; Accession=PF00571.18; Description=CBS domain
  Pfam annotation: Domain name=PPR; Domain location=109-143; Score =33.7; E_value=6.6e-07; Accession=PF01535.11; Description=PPR repeat
  Pfam annotation: Domain name=PPR; Domain location=151-185; Score =18.6; E_value=0.023; Accession=PF01535.11; Description=PPR repeat
  Pfam annotation: Domain name=PPR; Domain location=187-220; Score =12.8; E_value=0.23; Accession=PF01535.11; Description=PPR repeat
  Pfam annotation: Domain name=PPR; Domain location=74-108; Score=32.5; E_value=1.5e-06; Accession=PF01535.11; Description=PPR repeat
  Pfam module annotation: Pfam domain module=CBS::PPR::PPR::PPR::PPR; Domain location=341-478::109-143::151-185::187-220::74-108
MHIKGLGEARRVDEAFELLETVENGTATGSPNLSAPLIFGLLNALIKTGDLRRANGLLARYGFVLREGGNFSVSVYNILMKGYINSGCPHTAINMLNEILRQGIMPDRLTYNTLILACVQSGKLDAAMQFFEEMKGKAQKFSNHDLFPDIVTYTTMLKGFGQTKDLATVLKIVLEMKSHRELYIDRTAYTAIIDAFLKCGSVKGALCIFGEILKQTGLNPELKPKPHLYLSLMRAFAFLGDYYLVKKLHKRIWPDSAGTILLVAQEEADHLLMEAALNAGQVNVAVKTLTEIVSKWKGISWTSRGGMVAYRIEALLGFSKSLFSPHLLPQVSPSEPVENYMIQFEATRPLQGSIKLRKVVMRFFYEAVVPIVDEWGSCTGLLHREDCIEARSVSFVDLQKIKAIPKVIELDAPLTTMMRSPPPTVTTSTSIGHVVDLILEKRYPMIIVVNYRNSYATTPYSSRAVGVFTSEQLSRFITPVSQVKGTDL

SEQ ID NO: 159296 - protein, 365 aa, Glycine max
  Coding DNA Sequence Number=SeqID_42518
  Gene Ontology: Mol. function=protein binding; Cellular component =cytoplasm; Biological process=regulation of GTPase activity
  Homolog annotation: Hit_ID=Q5W7F2; Match level="QueryCoverage=98%, HitCoverage=45%, E-value=1e-119, Identity=62%"; Hit description=ARF -GAP
MNGCGCSSSAWKRVQNRYARDVSSFTKDVENTRLGEAYDGDISIASALENFGGGHNDPLFVTLGGPVVTKFSIALREISTYKELLRSQAEHMLNDRLLNMLNVDILDVKEARRRFEKASLVHDQGREKFMSLRKSTRMDIATVVEEVSALHNVEAKKRFEFLEAVTGVMDAHLRYYRQGYQLLHEMEPFIIEVLAYTQKARESYNEKQISLCERMLEYKKHVNHESMLSLNGPYDSPCRDGQVQPFSRISNKVADAITESAENGKVQIIRQGFLSKRSTNLRGDWKRRYFVLDSRGMLYYFRKPWSGLHSGNQSSLHRNCATDNSAGIFSRLLSSHYHGFIPDEKFVARHTVNLLTSTIKIDAEQ

SEQ ID NO: 159297 - protein, 419 aa, Glycine max
  Coding DNA Sequence Number=SeqID_42519
  Gene Ontology: Cellular component=membrane; Biological process =transport
  Homolog annotation: Hit_ID=Q1SD20; Match level="QueryCoverage=75%, HitCoverage=100%, E-value=6e-63, Identity=75%"; Hit description=TMS membrane protein/tumour differentially expressed protein
  Pfam annotation: Domain name=Serinc; Domain location=19-281; Score= -228.1; E_value=5.1e-05; Accession=PF03348.6; Description=Serine incorporator (Serinc)
MEAGESNSGNERRIISKDSSWCSQFRNASNPWMARYAYALIFLVANLLAWAARDYGRGALTEMKRFKGCNGGKDCLDAEGVLRIFYIIMFLSTARTSKLNNLRDTWHSGWWSVKIALWVVTTAIPFLLPTEFIQIYGRVFLLIQLISIISFITWLNECSESEKFASRCEPAGGNCIRKSDSATKTDWLSIISFVVAILAIVIATFSTGIDSKCFQFRKDDTAPAEDDVPYGYGFFHFVFATGAIALIHVIASSQDVITFILSADGQLMWAGPAPGSKYNSFHIILEQLRLNETILVFLDSVDADSPNHMEKQTNWFYLRTRRNTNHSSFDIFFKERSSDSSISQMQLGKRIAIEKSREFSGRNGSSSVDTRQKQWVCHKCIYTCWISITPVDIRSFPSNQPIILKKNTLFTCTCVNQGA

SEQ ID NO: 159298 - protein, 85 aa, Glycine max
  Coding DNA Sequence Number=SeqID_42520
  Gene Ontology: Mol. function=DNA-directed RNA polymerase activity; Cellular component=nucleus; Biological process=transcription
  Homolog annotation: Hit_ID=Q6ATY6; Match level="QueryCoverage=72%, HitCoverage=35%, E-value=7e-28, Identity=96%"; Hit description =Putative RNA polymerase II subunit 5
MGGVTEWLGTSSRQHIPLLLLIPDDMEFQSGDMPNYTTSDGSVKIQKDSEVRLKIIGTRVDATEIFCIGTIKDDFLGVINDPATV

SEQ ID NO: 159299 - protein, 349 aa, Glycine max
  Coding DNA Sequence Number=SeqID_42521
  Homolog annotation: Hit_ID=Q2R9D1; Match level="QueryCoverage=76%, HitCoverage=40%, E-value=2e-39, Identity=38%"; Hit description =Expressed protein
  Pfam annotation: Domain name=DUF616; Domain location=2-298; Score =542.6; E_value=4.1e-160; Accession=PF04765.4; Description=Protein of unknown function (DUF616)
MQGNADSFGGNLSSHLRFSYFDHQNDSREVPCGFLKKFPISDYDRISMEKCESVVVVSAIFNDHDKIRQPRGLGSQTLQNVCFFMFIDDITLKGLEYHGLISTKSSEYKIGVWRIVKVSKENLYQNPAMNGVIPKYLVHRLFPNSQFSIWIDAKLQLMVDPLLLIHSLVISQNADMAISKHPYFVHTMEEAMATARWKKWWDVNALKMQMEIYCENGLQPWSPGKLPYASDVPDSALILRKHGQSSNLFSCLIFNELEAFNPRDQLAFAFVRDHMKPKLKLNMFEVEVFEQVTMEYRHNLKPSSDVSIAKKFSMTRKTVRAEPDLLYENGSCCSRCQQYLTTMWGDSHQ

SEQ ID NO: 159300 - protein, 1007 aa, Glycine max
  Coding DNA Sequence Number=SeqID_42522
  Gene Ontology: Mol. function=hydrolase activity, acting on glycosyl bonds; Cellular component=lysosome; Biological process=carbohydrate metabolic process
  Homolog annotation: Hit_ID=Q9FFX7; Match level="QueryCoverage=97%, HitCoverage=96%, E-value=0.0, Identity=64%"; Hit description=Alpha -mannosidase
  Pfam annotation: Domain name=Alpha-mann_mid; Domain location=365-439; Score=102.5; E_value=1.3e-27; Accession=PF09261.1; Description=Alpha mannosidase, middle domain
  Pfam annotation: Domain name=Glyco_hydro_38; Domain location=41-361; Score=477.5; E_value=1.6e-140; Accession=PF01074.12; Description =Glycosyl hydrolases family 38
  Pfam annotation: Domain name=Glyco_hydro_38C; Domain location=507 -1002; Score=417.6; E_value=1.7e-122; Accession=PF07748.3; Description=Glycosyl hydrolases family 38 C-termi
  Pfam module annotation: Pfam domain module=Alpha-mann_mid::Glyco _hydro_38::Glyco_hydro_38C; Domain location=365-439::41-361::507-1002
MENTGLCVLCFILLLLGCVISSECKYIRYNTTSTIVPGKLNVHLVPHTHDDVGWLKTIDQYYVGSNNSIQFFTVGVVQGACVQNVLDSLVTALLADKNRKFIYVEQAFFQRWWREQSDDIQNIVKELVNSGQLEFINGGFCMHDEAATHYIDMIDQTTLGHQFIKEEFGVTPRIGWQIDPFGHSAVQAYLLGAEVGFDSLFFARIDYQDRAKRKDEKTLEVVWRGSKSFGSSSQIFSGAFPENYEPPSSFYYEVNDDSPIVQDDVSLFDYNVPERVNEFVAAAISQANITRTNHIMWTMGTDFKYQYAQTWFRQLDKFIHYVNQDGRVHALYSTPSIYTDAKHAAKEAWPIKTDDFFPYADRVNAYWTGYFTSRPAIKGYVRFMSGYYLAARQLEYFKGKSPLCPKTDSLAEALAIAQHHDAVSGTEKQHVANDYAKRLSIGYTEAEKVVALSLACLTEGATKTGCKNPQTKFQQASSDVLSSTTCPLLNISYCPASEVDFSNGKNLVVVVYNALGWKREDIIRIPVVNENVVVRDSSGKNIQSQLVPILDDFRGLRNYHTVAYLGVSPTAKPKYWLAFAATVPPIGFSTYYVSYAKKEATISDRDTAYQPGNKSDTITVGLKNLNLVYSVKEGKLIQYINSRSKVNESLEQAYKFYAGYGNDGTETAQASGAYIFRPDGSPSPIKSNGKTTRLYKGKEHAEVEFIVGPIPIDDRVGKEIATEIKTNLASNKTFYTDSNGRDFIERVRDYREDWHLEVNQPVAGNYYPINLGIYLKDKSKEFSILVDRAVGGSSIIDGQLELMVHRRLLEDDSRGVAEALNETVCIHDNCTGLTVLGKYYFRIDPVGEGARWRRSFAQEIYSPLLLAFTEVGEGHWGDSHVTTFSAIDSSYNLPDNVAIITLQDLGDGRVLLRLAHLYEIDEDKYLSVKATVELKKVFPNKQINKITEVSLSANQERAEMERKRLVWQVKGSPPEPKVWRGGPVDPENLIVELAPMEIRTFIISFRH

SEQ ID NO: 159301 - protein, 288 aa, Glycine max
  Coding DNA Sequence Number=SeqID_42523
  Gene Ontology: Mol. function=protein kinase activity; Cellular component=cytoplasm; Biological process=regulation of progression through cell cycle
  Homolog annotation: Hit_ID=Q8W5S1; Match level="QueryCoverage=90%, HitCoverage=91%, E-value=2e-62, Identity=44%"; Hit description =Cyclin H
MADFQTSTHRAKWIFSPQQLVEKYRAANQRAKQILEKCGATLMEVDVDGSLSYPEPQMTAKDSAEKHSRTKPLTIEEEQCIKVFYENKLQEVCNNFRFPHKIQSLEFDLIVYAPYRSVEGFINDMEEFFNAGDNQLEMLKTLQETARFEVDKMMLTDAPLLFPPGQLALAALRNSNAFHRVIDFDSIFFDPNCSILFTLALNCSYLRGIFSRENSMHTMSELSESLDAIDSWVRKYKSPSEKELKHINRKLKSCWGHHSHDEGKKREKKSKHKSKKSSNEAQNMPSIA

SEQ ID NO: 159302 - protein, 165 aa, Glycine max
  Coding DNA Sequence Number=SeqID_42524
  Gene Ontology: Mol. function=cytochrome-c oxidase activity; Cellular component=integral to membrane; Biological process=electron transport
  Homolog annotation: Hit_ID=Q75HA3; Match level="QueryCoverage=67%, HitCoverage=42%, E-value=5e-46, Identity=71%"; Hit description =Expressed protein
  Pfam annotation: Domain name=DUF887; Domain location=1-158; Score =62.5; E_value=1.4e-15; Accession=PF05967.2; Description=Eukaryotic protein of unknown function (DUF887)
MREEFWELIGGAEVSVGYFIADLGTILWFFPALGGYEYVIHHLFSLVAVAYAMLTGEGQLYTFMVLISETTTPGINLRWYLDVAGMKKSKAYLINGVVIFISWLVARILLFIYMFYHVYLHFDEVADFDIQFLAFNDSKDVCTLFSWMINGLDHGSTYFFLSAKI

SEQ ID NO: 159303 - protein, 77 aa, Glycine max
  Coding DNA Sequence Number=SeqID_42525
MGTLAANEDIYSNISIVIFFLLAMFFFFWPTPARLCHVVVPPSGLALGGVKGRASFVEVSLLSCVIKVLLMHLGFYI

SEQ ID NO: 159304 - protein, 48 aa, Glycine max
  Coding DNA Sequence Number=SeqID_42526
MLNFQKLVKRIGRRDSAKDDQPSFQQILVINNVDIAEDKLDSFLGIVA

SEQ ID NO: 159305 - protein, 60 aa, Glycine max
  Coding DNA Sequence Number=SeqID_42527
MSVYSHTGIRDMQLWSMIGKHTAAGDKEHETGVHSQDTGVQLAGKSKRVTTRPSYLRYYI

SEQ ID NO: 159306 - protein, 57 aa, Glycine max
  Coding DNA Sequence Number=SeqID_42528
MGAKHLTRTKERSHVIKQRSPDEIRNEFVEESRTKAKRVRLILVRNHGLSIYSVQEH

SEQ ID NO: 159307 - protein, 89 aa, Glycine max
  Coding DNA Sequence Number=SeqID_42529
MDKVAKAYNASFVVSSSELGEYDSLMQNATQHFPSLRLPWYTTYTTTTSSKTKGQEVGCFSKKITTSNRITSGVIGVDTELLKWIQRLK

SEQ ID NO: 159308 - protein, 665 aa, Glycine max
  Coding DNA Sequence Number=SeqID_42530
  Homolog annotation: Hit_ID=Q9T0K5; Match level="QueryCoverage=48%, HitCoverage=42%, E-value=1e-141, Identity=74%"; Hit description =Extensin-like protein
  Pfam annotation: Domain name=LRRNT_2; Domain location=4-43; Score =25.4; E_value=0.0002; Accession=PF08263.3; Description=Leucine rich repeat N-terminal domain
  Pfam annotation: Domain name=LRR_1; Domain location=101-123; Score =7.7; E_value=11; Accession=PF00560.23; Description=Leucine Rich Repeat
  Pfam annotation: Domain name=LRR_1; Domain location=125-144; Score =10.5; E_value=3; Accession=PF00560.23; Description=Leucine Rich Repeat
  Pfam annotation: Domain name=LRR_1; Domain location=148-170; Score =4.5; E_value=41; Accession=PF00560.23; Description=Leucine Rich Repeat
  Pfam annotation: Domain name=LRR_1; Domain location=171-193; Score =5.2; E_value=31; Accession=PF00560.23; Description=Leucine Rich Repeat
  Pfam annotation: Domain name=LRR_1; Domain location=195-217; Score =5.9; E_value=23; Accession=PF00560.23; Description=Leucine Rich Repeat
  Pfam annotation: Domain name=LRR_1; Domain location=219-241; Score =8.9; E_value=6.2; Accession=PF00560.23; Description=Leucine Rich Repeat
  Pfam annotation: Domain name=LRR_1; Domain location=243-265; Score =12.9; E_value=1.1; Accession=PF00560.23; Description=Leucine Rich Repeat
  Pfam annotation: Domain name=LRR_1; Domain location=267-288; Score =0.1; E_value=2.7e+02; Accession=PF00560.23; Description=Leucine Rich Repeat
  Pfam annotation: Domain name=LRR_1; Domain location=53-75; Score=4.0; E_value=51; Accession=PF00560.23; Description=Leucine Rich Repeat
  Pfam annotation: Domain name=LRR_1; Domain location=77-99; Score=4.3; E_value=45; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1; Domain location=4- 43::101-123::125-144::148-170::171-193::195-217::219-241::243 -265::267-288::53-75::77-99
MTVLRNAYIALQAWKQAILSDPRNQTADWVGSDVCSYTGVYCAPALDIPKIRTVAGIDLNHCDIAGYLPEELGLLLDLALFHVNSNRFCGTVPHKFERLKLLYELDLSNNRFAGNFPEVVLRLPSLKFLDLRFNEFEGTVPRELFDKDLDAIFINDNRFVFDLPDNFGNSPVSVIVLANNRFHGCIPASLGNMSNLNEIILMNNAFRSCLPSEIGLLKNLTVFDVSFNQLLGPIPNAVGNAVSLEQLNVAHNLLSGQIPASICMLPHLQNFTYSFNFFTGEPPACLALPAFDDRVNCLPARPLQRPPAQCKSFLSKPVDCNSFKCKHFVPSPPSPSPFPSPTAPVTPSPSPSTPSPFPSPTTPVTPPSPSHSPPSPSTPSPTTPVTPSPSHSPPSPATPSPFPSPTTPVTPSPSHSPPSPATPSPFPSPTTPVTPSPSHSPPSPATPTTPVTPSPSHSPPSPATPSPFPSPTTPVTPSPSHSPPSPATPSPFPSPTTPVTPSPPSPSTPSPFPSPTTPVTPSPVHSPPSPVYLPPPHSSPTPPAHNYGSPPPHHSPAQPVYPYLSPPPPPSVHSSPPPPPPPPCIELPPPPPQSTPSPTPYLPPPSPSPPPPPPPVYHSPPPASPPPCETPPSVSPPPPPAPVYEGPLPPIVGLPYASPPPPPFY

SEQ ID NO: 159309 - protein, 41 aa, Glycine max
  Coding DNA Sequence Number=SeqID_42531
MRTRCTVNLKADEMIQLGVGATGQVSSAMFSGPNPRGERPQ

SEQ ID NO: 159310 - protein, 115 aa, Glycine max
  Coding DNA Sequence Number=SeqID_42532
  Gene Ontology: Mol. function=binding; Cellular component=membrane
  Homolog annotation: Hit_ID=Q6Z4S6; Match level="QueryCoverage=66%, HitCoverage=17%, E-value=5e-21, Identity=61%"; Hit description =Tetratricopeptide repeat-containing protein-like
GGVHYVKGNKAIKENDFGEAADNFSRAHEIRVAHYGELAPECVHTYYKYGCALLYKAQEDADPLADVPKKEDGSQHGSNKDVLSPIIVLLISERTSSKENGQASASDQDVAMINS

SEQ ID NO: 159311 - protein, 80 aa, Glycine max
  Coding DNA Sequence Number=SeqID_42533
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=50%, HitCoverage=4%, E-value=1e-14, Identity=95%"; Hit description =Kinesin-like protein
MLGPKYFNQPILEGFATKKPIVGMLDSLLPGPVTVVLKRGSEGHTLEEAKSINLSLSALGKCINALAENSAHVPFRDSAY

SEQ ID NO: 159312 - protein, 288 aa, Glycine max
  Coding DNA Sequence Number=SeqID_42534
MIVNQQVKVPFSIGTYKDEVNCDIIPMEARHIFLGRPWQFDRKIICNGLTNQITLTHLGTKFVLYPQTPSQVAKDQLTMKDKRDEEEKVENQKKKKDSVEEKISEFQESLDLWSNPFQGGGNYAIQPSPQRALDRRIQEDWARDAREDPKVLMSLRNRTRWRKRKRDSQISQRHQKQEEEEDDNDDENPNTEEDLAERDYDSEDQMHHNHLNLQPHVEKEILSDHDVHILQFLTSVLPGILQGDKSDSLLYGFVDNGKKICWNEDFHSKVRDFDRNGLNLNASKREEL

SEQ ID NO: 159313 - protein, 210 aa, Glycine max
  Coding DNA Sequence Number=SeqID_42535
  Homolog annotation: Hit_ID=Q1SAV4; Match level="QueryCoverage=40%, HitCoverage=21%, E-value=4e-26, Identity=62%"; Hit description =Integrase, catalytic region
MSTAYHPQTDDQTEVMSRVIEQYLREFVHRKLTTWRRFLMWAEWSYNTSSHSATGMSPYEIKFGKKPPHFPQYLAGVSNVEAVDTWISYSSPIIPHRSPRPGPLPYPKTLKTISPSSPLLRYSTLSGKASETTNSSLSWFSGQTTYNLEDEVVLHAQGNDTAENIIKKQTVELAEAEPKEAESPNSRAKMEESRPKRTITKPPYLWDFME

SEQ ID NO: 159314 - protein, 66 aa, Glycine max
  Coding DNA Sequence Number=SeqID_42536
MVFGSSYLLSLLILLKLQLRDERGREELTSERKKSHGEGVVARDAAERERERACDGVLRGRERARL

SEQ ID NO: 159315 - protein, 114 aa, Glycine max
  Coding DNA Sequence Number=SeqID_42537
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1SCC5; Match level="QueryCoverage=74%, HitCoverage=23%, E-value=6e-26, Identity=68%"; Hit description=2OG -Fe(II) oxygenase
MTYNIHSFSRKDTKENHVTENIVVKAMPIHLMTNDMFISVNHRVLVSHSPRISVASFFMNFTMPKCTSKIYGPIKELLSEENPPIYRDITMKDFLTHYYSKGLDGNSCLLPFRI

SEQ ID NO: 159316 - protein, 48 aa, Glycine max
  Coding DNA Sequence Number=SeqID_42538
MEEGNRKNYEREENSLRKSSQALGMYESASRLVTEVNLGLHIRALLAQ

SEQ ID NO: 159317 - protein, 379 aa, Glycine max
  Coding DNA Sequence Number=SeqID_42539
  Gene Ontology: Mol. function=oxidoreductase activity; Cellular component=proton-transporting two-sector ATPase complex; Biological process=ATP synthesis coupled proton transport
  Homolog annotation: Hit_ID=Q1SMV3; Match level="QueryCoverage=76%, HitCoverage=77%, E-value=1e-103, Identity=62%"; Hit description=2OG -Fe(II) oxygenase
  Pfam annotation: Domain name=2OG-FeII_Oxy; Domain location=223-306; Score=63.7; E_value=5.9e-16; Accession=PF03171.10; Description=2OG -Fe(II) oxygenase superfamily
MVVTTGTNELETSDGSTYDGRAERISFDDSKTGVKGLVDSGITKIPRMFHSGKLDLSETSLSASNIISIPIIDLQEVNKSSSLHAEVVDQIGSACRKWGFFQVMNHGVGVDVLDEMICGIRRFHEQDAEVRKTFYSRDSNKRVRYFSNGGLLRDLDQPANWRDTIAFVANPDPPNPEEIPATCRDIVAEYSKKVRALGVTILELLSEALGLDPSYLKKMDCSEALFIMGHYYPACPEPELTLGSTEHTDMDFMTILLQDQMGGLQVLHENQWINVSPVHGALIVNIGDLLQLTQPSDAKIAEWSMHQRKTVCEKRLGFSRCKSWHTICDTAENVIKKQTAELAEAEPKEAESPNSGAKMEESRPKRTITKPLYLRDFVE

SEQ ID NO: 159318 - protein, 118 aa, Glycine max
  Coding DNA Sequence Number=SeqID_42540
  Subcellular localization annotation: CTP_CleavageSite=55; ConfidenceScore=5.16e-01
MEKCIKTSLPNTNLSLTTHHVGSFVCKKQSLMVKTRKRRFNGDKQGRIMLVAHLCAFIAEGMNEFLNYDSCLPRVLQVEEIAFEHTFILMALSKPMAVDSTSPSFDGLASGCRDLCAS

SEQ ID NO: 159319 - protein, 500 aa, Glycine max
  Coding DNA Sequence Number=SeqID_42541
  Gene Ontology: Cellular component=microtubule; Biological process =microtubule cytoskeleton organization and biogenesis
  Homolog annotation: Hit_ID=Q6F379; Match level="QueryCoverage=67%, HitCoverage=67%, E-value=4e-37, Identity=31%"; Hit description =Expressed protein
  Pfam annotation: Domain name=Frigida; Domain location=94-364; Score =132.5; E_value=1.2e-36; Accession=PF07899.2; Description=Frigida -like protein
MATRVHQFFDELEAKKTILAKCTDLFTTLSTHFSSLQHSVAEKSQSLDSKLQSLDSLSKETLESLHRRETSIPERESSAAARIKEQREAALAELLRATPPPDPDLSATLKSLWRKMDAAALLRFVVSKRKESASLRAEIAAAMEEAVDPARLVVEAVEEFLKSKVAKSGVTDKRWACGLVIQALMVSSESREHSRKIVERAVAVVETWKEHLDGESESGAAEVVMFLQMVVCFGLRSRFDDDYLRNFVMQFASRRDMAKLAASLQFGDKIIESGLTERFPPIDLLKSYHRNYKKNVSAIFKKGNNNHATMDDSSTSELNSIKAIIKCVEDHKLESEFNLDNLRKRATLLEKAKAEKKKGSTSRSKPQNKRGSGSSSSRPAKSAKFNSAHSSSFSRRNLAPSLQPSPGARFSAPFNYPSQTIYNGATANPYAATYGTSHTQSPAGITQQHYSIPVDNLGPSGYRSSGSYSGQTSYGLYDYRNGAPPTYPPPYSVDETTYRG

SEQ ID NO: 159320 - protein, 118 aa, Glycine max
  Coding DNA Sequence Number=SeqID_42542
  Gene Ontology: Mol. function=structural constituent of ribosome; Cellular component=ribonucleoprotein complex; Biological process =translation
  Homolog annotation: Hit_ID=Q9M2F1; Match level="QueryCoverage=71%, HitCoverage=98%, E-value=3e-35, Identity=81%"; Hit description=40S ribosomal protein S27-2
  Pfam annotation: Domain name=Ribosomal_S27e; Domain location=62-116; Score=114.8; E_value=2.4e-31; Accession=PF01667.7; Description =Ribosomal protein S27
MVTLISLFLSLSLSLNSRIRSAIVSPIFHSSSHVLQNDIDLLNPPAELEKRKHKLKRLVQSPNSFFMDVKCQGCFNITTVFSHSQTVVVCGNCQTVLCQPTGGRARLTEGCSFRKKGD

SEQ ID NO: 159321 - protein, 241 aa, Glycine max
  Coding DNA Sequence Number=SeqID_42543
  Gene Ontology: Mol. function=ATPase activity, coupled to transmembrane movement of substances; Cellular component=integral to membrane; Biological process=transport
  Homolog annotation: Hit_ID=O23998; Match level="QueryCoverage=99%, HitCoverage=70%, E-value=3e-81, Identity=55%"; Hit description=P -glycoprotein homologue
  Pfam annotation: Domain name=ABC_tran; Domain location=33-217; Score =197.7; E_value=2.7e-56; Accession=PF00005.17; Description=ABC transporter
MSGKIELKNVDFAYPSRVGTPILRKFCLEVKPGKSVGLVGKSGCGKSTVIALIQRFYDVKRGSVKVDDVDIRELDIHWHRQHTALVSQEPVIYSGSIRDNILFGKQDATENEVVEAARAANAQEFISSLKDGYETECGERGVQLSGGQKQRIAIARAIIRNPKILLLDEATSALDVQSEQVVQEALDRTMVGRTTVVVAHRLNTIKELDSIAYVSEGKVLEQGTYAQLRHKRGAFFNLASH

SEQ ID NO: 159322 - protein, 57 aa, Glycine max
  Coding DNA Sequence Number=SeqID_42544
MALPSKAGKRLHLPCLKETCETQICDLADARPCLALKVYLSHCQHEVLMQCLALALQ

SEQ ID NO: 159323 - protein, 98 aa, Glycine max
  Coding DNA Sequence Number=SeqID_42545
  Subcellular localization annotation: CTP_CleavageSite=65; ConfidenceScore=5.87e-01
MAQSSSIVVTLRQHLFKRNLTSLTLPHSPSLPSFSFSLRTTPHTPLSLSASFSSHTSMAHTSLPSADAGMDAVQRRLMFEDESVPLLIHSFFNYFFFA

SEQ ID NO: 159324 - protein, 101 aa, Glycine max
  Coding DNA Sequence Number=SeqID_42546
MWTTTGEELATQLAQASKVASSRSNSLLEEESGRPNFRRSYENSRIAKNASFRFPSHHGIFTDRIANETFLQSRPEDADNSGKGADDDVCDCLLLGFESYG

SEQ ID NO: 159325 - protein, 301 aa, Glycine max
  Coding DNA Sequence Number=SeqID_42547
  Gene Ontology: Mol. function=RNA-directed DNA polymerase activity; Biological process=RNA-dependent DNA replication
  Homolog annotation: Hit_ID=Q8H6Q8; Match level="QueryCoverage=79%, HitCoverage=51%, E-value=5e-27, Identity=30%"; Hit description=CTV.20
LKKKLRNLNLEPAIEEQINNLLIETSEEETETSSSVLSDEDLNLIQQDDQLSSTDDDDGQINTLTREQDLLFEAINSIPDPQEKKVFLEKLKKTLEVKPRQKDFITNNKFDVSNILKRLENSSTKPTTIRDLQTEINNLKREVKELRQQQEIHQIILSQLEEESDSESANNNENNQPENLEDEMFIGLIKKIKIQKFYINIKIIINDFVLETMALFDTGADSNCIFEGLIPTKFFEKTSEKLSTANDSKLKINFKLSNAIIENQSLRINTNFLLVKNLKNEVILGTPSLEPCFPSKYLMKE

SEQ ID NO: 159326 - protein, 92 aa, Glycine max
  Coding DNA Sequence Number=SeqID_42548
  Gene Ontology: Mol. function=structural constituent of ribosome; Cellular component=intracellular; Biological process=translation
  Homolog annotation: Hit_ID=Q9M2F1; Match level="QueryCoverage=49%, HitCoverage=59%, E-value=7e-19, Identity=82%"; Hit description=40S ribosomal protein S27-2
  Pfam annotation: Domain name=Ribosomal_S27e; Domain location=47-90; Score=58.5; E_value=2.2e-14; Accession=PF01667.7; Description =Ribosomal protein S27
MSSPLEISEPIASTHTDDNEVKAMFHVTDEAGKKLTDETLMLHIQQDVKCQGCFNIHSQTVVVCGNCQTVLCQPTGGRARLTEGCSFRKKGD

SEQ ID NO: 159327 - protein, 134 aa, Glycine max
  Coding DNA Sequence Number=SeqID_42549
MSDTTFTEEEAERLLKECLNTNPRDTNAFHAQMQLTLMDEVSAEGGLIGQCAHSGDLRLALEHVAGRGEVLLAPCRNETRLSGSCRGGSRMKDWVGRRGRCTVRRMKSGLMKWWGPLLGAWKKRSRLSLKNIIS

SEQ ID NO: 159328 - protein, 861 aa, Glycine max
  Coding DNA Sequence Number=SeqID_42550
  Gene Ontology: Mol. function=ATPase activity, coupled to transmembrane movement of substances; Cellular component=integral to membrane; Biological process=transport
  Homolog annotation: Hit_ID=O23998; Match level="QueryCoverage=100%, HitCoverage=91%, E-value=0.0, Identity=54%"; Hit description=P -glycoprotein homologue
  Pfam annotation: Domain name=ABC_membrane; Domain location=1-216; Score=30.9; E_value=4.4e-06; Accession=PF00664.13; Description=ABC transporter transmembrane region
  Pfam annotation: Domain name=ABC_membrane; Domain location=550-830; Score=143.5; E_value=5.8e-40; Accession=PF00664.13; Description=ABC transporter transmembrane region
  Pfam annotation: Domain name=ABC_tran; Domain location=270-454; Score= 197.2; E_value=3.8e-56; Accession=PF00005.17; Description=ABC transporter
  Pfam module annotation: Pfam domain module=ABC_membrane::ABC _membrane::ABC_tran; Domain location=1-216::550-830::270-454
MAEGYCWSKTSERQVLRIRYKYLEAVLRQEVGFFDLQETTTSEIINSISKDTSLIQEVLSEKVPLFLMHSSSFISGVAFATYFSWRLALVAFPTLLLLIIPGMIYGKYLIYLSKSTLKEYGKANSIVEQALSSIKTVYSFTAEKRIMGRYSDILCKTSRLGIKQGIAKGIAVGSTGLSFAIWAFLAWYGSRLVMYKVVLPDLKYFTEASVAASRIFDMIDRTPLIDGEDTKGVVLESISGRLDFEHVKFTYPSRPDMVVLRDFNLQVEAGKTVALVGASGSGKSTAIALVQRFYDADEGVVRVDGVDIKSLQLKWMRGKMGLVSQEHAMFGTSIKENIMFGKPDATMDEIVAAASAANAHNFIRELPEGYETKIGERGALLSGGQKQRIAIARAIIKNPVILLLDEATSALDSESELLVQNALDQASMGRTTLVVAHKLSTIRNADLIAVVSGGCIIETGTHNELITKPNGHYAKLAKLQTQLSIDDQDQNPELGALSATRSSAGRPSTARSSPAIFPKSPLLDDQATPSQVSHPPPSFKRLLSLNAPEWKQGLIGTLSAIAFGSVQPLYALTIGGMISAFFAESHQEMRHRIRTYSLIFCSLSLASIILNLLQHYNFAYMGAKLTKRIRLGMLENILTFETAWFDEEQNSSGALCSRLSNEASMVKSLVADRLSLLVQTTSAVTIAMIIGLAVAWKLALVMIAVQPLTILCFYTRKVLLSTLSTKFVKAQNRSTQIAVEAVYNHRIVTSFGSITKVLWLFDEAQEAPRKEARKKSWLAGIGMGSAQCLTFMSWALDFWFGGTLVEKREISAGDVFKTFFVLVSTGKVIADAGSMTSDLAKSSTAVASVFEILDRKSLIPK

SEQ ID NO: 159329 - protein, 71 aa, Glycine max
  Coding DNA Sequence Number=SeqID_42551
  Gene Ontology: Mol. function=structural constituent of ribosome; Cellular component=ribonucleoprotein complex; Biological process =translation
  Homolog annotation: Hit_ID=Q250M5; Match level="QueryCoverage=95%, HitCoverage=47%, E-value=3e-13, Identity=57%"; Hit description=50S ribosomal protein L16
MGTSSGTPPSSHINLLGFITSCLVKGAPLPLPIHVSAGIAKTWLSRNIIIHTLPPRLMLLVKGGRAAGVCL

SEQ ID NO: 159330 - protein, 54 aa, Glycine max
  Coding DNA Sequence Number=SeqID_42552
MWGQTVEKMHGNIGGVLFWLRKEAWMQTDANRKKRNGPREHKGFSSEQLVWLDF

SEQ ID NO: 159331 - protein, 82 aa, Glycine max
  Coding DNA Sequence Number=SeqID_42553
  Gene Ontology: Mol. function=nucleotide binding; Cellular component =membrane; Biological process=small GTPase mediated signal transduction
  Homolog annotation: Hit_ID=P29687; Match level="QueryCoverage=98%, HitCoverage=41%, E-value=2e-17, Identity=55%"; Hit description=Ras -related protein Rab5
  Pfam annotation: Domain name=Ras; Domain location=1-56; Score=-68.8; E_value=0.00041; Accession=PF00071.12; Description=Ras family
MFLVANKADLEAERKVRYEEGEEYAKENGLSFLETSAKTAQNVNELFYEIAKRLAKANPSRQSGMKLHNRAGETRRGFFCCT

SEQ ID NO: 159332 - protein, 151 aa, Glycine max
  Coding DNA Sequence Number=SeqID_42554
  Gene Ontology: Mol. function=sugar porter activity; Cellular component=integral to membrane; Biological process=carbohydrate transport
  Homolog annotation: Hit_ID=Q39416; Match level="QueryCoverage=51%, HitCoverage=18%, E-value=2e-23, Identity=76%"; Hit description =Integral membrane protein
PRAVKHILVKPLLRDLNPYLPQTLATSSSGAHAMKTVSIIVSLCRDPLHEELLLSSSGISLKPVWLHVLGCGPVIDDCCDPQYNRDSSFLYMGMLLEGFGVGIISYVVPVYIAEIAPQNLRGGLGSLSVTISTMLAYLLGPFVNWRVLAIL

SEQ ID NO: 159333 - protein, 66 aa, Glycine max
  Coding DNA Sequence Number=SeqID_42555
MEDDEDFLEDDQEHHVDLVVPFRKSVKHIMRELPSFHLAYLISGALASASSFMKGVYIFFIFTFII

SEQ ID NO: 159334 - protein, 494 aa, Glycine max
  Coding DNA Sequence Number=SeqID_42556
  Gene Ontology: Mol. function=transferase activity; Cellular component= nucleus; Biological process=flavonoid biosynthetic process
  Homolog annotation: Hit_ID=Q1T1I0; Match level="QueryCoverage=90%, HitCoverage=96%, E-value=2e-96, Identity=44%"; Hit description =Transferase
  Pfam annotation: Domain name=Transferase; Domain location=47-493; Score=340.0; E_value=4e-99; Accession=PF02458.6; Description =Transferase family
MDCLANDTTKCMAKMYLLNRGGNVNYDMPVMLLYMVWSSRFGVAGVTMVSILSSYTVIPSEATPNCSLLLSESEQINAPTHSLTIYVYKPNHLNKIIPNMNMVDTMRDSLAKILVHYYPLAGRLRMIQGRRWEVECNAKGVILLEAESTRALNDYAIFEPNDTIKELIPKVDYTEPIENSPLFLVQLTRFSNGGFCVGIAISNIITDGISGTHFINLWATLARGDTLEEHDMPLLNKVVLQSSDKKPCFDHKEFKPLPLVLGHADTTEESKKETTVAMLKLSREMVEKLKKKANEGNQGRAYSRYESISAHIWRCVVKARDGYHNQPTVVHIIAGARNRLNPPLPLNYFGNATYPTVTPTCLSGDIVSKPLSYVAHKIREAIEVLTDEYLRSGFGFIRSQSDVGWLREKNDNEGKVESLFLGNPNLNIWSWMRNMPMYGPNFGWGRPVYMGPGVVKGDGRAFIMPGQEDGSVLVAIRLQSAHVEAFKEVFHKDM

SEQ ID NO: 159335 - protein, 205 aa, Glycine max
  Coding DNA Sequence Number=SeqID_42557
  Gene Ontology: Mol. function=ribonuclease H activity; Biological process=DNA integration
MVVTFALHGYHTSIRISICATPFSLVYGMEAVLPIEVEIPSLRVLMEAKLEEAKWVQSEFEKLNLIKEERLNAICHDQLYQKRLKKAFERKVHPREFQVEDSVLKKILLNKKDKLGKWTPNYEGSYAVKKKFSGGAFILTNMDGKELSYRDNLGKVEVTCQVERNILKKKVWNKKRGVCQTLTKGLASHVVRDFYTLEVEVDGRR

SEQ ID NO: 159336 - protein, 415 aa, Glycine max
  Coding DNA Sequence Number=SeqID_42558
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=97%, HitCoverage=96%, E-value=1e-160, Identity=66%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=34-415; Score=- 409.1; E_value=6.6e-05; Accession=PF00743.9; Description=Flavin -binding monooxygenase-like
MEYLKEVEGKSVHDYVEVKMGKMTKPISVAGPVIVGAGPSGLAAAACLKQKGIPSLILERADCLASMWQLKTYDRLCLHLPKQFCQLPLMPFPQNFPSYPTKQQFLAYLKAYADHFDIKPALSKTVISANFDHGCGYWRVKTQGLKKEETEYVCQWLIVATGENAEEVVPQIEGMSEFEGPILHTSSYKSGSMFGGKNVLVVGCGNSGMEVCLDLCNHDARPSLVVRDTVHILPQQMFGKSTFGLSMSLLKWFPMRLVDKFLLLMSHLILGDTAQFGLNRPKIGPLELKNLCGKTPVLDVGTLAHIKSGKIKVCRGIKQLAKHKVEFVDGKTENFDVIIMATGYKSNVPTWLKGSNMFCEKDGLPRKDFPNGWKGENGLYAVGFSKRGLLGASIHSKRTAEDIEHCWKAANTTRV

SEQ ID NO: 159337 - protein, 127 aa, Glycine max
  Coding DNA Sequence Number=SeqID_42559
  Pfam annotation: Domain name=DUF292; Domain location=20-124; Score =30.1; E_value=8.9e-08; Accession=PF03398.5; Description=Eukaryotic protein of unknown function, DUF292
MLDGILGRGFTAKCKSLIKLTNRRIDVIRRKRRATEKFLKKDIADLLLNGLDINAYGRAEGLVVELTLSSCYGFVENCCEFVLKHLPAMQKLRIMTYVVNLPVLFASNIIALAENQFYSEIRPLNWV

SEQ ID NO: 159338 - protein, 326 aa, Glycine max
  Coding DNA Sequence Number=SeqID_42560
  Homolog annotation: Hit_ID=Q10RR9; Match level="QueryCoverage=28%, HitCoverage=25%, E-value=3e-13, Identity=43%"; Hit description =Expressed protein
  Pfam annotation: Domain name=DUF677; Domain location=27-321; Score= -95.5; E_value=6e-06; Accession=PF05055.3; Description=Protein of unknown function (DUF677)
  Subcellular localization annotation: CTP_CleavageSite=44; ConfidenceScore=5.02e-01
MLKCISFKSSTSSSTIPNPSQEGTPSISREYNLAVHTTSYTEIRSNVEAQLHHLNPNRDRVQDALTLIPTRLTRLISTFFDHTETASDLCLHLHQCLLRARDLHAPLLDFFQTLNPTDPTQNDCVRALRLFHPFHAFQNPIPDSLTFSAIRSDLSALKTQLDRRVAKSLSRLRIVRRAVRGSALCLVAVAIAVVAATVAVTLHAVAALAAAGAVPVCAFEKKELAELRQLDAAAKCAYVLSNDLATIDALASRLRAAVEGDKVLVRLVLERGNERYLVEEVIKQLWKSHKGFLEQVEDLEEHIFLCFYNINKARFLVLQEITSNPA

SEQ ID NO: 159339 - protein, 47 aa, Glycine max
  Coding DNA Sequence Number=SeqID_42561
MTVGGHWYEDGHGVRPVLEWGLFYIGCDGTTDVECECSTSVLRVKPM

SEQ ID NO: 159340 - protein, 1004 aa, Glycine max
  Coding DNA Sequence Number=SeqID_42562
  Homolog annotation: Hit_ID=Q9FFY0; Match level="QueryCoverage=99%, HitCoverage=95%, E-value=1e-142, Identity=34%"; Hit description =Arabidopsis thaliana genomic DNA, chromosome 5, P1 clone:MAC12
MAADQRRKRVNGANIAGYGSREQHRIKRKNLGLVQNDLNMRPHISVEWDDNHKKVVAKREQIGISWRQMKPFINSVSNDHKILADVFSVPQEIFDLDNLSEVLSFEVWKTHLSENERNLLMNFLPCGFEPHQVVEELLTGINFNFGNPFSKWGASLCLGGLHPDMIVDQEQHLKTERREYHSHIHNYHNDMIGFLSKLKKSWQSCKDPEKEIAQKIWRSKHVEKRMPSKVIESRVYDHDGNVTGTSDSCSWDAEEKACSSDNQISSLRKDNKLQRRVLEKGIFKGKSQNLMDSLDNMPNVAEKPKTGDKLPKRSIHSSDSDKYMSCIKISRQQHELVKNMKQSGKSIQSRSLNRVLGNLEKIHVQPYNIFVKEEQKKLQEHWLLLVNKDLPVAYVNWTERQIQRHAVRNSLVAEMKDKSIPLIEGVNTGSELKDQVDVNSGSELKDHDDVNSGSELQDHDEEVNSGSELQDQDEDNISSGDKLKDQNEDNMSSEGELQDQNDDNLSSGSELQDQGEDNVNSGDELQDQVKDGGLSDQSDLKDDDDSISRSPENQSQHNSDVSGDNEFNQMSVDSEKNILLSKSTNNTSSGSGDHEFNQMSVDSEKNLLSKSNNTSSNKDEYSVHMNTQDVSIDEGAPFTSSGDVWQGVEMPHSYYDSAVTHEYAASGLSLANPQVSQEQPTRMIDLEADLRREETGKELLSRQLDNGTFSSYQSQDRSVLLQSLFKGEGLLPYHHDQKEAELDFQTSNNVMMGGGQFSSHFKEPLQTSLTLDQGRRRATEVYMPENMSENIYSDEGRYLIPRQDPLIPRQDPLIPTQDPLIPRQDPLIPRQDPLVPRQDPLAAVNMTDWAANNARIAGPSQSHLNTGDFIGHHWFPADHQVRGGGWNGSDGGGLSNQSLGPGASSDQSLFSILSECDQLHSGSLYDSVRNTDQFLAPRTYGLVDAGTPRVNTVAPPASRPLDYFTGREAPSGLVPDDMAWMSLPRQNSSIHDQMGKPYLRSWNR

SEQ ID NO: 159341 - protein, 144 aa, Glycine max
  Coding DNA Sequence Number=SeqID_42563
  Homolog annotation: Hit_ID=Q9FM77; Match level="QueryCoverage=93%, HitCoverage=42%, E-value=1e-31, Identity=52%"; Hit description =Arabidopsis thaliana genomic DNA, chromosome 5, P1 clone:MDF20
MAWKLLKDIPRSATRKAGRSMPTLVYVYCVSRTTFRGHMLGVAASWLVQVGIDLYRFFSSAFQGQHEDNDVDQTNQVGVLGQKVFIATVRCTSSLIFASIGAGIGATLIRPSLGQWVAMSDRATRKLVDLLLAERILTIFSHDG

SEQ ID NO: 159342 - protein, 293 aa, Glycine max
  Coding DNA Sequence Number=SeqID_42564
  Homolog annotation: Hit_ID=Q8GSM4; Match level="QueryCoverage=24%, HitCoverage=20%, E-value=5e-20, Identity=59%"; Hit description=Ovate protein
  Pfam annotation: Domain name=DUF623; Domain location=232-291; Score =101.9; E_value=1.9e-27; Accession=PF04844.4; Description=Protein of unknown function, DUF623
MENHNRLKLRISRMFRSSFGSCRTRNLTDVMEKTVFAPPSPIDEPPSPKTRPIFRPKTINDTCILSFKDSHSLPRRKISEWSSPFVVGGGNKIKNNNLNLNLGVMSCPPTSPNISLNTIHEHDFGYDDKKKVSTKNSRTNKKKKKKKKKRHAQKKREFFPFNSCAKDTNFGGYWWYSSDEDDETDTLFSSKSLSSDSSRSRRRRRNNERSSDMGVLPLNGKVKDTFAVVKRSSDPYSDFRTSMLEMIVEKQIFSPADLENLLQCFLSLNSHHHHKIIVHVFTEIWEALFSDWF

SEQ ID NO: 159343 - protein, 107 aa, Glycine max
  Coding DNA Sequence Number=SeqID_42565
MRFSISFHFIKQYCISLLMLVTLEAGEKVSRNSVRMCSHFSTIPSSRMWGPVRKQKVKKGNKGACEDKRAQKSKGSLCPKPKREFHPSFKRKKAKESFMAPLLLSSV

SEQ ID NO: 159344 - protein, 484 aa, Glycine max
  Coding DNA Sequence Number=SeqID_42566
MHITHLQKYRIFLRKVAEKGLLEGLSNRDLRSIFSSGLSLAMIKDFQATTAKTCVPVQQYMKRITHQSGYGGTGNAVKPYNYVSSVTNTPLGKCHQFPYIYHKGLNMMLHNQHDNYLNQARLGVQSSFGSNVGTNNIHQNMLGSYANQPYYAQSSYNNVGVVSPSDGVMRHDFMTSSNGLREGSLGNNQKFISDQGNRNTGSLNNSNTNLPWTNSTYNPSHNIQLNGGPQMVGNGIQGRFNSTIGIMDSVANNNSFGLINETSQNAKMWALLGQGNFGLAQGGFAFAFATSTGESSSSEVPETLITNNGTRAENISGNPQLPQQLHDNVAENYNGTSIGKGNVVHLEDDLSDLFTMLDEMDLLLTENPDTNEFLKSDFSSSTHVVQCLEQSNRASDMIVNPNETTLNLPYNSPTRSEKNSNQMGGDDRSVYMEPLDRFMMNDVSLASNSATDQGWDLKLIEALLLVTRLTRGNEKIAAISCSQQ

SEQ ID NO: 159345 - protein, 65 aa, Glycine max
  Coding DNA Sequence Number=SeqID_42567
  Subcellular localization annotation: CTP_CleavageSite=18; ConfidenceScore=5.18e-01
MARSRPKNNGTHFVAHVAANLEGSLLSPPPLRGGPTTPLPLMSLETQSLMTADPILPPIPFFPSE

SEQ ID NO: 159346 - protein, 98 aa, Glycine max
  Coding DNA Sequence Number=SeqID_42568
MEADFNENIYAVKTYRILYQFALLDSDAKFTINWNRLAVTSMFGFGFVGPVGHFWCVPVKCFLDSAFLSCLEQQKGAPLKKWFASFHSTITNEKGGGH

SEQ ID NO: 159347 - protein, 75 aa, Glycine max
  Coding DNA Sequence Number=SeqID_42569
  Subcellular localization annotation: CTP_CleavageSite=39; ConfidenceScore=5.07e-01
MMINPKACFSKHSQWPPKSFRLRQARELMLLLSFLGCLRLAPVSLVRFCYTWLNEDGVFVTHIFVSTGISLFPHS

SEQ ID NO: 159348 - protein, 74 aa, Glycine max
  Coding DNA Sequence Number=SeqID_42570
MAALALKPGEGESSWYNVSDIQGRIKAALALKPGEGESSWAATANVLRNSLKRYHHRQQTMYHGGKYYNICGLI

SEQ ID NO: 159349 - protein, 94 aa, Glycine max
  Coding DNA Sequence Number=SeqID_42571
MELEQKIFQGTDNCLNSYTTMLQKMIMTEENPNTHEFLKSDFSSSNHVVQYLEQSNRATDVIVNPTEGTSNMPNQTSISSDNNSNQKKKIDCAD

SEQ ID NO: 159350 - protein, 105 aa, Glycine max
  Coding DNA Sequence Number=SeqID_42572
MAQDIHLVRGNHILREANLQVANLLAKRGVELHDGVHVFHSPPTRNQLAMLADVSSVYFSLLNYKSQKRNQTHTCTSHTQFNFPVQCITGEREMPRAYIKDKDYD

SEQ ID NO: 159351 - protein, 61 aa, Glycine max
  Coding DNA Sequence Number=SeqID_42573
MAPLQWLPVELGSLESMMPLHSAVASARLVSSLSIESLGWGLVPQGYTISSALGYWKYLYL

SEQ ID NO: 159352 - protein, 142 aa, Glycine max
  Coding DNA Sequence Number=SeqID_42574
  Gene Ontology: Mol. function=oxidoreductase activity; Cellular component=intracellular; Biological process=electron transport
  Homolog annotation: Hit_ID=O24093; Match level="QueryCoverage=81%, HitCoverage=20%, E-value=9e-49, Identity=80%"; Hit description=L -ascorbate oxidase precursor
  Pfam annotation: Domain name=Cu-oxidase_3; Domain location=31-140; Score=119.1; E_value=1.2e-32; Accession=PF07732.5; Description =Multicopper oxidase
MGLKALFVWCIIWLGLAHLSLGGRVRHYKFDVEYMIRKPDCLEHVVMGINGQFPGPTIRAEVGDILDIALTNKLFTEGTVIHWHGIRQVGTPWADGTAAISQCAINPGEAFHYRFTVDRAFVISIVSYTEKTMLIDSPGRIL

SEQ ID NO: 159353 - protein, 94 aa, Glycine max
  Coding DNA Sequence Number=SeqID_42575
  Gene Ontology: Mol. function=serine carboxypeptidase activity; Biological process=proteolysis
  Homolog annotation: Hit_ID=Q6JJ33; Match level="QueryCoverage=68%, HitCoverage=19%, E-value=1e-17, Identity=48%"; Hit description =Putative serine carboxipeptidase
MVSTLRSKHGSEEWGFVQVRPSSSGVGFGNFKEIGPLDANLKPRNFTWLRKANMLFVDNPIGTGYNFVEDYEWLPNFCFMCIGSKKAIRYKITT

SEQ ID NO: 159354 - protein, 166 aa, Glycine max
  Coding DNA Sequence Number=SeqID_42576
MLESYANQPYNAESSYNNVGVVFSSNGAMGHGLMTSANGLRGVVNHGDNQLMYPNYGCRLWWESQIGSHHEKWSLRHSSLLNDSAKHQTKLFNTTFLDATPPRQCFTLNPSRFRRFSKTLTAFPGMDMTLSRSRRGGTTATIFTCQIAIFGAGTALEVVVTAFDCP

SEQ ID NO: 159355 - protein, 80 aa, Glycine max
  Coding DNA Sequence Number=SeqID_42577
MVGIGNGIQGGFNSTVGIMDSVANNNSFDMINETTQKANKNVAPLGQGNFDLAQGGFGSASTSGLNLAQLKLLTTHSISV

SEQ ID NO: 159356 - protein, 74 aa, Glycine max
  Coding DNA Sequence Number=SeqID_42578
MRDSSSACHKLASVADVMQCNWLVAYCMLKHLTKVLKLSMDHGESPLYQVNASPLRDIGKTPHRITLSLVYKFA

SEQ ID NO: 159357 - protein, 86 aa, Glycine max
  Coding DNA Sequence Number=SeqID_42579
MGYKQPWNAFKDSATSVPMDALNQGLQMHDLPSTDDHFFDLRASEGSNKGGMQGIVPVARFDHDLSLHFVSGLPCPPSAFAPMGEV

SEQ ID NO: 159358 - protein, 119 aa, Glycine max
  Coding DNA Sequence Number=SeqID_42580
MSLHHHHEVSIIITNFMAAPLIFYTGRHSKDLKYCLTLSNLTLIHSPALQGNKKPLNEFGAIVSMPHQKIKFPSLTGEMVTIKADQKQAQKCYAESLKVALYPPTREPVKPHLTSDNIT

SEQ ID NO: 159359 - protein, 175 aa, Glycine max
  Coding DNA Sequence Number=SeqID_42581
MGQQLFYIHFGGAIRSKLIHHHFHCLHLRTPERQANPSLSLLTYNALDKLATATTIAPLIWQYYSNSNLSLNFKAYISTSINTFLATSPQGLTSFTTPGWEDTKPDVEHSFMQQLVLFHSDGFARFIPCCADVDCYLSSTAKSKEQLLLQLQAYQVHYMSVTKEMDLLAFEGEDN

SEQ ID NO: 159360 - protein, 98 aa, Glycine max
  Coding DNA Sequence Number=SeqID_42582
MEVALAGLCLCHPSYLLDRFMLLWRLSITSRLIVSLSSLIFYSISSSVYVITPMMLLLVFSGSLSCLVVVQPFNELGWVSSLIWSSLTSVWVISSEVA

SEQ ID NO: 159361 - protein, 391 aa, Glycine max
  Coding DNA Sequence Number=SeqID_42583
  Gene Ontology: Biological process=regulation of transcription
  Homolog annotation: Hit_ID=Q1SWC6; Match level="QueryCoverage=81%, HitCoverage=56%, E-value=1e-112, Identity=62%"; Hit description =Tesmin/TSO1-like, CXC
  Pfam annotation: Domain name=CXC; Domain location=177-218; Score =87.2; E_value=5.2e-23; Accession=PF03638.5; Description=TesminTSO1 -like CXC domain
  Pfam annotation: Domain name=CXC; Domain location=92-132; Score=73.6; E_value=6.2e-19; Accession=PF03638.5; Description=TesminTSO1-like CXC domain
  Pfam module annotation: Pfam domain module=CXC::CXC; Domain location =177-218::92-132
MGEGEAEGSDGAPKNVVANDVVANALLPFDVPAKKLARQLDFTGFGGMSTTPQPQPPVVLPLRPSTSVRVGKPESPKSRPRPGFEIKEATPKKQKQCNCKHSKCLKLYCECFASGIYCDGCNCVNCCNNVENEAARREAVEATLERNPNAFRPKIASSPHRTRDIREDAGEILILGKHNKGCHCKKSGCLKKYCECFQANILCSENCKCMDCKNFEGSEERQALFHGDQNNNLVYIQQAANAAITGAIGSSGYSSPPISKKRKGQELLFGPTVKDPSVGRQGQQANNVRVPAPSSSLSPIPGARVGPATLGPSKLMYRSLLADIIQPQHLKELCSVLVLVSGQAAKTFTETSASENQELNKFSIIVSCLMSFEFGMECDAQDAGVSKNFST

SEQ ID NO: 159362 - protein, 396 aa, Glycine max
  Coding DNA Sequence Number=SeqID_42584
  Gene Ontology: Mol. function=transporter activity; Cellular component= membrane; Biological process=oligopeptide transport
  Homolog annotation: Hit_ID=Q2HU49; Match level="QueryCoverage=100%, HitCoverage=84%, E-value=1e-109, Identity=49%"; Hit description=TGF -beta receptor, type I/II extracellular region
  Pfam annotation: Domain name=PTR2; Domain location=1-345; Score =115.0; E_value=2.1e-31; Accession=PF00854.12; Description=POT family
MALGASGIRSCTLAFTADQIYNPENPQNERTMKSFFNWYYLSVAISVTISMAFIVYIQVKAGWVVGFGISMGIVSLSAIMFFLGTSIYVKVKPNKSLLTGFAQVIVAAWKNRHLPLPPKNSDIWYFRNGSNLVQPTNKVRFLNKACIIKNREKDLDYEGRPNEPWSLCTVRQVEELKAIIKVLPIWSTGIILATTVSQQQFFIVQAGTMDRMVFGIDIPATNFALFMMLTLTMWVIVYDRILVPILPNQRILTVKLRMGIGLVISCLATLVATLVEKKRRNQAISEGFIDNPKGVVNMSAMWLVPSYCLFGLAQGFTVIGQIEFFYSQFPKTMSTVAVSLSTLNIGVGNLVGSLIIKVVKDGTRRGGRASWLASNINRGHYDYYYGLLFILNLVNL

SEQ ID NO: 159363 - protein, 225 aa, Glycine max
  Coding DNA Sequence Number=SeqID_42585
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=98%, HitCoverage=14%, E-value=6e-37, Identity=38%"; Hit description=Zinc finger, TAZ-type; Zinc finger, ZZ-type; Transcriptional coactivation; Zinc finger, FYVE/PHD-type
  Subcellular localization annotation: CTP_CleavageSite=41; ConfidenceScore=5.34e-01
MTNHNQQHPQLVSSSPIGTMIPTPDMSHVTNSIMIMASSMDASMIPACGCNNIAYSSVNSVNRSDGGNMSSVGVQRATSHMIPTPGLSVSNNHSYTNMDPSTDSSSFSDQVALDKFFSGVDSTKLSQSQSQPQRHQKLQDCDHNNHALHNLGSQIDGGMRSDLLQNSFAYPNGSINNGLGLIGNSIQFANEPGTHDYSSMYTNSPKHLQQHFDQNQQPIVQSNLS

SEQ ID NO: 159364 - protein, 52 aa, Glycine max
  Coding DNA Sequence Number=SeqID_42586
MDGFFITNQEKPIKSYSCKARWVQGEASSWKRRIRKCSIKDFGSVLGGVIEQ

SEQ ID NO: 159365 - protein, 79 aa, Glycine max
  Coding DNA Sequence Number=SeqID_42587
  Homolog annotation: Hit_ID=Q1RXR5; Match level="QueryCoverage=48%, HitCoverage=7%, E-value=2e-11, Identity=74%"; Hit description=SAM (And some other nucleotide) binding motif
MTTEIYQYTQYTGKWPMLPIFNEHKIKSTRICGSKQLLCYTAANVLEGPQAQWTRPVLHLGLFAFFSDYHSSDDCQQMK

SEQ ID NO: 159366 - protein, 189 aa, Glycine max
  Coding DNA Sequence Number=SeqID_42588
MVLANDKKRRRQQHREAILAKSQASPSKTQGKSQVAKKKLDNSVPASNEDPRQLLKSQPALFLTYWEPKKQPGADPNWLETKSGADSFSDHTCYKFISNHGRVNIWALSRISYLSGNVKSRFPIYRSEIHHQVHYFSHLAPICATFKEPMGFGPAPKKRKKSKMRRDYDEEDDDEEQEEEEEPGELFLK

SEQ ID NO: 159367 - protein, 88 aa, Glycine max
  Coding DNA Sequence Number=SeqID_42589
MSVQHLCSNNVCRDLFEPHFQEQCRGFCGFERGQCGFFGSVGGSVVSSEDNVGVEGAVSGGRRKRRAISDRRMKKRRGRARFSSARGL

SEQ ID NO: 159368 - protein, 119 aa, Glycine max
  Coding DNA Sequence Number=SeqID_42590
WLFLGWIRYKGIPDTYDIAIWNNSNYSIVGSLQTGSDVRAMEVSSELIYLGCKGGTVEIWDKKKHKRVDTLQMGTNCRVNCMALDSNEEVLVIGTSDGQIQVPRELYIAQSLYIQVTCT

SEQ ID NO: 159369 - protein, 142 aa, Glycine max
  Coding DNA Sequence Number=SeqID_42591
  Gene Ontology: Mol. function=RNA-directed DNA polymerase activity
MTVKEHNENDSLTIKSTPLLNVTTSDNFENSWHVIFGCNPSSASLHKEWSAARALSNLHHEHHHQIMLSSWSKPAPGYIKINIDAASFKDINKYDVSVCIRDDQSNFISAKSLHHEGTPEPREAEAIDLLHGLLWAKRATTS

SEQ ID NO: 159370 - protein, 228 aa, Glycine max
  Coding DNA Sequence Number=SeqID_42592
  Gene Ontology: Mol. function=monooxygenase activity; Cellular component=integral to membrane; Biological process=electron transport
  Homolog annotation: Hit_ID=Q8W4T9; Match level="QueryCoverage=80%, HitCoverage=38%, E-value=3e-28, Identity=32%"; Hit description =Taxane 13-alpha-hydroxylase
  Subcellular localization annotation: CTP_CleavageSite=23; ConfidenceScore=5.13e-01
MVYGILFFVLFAFTLSLAFLLSKCLSKSQTKNVPKNVPKGSLGYPIIGETLSFLKAQRQDKGSVWLEERISKYGPIFKTSLMGFPTVLVIGQEGNKFVLGSPDDLLSSKKPLTLRKILGRQSLVELTGPRYRLVKGEMLKFLKPECLQNYVKKMDELVNATLLREFRENETIGAVVFMKKLSYEIACNLLFDIKDEHTKEALFVDFTLAFKAIHSLPINLPAEPGQEL

SEQ ID NO: 159371 - protein, 119 aa, Glycine max
  Coding DNA Sequence Number=SeqID_42593
MPLHLVHPPPLVLLSAPVRFLEITDFPWSSPTRGHTRLLGTIASGTTISSGVSASKIAIWHVKIVAVVPPLHDQLSVKSILGKADKVFENLLKRDGFKVKSLVRCLVESLSSDECRGST

SEQ ID NO: 159372 - protein, 102 aa, Glycine max
  Coding DNA Sequence Number=SeqID_42594
MTLAALANLRQANDESLPKFMDRFGHIVVQIHNLNPEVALHSLLLALKPNKFAESLCEKTPSSMDEPMATSRWKKCLDSRTKSNKSDKNAISQKEALRPTHT

SEQ ID NO: 159373 - protein, 505 aa, Glycine max
  Coding DNA Sequence Number=SeqID_42595
  Homolog annotation: Hit_ID=Q6K6Z8; Match level="QueryCoverage=40%, HitCoverage=46%, E-value=3e-34, Identity=44%"; Hit description =Hydroxyproline-rich glycoprotein-like
MDAMSDECLILFGHEMVDQYCYMRKRWGGCWGAFSCLGSQKGGKRIVPASRIPDSNGPASQPNGPQVVGLTNQATGLAPSLLAPPSSPASFTHSALPSTAQSPSCFLSLSANSPGGPSSTMFATGPYAHETQLVSPPVFSNFTTEPSTAPLTPPPELAHLTTPSSPDVPFAHFLSSSVDLKNNGKGNYITANDLQATYSLYPGSPASSLISPISRNSGDCLSSSFPEREFHPQWDSSLSPENGKYQRTGSGRVSGHDTSGVTMASQDTNFFCPATYAQFYLDQNPPFPHNGGRLSVSKDSDVQSNGGNGHQSRHARSPKQDVEEIEAYRASFGFSADEIITTSQYVEISDVMEESFTMLPFASNKSTMEESIEPSFMKGFKAQDTQVALQSQRSLRSDPGPVGKEKDNQAPICPGYEGIVHICISSGKDGGKYALSCMSDHISQGHCSNSSGLSTPENRTLEDDEDIFSKMESSRICRKYQMGLSCSDAEVDYRRGRSFREEKGM

SEQ ID NO: 159374 - protein, 286 aa, Glycine max
  Coding DNA Sequence Number=SeqID_42596
  Homolog annotation: Hit_ID=Q1SHC4; Match level="QueryCoverage=17%, HitCoverage=20%, E-value=1e-07, Identity=56%"; Hit description=RNase H, putative
MVNTKCSYQNPELTYIRVDEAKVRDNLLVGKPDCLGLGVRALVSELTWKVNVCLEVSRNSFLDVDARAWLLEGSTFYFEESHDNMVQIVHQVNVMRDIILSCFNGGANSSKPPRLTCWRQNFDNVDGSSLGNLGLAGYGRILRNSDGEWIYGFHGHIGNSKNLHAEPLYFLRGFPYNMLVMLTRELAPPLEGLLQRDDDIFCVVYIIDFLLHFNFKPFLFDMLNFPLPTPQITIVSVDSISSEESNAWGLEGNWYTMAYTTIPDYSIQSMAQCMAQVLRAVEHLHA

SEQ ID NO: 159375 - protein, 56 aa, Glycine max
  Coding DNA Sequence Number=SeqID_42597
MWISDVGGLNFGPGYASKGCFFYKLFQSLDPMEQGCFLKLYFTYKKENNYNTGYQG

SEQ ID NO: 159376 - protein, 1112 aa, Glycine max
  Coding DNA Sequence Number=SeqID_42598
  Gene Ontology: Mol. function=ubiquitin-protein ligase activity; Cellular component=ubiquitin ligase complex; Biological process =protein ubiquitination
  Homolog annotation: Hit_ID=Q6H6D6; Match level="QueryCoverage=48%, HitCoverage=56%, E-value=2e-40, Identity=24%"; Hit description =Transducin-like
  Pfam annotation: Domain name=U-box; Domain location=392-465; Score =45.8; E_value=1.4e-10; Accession=PF04564.6; Description=U-box domain
  Pfam annotation: Domain name=WD40; Domain location=1027-1063; Score =11.4; E_value=1.7; Accession=PF00400.22; Description=WD domain, G -beta repeat
  Pfam annotation: Domain name=WD40; Domain location=1069-1107; Score =12.4; E_value=1.3; Accession=PF00400.22; Description=WD domain, G -beta repeat
  Pfam module annotation: Pfam domain module=U-box::WD40::WD40; Domain location=392-465::1027-1063::1069-1107
  Subcellular localization annotation: CTP_CleavageSite=52; ConfidenceScore=5.05e-01
MTTVTVTTRAQILRHTAAFTSSVLSQSELRRRLIATLLRDTPFSDQKHLNLAADTLESAISFSSPALRFSSLSLAEKLLLPLPDFPLSSLLLSLIHALRNRPTESAVSLLRIFHSNASLARSEIAPALYERLFSLHLFPVFRWFDDQRTRILSTSRNDSDYSVTSEEYSVVLPCAKVLSKMSEEQAAKLREVERDYEEVLNQNCMVLAEYFKEVLVNENGDAAAISPPSLVLKSAAEDGRGGVENRKEEMMKMSVLENGRYNPIWSEREASIEFLSPSSSSRSSQVPFYPQRVFSRILKPQKASKTWTTPVYLNSTTADTDFSLDESLLSSSSDSEAENDEEKDKTVALLEPRQSQIKERMLSIFKQSRGSPDYPMADFDTPLHGIGKHAPPKDFVCPITSHIFDDPVTLETGQTYERKAIEEWFNRGNITCPITRQKLQNTQLPKTNYVLKRLIASWKDRNPHLVPPPCESPYEDTDEAVVIPTTLPSTSPNSVITQATVDGMMSELRCAINNLYMSEVLQESEMAVLQIDKFWRGVNVGVDIHSMLSKPAIINGFMEILFNSVEPQVLQASVFLLAEMGSRDNAVIKTLTRVDTDVECIKALFKNGLTEAVVLLYLLNPSTMSLAEMAIVESLITVFNKKEEDLVKMCLKPKTAAVLLLARIVGSSEEIIASSVVNTLFSEKTIGTIVGSLGADLAKERIAAVEILLRCMEEDGTCRNNIADKAELSPILETLIGATDGDRFKIIQFFFELVKLNRRTFIEQILHIIKEEGPFSTMHTLLIYLQTALQDQCPVMAGLLLQLDLLVEPRKMSIYREEAMDTLISCLRNTDFPVTQLAAADTIISLQGSFDFSGNPRTREVLLKRAGIEKSSRSLVQEEEKAADDWERRIASVLVSHEFGTLFEALADGMKSRNPELRSACFILATWLIYMLTILPDTGIHVAARACLLKQFIAKLNCAKDVEDRILSMLALNSFLHFSDGFGDLTSFTKDIIKGLRELKRSCPLATKMLKVLVEENESKAEIWIHKELIKEDCSENGEVLSVICFKGKFFSGHTDGTMKVWTLKDNLFCLMQEIQEHTKAVTNLVISESDDRLYSGSLDRTARGTGVKARV

SEQ ID NO: 159377 - protein, 113 aa, Glycine max
  Coding DNA Sequence Number=SeqID_42599
  Gene Ontology: Mol. function=magnesium ion binding; Cellular component=membrane; Biological process=photosynthesis, light harvesting
  Homolog annotation: Hit_ID=Q9C9K1; Match level="QueryCoverage=78%, HitCoverage=27%, E-value=8e-39, Identity=77%"; Hit description =Putative chlorophyll A-B binding protein; 65434-67056
  Pfam annotation: Domain name=Chloroa_b-bind; Domain location=33-113; Score=10.1; E_value=3.7e-06; Accession=PF00504.12; Description =Chlorophyll A-B binding protein
MLPINKERGWERGRILSFGEEDRPRWLGPISYEYPSYLTGELPGDYGFDIAGLGQDPVALQKYFNFEILHARWAMLASVGALIPEILDLLGAFHFVEPVWWRVGYSKLKVHML

SEQ ID NO: 159378 - protein, 71 aa, Glycine max
  Coding DNA Sequence Number=SeqID_42600
MDEQERVDKRPQDMFYHGPMVDTKYTYQNLKLAHVRVYVAQVGSRTSHADFKRKRVELRVLNSIVELKLIT

SEQ ID NO: 159379 - protein, 374 aa, Glycine max
  Coding DNA Sequence Number=SeqID_42601
  Gene Ontology: Mol. function=transcription regulator activity; Cellular component=nucleus; Biological process=regulation of transcription
  Homolog annotation: Hit_ID=Q1SP86; Match level="QueryCoverage=96%, HitCoverage=100%, E-value=7e-72, Identity=46%"; Hit description =Helix-loop-helix DNA-binding
  Pfam annotation: Domain name=HLH; Domain location=211-249; Score=2.7; E_value=0.076; Accession=PF00010.16; Description=Helix-loop-helix DNA- binding domain
  Subcellular localization annotation: CTP_CleavageSite=77; ConfidenceScore=5.66e-01
MNRGVLQSSPVQQMMARNPNNWWNINTMRPPPPSQASAPFFSTPSNFLTPYNPTSLPLPSWHDNNQELPESWSQLLMSGMVSEEEKGGMCQIQSKKLENWEQQMLSQAPSAPIVDVKQESSVNSYVYGHGTNEEFQAAKPITWSQIVPASSPKSCVTSFSSSMLDFSNNNADARPPPPDPSSECNSSTATGGAFKKARVQPPTTQSTFKVRKEKLGDRITALHQLVSPFGKTDTASVLLEAIGYIRFLQSQIEVINVYSPRSVDFCKRPRESVNSDGTLDALSLPYLGSGSGNMRHQQSVQGEKNCIFPEDPGQLLNENCLKRKAASSEQDSQEEANKDLRSRGLCLVPVSCTLQVGSDNGADYWAPAFGGGFR

SEQ ID NO: 159380 - protein, 72 aa, Glycine max
  Coding DNA Sequence Number=SeqID_42602
MEMRTSCSIHKDRPAQDATKINQPREELHQSKEEMRVFYSVVFQFLPPEARTLFININNLTSNIKTNNKTRE

SEQ ID NO: 159381 - protein, 119 aa, Glycine max
  Coding DNA Sequence Number=SeqID_42603
  Subcellular localization annotation: CTP_CleavageSite=36; ConfidenceScore=5.19e-01
MAFLGETSSQTVVNSTLGFIFPNGSIVHNDSGVSFQASTPVPIRVPNGCDFQTLKTRIHNTLKLTNKQFLDEIYYRQPFTYAVGPIELLCSIARTPDGILNLLEATMTPTHDALLYYNG

SEQ ID NO: 159382 - protein, 168 aa, Glycine max
  Coding DNA Sequence Number=SeqID_42604
  Gene Ontology: Mol. function=hydrolase activity, acting on ester bonds; Biological process=lipid metabolic process
  Homolog annotation: Hit_ID=Q5J7N0; Match level="QueryCoverage=79%, HitCoverage=63%, E-value=5e-18, Identity=44%"; Hit description=GSDL -motif lipase
  Pfam annotation: Domain name=Lipase_GDSL; Domain location=5-145; Score=3.0; E_value=0.001; Accession=PF00657.12; Description=GDSL -like LipaseAcylhydrolase
MTTTVASMSVCQALWLDKLQQEMKVKEPGAVGIIRMFEQYQERLSAVVGAKRAKKVVNEALVLMTLGGNDFVNNYFLAGSYYSERLYELGARRVLVTGTGPLGCVPSQLAMRSTNGDLCSNRDAYAFWDAFHPSQRALDFIVDGIFKGTSNLMSPMNLSTIMAMDSNI

SEQ ID NO: 159383 - protein, 358 aa, Glycine max
  Coding DNA Sequence Number=SeqID_42605
  Gene Ontology: Mol. function=protein binding
  Homolog annotation: Hit_ID=Q1SA54; Match level="QueryCoverage=62%, HitCoverage=100%, E-value=4e-69, Identity=64%"; Hit description =Leucine-rich repeat; Leucine-rich repeat, ribonuclease inhibitor subtype; Leucine-rich ...
  Homolog annotation: Hit description=repeat, cysteine-containing subtype
  Pfam annotation: Domain name=LRR_1; Domain location=138-161; Score =14.0; E_value=0.54; Accession=PF00560.23; Description=Leucine Rich Repeat
  Pfam annotation: Domain name=LRR_1; Domain location=170-192; Score =1.7; E_value=1.4e+02; Accession=PF00560.23; Description=Leucine Rich Repeat
  Pfam annotation: Domain name=LRR_1; Domain location=199-221; Score =4.6; E_value=39; Accession=PF00560.23; Description=Leucine Rich Repeat
  Pfam module annotation: Pfam domain module=LRR_1::LRR_1::LRR_1; Domain location=138-161::170-192::199-221
MAEAPPSLISLCIDALAQQFLRPSDDLPSIYDLPSHLLHTLITRLPPFALRTFHRHHLPFDEEGFSRDDSTKKRKRARDWNLSSAWQRLFLLRWPDRVKQIQPTDWEQHYWEIHLQEENNLGKDDVESLRYALQHVPNLEELDISGNSIEDEGIRNLIPYFVGASETCPHITCLKLENCDLSCVGVNNLLHILSNFKGPLKSLSIADNYLGSQVAEALGKFFSTPIEVLDIAGIGLGSYGFQELQSLIKEKVKLVKINISKNRGGIATAKFLSKLLSQAPQLVDVNAASNLMPIESLAIICSALKFAKGNVQQVDLTGHIWDYKPEHVSPYTEFVHNGLPILILPSSSASAAPHDHDP

SEQ ID NO: 159384 - protein, 407 aa, Glycine max
  Coding DNA Sequence Number=SeqID_42606
  Gene Ontology: Mol. function=methyltransferase activity; Cellular component=cellulose and pectin-containing cell wall
  Homolog annotation: Hit_ID=Q1S0J0; Match level="QueryCoverage=97%, HitCoverage=62%, E-value=0.0, Identity=80%"; Hit description=Generic methyltransferase
  Pfam annotation: Domain name=DUF248; Domain location=1-394; Score =738.1; E_value=5.8e-219; Accession=PF03141.7; Description=Putative methyltransferase
  Pfam annotation: Domain name=Methyltransf_11; Domain location=9-93; Score=8.2; E_value=0.0086; Accession=PF08241.2; Description =Methyltransferase domain
  Pfam module annotation: Pfam domain module=DUF248::Methyltransf_11; Domain location=1-394::9-93
MMQVASWGAYLLSRDIITVSIAPRDTHEAQVQFALERGVPALIGVLASKRLPFPSRAFDMAHCSRCLIPWAEYDGLYLNEIDRILRPGGYWILSGPPIRWKKHWKGWERTKEDLNEEQTKIENVAKSLCWNKLVEKDDIAIWQKAKNHLDCKANRKLSHNRPLCKAQSNPDKAWYTEMQTCLSPLPEVSSKDETAGGALKNWPERLKATPPRISKGTIKGVTSETFSKDNELWKKRIAYYKKVNNQLGKAGRYRNLLEMNAYLGGFAAVLVDLPVWVMNVVPVQAKVDTLGAIYERGLIGTYHNWCEAMSTYPRTYDLIHADSVFSLYSDRCELEDILLEMDRILRPEGSVIIRDDVDILVKVKSIVNGMDWDCQIVDHEDGPLEREKLLFAVKNYWTAPAASDKNS

SEQ ID NO: 159385 - protein, 208 aa, Glycine max
  Coding DNA Sequence Number=SeqID_42607
  Homolog annotation: Hit_ID=Q1SZQ0; Match level="QueryCoverage=43%, HitCoverage=11%, E-value=1e-07, Identity=31%"; Hit description =Integrase, catalytic region; Zinc finger, CCHC-type; Peptidase aspartic, catalytic
MERSGTLKFIITPLSGGTKKANEDAKKKYEKDNKTLTGNWLRFQMLDDKSIMEQERRCEILQANVLLEKFPPSWSDYRNQLKPNKRDLSLQELVNHMMIEEAKRLKDKHVLFFVNFVNANVVEIVDQNRFKGKGKEKKKSEKSYRYQQRQAWLITRWTRFWILVFLNTYVPTKSFFTTLRMLLMESVSSWEILLQLECLVKERFFSNF

SEQ ID NO: 159386 - protein, 107 aa, Glycine max
  Coding DNA Sequence Number=SeqID_42608
MTLMYRAETVRRRFRNCSLFCSCMTCLVVLENEDRNNIARSLVLGSLAGVISSSRVFGFSFKIHIYCKITSKSMQKQLLVVRDPRPVVSIVFPNTLLVDSRGALRNM

SEQ ID NO: 159387 - protein, 93 aa, Glycine max
  Coding DNA Sequence Number=SeqID_42609
  Gene Ontology: Mol. function=transferase activity; Biological process= DNA integration
  Homolog annotation: Hit_ID=Q1RU49; Match level="QueryCoverage=99%, HitCoverage=11%, E-value=5e-24, Identity=53%"; Hit description =Polynucleotidyl transferase, Ribonuclease H fold
MESKFIALDLASQEARWLRNLFINVSLWGKRSIPVSLHCDSQAAIGLAMNNVYNGKRRHICIRHSSIKELLKNGVISLEFVRSERNLTDPLNK

SEQ ID NO: 159388 - protein, 95 aa, Glycine max
  Coding DNA Sequence Number=SeqID_42610
  Gene Ontology: Mol. function=peptidase activity; Cellular component =extracellular region; Biological process=immune response
  Homolog annotation: Hit_ID=Q1S0I9; Match level="QueryCoverage=79%, HitCoverage=80%, E-value=4e-21, Identity=64%"; Hit description=Plant lipid transfer/seed storage/trypsin-alpha amylase inhibitor
  Pfam annotation: Domain name=Tryp_alpha_amyl; Domain location=33-92; Score=46.6; E_value=8.5e-11; Accession=PF00234.12; Description =Protease inhibitorseed storageLTP f
  Subcellular localization annotation: CTP_CleavageSite=59; ConfidenceScore=5.29e-01
MAASPKSLLSLILLLLVVVAHGTQIAMAQSSTCTTQLSELNVCAPFVVPGVNTNPSSRCCNALQAVDRDCLCSTIRIASQLPSQCQIPSLGCSAN

SEQ ID NO: 159389 - protein, 1131 aa, Glycine max
  Coding DNA Sequence Number=SeqID_42611
  Gene Ontology: Mol. function=binding; Cellular component =cytoskeleton; Biological process=cell division
  Homolog annotation: Hit_ID=Q1SA51; Match level="QueryCoverage=99%, HitCoverage=98%, E-value=0.0, Identity=85%"; Hit description=Mast C -terminus, putative
  Pfam annotation: Domain name=HEAT; Domain location=1056-1091; Score =18.0; E_value=0.035; Accession=PF02985.12; Description=HEAT repeat
  Pfam annotation: Domain name=HEAT; Domain location=13-48; Score=5.0; E_value=11; Accession=PF02985.12; Description=HEAT repeat
  Pfam annotation: Domain name=HEAT; Domain location=136-168; Score =1.5; E_value=28; Accession=PF02985.12; Description=HEAT repeat
  Pfam annotation: Domain name=HEAT; Domain location=478-511; Score =1.3; E_value=29; Accession=PF02985.12; Description=HEAT repeat
  Pfam annotation: Domain name=HEAT; Domain location=520-555; Score =23.8; E_value=0.0006; Accession=PF02985.12; Description=HEAT repeat
  Pfam annotation: Domain name=HEAT; Domain location=560-596; Score =20.6; E_value=0.0056; Accession=PF02985.12; Description=HEAT repeat
  Pfam annotation: Domain name=HEAT; Domain location=646-678; Score =9.0; E_value=3.4; Accession=PF02985.12; Description=HEAT repeat
  Pfam annotation: Domain name=HEAT; Domain location=937-973; Score =22.4; E_value=0.0017; Accession=PF02985.12; Description=HEAT repeat
  Pfam module annotation: Pfam domain module=HEAT::HEAT::HEAT::HEAT::HEA T::HEAT::HEAT::HEAT; Domain location=1056-1091::13-48::136-168::478 -511::520-555::560-596::646-678::937-973
MVLCAVDYPCFCGLLKQLVGPLTTQLSDRRSTIVKQACHLLCFLSKELLGDFEACAEMLIPVLFKLVVITVLVIAESADNCIKTMLRNCKVARVLPRIADCAKNDRNAVLRARCCEYAYLVLEHWPDAPEIHRSADLYEDLIKCCVSDAMSEVRSTARMCYRMFAKTWPERSRRLFSSFDPAIQRLINEEDGGMHRRHASPSIRDRGALMSLSSQASAPSNLPGYGTSAIVAMDRSSSISSGTSISSGILLSQAKSLGKGTERSLESMLHASKQKVSAIESMLRGLDLSDKHNSSSLRSTSLDLGVDPPSSRDPPFPAAVPASNHLTSSLTESTTSGINKGSNRNGGLGLSDIITQIQASKDSAKLSYRSNVGIEPLSSLSSYSSKRASDRQERSSLDDNNDMRETRRYMNPNTDRQYLDAPYRDGNFRESHNSYVPNFQRPLLRKNVAGRMSASRRRSFDDNQLSLGEMSNFADGPASLHEALSEGLSSGSNWSARVAAFNYLHSLLQQGPKGTLEVVQNFEKVMKLFFQHLDDPHHKVAQAALSTLADIVPVCRKPFEGYMERILPHVFSRLIDPKELVRQPCSTTLEVVSKTYSIDSLLPALLRSLDEQRSPKAKLAVIEFAINSFNKHAMNPEGAANIGILKLWLAKLTPLVNDKNTKLKEAAITCIISVYSHFDSTAVLNFILSLSVEEQNSLRRALKQYTPRIEVDLINYLQNKKEKQRSKSSYDPSDVVGTSSEDGYVGYSRKAHYLGKYSAGSLDGDGGRKWSSQDSTLIKASLGQASSGETREHLYHNFETDPNSGSLGSKTKDLAYAVNPMGQNIGSQTSQHGHVDSSVSLEGLSIPRLDVNGLMPSEHLNGTEGYVNDKEHPSELERNHHSAEDVKINSMTDTGPSIPQILHMICSGGDGSPISSKRTALQQLVEASITNDHSVWTKYFNQILTVVLEVLDDSDSSVKELALSLIVEMLKNQKGAVENSVEIVIEKLLHVTKDIIPKVSNEAEHCLTIVLSQYDPFRCLSVIVPLLVTEDEKTLVICINCLTKLVGRLSQEELMTQLPSFLPALFEAFGNQSTDVRKTVVFCLVDIYIMLGKAFLPYLQGLNSTQLKLVTIYANRISQARTGKAIDAVQD

SEQ ID NO: 159390 - protein, 76 aa, Glycine max
  Coding DNA Sequence Number=SeqID_42612
MTIQADVDGLAIGTTDTRWRGVSRQKHWRYRLQARARGCAEVRGHMHACFSPFPLVRLVQSRFAISSGKTGADSFK

SEQ ID NO: 159391 - protein, 490 aa, Glycine max
  Coding DNA Sequence Number=SeqID_42613
MKKTVCAALFLCGVFVFSQENIKSDTIDQTKTAEIQEVIIKSQRKKQFADKAVYTFDKAALEKARYAKDLLRTLPELQLDPVSNTLKSTKGGTSLFLINGIEATDMQIRSIAPSEVVKVEYYDIPPARWATRADTVINVITRSTETGYVFGTDVMTALNTGFVNGSAYANFTKGKNNLGLEYSMNLRDYDNRRVRSIYDYQLDNSHYLSDENKKDHFGYTSQNIALRYTRMVPDNYSFQAKLNMDILHTFVNGKGESTFTKDDVTEGHTMMKRGGTDYVAPTLDLYFSKKLSKKDELSLNVVGSHFTTDTSEFTKEWITSSGNSVFDNDMNLTAKQTGFVGEIAHTHDFEGGKLSSGYRISNTSISNDLQNLAGFSQYKVNYLEQYFYTEFSGKIEKFTYRVGAGLTNIHNKSAETTFDEWSITPKVILGYQLKGNQSLRFTSSYKPKSPWSAALSSNVVQMAPNIVQKGNPFLKSQLTWGNNLIYSLNN

SEQ ID NO: 159392 - protein, 59 aa, Glycine max
  Coding DNA Sequence Number=SeqID_42614
  Subcellular localization annotation: CTP_CleavageSite=33; ConfidenceScore=5.00e-01
VVAAQGAMMVVRVSDNGSLRSCLGCEGATLVARGATVTARGSGTSGSKGSRGCVRERQH

SEQ ID NO: 159393 - protein, 108 aa, Glycine max
  Coding DNA Sequence Number=SeqID_42615
  Gene Ontology: Mol. function=two-component response regulator activity; Cellular component=nucleus; Biological process=two -component signal transduction system (phosphorelay)
  Homolog annotation: Hit_ID=Q1SA49; Match level="QueryCoverage=95%, HitCoverage=80%, E-value=8e-32, Identity=64%"; Hit description =Response regulator receiver
  Pfam annotation: Domain name=Response_reg; Domain location=6-108; Score=75.5; E_value=1.6e-19; Accession=PF00072.14; Description =Response regulator receiver domain
MEPRQLTALIVEDDMVIRMVHQKILNSVGLKIQVAENGKEAIEIHGSGQSFDLILMDRDMPVMNGIEATKTLRSMGINSMITGVSTRSVAAHIREFMEAGLDDYVEKP

SEQ ID NO: 159394 - protein, 140 aa, Glycine max
  Coding DNA Sequence Number=SeqID_42616
  Gene Ontology: Mol. function=sequence-specific DNA binding; Cellular component=nucleus; Biological process=regulation of transcription, DNA-dependent
  Homolog annotation: Hit_ID=Q1S0I1; Match level="QueryCoverage=87%, HitCoverage=14%, E-value=5e-30, Identity=57%"; Hit description=Lipid- binding START; Homeodomain-related
  Pfam annotation: Domain name=Homeobox; Domain location=56-125; Score =64.5; E_value=3.5e-16; Accession=PF00046.19; Description=Homeobox domain
MEGHSEMGQIGESFDTSNLLGRLRDDEYESRSGSDNFDGGSGDDQDAGDDQPHKKKKKYHRHTPQQIQELEAYGSMKFSNLFYKMFFKECPHPDEKQRTDLSKRLGLENKQVKFWFQNRRTQMKAVKNIIVMSFDQSVIT

SEQ ID NO: 159395 - protein, 66 aa, Glycine max
  Coding DNA Sequence Number=SeqID_42617
  Gene Ontology: Mol. function=hydrolase activity; Cellular component =nucleus; Biological process=mRNA transport
  Homolog annotation: Hit_ID=Q9SPM8; Match level="QueryCoverage=75%, HitCoverage=10%, E-value=2e-15, Identity=80%"; Hit description=Nod factor binding lectin-nucleotide phosphohydrolase
MLSLSTGSICKGLVNNATAGLRLLKGNASEQILQAVRDMLSNRSTLNLQSDAVTILDGNQEAAYMW

SEQ ID NO: 159396 - protein, 624 aa, Glycine max
  Coding DNA Sequence Number=SeqID_42618
  Gene Ontology: Mol. function=sequence-specific DNA binding; Cellular component=nucleus; Biological process=regulation of transcription, DNA-dependent
  Homolog annotation: Hit_ID=Q1S0I1; Match level="QueryCoverage=99%, HitCoverage=84%, E-value=0.0, Identity=60%"; Hit description=Lipid -binding START; Homeodomain-related
  Pfam annotation: Domain name=START; Domain location=148-372; Score =238.8; E_value=1.1e-68; Accession=PF01852.10; Description=START domain
MILRQENDKLRAENSVMKDALANPTCNNCGGPAIPGQISLEEHQTRMENARLKDELNRICALANKFLGRPLSPLASPMALPPSNSGLELAIGRNGIGGPSNFGMSLPMGFDVGDGVMGSSPGMSSMGARSPMGMMGNEIQLERSMLLDLALNAMNELIKMAQPDTSLWIKSSDGRNEVLNHDEYARLFSPYVGSKPAGYVTEATRGTGVVPASSLGIVETLMDVDRWAEMFSSMIASAATLEVLSSGMGESRSGALQVMLAEVQLLSPLVPARSLSFLRYSKQHGEGVWAVVDVSVDIGRNVTNSHPLMSCRRLPSGCVIQDMPNGFSKITWVEHSQYDESVVHQLYRPLVSSGIGFGAQRWIATLLRQCDCLAILMSQIPSEDPTVISLEGKKNMLKLAQRMTEYFCSGICASSVRKWEILNIGNLADDMRIMARKINMDDPTEAPGIVLSASTSVWMPVSRQRVFDFLRDENLRGEWDMLSKDGPMKEMLHIAKGQDRGNCVSILHSANSECNVLYLQESWTDASGSLVVYSPINMQALNMVMNCGDSSFVALRPSGFAILPDGASNNGDGSDGGGSCLLTVGLQMLPNGDQSTKFTMESVVTVNSLISNTIQKVKDALGVA

SEQ ID NO: 159397 - protein, 151 aa, Glycine max
  Coding DNA Sequence Number=SeqID_42619
MARRDKLWSFCAFPSRLDRVRWHAKTNYGHSAPFCHPEAAGSMAYGDKLWSLCTPFRHPEAIVSDGAQRQIMFILRLSIQARSCPMARRDKLWSFCALCHSRAASQVINAQRQFMVILHPLSFKGSTSSSKRAETNYGHSAPFVIQGQQVE

SEQ ID NO: 159398 - protein, 107 aa, Glycine max
  Coding DNA Sequence Number=SeqID_42620
  Subcellular localization annotation: CTP_CleavageSite=80; ConfidenceScore=5.32e-01
MVVAKYACNMAPCFTSTGCKTSIACSERCSPTLNTYAPSAPISPFKVAKTTMPTISLVALAEQPRVQSQAYIASMHGDIRACMAGGYVKIDPLSHLFENRPTLRISL

SEQ ID NO: 159399 - protein, 39 aa, Glycine max
  Coding DNA Sequence Number=SeqID_42621
MILDLLILDGHWWWKRNIDIEGCYWSISINEDSRVMVEY

SEQ ID NO: 159400 - protein, 121 aa, Glycine max
  Coding DNA Sequence Number=SeqID_42622
  Homolog annotation: Hit_ID=Q689D6; Match level="QueryCoverage=74%, HitCoverage=22%, E-value=6e-35, Identity=78%"; Hit description=Plant- specific family protein RPD1
  Pfam annotation: Domain name=DUF860; Domain location=2-107; Score= -177.1; E_value=0.0054; Accession=PF05898.4; Description=Plant specific of unknown function (DUF860)
MEAQKRMEKRAIATIHELLSLTVEKKITLERIAHFRMAKNLPKKLKDFLQQHQGIFYVSTRGNQGKLYTVFLREAYRKGELIELNELYLARSITIKQLQLVTRSYLSSLLVMAVSWLLEVI

SEQ ID NO: 159401 - protein, 510 aa, Glycine max
  Coding DNA Sequence Number=SeqID_42623
  Gene Ontology: Mol. function=nucleic acid binding
  Pfam annotation: Domain name=SWIM; Domain location=280-312; Score =41.5; E_value=2.9e-09; Accession=PF04434.8; Description=SWIM zinc finger
  Pfam module annotation: Pfam domain module=MuDR::SWIM; Domain location=44-211::280-312
MTEGVLLTIDEGGKPVVEGDLGNDVIDGKNSDGEVDMADLDDRDKETDEDKGDDDNYEEKDSDDGDDLDVEYDTDKLEFDIASEEDDDCYNQFPRDFNLMKWEDILIEVGMEFDSISQFKVAIKEYANLHGFGVKFKKNDNVRCRVICQDGCEWVAYVSKVSKEAYDWLMQLDPRFWSKAHMSEYFRCNMVMNNILEAFNGRILEAREQPIVAMLECIKVYMMTRFAKNRKLGEKQKAKGQKVCPRPMNILDQEVLAYSKWTVVWGGGPKFEVQKYPLAFKVNLDEKSCSCRFWQLTGISCRHAVATMFDRRLLPSDLVHPYCHVNTYTNCYALIMEPINGEDMWQQIGLPTALPPQVRVLIGRPKKVRRRENDEAPKPHKLKRTNTSLRCDMCGTFRQNKRECQNMTIPKLDPPPKKPKVMTSTKKKNTATSTSKQTQPSNTQQSHTQPPKTSNMHTQQSQTQAPTTAKGGFRPKLLIKSKGLQWKGKQAITQQQLQDVVKNASGKKTN

SEQ ID NO: 159402 - protein, 90 aa, Glycine max
  Coding DNA Sequence Number=SeqID_42624
MSGDGANSQQPISGEGNQSQLPDLNDLPSVEMDFDMSVDKEEDGMADDTEDASLHGVMSDGQEEEANAETEFPINTDATLNKQRRFLSNE

SEQ ID NO: 159403 - protein, 204 aa, Glycine max
  Coding DNA Sequence Number=SeqID_42625
MCRITTIVREIQKITPTGNVLKITVKLITAETSQHRGRQKEYNIFAIRQIMAAACSWLGSCRSICKGMGTQCIYVRGTDTVSFLRSHFSFGKWKWNLMQEKGEIWTRVLESKYGGWRSFHELGRTGQQSVWWRNLKQTFNISHQGDIIQSNMRWKVVGGDKIRFWEDKWSQQQQTLAERYPRLYLISSQQKQSIRQLGHHIDSG

SEQ ID NO: 159404 - protein, 102 aa, Glycine max
  Coding DNA Sequence Number=SeqID_42626
MKTIHKYYKVPNLVVVLVFSTWWLKDRVRTIPLAAALLSSSNLGKGGGSDEGRERPLGVVDLTVTDGGLYEGCDNNLGEALKILDGVTTKGVDITDLDDAVE

SEQ ID NO: 159405 - protein, 176 aa, Glycine max
  Coding DNA Sequence Number=SeqID_42627
  Subcellular localization annotation: CTP_CleavageSite=45; ConfidenceScore=5.22e-01
MYTSRHSHMKNKGMAKKASKVLRHSPSLVHITLSKFNRSKAIRESCSLGQQSCGLDETDLLETNVPTNFELAAIVVKDHLPSHDLDKVGGWVLQRRSSNEEILSHVDTQVECKSVDLVTQGSSNFSPTLRMVNVHDGLYFIDHFQPSLSALPSFSIAVVIIHTQSPTLEPNNAQEL

SEQ ID NO: 159406 - protein, 87 aa, Glycine max
  Coding DNA Sequence Number=SeqID_42628
  Gene Ontology: Mol. function=monooxygenase activity; Cellular component=membrane; Biological process=electron transport
  Homolog annotation: Hit_ID=Q1SND2; Match level="QueryCoverage=68%, HitCoverage=15%, E-value=2e-15, Identity=92%"; Hit description=E -class P450, group IV
MKQLLDEHDCFVVPFLSAVHLDENVYSGEIGELVHSMHPLEEGLDSVQEQSWLAYKLLFFSSLLRNYLQVVKRKRKAATFTVESNKC

SEQ ID NO: 159407 - protein, 194 aa, Glycine max
  Coding DNA Sequence Number=SeqID_42629
MASADEMYLRCCLESVHNSALKASQHNKPVSLNTVKFVGEAECDSGQLVLGHSVAVSNNASDNWTLGTVMGTKSMINILNSPLLQHFGASEGNDNLNSMNFTDAKNMTCYDFKDSPSSSYKLEMETPMVQSHEYGSISVHKRTTSKTNSTYDQKEVYVAKLSKVDTTHDEDLDYVYLFHLNKGCEIPDRDLQLV

SEQ ID NO: 159408 - protein, 287 aa, Glycine max
  Coding DNA Sequence Number=SeqID_42630
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=1e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLRTLAIRGLHALTLRGLHVLAFRGLHALTCRGLHVLAFRGLHVLDLRGLHVLTFRGLHALAFRGLHALTFRGLHILTFRGLHALAFRGLHILTFRGLRTLTFKGLHALAIRGLHVLAFRGLHVLAIRGLHALAFRGLDVLAFRGLHVLTFRGLHALAFRGLHVLSFKGLHALTLEGYTSSPSEDYTSSLSEGGTLAFKGLHALTFRGLHVLAFKGLHALTFRGICVLTFRGLHALAFRGLHVLAIREMHALAFKGRHVLDFRGLHAYAFRGLRVPILVGSTSAP

SEQ ID NO: 159409 - protein, 419 aa, Glycine max
  Coding DNA Sequence Number=SeqID_42631
  Homolog annotation: Hit_ID=Q1PFY7; Match level="QueryCoverage=96%, HitCoverage=96%, E-value=5e-77, Identity=45%"; Hit description=Zinc finger CONSTANS-like protein
  Pfam annotation: Domain name=CCT; Domain location=328-366; Score =82.5; E_value=1.3e-21; Accession=PF06203.4; Description=CCT motif
MLLTMLICHHSLQDEISSPISARIFELCEPDFFPDTLQNSDVTSSSNCCHEEKSSYATTISPPLDLVDNKININNNSNIVTTTSSSTTTTSTTTNNNNNNTTNSNNLSILFDTQDEIDNDISASIDFSSCRSLVVPPLLSISTQQDQFDFSSAQPQVQLSAAAGSVLKGLSHYPTDHVIAPLIGSPLPSVFDEDCISSIPSYVPLNPSSPSCSYLSPGIGVYMPPPGSLNTALSADSSGLFGGNILLGSELQAHELDYQGENGGIFCTDSIQRVFNPPDLQALGTETQKLVAGAGSSATLTPEISHLEDSNLKVGKLSVEQRKEKIHRYMKKRNERNFSKKIKYACRKTLADSRPRVRGRFAKNDEFGESHRQGSSNHEEDDEEIIVKEDDDMVDSSDIFAHISGVNSFKCNYSIQSLI

SEQ ID NO: 159410 - protein, 611 aa, Glycine max
  Coding DNA Sequence Number=SeqID_42632
  Gene Ontology: Mol. function=DNA binding; Cellular component =chromatin; Biological process=DNA integration
  Homolog annotation: Hit_ID=Q1SS72; Match level="QueryCoverage=99%, HitCoverage=90%, E-value=2e-61, Identity=48%"; Hit description =Integrase, catalytic region
MSEEQDGSLSVHSPHYLHPSENPAISLVSPLLDPKNYNSWSRSALTVLSGKNKVEFVDDFLPQPISNRRLYAAWKRANNMVVSWLVHSIATSIRQSILWMDNAVDTSAIGNILSFVCNIHKSEAVTWILDSGATDHVASSLTCYSTYREINPIVVRQPTGQQVIATHSRTVKFTEFLHLEDDISSQRMIGTVDVVEGLYKLRIPAANSVPKANNNFISIKSVLSCNKEVIDIWHFHLGHPSYDRMQLQFNTKVKAIRSDNGAKFIMKQFYHSTVFGCLCYTSTLTNNRKKLDPRASAFVFLGFKPHTKGYITFDLSSRAIMVSRHVIFHEDCFPYVSPSASQSFPAFPVHSYPTIYDYDISYDASNSPIIIAPRRSNRERTRPKKFQDFHTTFTSIATGQSSDYKDLCMALNKPVDSGMIDCPLSSSHMAIDSNDLLEIKSIIQLLDEVFKIKDLGDLKFFLGFEVARSKQGINICQRKYVLDILHDVGMLGSKPASTLIDCVVRLHQQFGTPLDDTTTSSYRRLIGRLIYLTNTRPDITYAVQHLSQFVAHPSSAHQQAAYRILRYLKAAPGSGVFFSTSNILQLKAFSDSDWAGCINTKRSITGYLVYL

SEQ ID NO: 159411 - protein, 67 aa, Glycine max
  Coding DNA Sequence Number=SeqID_42633
MGSCSAGVEGWITSCNMVVVNPLLHRIKEAIMKRKLVMCIYRGIDEVVRRPSSLALAGVNARVAFGH

SEQ ID NO: 159412 - protein, 103 aa, Glycine max
  Coding DNA Sequence Number=SeqID_42634
MTYFTPRYRRLLRLMGRSKGGEAWPERWRSSAPSTTGSRDYLPEESSLTQPNYSSVPSKALSKQLFQYSQCAVHVYQPQKRLPEKGLCSNPGEDLSPSEAVEQ

SEQ ID NO: 159413 - protein, 456 aa, Glycine max
  Coding DNA Sequence Number=SeqID_42635
  Homolog annotation: Hit_ID=Q1S7C5; Match level="QueryCoverage=21%, HitCoverage=8%, E-value=3e-12, Identity=37%"; Hit description =Integrase, catalytic region
  Subcellular localization annotation: CTP_CleavageSite=66; ConfidenceScore=5.77e-01
MASINNSQPPPPPPPPDSLAPVTKSSIPMLVRTVSVIPQSTSSIQMPILTVFPSSTPILFPSSTLTVMSVPPVPLFTAPFTVEFMSTAVPSLSSMADPPISLMMTPVVATPLLSFPASTAIPEAVSSSALQPSSFVVFDGRSTDLFDDDSSGCDTTSVVPCFNCDSGSCVIFCFEAFLLLACNLCETCELELLAVVNPVIPPQFRTLADQDLGIFFPEYLAWESQDQLFSCLQSTISPETIVDALGSIGVTILFDEQLDVIIEGLPRDYDSVMSLICSKFEPLSIDEVETLRLVHEAMLDRFQKRDSQIIVNLTQGASTSSTVNFSQGASTSNSNAYVQAVQVLQNVPSSSCSSSSTQSFDAQAHLTQGNYNLRFLECEFRPNSTSKASSRGGRSYGGRNGGRGNAGREDGCGRGRFAIVQCQQAVNQQSSVPQTVTQTQQPPSAQQCMPIMAPFP

SEQ ID NO: 159414 - protein, 59 aa, Glycine max
  Coding DNA Sequence Number=SeqID_42636
MVFGYRRIADGDRSSSSGAEGRVPKKGKTNRFGDGGVCEWEKGREKLPRRWWGSLPSRT

SEQ ID NO: 159415 - protein, 235 aa, Glycine max
  Coding DNA Sequence Number=SeqID_42637
  Homolog annotation: Hit_ID=Q1T555; Match level="QueryCoverage=36%, HitCoverage=67%, E-value=1e-07, Identity=34%"; Hit description=RNA -binding region RNP-1
  Pfam annotation: Domain name=RRM_1; Domain location=68-138; Score =36.9; E_value=6.8e-08; Accession=PF00076.12; Description=RNA recognition motif. (a.k.a. RRM, R
MRERERETERDSERDSGWERVRSRRERRENERTRGMEGPCLFIAREGKGGQQRRLRVNWRDHRNISSFYFTRFPEDTTEDELWKIFRRAGDVREVFIPNKRNRTGRRYGFVRFIGVDNVQQLERRLDNIVMGGLKLYVNIPKFERGRGRVQPQSTGGREHTRLVEQGRRETYQAQKHTATPGLVRGSFADVVARREPRIQQRRTSAVQNAKTNTSRSEVHLDRPMTAPKWLQDAW

SEQ ID NO: 159416 - protein, 200 aa, Glycine max
  Coding DNA Sequence Number=SeqID_42638
  Subcellular localization annotation: CTP_CleavageSite=27; ConfidenceScore=5.22e-01
MKFPNSQLFFPLFFFFFFAFTPFRALGQQTDWNSEETQHGNGVRRRVLLSFKEKPSGSNVTFECAPSGPCVPCLYSEKDYFNIRDLRRLYMFGDEKYRCSETGYRIPFKCVEIKDSTKDAKKTKSQKGRLSLEISDGIAESHIVSHVAGEINPSQSHRRLVDDSLSSDNSSQAYITYRSCITPVNEEKLSLLNFEVIFSL

SEQ ID NO: 159417 - protein, 136 aa, Glycine max
  Coding DNA Sequence Number=SeqID_42639
  Gene Ontology: Mol. function=ATP binding; Biological process=defense response
  Homolog annotation: Hit_ID=Q1SWV1; Match level="QueryCoverage=59%, HitCoverage=7%, E-value=7e-15, Identity=52%"; Hit description =Disease resistance protein
MAEAVLEVALEKLSSFIGKEMGLYLAYELDDILDECAYEALGLEYQGVKSGLSHKVATIMGTMSPHKLSMLLEEDGWELFKHQAFGPNEEEQAELVAIGKEIVTSVGECLLQQSTRRFSTLQRKGNEWLYVKENNL

SEQ ID NO: 159418 - protein, 99 aa, Glycine max
  Coding DNA Sequence Number=SeqID_42640
  Homolog annotation: Hit_ID=Q5W7C9; Match level="QueryCoverage=56%, HitCoverage=24%, E-value=5e-10, Identity=60%"; Hit description =Unknow protein
  Subcellular localization annotation: CTP_CleavageSite=53; ConfidenceScore=5.34e-01
MQQPLPATLQLPVISETAMSEQFSYSIARSYPLFTAKTNGVSNPIRSPSFRLSVSVQQSVFAVDVLFDLYAFPYSTPEIPSAPTVLQLGSFHCLSKVEP

SEQ ID NO: 159419 - protein, 545 aa, Glycine max
  Coding DNA Sequence Number=SeqID_42641
  Homolog annotation: Hit_ID=Q6YRM6; Match level="QueryCoverage=94%, HitCoverage=82%, E-value=1e-123, Identity=44%"; Hit description=Zinc finger (C3HC4-type RING finger) protein family-like
  Pfam annotation: Domain name=DUF23; Domain location=256-515; Score =178.3; E_value=1.9e-50; Accession=PF01697.17; Description=Domain of unknown function
  Pfam annotation: Domain name=Glycos_transf_2; Domain location=261 -433; Score=-21.0; E_value=0.1; Accession=PF00535.16; Description =Glycosyl transferase
  Pfam module annotation: Pfam domain module=DUF23::Glycos_transf_2; Domain location=256-515::261-433
STLSLLYSSASNSVLDPFQPTAPSYSLQHRILFPDHHLLIITNPQQQKLHELECVYYTLHPNASSSGSPEPVFQVHVRPVLSTDRYDESRSIVRCPLTQTNSSAGDASKAVDMRRRGEVGHRNLGVLMNQTAQSWDRVAYEATLDGDTVVVFVKGLNLRPHKISDPTRIRCHFGLKSFDKDNAFLLTTRAVSVAQEVVRCMLPQSMRNNPDKARGIRVTVSYLGGNVRHPVRVLVRSVSRVSSPGGGGKVQKRNRKKYELCACTMVWNQASALREWVMYHAWLGVERWFIYDNNSDDDIEKVVQDLDLQGFNVSRKSWPWIKTQEAGFSHCALRAREECKWVGFFDVDEFFYFPSEFRQPLGEGVPGENYLRSVVANFSSSKFIGEIRTACHSFGPSGLKSPPKQGVTLGYTCRLQSPERHKSIVRPDLLDISLLNVVHHFQLKEGFRYHNMPEGTAIVNHYKYQVWETFKAKFFRRVATYVVDWQEDQNKGSKDRAPGLGTEAIEPPNWRQQFCEVWDTGLKDFLVSYFTEPATGLMPWEKSSL

SEQ ID NO: 159420 - protein, 127 aa, Glycine max
  Coding DNA Sequence Number=SeqID_42642
MTAHDTYHQFPLSPLSEKSALSPRLIAEKSFFLIMSIHFNNSFLAKSLLTMIGNSKFFLHVYRKPSENGLKVTYDQSIQKCIFERVRKHGQSQVPISGTTLLLFSCRCCLFICKLEQCSHRGVARTP

SEQ ID NO: 159421 - protein, 134 aa, Glycine max
  Coding DNA Sequence Number=SeqID_42643
MICLHGCGSHVFGIRVLCDLEEDSSVKACDPKSEEGGLDRLITRDKTLLLDIDENKWSFFELVGILKDDIKFAAPSDGEEGVVIIVSESNGSDTKSDEGGSENNNKGALFEDNKEERAVVIGDGFNSEDEPLVM

SEQ ID NO: 159422 - protein, 126 aa, Glycine max
  Coding DNA Sequence Number=SeqID_42644
  Pfam annotation: Domain name=zf-GRF; Domain location=19-61; Score= -4.2; E_value=0.097; Accession=PF06839.3; Description=GRF zinc finger
MGCLCEWNALEPKEENGIHWCDKVAIQLISRTKKHPDKIFWQYAEWNEDKRCKFLGWDDDLAKYLNQGFGSTVEVQDLKKMLAKEDAQSRGYAKGVEELRYVQVEKDEGPEADALPRLLIAAEGPS

SEQ ID NO: 159423 - protein, 494 aa, Glycine max
  Coding DNA Sequence Number=SeqID_42645
  Gene Ontology: Mol. function=metal ion binding; Cellular component =integral to membrane; Biological process=defense response to bacterium
  Homolog annotation: Hit_ID=Q4VG19; Match level="QueryCoverage=99%, HitCoverage=96%, E-value=1e-176, Identity=61%"; Hit description =Pollen ankyrin-like protein
  Pfam annotation: Domain name=Ank; Domain location=111-146; Score =13.8; E_value=0.32; Accession=PF00023.20; Description=Ankyrin repeat
  Pfam annotation: Domain name=Ank; Domain location=199-231; Score =36.3; E_value=1.1e-07; Accession=PF00023.20; Description=Ankyrin repeat
  Pfam annotation: Domain name=Ank; Domain location=242-277; Score =19.3; E_value=0.014; Accession=PF00023.20; Description=Ankyrin repeat
  Pfam annotation: Domain name=Ank; Domain location=44-76; Score=39.5; E_value=1.1e-08; Accession=PF00023.20; Description=Ankyrin repeat
  Pfam annotation: Domain name=Ank; Domain location=77-109; Score=30.1; E_value=7.5e-06; Accession=PF00023.20; Description=Ankyrin repeat
  Pfam annotation: Domain name=zf-C3HC4; Domain location=344-393; Score= 13.0; E_value=0.0072; Accession=PF00097.15; Description=Zinc finger, C3HC4 type (RING finger)
  Pfam module annotation: Pfam domain module=Ank::Ank::Ank::Ank::Ank::zf -C3HC4; Domain location=111-146::199-231::242-277::44-76::77-109::344- 393
MGNSFGCSASGERLVSAARDGDLVEAKMLLECNPCLAKYSTFGGLNSPLHFAASKGHNEIVALLLENGADVNSRNYCGQTALMQACRYGHWEVVQTLLLFKCNVMKADYLSGRTALHFAAINGHARCIRLVVADFVPSAPFEALHAHMVAEGDASNTPDLLEVYTAVAFLMGLPEVCTAVEMRSMCSALSKFINKTADAGITALHMAALNGYFDCVQLLLDLSANVSAATFHYGTSMDLIGAGSTPLHYAACGGNLKCCQARIASTLIGASRMALNCNGWLPLDVARMWGRHWLEPLLTPTSDATISSFPSSNYLSLPLMSVLNIARECGLQSTTTSSNEVDACAVCLERQCSVAAEGCGHELCVRCALYLCSTSNVSSETGGPPGSIPCPLCRHGIVSFVKLSDRPSLSLTPEIRRNRVASVPSEMLCPVTCTPFPSVAIPLCTCNDGPCPSFEPREAEAQDGSPRHSQAAMMDQNKMDGPRLEKMTCSGMFW

SEQ ID NO: 159424 - protein, 84 aa, Glycine max
  Coding DNA Sequence Number=SeqID_42646
MTGRHRKARKKSHVEGPLGTQEARRSNTLRTCQRAPVKKGKEKKKSIAKGATGGEAIPIDPNVVAVATTHFVQAENTDPNSTCG

SEQ ID NO: 159425 - protein, 301 aa, Glycine max
  Coding DNA Sequence Number=SeqID_42647
  Gene Ontology: Mol. function=ubiquitin-protein ligase activity; Cellular component=ubiquitin ligase complex; Biological process =protein ubiquitination
  Homolog annotation: Hit_ID=Q93VZ1; Match level="QueryCoverage=85%, HitCoverage=58%, E-value=4e-76, Identity=56%"; Hit description =Immediate-early fungal elicitor protein CMPG1
  Pfam annotation: Domain name=U-box; Domain location=27-100; Score =78.8; E_value=1.8e-20; Accession=PF04564.6; Description=U-box domain
MVLGWRRRKGCNNNRRKGGKSITELVIPNHFRCPISLDLMKDPVTLSTGITYDRESVERWFDEGNITCPVTNQVVRNFDMIPNHSLRIMIQDWCVENRQHGVERIPTPRIPISPNEVAELLMQVKASARGLDQYGCLKLVQKLKRWGGESERNKRCIVDNGAPVALASSFDAFANDSVERNVVVLEEILSALNWMFPLQLEAHKSLGSLASLRCMVWFLKHQDLSGKEKSIVALKELLSFGDVQHVEALSQIEGVNVLLEFINKRISPTITKASLRVVWYLVSSSSKSTLKKEGTKPAGMI

SEQ ID NO: 159426 - protein, 204 aa, Glycine max
  Coding DNA Sequence Number=SeqID_42648
GDLFAGFDNGFSGSEYEPVDEDGNDNEDYESENISDFEETIDVTGNNYLDDDIEKIYVERGIKTMLYRKDFNCIEFKMEEQGLLMSVTLVVAHGGSMHPLLQISYPAMKQTLLEKYGVKPGSKMQFYRAKRKVQQTTKGVHVVSYNDLPPWIVAVENENKGSIVKLNVELVPNPNMNTQFKRLFFCLDAQKKGFVKGYAGLGLE

SEQ ID NO: 159427 - protein, 144 aa, Glycine max
  Coding DNA Sequence Number=SeqID_42649
  Gene Ontology: Mol. function=phosphoprotein phosphatase activity; Cellular component=cytosol; Biological process=mRNA processing
  Homolog annotation: Hit_ID=Q2QX64; Match level="QueryCoverage=83%, HitCoverage=61%, E-value=7e-35, Identity=54%"; Hit description=Ssu72- like protein, expressed
  Pfam annotation: Domain name=Ssu72; Domain location=6-144; Score =143.6; E_value=5.2e-40; Accession=PF04722.4; Description=Ssu72-like protein
MYVIYMSIICCWTSLWNLDLECSYKRNGIFPMLKRNSTVKLAPQRWQENAADGSFDVVVTFEEKVFDMVIEDLHNRDHALLKTVLVINLEVKDNHDEAAVGARLTLDLCREIEAAESWEESIDEIIAGFENKHRRKLLYSISFY

SEQ ID NO: 159428 - protein, 165 aa, Glycine max
  Coding DNA Sequence Number=SeqID_42650
  Gene Ontology: Mol. function=binding
MALDEISHDLAVSGGRVSNIDATEDTCCKLPGTDFLSSKFWKKTEGRYSTSRFSLGSIPSTDAVHIATNKDGKREILTANNNRLQHGKGGYFVNPLAEVQSDLKGHHTYKLSKNLFQDAVRRYDGIQPATESLRNQNIRKRGENDEEFSSFCQNWHIEWVLKMKN

SEQ ID NO: 159429 - protein, 505 aa, Glycine max
  Coding DNA Sequence Number=SeqID_42651
  Gene Ontology: Mol. function=binding; Cellular component=microtubule
  Homolog annotation: Hit_ID=Q6Z5N1; Match level="QueryCoverage=95%, HitCoverage=72%, E-value=3e-46, Identity=30%"; Hit description =Putative potyviral helper component protease-interacting protein 2
  Pfam annotation: Domain name=HEAT; Domain location=209-245; Score =31.3; E_value=3.3e-06; Accession=PF02985.12; Description=HEAT repeat
  Pfam annotation: Domain name=HEAT; Domain location=86-122; Score =20.7; E_value=0.0052; Accession=PF02985.12; Description=HEAT repeat
  Pfam module annotation: Pfam domain module=HEAT::HEAT; Domain location=209-245::86-122
PPLSGTESTHNLRQRVITCLNKLSDRDTLAGAAAELESIARTLNHDSFSSFLSCIHNTDSSSKSPVRKQCVHLLNVLSRFHGEALSPFISKMLATVLRRLRDTDSAVRSECVDAVASMSSRITRPPFSAAFLRPLMDALAQEQEANAQIGAALCLAAAVEASPDPDAEALRRSALPRLGKLVKSDACRARAALLVLIGSVVGAGGASSRGAVNWLVPCLVEFLGSEDWTVRKAAAEALAKVASVERDLASQHKALCLDSLQNRRFDKIKVVRETMNRALETWKEVTEDAPASQVKSECASVGTDDGKSQCVTKSSPNVGFKSSSKTVIANRSPASVVSFMSSIKRESSLKSNERHLRMGTMHQQGQEKSSDEKLETPFLGSSHSNMSREDDIKRCNVEVSKPPPYQNQNGVNSRAEIKRVLFSKMSDEKMRRFSGSKSRVVPCIDDDDLDADVIVNNANEVCESPQDVEEFALIREQLLQIENQQSNLLDLLQVYYSAVIYLLPY

SEQ ID NO: 159430 - protein, 124 aa, Glycine max
  Coding DNA Sequence Number=SeqID_42652
MGIKIYVMIEAGKKIKGMLVYCDNNNAPIPLRSTSQQIYNDVVLLAILDPESNSSSNGGFSSCCSLAASAMGSPQHHSGPQKETMMMGLRDCGYGEIFCCGVACVWLFYDFTKPSCPLEARVEG

SEQ ID NO: 159431 - protein, 150 aa, Glycine max
  Coding DNA Sequence Number=SeqID_42653
MPMIHMRSHIRGFLVEGSLKTMRFGESEIEDNSVVPEKDASFIDGIFYQSASQGACGPSYLGLCWWRCHKDMKLKECKGVFKLWWKGVDNEIKEFALDSHAVELCNHYVSTDNVVKMYVKVLNGGGNEVAVGGNENAQGGNEVVTAGRSQ

SEQ ID NO: 159432 - protein, 109 aa, Glycine max
  Coding DNA Sequence Number=SeqID_42654
  Gene Ontology: Mol. function=nucleic acid binding; Cellular component= chromatin; Biological process=RNA-dependent DNA replication
  Subcellular localization annotation: CTP_CleavageSite=36; ConfidenceScore=5.22e-01
MTKVMQAQMKAICQMNGNGSTVVTNSIAPLNPQYTRLSEFRRNDLPFFRDSVDPMEAEEWLQKLEKFLRVMICDDAQKVDFATYMLESDAEHWWNNTQGNLATSGALIT

SEQ ID NO: 159433 - protein, 107 aa, Glycine max
  Coding DNA Sequence Number=SeqID_42655
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=Q4JIY3; Match level="QueryCoverage=92%, HitCoverage=25%, E-value=3e-44, Identity=84%"; Hit description =Pyruvate dehydrogenase
MDTYRYHGHSMSDHGSTYRTRDEISGVRQERDPIERVRKLLLSHDIAAEKELKDIEKEVRKEVDEAIAKAKENPMPDPSDLFTNVYIKGYGVEILISSNKLYVLQNL

SEQ ID NO: 159434 - protein, 216 aa, Glycine max
  Coding DNA Sequence Number=SeqID_42656
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=P52901; Match level="QueryCoverage=60%, HitCoverage=33%, E-value=1e-54, Identity=80%"; Hit description =Pyruvate dehydrogenase E1 component subunit alpha-1, mitochondrial precursor
MHGTTLPLRAPITAAHELGEDLEERATAAEEGAVVAVGGDDGVHFCDGGLHADGDSLLAVVEVAEAADELGLVEGVRGDLHAPHQGHIEEEGEELRGGGCHGARGGFAVVRGGVDGGLDGEGGVGGGDDGGEGLNGNGVVVTGEGSNGAMNREEKGYVKQKNREDEKPSVGRSELIHLIDERERQRQRQGEYFRYFFQYFTNHGRVACHLLIHCCQ

SEQ ID NO: 159435 - protein, 257 aa, Glycine max
  Coding DNA Sequence Number=SeqID_42657
  Gene Ontology: Mol. function=oxidoreductase activity, acting on the aldehyde or oxo group of donors, disulfide as acceptor; Biological process=metabolic process
  Homolog annotation: Hit_ID=Q4JIY3; Match level="QueryCoverage=31%, HitCoverage=20%, E-value=1e-40, Identity=95%"; Hit description =Pyruvate dehydrogenase
  Pfam annotation: Domain name=E1_dh; Domain location=1-211; Score= -103.6; E_value=0.00054; Accession=PF00676.10; Description =Dehydrogenase E1 component
MGLLGCGLAFAQKYSKDESVTFAMYGDGAANQGQLFEALSIAALWDLPAILVCENNHYGMGTAEWRAAKSPAYYKRGDYVPGLKVSLVNVFFDALVVMVYLLMGGFNVFLQRNLQILIIGNEEIQGYIHGYEAQTRIITGLYEKRIGIIHGTHGTEKGEEKLEGNQRKQKKCISADTILTESCVQQRNLQILIIGNEEIQGMYAFPVLALYVDASVDSPFLASSLGFIPVDGMDVLAVKQACKFAKEHALKNGLLVS

SEQ ID NO: 159436 - protein, 818 aa, Glycine max
  Coding DNA Sequence Number=SeqID_42658
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =87%, HitCoverage=82%, E-value=1e-103, Identity=46%"; Hit description= actin binding
  Pfam annotation: Domain name=Extensin_2; Domain location=5-399; Score= -131.1; E_value=0.035; Accession=PF04554.4; Description=Extensin-like region
  Pfam annotation: Domain name=FH2; Domain location=374-793; Score =443.1; E_value=3.7e-130; Accession=PF02181.13; Description=Formin Homology 2 Domain
  Pfam module annotation: Pfam domain module=Extensin_2::FH2; Domain location=5-399::374-793
MSVNMMLLLVILFVLQSFLIPTCYCQTNTPQNIEIFYPIQTPKPPFPIQPPESQPKPQASPPSPGPVAASKTSSSSSKIGTAVAATAAGTLVVSGLIFCLVQRCFRARKRKEVTNNTASAVDRRVAPQVNVFERMEGNVKGLIVDEDGLDVVYWRKLEGKKLPDKDFQREVLDGTQDKIEDDHEENQRKRSESIQEIPLLRDRSSTSHMNIFLPEESYTIMRIPPPAPPPSVPSSIGGSSTQSPSPPFTPSSPKPLNTSFSSISNITSPALPITDINNQAPAPPPPPPIAGIKSSALPPPPPPIPVKKNSAAAPPPPPPIPNKKNSAAAPPPPPIPPRKSPAPPPPPPKASGLKSSSKPPPTPIERTPSTTTRQGNTSPEVKLKPLHWDKVTTNLDHSMVWDKMDRGSFRVDDDLMEALFGLVATNRNDNTPKVNNSMSPSRDALATSVNTFILDPRKSQNIAIVLKSLAVSRKEIIEALIDGQGLNTDTIEKLGRVAPTEEEQSLILAHEGDPSKLAAAESFLHHILKAVPSAFKRLSALLFRLNYDSEIVEIKEFLQTLELGCKELRNQGIFVKLLEAVLKAGNRMNAGTQRGNAQAFNLASLRKLSDVKSTDGKTTLLHFVVEEVVRSEGKRAVLNRNHSLSRSSSRNSNSSVDSKNSAASNEQRQREYITLGLPVVGGISSEFPNLKKAAVTDYKSFVGSISSLSARIVEIRELVSKCGNDKGGNFVREMNNFLENAEEELRLVREEQTRVMQLVRRTTDYYQGGASKDSVENPLYLFVIVKDFLGMVDQACIEIARNMQKRKTPKRGPCAAKC

SEQ ID NO: 159437 - protein, 440 aa, Glycine max
  Coding DNA Sequence Number=SeqID_42659
  Gene Ontology: Biological process=response to UV-B
  Homolog annotation: Hit_ID=Q10DW0; Match level="QueryCoverage=85%, HitCoverage=78%, E-value=1e-114, Identity=59%"; Hit description =Expressed protein
  Pfam annotation: Domain name=DUF760; Domain location=16-440; Score =638.3; E_value=6.3e-189; Accession=PF05542.2; Description=Protein of unknown function (DUF760)
  Subcellular localization annotation: CTP_CleavageSite=72; ConfidenceScore=5.71e-01
MEAAATATATVLAPPSAFLGRPSVLAFRSNLRFSTKFCKGVIQNMLLSTSVAISKHGHGRHCVGTRRGFVVRAASFTPESSEPSSKIAPLKLESPIGQFLSQILISHPHLVPAAVEQQLEQFQTDLDGDKQKKEPSASGTDLVLYRYTKEVKISYNNNNNNKSLNPIRRIAEVKAKERKTALEEILYALVVQKFMDASISLIPSLTPNHSGQVDSWPSEDGKLEELHSPEAYEMIQNHLALILGNRLGDSTSVAQISKIRVGQVYAASIMYGYFLKRVVQRFQLERTMKILPNATEENSIQQTVVDDSRIRGGEGHSHVMSHPEVSTLPGGGISSGGFGYGSKVSRLRTYVMSFDSETLQRYATIRSKEALSIIEKHTEALFGRPEIVVTPQGVIDSSTDDNIKISFGGLKRLVLEAITFGSFLWDVESYVDSRYHFVLN

SEQ ID NO: 159438 - protein, 127 aa, Glycine max
  Coding DNA Sequence Number=SeqID_42660
MNRVYNFPNWFLQWWNFFGPILEILPEQFDSSKADPEQVKLWFQFHPEFLKAADPETSVFLNQKSHMAAFLAGSKSKEVLTKNLKEVMQMLQQKEESSSSKKEETSSVEEEDPFYPNKDDCFGICLD

SEQ ID NO: 159439 - protein, 63 aa, Glycine max
  Coding DNA Sequence Number=SeqID_42661
MSLPKTPLLLINPMGVCIIRSIQRPCITPMVMAPSTGTSHVAMEAPFPPARLLLLRWLWKRQQ

SEQ ID NO: 159440 - protein, 66 aa, Glycine max
  Coding DNA Sequence Number=SeqID_42662
MAARFQSASESVWKVIWAQSALVILGNDEIQVYERMEIYCTTSFERKIGNPFFFISQSQFSWRPKF

SEQ ID NO: 159441 - protein, 96 aa, Glycine max
  Coding DNA Sequence Number=SeqID_42663
MGVLTSRYRSGGACLRRCRRWKEKTEMVFLVEEHILSEARTQIKECYEKEEYLPSREAFCDSMDENDGHILFKRSTIRRCLLEKKREKVFWCPLKF

SEQ ID NO: 159442 - protein, 1010 aa, Glycine max
  Coding DNA Sequence Number=SeqID_42664
  Gene Ontology: Mol. function=hedgehog receptor activity; Cellular component=integral to membrane; Biological process=cholesterol transport
  Homolog annotation: Hit_ID=UPI000034F451; Match level="QueryCoverage =97%, HitCoverage=90%, E-value=0.0, Identity=56%"; Hit description =hedgehog receptor
  Pfam annotation: Domain name=Patched; Domain location=336-1010; Score= -250.2; E_value=2.1e-07; Accession=PF02460.9; Description=Patched family
ERHSEDYCAMYDICGTRSDGKVVNCPYGSPAVKPDDLLSSKIQSLCPTITGNVCCTEAQFETLRTQVQQVGGNLTVGGIDYFVTDAFGEGLYESCKEVKFGTMNSRALQFIGAGAQNYKDWFSFIGRKAAPHGLGSPYAITFWPNATASSDMKPMNVSTYSCGDISLGCSCGDCPSSSVCSNSASTTTNKKDSCSVKVGTLMVKCVDLSLAVLYIILICVFLGWGLYHRIRERKPTYRTKSVSNVISDGALYSHNREKDENLPMQIHMMEDAQQNRNRVRLSAVQGYMTNFYRKYGSYVARHPIMVLASSLAIVLLLCLGLIRFKVETRPEKLWVGPGSKAAQEKQFFDTHLAPFYRIEQLILATVPDHVNSTSTRIVSEDNIRFLFEIQKKVDAIRANYSGLTVSLQDICMKPLDKDCATQSVLQHYSSADHCMSAFKAPLDPSTVLGGFSGNDYSEASAFIVTYPINNAINEEGNGTRKAVAWEKTFIQLVKDELLPMVQSRNLTLAFSSESSVEEELKRESTADAITILVMLGLSGVILVMLSVIGSVGFFSVLGIKSTLIIMEVIPFLVLAVGKWDKVQVQVHAVKRQKLELPLEGRISNALVEVGPSITLASVSEVLAFAVGSFISMPAIRVFSMFAALAVLLDFLLQVTAFVALIVLDSLRAEDKRVDCFPCIKVHADPDIGTGRRKPGLLARYMKEVHAPILSIWGVKIVVIAIFVGFALASIALSTRIEPGLEQEIVLPRDSYLQGYFNNVSEYLRIGPPVYFVVKNYNYRDAWGRVLVIARAALVPDTSYIAKPAASWLDDFLVWVSPEAFGCCRKFTNGSYCPPDDQPPCCAPGESSCVSVGTCKDCTTCFRHSDLHNDRPSTTQFREKLPWFLSSLPSADCAKGGHGAYTSSVELKGYDNGIIKASSFRTYHTPLNKQIDYVNSMRAAREFSSRVSDSLKGVMAILNIQLNALSVVNLVMSVGIAVEFCVHMTHSFTVASGDRDQRAKEALGTMGASVF

SEQ ID NO: 159443 - protein, 907 aa, Glycine max
  Coding DNA Sequence Number=SeqID_42665
  Gene Ontology: Mol. function=DNA binding; Biological process =regulation of transcription
  Homolog annotation: Hit_ID=Q7X9C1; Match level="QueryCoverage=99%, HitCoverage=100%, E-value=0.0, Identity=70%"; Hit description=NIN -like protein 1
  Pfam annotation: Domain name=PB1; Domain location=813-896; Score =95.5; E_value=1.6e-25; Accession=PF00564.15; Description=PB1 domain
  Pfam annotation: Domain name=RWP-RK; Domain location=591-642; Score =99.6; E_value=9.1e-27; Accession=PF02042.6; Description=RWP-RK domain
  Pfam module annotation: Pfam domain module=PB1::RWP-RK; Domain location=813-896::591-642
MGDSGVTSSAATMMEAPPPDGTTTTATSMDFDYMGEFFLDGCWLEASADVSDFLLQSPSFSNPLFDPSLSWPALETNHNKSQDAAFGTQQESHNNIVSVVAGGGYSQQFQSETHSVEGVSEGVRRWWFAPSPIPSPGPGPSIMEKLIRALMWIKDYNRNKDMLIQIWVPIHKEGRPILAADDLLFSLESKSLNLAKYREISVTYEFSAEESDSKELARGLPGRVFRYKVPEWTPDVRFFRSDEYPRVDHAQEYDVRGTVAVPIFEQGSKTCLGVIEVVMTTQQINYGPELESVCKALEAVDLRSSKQLSIQNVKACNRTYEAALPEIYEVLRSACEMHRLPLAQTWVPCVQQGKEGCRHSEDNYLLCISPVEHACYVGDPSIRSFHEACTEHHLLKGEGVAGGAFMTNQPCFSDDITSLSKKDYPLSHYARLFGLHAAVAIRLRSIYNSTDDFVLEFFLPVDCNDSEEQRKMLTALSIIIQRVCRSLRVIRDKELEEANLSVDEVIALADSGFARNAIFSEPQYKGMVASLDAEEKSSETMGRKFSDLRQQQESPILKGNLDCVKECSTSVEGNLSSLGTNKTGERRRAKAEKTITLQVLRQYFAGSLKDAAKNIGVCTTTLKRICRQHGIKRWPSRKIKKVGHSLQKLQLVINSVQGASGAFQIGSFYSNFPDLASPNLSGTGFFSTLNQSDYPNSTSTQPDHGSLSPEGASKSPSSSCSQSSISSHSCSSMSELQQHRTANGAGNKVSTTVSEDSAGVVLKRISSEAELKSLSQDRAKLLPRSQSQETLGEHPKTQYQQPLLKTSSSKVDSHRVKVAYGDEKTRFRMPKSWGYEDLLQEIARRFNVSDMSKFDVKYLDDDCEWVLLTCDADLEECIDVCQSSESGTIKLSLQPSSHSMRSSLEFR

SEQ ID NO: 159444 - protein, 215 aa, Glycine max
  Coding DNA Sequence Number=SeqID_42666
  Gene Ontology: Mol. function=RNA-directed DNA polymerase activity; Cellular component=mitochondrion; Biological process=RNA-dependent DNA replication
  Homolog annotation: Hit_ID=Q1RZQ1; Match level="QueryCoverage=48%, HitCoverage=21%, E-value=1e-21, Identity=41%"; Hit description=IMP dehydrogenase/GMP reductase
MANLINQYLQEWNKDLIKDIFNDDDSGKILSLPLILTNEPNLLAWRLTNTGAYTVKSTYHKIMEEILDTSHLKVAGNWVQIWKLNVPPKIRNFIWRLQRNCVPTRLRFRRIVSHVLLNQAARTTTLSNQAPPTLDQGIKWRSPPPNVIKCNLDAAFFTKTTWFYDIPLVFEAETWALYQAIQSSIQLQLNHVIFEIDSKMVVLEVHVHLHVLLIN

SEQ ID NO: 159445 - protein, 98 aa, Glycine max
  Coding DNA Sequence Number=SeqID_42667
MQEINNGYASFQYISQNLTNPTPKHETTNSFDPFFNDGSWQPGPSGTMSFISWNCRSKLHDESSLIQRSFDDNEGDDKKLKGQEHFMITKMMISRIKE

SEQ ID NO: 159446 - protein, 144 aa, Glycine max
  Coding DNA Sequence Number=SeqID_42668
MSKKQNQTQATQAEPNFKNSPPSTSFEDGFPGEALQIVRLAPVSILVVKVCLKDKEPKVHIEHFFNIDSLKNVAYVIKANLMMCGIHHFFKDPKLVVPELIHEFWRTIKLIAKMIAQAIGCEQQGTKFMNSWGNELEDHNGHSL

SEQ ID NO: 159447 - protein, 284 aa, Glycine max
  Coding DNA Sequence Number=SeqID_42669
  Gene Ontology: Mol. function=3-oxoacyl-[acyl-carrier-protein] reductase activity; Cellular component=chloroplast; Biological process=fatty acid biosynthetic process
  Homolog annotation: Hit_ID=P28643; Match level="QueryCoverage=64%, HitCoverage=62%, E-value=8e-54, Identity=58%"; Hit description=3 -oxoacyl-[acyl-carrier-protein] reductase, chloroplast precursor
  Pfam annotation: Domain name=adh_short; Domain location=58-212; Score= 32.6; E_value=4e-08; Accession=PF00106.15; Description=short chain dehydrogenase
MSTRAKSMKPKTTHKVTDFELDELEKSSLSTWSCLFKNTTMLGTLTCLAKGMCSLWWFLVSYSMVAVLMVMLLKKLSWLIEAFGGQALTFAGDVSNEADVEAMIRTVVDAWGTVDVLVNNAVITQDGLLMRMKKSQWQEVINLNLTSVFLCMQELMVCILQAAAKIMTMKKKGRIINITLVIGQVANVGQANYSAAKAGVIGLTKSVAREYASRNITLNTFTLDSGRLGLLEEVVGLVEFLALNPAANTSLGRVFTVDGGMAIYLNFFTSQFISKATKFQLLPW

SEQ ID NO: 159448 - protein, 143 aa, Glycine max
  Coding DNA Sequence Number=SeqID_42670
  Subcellular localization annotation: CTP_CleavageSite=26; ConfidenceScore=5.29e-01
MDAPSSKATPAPQHLLLILVAHKATSAMPHVSRRATPKKQQPSSTADRLRELSETDDNEDGLVFRKRKFAPPLDETSAPQVKKAKPTPQIFLSFENRPPTIQPHPPLPTAYFAPTITDNLVPVPPPSPPKSPPSNPPPLSTEG

SEQ ID NO: 159449 - protein, 93 aa, Glycine max
  Coding DNA Sequence Number=SeqID_42671
MMFLHIKWHQALNESPIGHNQSPKVTSEAVAIAEDINDMSFISAQSAEVTSYTTDKGHDGLLEEDENGAKDCIIKDGGWEKAKNEVTSLKKQV

SEQ ID NO: 159450 - protein, 123 aa, Glycine max
  Coding DNA Sequence Number=SeqID_42672
  Homolog annotation: Hit_ID=Q8LJR8; Match level="QueryCoverage=42%, HitCoverage=22%, E-value=1e-09, Identity=59%"; Hit description=RING -H2 finger protein
MADWARHQTHTIDSLCGHYHLCRLRHNPERAFDSIDGRYQRSFASKSIDSEENVRSSIEGMVGNIYASSSILASSMLLFFLFTLFEFLTMSLFNRVVYEELGKYGDLDNQVLCRERVEELGNS

SEQ ID NO: 159451 - protein, 77 aa, Glycine max
  Coding DNA Sequence Number=SeqID_42673
  Gene Ontology: Mol. function=protein serine/threonine kinase activity; Cellular component=protein complex; Biological process =protein amino acid phosphorylation
  Homolog annotation: Hit_ID=Q39008; Match level="QueryCoverage=93%, HitCoverage=12%, E-value=1e-23, Identity=69%"; Hit description =Mitogen-activated protein kinase kinase kinase 1
VDVSGQVKLADFGLAKVTKFNDVKSSKGSPYWMAPKVVNLKNQGGYRLAVDIWSLGCIVLEMLTRQPPYSDLEGKRK

SEQ ID NO: 159452 - protein, 58 aa, Glycine max
  Coding DNA Sequence Number=SeqID_42674
MEDQGSSSQELCLYLDQLNFYATFALSALGEYDRIVALSACLALSAPSRFRLLHTSSC

SEQ ID NO: 159453 - protein, 252 aa, Glycine max
  Coding DNA Sequence Number=SeqID_42675
  Gene Ontology: Mol. function=oxidoreductase activity; Cellular component=integral to membrane; Biological process=electron transport
  Homolog annotation: Hit_ID=Q9STK7; Match level="QueryCoverage=94%, HitCoverage=62%, E-value=7e-24, Identity=38%"; Hit description =Cytochrome P450 71A26
MGSSKRGVGRCVIGRRYGGSELREPMSQMEELYGVSVIGDYLPWFDWLGRVNGVYGRAERVAKRLDEFYDEVVEEHVSKRGLDGHGDVDSEDQNDFMGILLSIQESITTDFQIDRTFVKTLVMLLFANCNYEASMFVAGSDTTLGVLEWAMTELLRHQNVMQKLQDERFSKSSMNIKGHDFQLIPFGAGRRGCSGIGFVMALNELVLANIVHQFDWSVPSGVVGDQTLDMSQTTGLTVHKKLSLVTLASPNV

SEQ ID NO: 159454 - protein, 69 aa, Glycine max
  Coding DNA Sequence Number=SeqID_42676
  Subcellular localization annotation: CTP_CleavageSite=58; ConfidenceScore=5.38e-01
MGDHHESTAKTFLKKKTPQFFGSPSVQGVERSYAASAPYRSSITSTLTTRTQFLGASMAMPKEAFLAKW

SEQ ID NO: 159455 - protein, 344 aa, Glycine max
  Coding DNA Sequence Number=SeqID_42677
  Gene Ontology: Mol. function=RNA-directed DNA polymerase activity; Cellular component=chromatin; Biological process=chromatin assembly or disassembly
MTQASVLAPPDFTLPFVLETNALGTAMGVVLQQRSYPIAFFSKVFCPRLQHASTYIRELHAITSTVRKWRHYLLGYPFVIITDHKSLKDLMSQVIQMPEQQHYLSKLLGFDYSIQYKPGSDNVAADALSRIHTLENQHFVLSMENFKFLEQLRLSLQDTQEFCDFLHRIQDNPSEHTNFSVSRGCCKDSAQAKDNFFWASMRGVVRDFVSRCLVCQQVKYETLKPANLLQPLPIPCTIWEDLSMDFITGLPPSHGLFVILVVVDRFTKGAHFGALPVTYTAHKVALLFIDIVCKLHGFPRSIVSDHDPILISRFWRELFCIFDTKLRISTSYHPEMDGQTEVLN

SEQ ID NO: 159456 - protein, 482 aa, Glycine max
  Coding DNA Sequence Number=SeqID_42678
  Gene Ontology: Mol. function=RNA-directed DNA polymerase activity; Cellular component=chromatin; Biological process=chromatin assembly or disassembly
MPIGHPQSTGIDLFEITWLEHGTDLGGVKGHSRCRDYMAQVLKFSSGKQTLLPDVIEKECNELAKKRFKQFIHHGLERCQRIAEAEGYYFVFVMSLMGAKSSFGHVVGGHGDLMKSLTELVNDGHGKTVLGSDGVQILVVNTTPLAHIGYLTLKLNFLTMRVSVGSYIDGLGIRVVPERGDRNEKEGVVGEVEAEVGWKGTLAVSWIGRPNKEKLMVREWNIRANLLAYEGAAIANHNLERVDDGGVQEPYMWKVAWVGMPDKALRLSCRVSDSGGRGNCEIGSGVSSVSLWSLQEVSFSEERRFTGSLGGGGEVVVVESGQGVAACPPRAWPGRNVAAATLVEGLAPHGGEVVIDGASLLKLEQSAMRVLVEGWCETSFEGLHGQTLIVRDAMIVEELGDFENPPRWIITVKSRDVELHVQPGNWRGRVIWLRRSRIESIFESMVDWLWEKVEHSLLKSLRGCLLGIVLRHGGTTGQIRPS

SEQ ID NO: 159457 - protein, 167 aa, Glycine max
  Coding DNA Sequence Number=SeqID_42679
  Gene Ontology: Mol. function=binding
  Homolog annotation: Hit_ID=Q1EPA6; Match level="QueryCoverage=63%, HitCoverage=14%, E-value=5e-20, Identity=49%"; Hit description =Kinesin light chain-related
MYLDKFSKQTSPKTLQIKFVRMTFYPYSMIQIQTNKKPQASFTNEGTGVAEDLDLDLEALVVVGDGSIDQAKHKEGVVKLHVVREDDEGMIGATFNVRDLDSAFEDRDGFFEVSEVVVDGNKDVEAHGKIEVGLSLDDTVLKGFGGNGVTSRDSGCQERHQKELEGF

SEQ ID NO: 159458 - protein, 117 aa, Glycine max
  Coding DNA Sequence Number=SeqID_42680
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS4; Match level="QueryCoverage=91%, HitCoverage=12%, E-value=8e-45, Identity=81%"; Hit description =Starch branching enzyme
MAESLTIIVRSKQYLATQKPVNLALGYRNPHGYGFSFGSRRSIHERVSSHFKGIAVMTDDKSTMSSTEEDLENIGIFHIDPSLKPYKDHFKYRLKRYVDQKKLIEEYEGGLEEFSQV

SEQ ID NO: 159459 - protein, 164 aa, Glycine max
  Coding DNA Sequence Number=SeqID_42681
  Gene Ontology: Mol. function=transferase activity; Cellular component= chromatin; Biological process=DNA integration
  Homolog annotation: Hit_ID=Q1SPQ1; Match level="QueryCoverage=66%, HitCoverage=21%, E-value=4e-20, Identity=45%"; Hit description =Polynucleotidyl transferase, Ribonuclease H fold
MTVIPMVVVGDVGGGAYMVLMVVFKVAVMEVQIESQSSYVVSSGAKPVHCTKTFRTGERVYLPDMASTGRHGTPDGFWRKWEVATDKRHGQCVPRYKKARKNVWRVWSMRAEGKFGGKAGAERKPNLRHQSGRPDCENLLSFPLRLVPWRGDVEGKSVVGFLTP

SEQ ID NO: 159460 - protein, 563 aa, Glycine max
  Coding DNA Sequence Number=SeqID_42682
  Gene Ontology: Mol. function=DNA binding; Cellular component=beta -galactosidase complex; Biological process=DNA integration
  Homolog annotation: Hit_ID=Q1SS72; Match level="QueryCoverage=95%, HitCoverage=38%, E-value=1e-107, Identity=36%"; Hit description =Integrase, catalytic region
  Pfam annotation: Domain name=zf-CCHC; Domain location=246-263; Score =4.2; E_value=0.2; Accession=PF00098.13; Description=Zinc knuckle
  Pfam annotation: Domain name=zf-CCHC; Domain location=282-299; Score =12.1; E_value=0.0098; Accession=PF00098.13; Description=Zinc knuckle
  Pfam module annotation: Pfam domain module=Retrotrans_gag::zf -CCHC::zf-CCHC; Domain location=77-192::246-263::282-299
MNETAFNSVESYLYLHPSENPATALVSPVLVSTNYHSWSRSMVTALSAKNKLEFVDGSAPEPLKTDRMYGAWRRCNNMVVSWIVHSVATSIRQSVLWMDKAEDIWRDLKSRYSQGDLLRISDLQQEASTLKQGALSITEYFTRLRVIWDEIESFRPDPVCTCNVRCSCPVSTIIGQRKLEDRAMQFLRGLNEQYTNIRSHVLLMDPIPPISKIFSYVAQQERQLLGNCSPNLNFESKEISINAARSVCEYYGRIGHTENVCYKKHGMPSNHETRNRSNGGRKTCTHCGKIGHTIDVCYRKHGYPPGYKPYSGRTTVNNVVTMNDKSMEDQTQHHEVQDFVRFSPEQHKALLALIQRPSTGSTTSEQTKQVASISSCTTDKLPNPGMSSSTISSWILDSGATDHVTCSLNNLHAYKPINPVIVKLPNGNHVQATHSGTAYLSKHITLFNVLYIPTFTFNLISISKLVSSTDCALILSSNSCMLQDTNKRMKIGIVEERHGLYHLIPDQNNKAVCSTIIHPKCNVIPIDLWHFRMGHLSTERLQYVMHRNTRTKRYCGTQAPTFA

SEQ ID NO: 159461 - protein, 60 aa, Glycine max
  Coding DNA Sequence Number=SeqID_42683
MPAGEEGRWGQVRVYIMTLGVLAPYRRLGIENMGKTLETKHAELHSKTALRNLEDANKVA

SEQ ID NO: 159462 - protein, 153 aa, Glycine max
  Coding DNA Sequence Number=SeqID_42684
MLKEENTEENYSMFHDSLALQDTERSFYEVITHNHNYPSSSTHHHVHNYLSVESPDQSLSCCSTSSSAESQWRNLDHIPDNFVFHSNSTTNMNTGFGFFNDSLQAGFLDSTFLQKFQRGVDQGAQFLPKHTPFIIAPSFPKAPHLVIKTEAEE

SEQ ID NO: 159463 - protein, 83 aa, Glycine max
  Coding DNA Sequence Number=SeqID_42685
MATKSKTYQDTVETADTRRGAKSALVSMAARKATSTDTTDTVDIKQENLPKHDQGGFARLRVVGQGQWQCRGWLCKVGQEQWQ

SEQ ID NO: 159464 - protein, 70 aa, Glycine max
  Coding DNA Sequence Number=SeqID_42686
  Homolog annotation: Hit_ID=O22490; Match level="QueryCoverage=46%, HitCoverage=31%, E-value=4e-07, Identity=72%"; Hit description =Cytochrome C
MATCKGQEKVESKMMSDARHFVTGTFVDGVALNALGLEDLLIVFRVFGRSFIEQQKLEAIDGSSVMVGLE

SEQ ID NO: 159465 - protein, 74 aa, Glycine max
  Coding DNA Sequence Number=SeqID_42687
MAPPKSSTCGGMTRVEYEATLHGDIVVMFVKGLNLRSHKISDPTRIRCHLGLKVSTKAMPFYLPRELFLWLKKL

SEQ ID NO: 159466 - protein, 66 aa, Glycine max
  Coding DNA Sequence Number=SeqID_42688
MVGGGGRGEACVGFHDCCDKHPVNIVASQLCISTKFTSTESSMAKYPLRSIEFPIAEFHNSSCHFY

SEQ ID NO: 159467 - protein, 54 aa, Glycine max
  Coding DNA Sequence Number=SeqID_42689
MAEEGRATSKRRAYSLSSSSSNLGASTPMLANALIPWMVALKAWIPASYNLKRM

SEQ ID NO: 159468 - protein, 167 aa, Glycine max
  Coding DNA Sequence Number=SeqID_42690
MCHLTANVCVYYNGQIYNTNEGPTFISNNIKTFMVNKAITLTQLLELVPQKISIEPHKHIQHLCFQCPIFELGQPHMYTCFILGDDPDLRPMFNIFYNNPTLPFVELFATIYDNNNPPNNQHDSTSNVEDLLYEYESCWVKDHGNDSDSSSKPQGCNTSPSHEPIFK

SEQ ID NO: 159469 - protein, 176 aa, Glycine max
  Coding DNA Sequence Number=SeqID_42691
MHTGARFHPCRCKEMSVDRAHQHDHSYTGVAPTRHPEEPNRALGFPALVTGLWVAPARHPVDSEEPNRALGFPALVTGPCQSYRGSCLQDTQWTRRSPTGPWSCQAIITGLCQLYGVLVIASKGIRPPTNRAFIKKYCVPRQAQGETPQQLGDGRQRATDAPPSPIEFTSAHPQKG

SEQ ID NO: 159470 - protein, 140 aa, Glycine max
  Coding DNA Sequence Number=SeqID_42692
  Homolog annotation: Hit_ID=Q338Y6; Match level="QueryCoverage=70%, HitCoverage=25%, E-value=1e-09, Identity=33%"; Hit description =Expressed protein
VRLKDSEIIFLREKLEEANRQNKAIENRLNQIGQLSVLDNLHITGLSPSHFITVLRHTVRSIINFVRLIVDDMRYAGWDIDATVDAIEQNVVYMAEDHKCFTKMAKRVWLLHCLAFSYEPQASIFQVGKWCIFSDVYMEV

SEQ ID NO: 159471 - protein, 165 aa, Glycine max
  Coding DNA Sequence Number=SeqID_42693
  Gene Ontology: Mol. function=nucleic acid binding; Cellular component= nuclear pore; Biological process=DNA integration
MVSNCMLPKYGADLFQDPTLYRSVVGALQYVTLTRPEISFAVNKVSRFMAKPLESHWAVVKRILRRSTSGAAIFLGPNLISWWSQKQKSAMSIAQNPLFHSRTKHMEIDVFLVREQVLAKKLFIFHIPALDQWANVLTKPLSSARFEFLRDKLNVKSFSSKNSSL

SEQ ID NO: 159472 - protein, 42 aa, Glycine max
  Coding DNA Sequence Number=SeqID_42694
MAGEEKGLSGVNEMRDNFSKLKDNNLESTMSPTLYALDAAVG

SEQ ID NO: 159473 - protein, 190 aa, Glycine max
  Coding DNA Sequence Number=SeqID_42695
  Subcellular localization annotation: CTP_CleavageSite=27; ConfidenceScore=5.30e-01
MWYHPQGNSLSMSTRHSHLGKLGSKCRGHSVVHRQLLPPPTVISLSLKGVLNRVTHPLVQVFLLTRNYKYLLAKFILFPCHMKYETWAPSRTSDKVNAPSHKHTTYETWASSRTSDKVNAPPTNIHNIQRMKHGHHQGHLTKSVHPSMNIQNRHHHSVFQHQQHFILISLSTSISFHLNDIVNNKNIISF

SEQ ID NO: 159474 - protein, 203 aa, Glycine max
  Coding DNA Sequence Number=SeqID_42696
MVVAAGIGYTMSHGGCFGACRECGFFMMHWPHPCPKCTGIGPIIDSITVLGFDLVKNHLFQQLLTSPISYCHRHQFITTAYWSVLVPDALASNVLASLSWLAKVDALLDMVEGLHHTCHQDHIQDLRRLQQHGTLAEFNNAFDAISGGIDIKTSYPIAQRLFAMRRYGERCCTQPYPFICKEAVSGFEPMTNKSPRHNFMSIS

SEQ ID NO: 159475 - protein, 502 aa, Glycine max
  Coding DNA Sequence Number=SeqID_42697
  Gene Ontology: Mol. function=DNA binding; Cellular component=nucleus
  Homolog annotation: Hit_ID=Q1RZ91; Match level="QueryCoverage=86%, HitCoverage=38%, E-value=1e-130, Identity=58%"; Hit description =Quinoprotein amine dehydrogenase, beta chain-like
MALLLPQAVPLLRTVSTDKEFTVRPSDMLPCQVNSKDEQKGYSVDVLPSDIVEAGRSSFNKEMCSQQLLGHDLTNGTITCHASGLDFKDMPQNCDVCIPESVLDDMSPKDLIIYERSDDACLHVKENPAHVFLSSVQKDLPTAQDFTGGVKAKSYQLENMATLAEKTQDEVVGQTGNAEMMIMSSNLPKLVYTRKKLRNDIPFQENCSVMECTEYDKFKHVTPEMYTAKDTLHPSEIILVNNSNDKPCETDDTAGLCVQTPQIRSDVLGGHSNLVDPNPTSSQNLTLFADENKCFGTKEVQLISEPMPLQNQELKNNLGSSVKFVGRYLHPMPVSSLFLSTREDEIHVCVLCGYLTGQYRTLFTYKVAIAEPTLGCPSVMAHSSILLPDPKHNFIKETMVERSGVQLTPGGQYVVLIGSIKTPNCREGKIDCHCSTCKSVCSEKNALKIVQVEHGYVSVVTTLETVDNWETAGVGHEFKMEVIMVTLFALAFPRAIYVPFRI

SEQ ID NO: 159476 - protein, 225 aa, Glycine max
  Coding DNA Sequence Number=SeqID_42698
MKKLIPMPQQDKNSMEGSGSEFNEAKASSWERKVELSSFDRSIEGETDLKGSNFECGSDPLQFLKSENRSKEGSVIKNHTLCGGEETKNDEAKLAIEKKIEKVMEEEVDPPIKREKPKENGVTNVGCEDNFLDNPITDLIKKEVEAGDSTKPHCFQDSDFHKKIVMVKQKSFMKVVGTTMVLKSWNVNLLGEPLALNFVASMADNLAMELRQKECTEPVKLIKVI

SEQ ID NO: 159477 - protein, 136 aa, Glycine max
  Coding DNA Sequence Number=SeqID_42699
  Gene Ontology: Mol. function=DNA binding; Cellular component=nucleus
  Homolog annotation: Hit_ID=Q1RZ91; Match level="QueryCoverage=91%, HitCoverage=10%, E-value=1e-44, Identity=67%"; Hit description =Quinoprotein amine dehydrogenase, beta chain-like
MAKTRSAEKAAQVDAEDRTDGLEIISIGSLYKGSWDKKYWTTSRGKDRYPYPVGYQAVRAYNGTTYKMEICEGVNGPRFLISSDDGSSSSGKTPDQAWEEFQKKGCPRIKIWHGKRLSSKMDGLEVEIIDVDEIYL

SEQ ID NO: 159478 - protein, 234 aa, Glycine max
  Coding DNA Sequence Number=SeqID_42700
  Gene Ontology: Mol. function=DNA binding; Cellular component=nucleus
  Homolog annotation: Hit_ID=Q1RZ91; Match level="QueryCoverage=87%, HitCoverage=16%, E-value=4e-79, Identity=69%"; Hit description =Quinoprotein amine dehydrogenase, beta chain-like
MVHATYIVHPFIYIFGSEKIEYFIIPADGSVSPGIMELKRVPKCTHLVVGHNSRGEFSLWDIAKCNCVTSFSALKSPVNEFFPISLFQWQTKGSGFSNVNIEEQADKLLEATNLWYSEQRDICWFSPIEEDVAMWLFVSTTSDLDSCHNHVSTSSSYDIHTARSWRLALLMKNSIIFGSPLDLRTSGNGVSCGYGIISTSDGVVYMWELSKGSKLDTLHHFQGMLQCATFTCML

SEQ ID NO: 159479 - protein, 185 aa, Glycine max
  Coding DNA Sequence Number=SeqID_42701
  Gene Ontology: Mol. function=DNA binding; Cellular component=oxygen evolving complex; Biological process=DNA integration
  Homolog annotation: Hit_ID=Q1S326; Match level="QueryCoverage=65%, HitCoverage=34%, E-value=3e-27, Identity=57%"; Hit description =Putative receptor kinase-related
  Subcellular localization annotation: CTP_CleavageSite=59; ConfidenceScore=5.45e-01
MAQGDYSRPHRDLQSQQTTVEDTPRATKPSGCSTYTSSRSSCRKSFLISSWNSGQWRIASMERKSWTKAILATREKVSIVLPKHLSEALRHQSSFKSINLANIEGIKPTSTYGGLFRRKRNQIPKQLPFRSAMEGQGQMLSLDVVKELASRVDYDLSFYKRIREAWATIYPKWPHCRRMLRCVFL

SEQ ID NO: 159480 - protein, 104 aa, Glycine max
  Coding DNA Sequence Number=SeqID_42702
MAIIAVVMLSVFCVTSGEVALRKWMMDRDTLGYSRQRDLKNIGELVSGDYPAFGALIWRGSEGLTSTINNFQLLTLPSTQTHLRAWHSSQRERVWPYIVKWTTR

SEQ ID NO: 159481 - protein, 510 aa, Glycine max
  Coding DNA Sequence Number=SeqID_42703
  Gene Ontology: Mol. function=nucleotidyltransferase activity; Cellular component=mitochondrion; Biological process=tRNA processing
  Homolog annotation: Hit_ID=Q6L5J0; Match level="QueryCoverage=99%, HitCoverage=98%, E-value=1e-114, Identity=43%"; Hit description =Putative tRNA His guanylyltransferase
  Pfam annotation: Domain name=Thg1; Domain location=1-246; Score =169.9; E_value=6.5e-48; Accession=PF04446.3; Description=tRNAHis guanylyltransferase
  Pfam annotation: Domain name=Thg1; Domain location=264-507; Score =331.7; E_value=1.3e-96; Accession=PF04446.3; Description=tRNAHis guanylyltransferase
  Pfam module annotation: Pfam domain module=Thg1::Thg1; Domain location=1-246::264-507
MANSKYEYVKCFEVEDEVMFPNIILVWIKASKLHKPHDLNALKLMNSCAVEVLEEYADVVLAYGFSDEYTFVFKKTSKFYERRASKVLSIFTSFFSSIFVRKWDEFFPYKELQCSPSFHGRVIACASVEALQVYLLWRQNICHLTNLHEQCLWRLVERGMNGKEAWDFIKDFDKGELNNLLFDEFNVNYNTLEPIFRQGSCVLKTIVEDIVKYTDNGAPIKRCKRKIITVRSKKIASKRFWNEHTVLLKELGGFVEEINNVTPEYVRSFEFDSKLMPSTWIVVRIDGCHFHRFSEIHEFVKPNDDRALNLMNLCAVAVLEKFWEDIVFAYGVSDEYSFILKKATNLYQRRANTIISAIVSFFTSTYVMRWKNFFPQSELKYPPSFDGRAVCYPSTEILRDYLSWRQVDCHINNQYNSCFWKLVASGKSKREAQNSLKGAQLQKKIEELAIDYNNLPVMYRQGSSVYRDKVDIALIHQENGEFPENYGKVIVGHIDIIGPTFWLEHPNILD

SEQ ID NO: 159482 - protein, 124 aa, Glycine max
  Coding DNA Sequence Number=SeqID_42704
  Gene Ontology: Cellular component=nucleus
  Homolog annotation: Hit_ID=Q5JK63; Match level="QueryCoverage=68%, HitCoverage=25%, E-value=3e-13, Identity=41%"; Hit description=Group II intron splicing factor CRS1-like
  Pfam annotation: Domain name=CRS1_YhbY; Domain location=1-50; Score= -1.2; E_value=0.023; Accession=PF01985.11; Description=CRS1  YhbY domain
MGLKRKNNVPVGRRGIYQAAEVKEIAAELARLSGGIVLDIHEDNTIIMYRGKNYSQPPTQIMSPRVSLSRKKALDKSKYRLEQELAILRAQFKSSAESKTEAAEAIQNSGRESIESGSISNFQL

SEQ ID NO: 159483 - protein, 107 aa, Glycine max
  Coding DNA Sequence Number=SeqID_42705
  Gene Ontology: Mol. function=uroporphyrinogen-III synthase activity; Biological process=tetrapyrrole biosynthetic process
MEVPEHRKWMDERTGPDKKKVTNEFMAGVVEFIDFACAKENYKREGKLRCSCKKFKCMKYHLVDEVKTHLCMKGFMSDYYYWTNHDEQRPPIPPTISNNYYYGSSGV

SEQ ID NO: 159484 - protein, 90 aa, Glycine max
  Coding DNA Sequence Number=SeqID_42706
MDKDQWMHDSIMSEEVDMNEQNEDEAGVKSEHVFPIHDDVLNWAQAVTYEIDSVAVIIRPDTNIGMRGRTSFVLIGCERSGQYKTKKKDL

SEQ ID NO: 159485 - protein, 172 aa, Glycine max
  Coding DNA Sequence Number=SeqID_42707
  Homolog annotation: Hit_ID=Q1STZ2; Match level="QueryCoverage=58%, HitCoverage=21%, E-value=4e-10, Identity=34%"; Hit description=IMP dehydrogenase/GMP reductase
MGSSQKPSLKKRFYQVKIKSLEVTSLRELGQLMGQLQQQAFRKAYGKIWDLARVEVSMEPIASLSQYYDQPLRCFTFEDFQLVPTVKEFEEILGCPLGGRKPYLFSGFYPSTTRVAKVEWGSRSTKEVFGGKGKGLGKSRANGLFFIDILALLIFGVVLFSEYGRVSGPSSD

SEQ ID NO: 159486 - protein, 159 aa, Glycine max
  Coding DNA Sequence Number=SeqID_42708
  Gene Ontology: Mol. function=N-acetyltransferase activity; Biological process=metabolic process
  Homolog annotation: Hit_ID=Q7MBD7; Match level="QueryCoverage=82%, HitCoverage=76%, E-value=4e-24, Identity=46%"; Hit description =Probable Acetyltransferase
  Pfam annotation: Domain name=Acetyltransf_1; Domain location=32-114; Score=26.2; E_value=0.00012; Accession=PF00583.14; Description =Acetyltransferase (GNAT) family
MATLLQIPSIPQVLARWLQHWETYGFGNWAIALTDNPGRVIGFGGLSIRSYADLSINNLGYRFATEAWGKGLATEFAKYTVDYGFGEIKLAEISAVVRANHLASQKVLTRAGLQYLREIHDVKSAPPSLLFTLTQTSGIKNKYAGHTVSRRITSISAVL

SEQ ID NO: 159487 - protein, 102 aa, Glycine max
  Coding DNA Sequence Number=SeqID_42709
  Homolog annotation: Hit_ID=Q5W7C9; Match level="QueryCoverage=53%, HitCoverage=20%, E-value=2e-18, Identity=76%"; Hit description =Unknow protein
LFLDGGKGYNSAVECHLDVVEVISSSLIIPKPNRTPVEYEAPGYKLCLGMEENSESALSTNNEAISNATRNLMESSILAHDERWRHALHMQVGRDVVFPVAD

SEQ ID NO: 159488 - protein, 103 aa, Glycine max
  Coding DNA Sequence Number=SeqID_42710
FSLTESRKAQEDLIKAEKDLVEVTKEPLKDDLKKVIDSAQTFQDEVERLNQEFALFKAEILRTHEASFKKALHQVKFFLKDVDISFFDVDKDIDHQGELVNEA

SEQ ID NO: 159489 - protein, 213 aa, Glycine max
  Coding DNA Sequence Number=SeqID_42711
MDIIPDKYPLSVQNIKFGSKLYVNADITEIHEFRQSLSVPFYSGGIINDKDGSQSQSSQSNVVEKFLQNAQVDCYCLTVGTVDEIIIDAPWSYDSCPNCTTTFDPSKGGSACRSCHTSVIDTVPRMKHNEDKGDFLLWDATCIKLFGKTAGECRDELITAGDDIKVFPTCVDEILSQTWAVRFKFRSQLRQSSVLDVSEVLHHIQSLIATLGL

SEQ ID NO: 159490 - protein, 204 aa, Glycine max
  Coding DNA Sequence Number=SeqID_42712
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=26%, E-value=3e-90, Identity=80%"; Hit description =Kinesin, motor region; Prefoldin
  Pfam annotation: Domain name=Kinesin; Domain location=87-203; Score= -143.1; E_value=2.5e-05; Accession=PF00225.13; Description=Kinesin motor domain
MEEKCSLKDNQIKALEEQLATAEKKLQVSNISAYETRTEYKGQQKFVNELQRRLADAEYILIEEERLRKKLHNTILELKGNIRVFCRVRPLLADESCSTEGKIFSHPTSMETSGRAIDLAQNGQKHSFTFDKVFTPEASQEEVFVEISQLVQSALDGYKTGSGKTYTMMGRPGHLEEKGLIPRSLEQIFQTKQSQQPQGWKYEM

SEQ ID NO: 159491 - protein, 215 aa, Glycine max
  Coding DNA Sequence Number=SeqID_42713
  Gene Ontology: Mol. function=RNA-directed DNA polymerase activity; Cellular component=mitochondrion; Biological process=RNA-dependent DNA replication
MDRFPAFLQSLEDMNNVDMMYKVDMSASTSVITKALVLKAVKPFVGDNDYVFRLVSSLLELPIYTKDGDKVLVGSDDIPPPLGEVSRLLFNFVLMDLFDREFVKCFPEIRFRRFSHEVFVATADIYDVFFSEKSCYALLGKIGLRGEIYSISRGGGYLTSGGVNEILLQVTRVNYHKPALTKLMTARKSIETFTKMLGNSLTKDLIELMHSNAKE

SEQ ID NO: 159492 - protein, 90 aa, Glycine max
  Coding DNA Sequence Number=SeqID_42714
MLQSLHRGQVAWPGAQPSPSRGGGAFTAQEPEPKEPVVAVEEPAEGEDELTPPEPFYYDTDVPSTDQMPEPSPAPAPQETLPSVLLDQVA

SEQ ID NO: 159493 - protein, 66 aa, Glycine max
  Coding DNA Sequence Number=SeqID_42715
MWLRMPPDSWVTIYVVLDNCETKNSLGVLFTKMRTCFSKETKLPTDQSSICFLDEKQCVYRGMRVC

SEQ ID NO: 159494 - protein, 354 aa, Glycine max
  Coding DNA Sequence Number=SeqID_42716
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-48, Identity=31%"; Hit description= UPI00006A17C9 related cluster
DYTSSPSVWLHALAFRGLHVLAIGGLHALTFRVLHILAFRGLHIPAFRGLHVLPFRGLFVRTFRGLHVLAFRGLQYLAFRGLHAVAFRGLHVLTFRWLHALAFRGLHVLSFRGLHVLAFTRLHVHAFRGLHALTFRGLHVLTLRGLHALVFRGLHAVTFRVLHAVTFRGLHVFAFRGLHVLAFKGLHALPIRGLHALTFRELHVLAFRGLHLLAFRGLHVLTFRGPHVLTIRGLHVLAFRGLHVLAFRGLHVLTIRGLHVLAFRGLHVLTFRGLHALAFKRGLHALTLRGLHVLAIRGLHALTFRGLDVPTFRGLNFLDFRGLHSLSFRGLHVLSFRGLHALTYRGVHVLAFRR

SEQ ID NO: 159495 - protein, 221 aa, Glycine max
  Coding DNA Sequence Number=SeqID_42717
  Gene Ontology: Mol. function=phosphoglycolate phosphatase activity; Biological process=carbohydrate metabolic process
  Homolog annotation: Hit_ID=Q8ZJF3; Match level="QueryCoverage=61%, HitCoverage=58%, E-value=5e-46, Identity=66%"; Hit description =Phosphoglycolate phosphatase
  Pfam annotation: Domain name=Hydrolase; Domain location=1-134; Score =28.2; E_value=2.9e-05; Accession=PF00702.16; Description=haloacid dehalogenase-like hydrolase
WALGREPHADEQRDARALFDKHYAATVEAGSTLFPQVQETLAALHASGLPLAIVTNKPTPFVAPLLQSLGIADYFSLIIGGDDVVVKKPHPAAIFLVLGRFGVLPGQLLFVGDSRNDILAAQAAGVPNVAMTFGYNYAAPSLPGELTIGNYMGALRQWVQMQDDFHCIYCIVDLHAITVRQDPAALRKSHAGYAGAVPCLRYRSGKKHHLSCSRTYRSTPS

SEQ ID NO: 159496 - protein, 151 aa, Glycine max
  Coding DNA Sequence Number=SeqID_42718
  Homolog annotation: Hit_ID=Q1RXS1; Match level="QueryCoverage=42%, HitCoverage=16%, E-value=9e-07, Identity=39%"; Hit description=Zinc finger, CCHC-type; Peptidase aspartic, catalytic
  Pfam annotation: Domain name=zf-CCHC; Domain location=39-56; Score =22.6; E_value=0.00018; Accession=PF00098.13; Description=Zinc knuckle
KDQGLGILEAAPSKPKGDKGNTIEKQLPKASMQEKTSSITCFKCLGRGHITSQCPTKKTMIMRGQDIYSCQDEATTSPSSSECEEAKGEESSEEIYPQEEGQPLMVKEECKETIVSIATPLRLEFIPQVKELLDVDLVRKSLNPCALLCPK

SEQ ID NO: 159497 - protein, 120 aa, Glycine max
  Coding DNA Sequence Number=SeqID_42719
MVIPKFKVLDFDKYKGTTCLKNHLKLYCQKMGEYAKDEELLIHSFQESLTGVAVTWYTNLEPSRVHSWKDLMVAFIRQYLVFASERINVGPKRGKFDHPTRTTEKTGANKEGEDEGEPML

SEQ ID NO: 159498 - protein, 107 aa, Glycine max
  Coding DNA Sequence Number=SeqID_42720
MLFLDEWSSTLGHASVYGFLEPQSIHNAKDRCAECEHYLQAWLKESQREVYLGAYLNHAMKSTNTTADGTNNPATPKWIEVKSHVQSGGYECGYYVMHWMWNIVSRG

SEQ ID NO: 159499 - protein, 110 aa, Glycine max
  Coding DNA Sequence Number=SeqID_42721
  Homolog annotation: Hit_ID=Q1SKD7; Match level="QueryCoverage=94%, HitCoverage=26%, E-value=3e-08, Identity=30%"; Hit description =Ankyrin
AALEFDNHRFRSAEHQQRFEAIKGWSFHRERRVQLRDDEYEDFQEEIARRRWTSLVTPMAKFDSDIVLEFYTNAWPTEEGVRDMRSASLVRERTRPMDLTRRPLPDVSPE

SEQ ID NO: 159500 - protein, 83 aa, Glycine max
  Coding DNA Sequence Number=SeqID_42722
MGQTTTLRGLLIGLDDVPQPKSKASARWIVVKCNRQKGSTECGYYVMHWMSTIILGTFRNNWEAYFNDPRPLEPERLKALRIQ

SEQ ID NO: 159501 - protein, 107 aa, Glycine max
  Coding DNA Sequence Number=SeqID_42723
  Gene Ontology: Mol. function=RNA-directed DNA polymerase activity; Biological process=DNA integration
MSYTWKLNSILELQKQACVALSTAEAEYVVVGSCCAQSLWMKQQLEDFGVILNHIPFKCDNTSAINLTKNLVMNSRAKHIEIRRHFLRDHVSKGFSKLFVLIDYATL

SEQ ID NO: 159502 - protein, 124 aa, Glycine max
  Coding DNA Sequence Number=SeqID_42724
MEGTLYSTINGVEMVINVVVWKAVVGIDMGEVCKFEESTDGCSKIQTYRGMLLNPARVLRNRLGVGDLTAEDRMLVYIITYILAPRCNNHAQVMDNGLQIIYGLKLSIQINWALLIEDIMLVIP

SEQ ID NO: 159503 - protein, 112 aa, Glycine max
  Coding DNA Sequence Number=SeqID_42725
  Gene Ontology: Mol. function=DNA binding; Cellular component =endoplasmic reticulum membrane; Biological process=DNA integration
  Homolog annotation: Hit_ID=Q1S0E3; Match level="QueryCoverage=64%, HitCoverage=7%, E-value=2e-20, Identity=65%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
MSASFDRDIEKVSFTIRQTQIPVAYNSKSGSMHQKKYVEYILKRFNMMECNSVITPTETGIKLQIDGDEKEVDPTLYKQIVGSLRYQGNTRPDIAYCVGLIVWFPASAPDHT

SEQ ID NO: 159504 - protein, 80 aa, Glycine max
  Coding DNA Sequence Number=SeqID_42726
MVVEELRDFEYPGHGIRPIEMGDVKGRGTRDDLIEFGIYGTLRACEGTLVLGQDCNGFLKLRESMSECYRPWGGGNESTN

SEQ ID NO: 159505 - protein, 132 aa, Glycine max
  Coding DNA Sequence Number=SeqID_42727
  Subcellular localization annotation: CTP_CleavageSite=92; ConfidenceScore=5.33e-01
MGLPPSLHLHLLARYSPRGLGFLTAITGSSHCPSQTSGGQAQRFSLTLSSPSSYSSIGISHQLITSIPTSTTSPGSTENLLQKAYTGRNGVLLSQNSHKESAFVGHLLAGHLPGPTIVVGGADAAGEVVVDE

SEQ ID NO: 159506 - protein, 48 aa, Glycine max
  Coding DNA Sequence Number=SeqID_42728
MTPLQEDLNGNITLAGDNSKWKGKLATLGDKVKDLQVKVSDAEVGDKG

SEQ ID NO: 159507 - protein, 100 aa, Glycine max
  Coding DNA Sequence Number=SeqID_42729
MVSIFREAEDIHSRESSNTYINSLGSYFIDFNLLVDLSNTSIGSLDSSYSSDASMVISQCHMLAYLEAINHIFVFPEELFSNHGRHVYIIKIWERGGIFL

SEQ ID NO: 159508 - protein, 191 aa, Glycine max
  Coding DNA Sequence Number=SeqID_42730
MDFEICPIMQKNAVELCNKFLMCAEKCLCIAGYGKGAERNEDKGYVGSGTWRYVAGVRRPWGHQGDRALVIDYQFGVINYTVLPATGNRLPFSEFGRPSKAMRGADSVAQFDSLLLHPEEPARTLQQSVEWILPTPTPYRLVEPVQVIKVSSSGAACGVRHWRQFGKHAATDPHGGRQGGGSRDREVGEQV

SEQ ID NO: 159509 - protein, 192 aa, Glycine max
  Coding DNA Sequence Number=SeqID_42731
MDQQNWAAKLLGYRFDIEYKLGLENKGTDALSHMYEEVEFHKIIHYPNWEGLKAILDEVHQDAKLLTIIEDLKQGKEYESGFSYKQAYINPKLAPWYYGPFKVLEQVGKVSYKLQLLDTTKIHSVFHVPLFKKVVGSYSMEEPLPLSLSNDETISVIVSKHKTLNAQADIAAAGKTSTSECKDWSSKTCFYK

SEQ ID NO: 159510 - protein, 368 aa, Glycine max
  Coding DNA Sequence Number=SeqID_42732
  Homolog annotation: Hit_ID=Q947Y6; Match level="QueryCoverage=39%, HitCoverage=15%, E-value=5e-19, Identity=29%"; Hit description =Putative retroelement
MGMGLDPSEKPKVWRVYSRRNRGAKKGVEVAEVASQRMPLEKIEAKVVALEMQLKVDAKHAKLLELLKKVREQEGNSLCPQSSLVVYFNNQGTSHEVKVNLAQLCMEGLTIHIFKSLLDEQKCLTWDEFKSELLEHYGSMVKNNEEIGLGFTMMGFKEETRWPSWVILVQLGTMVVMGRVNIMEWMWAQTVQTENEGDDTQGEANVVVINDESETEMEEEECIMLFLRTAMGVDLILGIAWLAPLGNMLFDWVNQIMKFKWQDQWVRIQGEGWHDEGHMALPYRYPQNHKNELQKQVLELLKTRVTAPNKFPISVIDELLDELRDARFFSKLDLKFKYHQVRVTESDVHKTTFYMHKGHYEYMVMPFG

SEQ ID NO: 159511 - protein, 1430 aa, Glycine max
  Coding DNA Sequence Number=SeqID_42733
  Gene Ontology: Mol. function=protein binding; Cellular component =membrane; Biological process=defense response
  Homolog annotation: Hit_ID=Q1SW19; Match level="QueryCoverage=60%, HitCoverage=95%, E-value=0.0, Identity=42%"; Hit description=Disease resistance protein
  Pfam annotation: Domain name=NACHT; Domain location=199-360; Score= -32.4; E_value=0.019; Accession=PF05729.3; Description=NACHT domain
  Pfam annotation: Domain name=NB-ARC; Domain location=163-475; Score =318.4; E_value=1.3e-92; Accession=PF00931.13; Description=NB-ARC domain
  Pfam annotation: Domain name=mTERF; Domain location=1161-1409; Score =46.1; E_value=4e-11; Accession=PF02536.5; Description=mTERF
  Pfam annotation: Domain name=mTERF; Domain location=885-1152; Score =59.5; E_value=1.1e-14; Accession=PF02536.5; Description=mTERF
  Pfam module annotation: Pfam domain module=NACHT::NB-ARC::mTERF::mTERF ; Domain location=199-360::163-475::1161-1409::885-1152
MAEMAVSFARDKLLSLLSNEAKLLWDLHTEFAEIKTELDFIQAFLKDADRRAEEEGDSTNEGIRTLVKQLREASFRIEDVIDEYLIFVEQQPDALGCAALFFECDITHFIEYLKRRHHIASEIQQIKSVVDGIMQRGKKYNFLRQPSVEQGQSSNAGSQSIQWHDPRIASRYLDEAEVVGFEGPRDELIDWLVEGPAERTVISVVGMGGLGKTTLASRVFNNQKVVGHFDFHAWITVSQSYTVEGMMRDLLKKLCKEKRENPPQDISEMDRDSLIDEVRNYLQQKRYVVILDDVWSVELWGQIKSAMFDNKNGSRILITTRKTGVVESCKNSPFDKVHELEPLSSEKSMELFYKKAFQFDFNGCCPDHLLNISSEIVKKCKGLPLAIVAIGGLLSGKEKTTFEWEKIRQSLNSEMEKNHHLIGITKILGFSYDDLPYYLKSCLLYFGIYPEDYKVKSTRLIRQWVAEGFVKDEGGKTLEDVAQQYLAELIGRSLVQVSSVTVDGKAKSCHVHDLLWDMILRKFKDLSFCQHISKEDESMSSGMIRRLSIATNSIDLVGSTESSHIRSLLVFSGKESALTDEFVQRISKKCRLLKVLDFEDGRLPFVPENWENLVHLKYLSLRPLGMETKSLTKFIGKLHNLETLDVRHATSMELPKEICKLTRLRHLLGDHMRLFQLKNSFGDMTSLQTLHQVNVDPDEEELINDDDVVELIRELGKLKNLRSLGLTGVKEGLGSALCSSINQMQNLEKLHIRSASNFYVDSTTTKSCKIDFDMFPLNRRSIEITTEYATFVVPPYWPLSLWSSIIIDKGSLNSLETLHFEGIGALKTVPCGIQHLENLLVLHILDMPSEFEQCIAPEGGPEHSMALKLSRRLELKNPDGPNAVIEILRNYGFSDTQLCSLVKKIPLVLLSKPEKTLLPKLKFFLSIGFSTTDLPRFLIGNTTFLGLSLHKTIIPRYQIIKSLVHSDKEVVSTLKNDRRYFNRWMSIDAVRNVGTLRHLGVPQRSISLLVTNFPSVTFMEHSRFFEAVEKVKVTGFDPLKSNFVLALQVLAKMNEAMWESKLMVFEKWGWSRDICLLVFKKHPQFIMLSEEKIMKILNFLMKDIGLPVENIAGCPEVLKCNLEKTVMPRFAVVEILKSREKAQKLANRLKLKNPNGPNAVIDILRNYGFSETQLCSLVKQRPFVLLSKPGKTLLPKLKFFHSIGFSTTDLPRFLIGNITLFYFSLNKSIIPCYQIIKVRNVGALRQLGVPQRSVSLLVTNHPGATFMKHSRFVEALEKVKEMGFDPLKSNFVMALKLFATINEATWKSKLEVLGRWGFSRDICLLAFKKQPQFMMSSEKKIMKMLNFLVKDMSLPPEDIARCPEILGCNLEKTVIPRFAVVKNLKSRGLIKSDLKTSSFIKISEKMFLERYVTRFQRNEPLLLDAYRGQK

SEQ ID NO: 159512 - protein, 119 aa, Glycine max
  Coding DNA Sequence Number=SeqID_42734
  Gene Ontology: Mol. function=protein binding; Biological process =defense response
  Homolog annotation: Hit_ID=Q1SW19; Match level="QueryCoverage=69%, HitCoverage=8%, E-value=2e-16, Identity=50%"; Hit description =Disease resistance protein
MEKKSTFSWYIAKILGFTCDDFPYCLKLCFFYFGIYLEDYEVQSTRLIRQWIAKALVKDKDGKTLEDVAQQYLTKLIGRSLVQVSSFSIDGVVVFLKKFSASVFIFFFIFLSAIISTPL

SEQ ID NO: 159513 - protein, 488 aa, Glycine max
  Coding DNA Sequence Number=SeqID_42735
  Gene Ontology: Mol. function=calcium ion binding; Cellular component =actin cortical patch; Biological process=establishment and/or maintenance of cell polarity (sensu Fungi)
  Homolog annotation: Hit_ID=Q7G188; Match level="QueryCoverage=37%, HitCoverage=34%, E-value=9e-66, Identity=55%"; Hit description =Fimbrin 1
  Pfam annotation: Domain name=CH; Domain location=305-422; Score=24.5; E_value=0.00038; Accession=PF00307.21; Description=Calponin homology (CH) domain
MKEGDIIFGNDIVSNNDEGNDTRDDNKQFTMASANALCSWPSERSSIAIVVCMDIVVVRKCHFSIRKSGSSFNSSIVKEGGEGDDGSLLCPLPDVFSHIATLQCGTFDMSNPITFLVRVFEFVSEHSDFLETKSAEKEVASLVCAVEKKREFLKVEREKVEKKKREDLKASKERGKSDKRLKEEKKSKAEDTNKDKSTSRVPNKGNGLDLEKYSWTQSLQEVNVNVPVPNGTKSRAYAYLLNVLAPEHCSPVTLDTKDGNERANLVLDHAERMGCKRYLTPRDVAEDTKKMSYAEMMTDDVQTSREERCFQLWINSLGISTHVNNMFEDVRNGWILLEVVDNIFPRSVNWKHATRPPIRMPFRKVENCNQLMRFTMLQLLKILRSDSQGKEITDADILKWVNRKVKSTGRTSQIESFKAWTEASSIPRALVSIILRLPRLKFTIVTLGKDGCIMLEKCVDDANAILAVSVSLAVCNAGAAVKKIPLYK

SEQ ID NO: 159514 - protein, 109 aa, Glycine max
  Coding DNA Sequence Number=SeqID_42736
MELYSVADGKYIFEICHFVSIQSSYETIVEDDTTHQNVWKTFFKWPDKLPLQVLDFCCQIKEVLTSTCKNVGNSFTDPGYASLNSIVGKYINGYFTAAKGKIIAIKSNF

SEQ ID NO: 159515 - protein, 74 aa, Glycine max
  Coding DNA Sequence Number=SeqID_42737
MWKIELTRIKNSEKFRFVFGLSNSHEAVSASSGVEVNVGEEVKAIEEVRTQRTARRGCAGGGRRGRAWQRRPCM

SEQ ID NO: 159516 - protein, 89 aa, Glycine max
  Coding DNA Sequence Number=SeqID_42738
MGTSFMFKWRVHPIGFSKRTREGTSLVDLWLVKDFIRLKEISRTVGCLGIGCRHGHLIQHLPHRGEWQRQPHSCNSGKKKVFFKGKSLA

SEQ ID NO: 159517 - protein, 72 aa, Glycine max
  Coding DNA Sequence Number=SeqID_42739
TAYGFLGNERALTNNENVWRAIVLDCKSRKCFFNVDQDTKMAKTILDAIEKSDQFDYLLDANSVHFKNALWK

SEQ ID NO: 159518 - protein, 609 aa, Glycine max
  Coding DNA Sequence Number=SeqID_42740
  Gene Ontology: Mol. function=protein serine/threonine kinase activity; Cellular component=cytoplasm; Biological process=vesicle -mediated transport
  Homolog annotation: Hit_ID=Q941L3; Match level="QueryCoverage=99%, HitCoverage=99%, E-value=0.0, Identity=65%"; Hit description=BONZAI1
  Pfam annotation: Domain name=C2; Domain location=194-282; Score=31.4; E_value=3.2e-06; Accession=PF00168.20; Description=C2 domain
  Pfam annotation: Domain name=C2; Domain location=49-146; Score=16.3; E_value=0.0086; Accession=PF00168.20; Description=C2 domain
  Pfam annotation: Domain name=Copine; Domain location=393-539; Score =287.2; E_value=3.1e-83; Accession=PF07002.6; Description=Copine
  Pfam module annotation: Pfam domain module=C2::C2::Copine; Domain location=194-282::49-146::393-539
MGNCFSEVAAGRAAIGGTARDFHNLAGAPNDAVDNFLRSHGHHGLFSQIELSFSASGLRDRDLLFKSNPMMVLYARGKNGALEELRRTEVVLNSSSPTWITKHTLIYHFEVVQALVFRVYDVDTQFHNVDIKMLELDEQQFLGEATCVLSQIITQPDKSLTIDLHTEDSIGSTLSKNSGKLMVHSEECISSKTAIEMAFRCSDLEYKDLFSRNDPFLLISKVVEGSAQIPICKTEVIRNDLNPIWKLVFVNIQQVGSKDSPLVVECYNFNSNGKHDLMGKVQRSLAELENIHNNGQGENLFLPSADGQNHDNKVLKSQLFVDKFTESVQYTFLDYLAGGFELNFMVAVDFTGVWICPVYLEEPLWIPQNANPLRPLLSGSTAASNGNPRLPDSLHYIDPSGRPNAYQRAIVEVGEVLQFYDSDKRFPTWGFGARPIDGPVSHCFNLNGSSHYCEVEGIQGIMMAYTSALLNVSLAGPTLFGPVISTAALIASQSVANGGRKYFVLLIITDGVVTDLQETKDAIVKASDLPLSILIVGVGGADFKEMEVLDADKGERLESSYGRVASRDIVQFVPFRELQSGFSVVQALLAELPAQFLTYVRSRNIQPSL

SEQ ID NO: 159519 - protein, 121 aa, Glycine max
  Coding DNA Sequence Number=SeqID_42741
MAITVMAIELVVIDNSDVVVDNNGDGNNDHDGACSGSHDDGGGGGGDNDEGHHNKSVTERWVWTFRRRSFMALYSCVIELRNRVFGLPAGRKDVVEKINPGTYLFLFDTFQASLWQPRPEC

SEQ ID NO: 159520 - protein, 223 aa, Glycine max
  Coding DNA Sequence Number=SeqID_42742
  Gene Ontology: Biological process=multicellular organismal development
  Homolog annotation: Hit_ID=Q1SMS1; Match level="QueryCoverage=84%, HitCoverage=33%, E-value=3e-49, Identity=60%"; Hit description=WD40 -like
MLDEAEKRLQDSESKLARLRGQTVSSRSTLDDGIKTLKTERRSNSPIDRNEGSTKNRHQSKPELLIPSANPKISQPVLLPKSFSKASITSSSEATPGVHSSPITGGSSRGKSDKSHSNRLSSEQQKTEVKEKGTKRKFEQKEHKELIPLIRKSSSPSLVTCQTSNHISSQHKRKLRSIALCPVNDQLFVTRNRTQVLRGLQQLTHTVQSTDLDPLGRINLLYK

SEQ ID NO: 159521 - protein, 106 aa, Glycine max
  Coding DNA Sequence Number=SeqID_42743
  Subcellular localization annotation: CTP_CleavageSite=61; ConfidenceScore=5.20e-01
MANIGSGYAQLLPDPQHTHQNAQNTQPDFKSSLVNMGHANVAMQSNAGSSLYHPYVPQEVVSSGYSSQGGQQTGMGSEYYQSSLQTVGNTQENFVSHLNSENSIGA

SEQ ID NO: 159522 - protein, 278 aa, Glycine max
  Coding DNA Sequence Number=SeqID_42744
  Homolog annotation: Hit_ID=Q5PCQ0; Match level="QueryCoverage=95%, HitCoverage=76%, E-value=2e-58, Identity=44%"; Hit description =Putative exported protein
  Pfam annotation: Domain name=DUF1176; Domain location=1-275; Score =128.3; E_value=2.1e-35; Accession=PF06674.2; Description=Protein of unknown function (DUF1176)
AYSGALPGAALKDNLLLDQRRLNPDLKHWTVEPHHLATSNAIAIDEYLAQTLDASNLQLTYKASASIPLRGMKAALLLMDDVQGRVNGASAWVKRGDRVQWDVPPPPSIPQLPAPMPAPAPLTQQETTGLIDYGTWRINTDNCSLDPLRREVSVAPLTDSKALLLISCETGAYNVIDLAFEVTRSQPYVSRGITLNLPFTPPSRTDNQLELVNAEFDASNGQLYTFSKGRGLGDCGVATRWQFDGNAFVLAEYAEEKTCDAWHSSDDWPTLWISQPAS

SEQ ID NO: 159523 - protein, 93 aa, Glycine max
  Coding DNA Sequence Number=SeqID_42745
MEGRSISHSSEREEEYDLFPIYSERSQQDMSAMVSALTQVIGGSNSDSLQQHEGLLTSSHNNTSTQNNNEQSQAPQQEQVLRASFSAVLKVAA

SEQ ID NO: 159524 - protein, 219 aa, Glycine max
  Coding DNA Sequence Number=SeqID_42746
  Gene Ontology: Mol. function=transcription factor activity; Cellular component=nucleus; Biological process=regulation of transcription, DNA-dependent
  Homolog annotation: Hit_ID=Q1SMR9; Match level="QueryCoverage=78%, HitCoverage=65%, E-value=2e-33, Identity=52%"; Hit description =Pathogenesis-related transcriptional factor and ERF
  Pfam annotation: Domain name=AP2; Domain location=34-98; Score=146.5; E_value=7.1e-41; Accession=PF00847.10; Description=AP2 domain
MKCFEIVGCLNITAHQKEQFPKLTIYHSLGSVRRRHYRGVRQRPWGKWAAEIRDPKKAARVWLGTFETAEAAALAYDEAALRFKGSKAKLNFPERVQGTASEFGYHLTNQHSTSSHDQQASNPIITPHFATTQETYSPSHHFQYAQQQLMGGGSNSFNNNQDMLRFYGGHNMFVSSQQSASSSSSTALSQNQQDELLRFSMQFGASSHSDHSGNWRGGQ

SEQ ID NO: 159525 - protein, 99 aa, Glycine max
  Coding DNA Sequence Number=SeqID_42747
MSVIFGSQWNIFCLTNFNKNNTDDTITKHRYASNGILMRACEEPVGGRGEMGHMHDFDLRVDVLGLGAKSCNWIIHFTRTDRKMDPSREFLTCHVFRGT

SEQ ID NO: 159526 - protein, 68 aa, Glycine max
  Coding DNA Sequence Number=SeqID_42748
MVDLAAPISFPCTACPRNKKHGIGICCYNLGNIKECKQVLPSTNYSQLVEPTTHWFCDCYANCRLAQA

SEQ ID NO: 159527 - protein, 136 aa, Glycine max
  Coding DNA Sequence Number=SeqID_42749
  Gene Ontology: Mol. function=DNA binding; Cellular component=nucleus; Biological process=regulation of transcription
  Homolog annotation: Hit_ID=Q0GYP2; Match level="QueryCoverage=88%, HitCoverage=29%, E-value=3e-59, Identity=89%"; Hit description=LEAFY- like protein
  Pfam annotation: Domain name=FLO_LFY; Domain location=1-123; Score= -9.1; E_value=8.1e-16; Accession=PF01698.7; Description=Floricaula Leafy protein
MAYCSGIKSIRFSRFKVTNQVFRYAKKAGASYINKPKMRHYVHCYALHCLDEEVSNELRRAFKERGENVGAWRQACYKPLVAIAARQGWDIDAIFNAHPRLSIWYVPTKLRQLCHAERNSAAASSSVSAGSAHLPF

SEQ ID NO: 159528 - protein, 151 aa, Glycine max
  Coding DNA Sequence Number=SeqID_42750
MSESRSIKRDECNRPRVATRSSIECGKQRHIKANCPTYLKKQQGGDKKRKKSFKKRRTYIAWDDNDVSSSSDLSEEEEANLCLMADIDEDETKSNLHEEAQRLFFVIKTLKGLVRWCIEKLTTLPKEVHDLKKEKVDLEKSIEDSICKCKI

SEQ ID NO: 159529 - protein, 231 aa, Glycine max
  Coding DNA Sequence Number=SeqID_42751
VFYVQDPCDERWSAVLHGKTIGVNLEDDDSTLNASHIPLSTHMPTINGEDEVDDIHGNRNAPSPSTSKRTRQATWLRSLFARPVGLVRPLVHVEPNTRKATGKDDDDETMCDKYGINKDKWNQLYESHRDPSWEDIRKKAQTIQKHNTTPSVLSYGGYILCGTSRGYIYLGCCTENKRGYISCGSVQVEGTSTWLFKENKGGYIPCGSLACKGFYKVERNLKNRWLLGDWM

SEQ ID NO: 159530 - protein, 92 aa, Glycine max
  Coding DNA Sequence Number=SeqID_42752
MLSFSHCNSSNHILLSQMYLLPCPFYVQLSVVHHVCLANDMVMVGVKEVQDVDFCISIPIEEGKHVPKKPKKLVDKLEPDDDPIYQMTLMIS

SEQ ID NO: 159531 - protein, 97 aa, Glycine max
  Coding DNA Sequence Number=SeqID_42753
MTKFGLRLSSGPPPLDDKRVRITVRYLRVSSGPPPLDDTRVQNDQIWSLLVIGPAASGRQKGADNRKGADNRKGADNRKGADNRKVSPRIIGPAASG

SEQ ID NO: 159532 - protein, 140 aa, Glycine max
  Coding DNA Sequence Number=SeqID_42754
  Gene Ontology: Mol. function=DNA binding; Biological process=DNA integration
MGQLATQLNQQQSHNSDILPSQPIQNPKNVSAITLRSGNEPAQLHSTPEKDDDKNLKTISNNKMEEAENEILETFRKVEVNIPLLDAIKQIPRYAKFLQELCTHKRKLKGSERISMGRNVSALIGKFVPQIPEKCKDPVN

SEQ ID NO: 159533 - protein, 41 aa, Glycine max
  Coding DNA Sequence Number=SeqID_42755
MWKLTLRPPRNIASLGHRRNKVNRLYKAREKIQILNSKKPA

SEQ ID NO: 159534 - protein, 243 aa, Glycine max
  Coding DNA Sequence Number=SeqID_42756
  Gene Ontology: Mol. function=DNA binding; Cellular component=nucleus; Biological process=regulation of transcription
  Homolog annotation: Hit_ID=Q0GYP2; Match level="QueryCoverage=99%, HitCoverage=58%, E-value=2e-66, Identity=59%"; Hit description=LEAFY- like protein
  Pfam annotation: Domain name=FLO_LFY; Domain location=1-243; Score =209.6; E_value=7.3e-60; Accession=PF01698.7; Description=Floricaula Leafy protein
  Subcellular localization annotation: CTP_CleavageSite=50; ConfidenceScore=5.12e-01
MDPDAFTASLFKWDPRTVLPPAPPPPPPRPPLLEYAVAPPPVTPSFHPSRAAAPRELGGLEELFQAYGIRYYTAAKIAELGFTVSTLVDMKDEELDDMMNSLSQIFRWDLLVGERYGIKAAVRAERRRVEDDDIKRRNNNNNLLSADTTTNALDALSQEGLSEEPVMQREKEAVGSGGGSTWEVVVAAEERRKQQRRRRTRMKTNNLHHEDNEELEDDEGEQNDEGNINTGGGCERQREHPFH

SEQ ID NO: 159535 - protein, 53 aa, Glycine max
  Coding DNA Sequence Number=SeqID_42757
MVGAPTRDTAHWHARPLPLRANAAVARQQDRTSAWRSVRSATKVDNTMHVTYK

SEQ ID NO: 159536 - protein, 150 aa, Glycine max
  Coding DNA Sequence Number=SeqID_42758
MVVAKGREESVRDYVGGRRGWGFGSQRKQMVVVGFTKGREESSQTFPSIPQNTFTTFHKSSNSSSHAQTPSNEKVDIQFSTQIGLENITIEEGGRSSSEKKMAYEYSFQLKRINFSLVRDLMFHSIQLSVMEDLKKECEPNIWRKISEKV

SEQ ID NO: 159537 - protein, 80 aa, Glycine max
  Coding DNA Sequence Number=SeqID_42759
  Gene Ontology: Mol. function=ATP-dependent helicase activity
  Homolog annotation: Hit_ID=Q7XJN0; Match level="QueryCoverage=71%, HitCoverage=12%, E-value=1e-10, Identity=63%"; Hit description=DEAD -box ATP-dependent RNA helicase 17
  Subcellular localization annotation: CTP_CleavageSite=44; ConfidenceScore=5.07e-01
MVKNSIRSAMRITLDMMKASSAFWRQRTQGCDSKKTDFFVWFFCSGKLSNTLRTGYSVKIIMTLLFHPVEQFYQLCIMNS

SEQ ID NO: 159538 - protein, 299 aa, Glycine max
  Coding DNA Sequence Number=SeqID_42760
  Gene Ontology: Mol. function=ATP-dependent helicase activity; Cellular component=nucleus; Biological process=rRNA processing
  Homolog annotation: Hit_ID=Q7XJN0; Match level="QueryCoverage=99%, HitCoverage=53%, E-value=1e-85, Identity=53%"; Hit description=DEAD -box ATP-dependent RNA helicase 17
  Pfam annotation: Domain name=DEAD; Domain location=50-212; Score =140.1; E_value=6.1e-39; Accession=PF00270.19; Description=DEADDEAH box helicase
  Pfam annotation: Domain name=ResIII; Domain location=46-207; Score= -24.7; E_value=0.0055; Accession=PF04851.6; Description=Type III restriction enzyme, res subunit
  Pfam module annotation: Pfam domain module=DEAD::ResIII; Domain location=50-212::46-207
  Subcellular localization annotation: CTP_CleavageSite=41; ConfidenceScore=5.09e-01
MGAKKQSQGVKNKGNGANNDVFASCSFSSLGLDSNLCEQLRDRLGFEVPTLVQAQAIPVILSGRHALVNAATGTGKTVAYLAPIIHHLQGYENRIQRSDGTFGYIMGGEKRSKEKSRLRKGISILIATPGRLLDHLKNTTAFLYSNLRWIIFDEADRILELGFGKDIEEILDLLGSRKKGHGDQENTVLTHSKIQRQNLLLSATLNEKVNHLAKMSLDNPVMIGLDGKKMEPISTIKRLDSSESDEDSEDKYSSKVPTVGDYKVPIQLIQRYMKVPCGSRLPVLLSILKHLFEREPSQK

SEQ ID NO: 159539 - protein, 83 aa, Glycine max
  Coding DNA Sequence Number=SeqID_42761
MVVVQCIKETLLGCASGLQLVQAICRMILVMGSVTIMHVYREANQYPNALANLACDMDSDVMSFEHAPAMLKRLLSFHVRGIP

SEQ ID NO: 159540 - protein, 108 aa, Glycine max
  Coding DNA Sequence Number=SeqID_42762
  Homolog annotation: Hit_ID=Q2QNA4; Match level="QueryCoverage=61%, HitCoverage=36%, E-value=5e-11, Identity=62%"; Hit description =Expressed protein
MDEGGGGGGNREDGEVPNDAVGALLGVADIGVGHWNSNAALSPSLVTRPVPFSCFGVLKKEKHVLLHSIADVVIEQGDGICSFLMCCSLDGFFLPYYTLSLQNMPNIH

SEQ ID NO: 159541 - protein, 89 aa, Glycine max
  Coding DNA Sequence Number=SeqID_42763
MRTDGNAPLTAENAMRVMETLRSVSFAGVASYWATRDPDDRANYGGEVNFFVFGGQAIDEVEAARREAHATRLSLLPLILTLFFSDPQP

SEQ ID NO: 159542 - protein, 132 aa, Glycine max
  Coding DNA Sequence Number=SeqID_42764
  Homolog annotation: Hit_ID=Q2QNA4; Match level="QueryCoverage=67%, HitCoverage=35%, E-value=2e-10, Identity=45%"; Hit description =Expressed protein
MPPSYCWTSNETIRQSPYLDFFAKSSKEKLHPPVSYSIIENVGVRRPPSDDVKIQGVANPNDFRKAVMMRLSNMRNEILSRQVSTLEDVPHHLMMSPSKSLKHDSNPSGELLPMQKLEEVGSSVKAGSKHEI

SEQ ID NO: 159543 - protein, 433 aa, Glycine max
  Coding DNA Sequence Number=SeqID_42765
  Gene Ontology: Mol. function=protein-tyrosine kinase activity; Biological process=protein amino acid phosphorylation
  Homolog annotation: Hit_ID=Q9C823; Match level="QueryCoverage=91%, HitCoverage=71%, E-value=1e-125, Identity=57%"; Hit description =Protein kinase, putative; 54672-52611
  Pfam annotation: Domain name=Lectin_C; Domain location=64-183; Score =17.0; E_value=1.8e-05; Accession=PF00059.11; Description=Lectin C -type domain
  Pfam annotation: Domain name=Pkinase; Domain location=261-431; Score=- 57.3; E_value=3.8e-05; Accession=PF00069.15; Description=Protein kinase domain
  Pfam annotation: Domain name=Pkinase_Tyr; Domain location=260-431; Score=-66.4; E_value=2.1e-08; Accession=PF07714.7; Description =Protein tyrosine kinase
  Pfam module annotation: Pfam domain module=Lectin_C::Pkinase::Pkinase_ Tyr; Domain location=64-183::261-431::260-431
MELKFVLFLLPLLVVAAHGLASNATLNETCGYFDGSLNRDPKVPCPIGWVMDPNKTKCFLHVGRPQSWNDSETCCSKYGGHLVSLTSLQELQFAQSLCGESINSCWIGGQRLNSTAGYQWMWSNNSPWNNSIFSMVNVPPHCNGTGPSCHRNSTDNLCTVVTNNSNSLITERCDNPHASLCILDIDTKRNQMHRRREYLIILTVVSTLILSTTLSVVVWLLVYKRGKKRRRSRKLSIPGASLPSWKVFTKEELRSITKNFSEGNRLVGDAKTGGTYSGVLSDGSKVAVKRLKRSSFQRKKEFYSEISRVARLRHPNLVAVMGCCYDHGDRYIVYEFVANGPLDKWLHHIPRGGRNLDWAMRMKIATTLAQGIAFLHDKVKPQVVHRDIRASNVLLDEEFGAQLMGVGLSKFVPYEVMHERTVMAGGTYGYLAP

SEQ ID NO: 159544 - protein, 51 aa, Glycine max
  Coding DNA Sequence Number=SeqID_42766
MEEYKNFCDRPRDQRPQPEEVIGTITKSHKGQESNWPFLRLIEAVWILQNI

SEQ ID NO: 159545 - protein, 62 aa, Glycine max
  Coding DNA Sequence Number=SeqID_42767
  Homolog annotation: Hit_ID=Q9FI44; Match level="QueryCoverage=97%, HitCoverage=35%, E-value=3e-16, Identity=67%"; Hit description =Arabidopsis thaliana genomic DNA, chromosome 5, TAC clone:K3K7
MEVDIRTGATPRISQRKPVRERVKKNLDIHSAPEVRATPGQPWVRGWDDIKKGQDGPVSGNQ

SEQ ID NO: 159546 - protein, 345 aa, Glycine max
  Coding DNA Sequence Number=SeqID_42768
  Gene Ontology: Mol. function=transporter activity; Cellular component= mitochondrial inner membrane; Biological process=transport
  Homolog annotation: Hit_ID=Q1SMQ9; Match level="QueryCoverage=99%, HitCoverage=72%, E-value=1e-150, Identity=75%"; Hit description =Calcium-binding EF-hand; Adenine nucleotide translocator 1
  Pfam annotation: Domain name=Mito_carr; Domain location=163-254; Score=105.2; E_value=1.9e-28; Accession=PF00153.17; Description =Mitochondrial carrier protein
  Pfam annotation: Domain name=Mito_carr; Domain location=261-344; Score=77.8; E_value=3.5e-20; Accession=PF00153.17; Description =Mitochondrial carrier protein
  Pfam annotation: Domain name=Mito_carr; Domain location=69-156; Score= 101.7; E_value=2.1e-27; Accession=PF00153.17; Description =Mitochondrial carrier protein
  Pfam annotation: Domain name=MoaE; Domain location=97-192; Score= -43.0; E_value=0.1; Accession=PF02391.7; Description=MoaE protein
  Pfam annotation: Domain name=efhand; Domain location=5-33; Score =25.3; E_value=0.00021; Accession=PF00036.22; Description=EF hand
  Pfam module annotation: Pfam domain module=Mito_carr::Mito_carr::Mito_ carr::MoaE::efhand; Domain location=163-254::261-344::69-156::97 -192::5-33
MNDEELAHFVEHVDKDNNGIITFEEWRDFLLLYPHEATIENIYHHWERVCLVDIGEQAVIPEGISKHVNRSKYFLAGGIAGGISRTATAPLDRLKVVLQVQSEPASIMPAVTKIWKQDGLLGFFRGNGLNVVKVSPESAIKFYAFEMLKKVIGEAHGNKSDIGTAGRLVAGGTAGAIAQAAIYPMDLIKTRLQTCPSEGGKVPKLGTLTMNIWVQEGPRAFYRGLVPSLLGMIPYAAIDLTAYDTMKDISKRYILQDSEPGPLVQLGCGTISGAVGATCVYPLQAQPSNTSDAYKGMFDAFRRTFQLEGFIGFYKGLFPNLLKVVPAASITYVVYESLKKTLDLD

SEQ ID NO: 159547 - protein, 121 aa, Glycine max
  Coding DNA Sequence Number=SeqID_42769
  Gene Ontology: Mol. function=oxidoreductase activity; Biological process=metabolic process
  Homolog annotation: Hit_ID=Q0VH86; Match level="QueryCoverage=54%, HitCoverage=20%, E-value=6e-19, Identity=71%"; Hit description=3 -ketoacyl-CoA reductase 3
MGPCTLATPVNAATTCYMLVVSCIHELLNLNYIFLLVVDILITGTTHGIGTETARVLALRGVHVIMAARDVIAAKAVKEAILKEIPTAKVDAMELDLSSMTSVRKFALEYISSGLPLNILM

SEQ ID NO: 159548 - protein, 52 aa, Glycine max
  Coding DNA Sequence Number=SeqID_42770
MGSSGFSSSSTAEEVTQGINGSGLTAIVTGSPQPEINIEKFFMGVVPKAIFP

SEQ ID NO: 159549 - protein, 48 aa, Glycine max
  Coding DNA Sequence Number=SeqID_42771
METCQTIAKRLERLLNLRIVSEGTETYDVMQDCLKITRGVTADCNVYV

SEQ ID NO: 159550 - protein, 111 aa, Glycine max
  Coding DNA Sequence Number=SeqID_42772
  Gene Ontology: Mol. function=transferase activity; Cellular component= endoplasmic reticulum; Biological process=polysaccharide biosynthetic process
  Homolog annotation: Hit_ID=Q9M2M5; Match level="QueryCoverage=58%, HitCoverage=15%, E-value=1e-20, Identity=74%"; Hit description=UDP -GlcNAc:dolichol phosphate N-acetylglucosamine-1-phosphate transferase-like protein
  Pfam annotation: Domain name=Glycos_transf_4; Domain location=5-111; Score=-38.6; E_value=0.00014; Accession=PF00953.11; Description =Glycosyl transferase
WLVEYNAALACICFMTLLGFVDDVLDVPWRVKLLLPSIAALPLLMAYAGHTTIVIPKPLVPHIGIENRRYIVPEVLQEATGGRFSWDRKVNKIMQHPNRNNSTQPNNTITT

SEQ ID NO: 159551 - protein, 84 aa, Glycine max
  Coding DNA Sequence Number=SeqID_42773
IGAGSGICVGVGGITGAEEGTGAMEEEGVGVSGGAEMVGASDLLPLAFLGPLNVTVGSSRFQQFFLIYATLMVGLKLSRDLESD

SEQ ID NO: 159552 - protein, 1051 aa, Glycine max
  Coding DNA Sequence Number=SeqID_42774
  Gene Ontology: Mol. function=nucleic acid binding; Cellular component= nucleus; Biological process=regulation of transcription, DNA-dependent
  Homolog annotation: Hit_ID=Q1SMQ6; Match level="QueryCoverage=99%, HitCoverage=99%, E-value=0.0, Identity=81%"; Hit description=Tudor; Staphylococcus nuclease subtype
  Pfam annotation: Domain name=SNase; Domain location=10-151; Score =21.9; E_value=9.1e-07; Accession=PF00565.8; Description =Staphylococcal nuclease homologue
  Pfam annotation: Domain name=SNase; Domain location=239-425; Score =26.8; E_value=3.8e-07; Accession=PF00565.8; Description =Staphylococcal nuclease homologue
  Pfam annotation: Domain name=SNase; Domain location=648-775; Score =67.9; E_value=3.3e-17; Accession=PF00565.8; Description =Staphylococcal nuclease homologue
  Pfam annotation: Domain name=TUDOR; Domain location=790-917; Score =135.6; E_value=1.3e-37; Accession=PF00567.14; Description=Tudor domain
  Pfam module annotation: Pfam domain module=SNase::SNase::SNase::TUDOR; Domain location=10-151::239-425::648-775::790-917
MASAASGATGWYRGRVKAVPSGDCLVIVAISSTKPGPLPEKTITLSSLIAPRLARRGGVDEPFAWESREFLRKLCIGKEVTFRVDYNVPSISRDFGTVFLGDKNVAMLVVSQGWVKVREQGQQKGEASPYLAELLRLEEQAKQEGLGRWSKVCFLPQKLIIRCEFVAVLATWCTWKPKCIVFGIFADVKQVFTTAIVLKLYILHVPGAAEASIRNLPPSALGDPSNFDAMTFLNANKGLPMEAVVEQVRDGSTLRIYLLPEFQFVQVFVAGIQLIVLPLPQAPQMGRRAAPESVVEPELVSDDTNGDVPGEPQAPLTSAQRLAVSTSAETAADPFAHDAKFFTEMRVLNRDVRLVLEGVDKFSNLIGSVYYPDGESAKDLALELVENGYAKYVEWSANMMEEEAKRKLKTAELQAKKDRLRMWTNYVPPPSNSKAIHNQNFSGKVVEVVSGDCIVVADDSIPYGSPLAERRVNLSSIRCPKMGNPRRDEKPAPYAREAKEFLRTRLIGRQVNVQMEYSRKVSPTDGSVVPSAASDSRVMDFGSVFLLSGAKVDNDDAPSSAPPAGSQQNGVNVAELIVGRGFGTVIRHRDFEERSNYYDALLAAESRAISGRKGTHSAKDPPVMHITDLTTASAKKARDFLPFLHRSRRVPAVVEYVLSGHRFKLLIPKETCSIAFSFSGVRCPGRAEPYSDEAIALMRRKIMQRDVEIEVETVDRTGTFLGSLWESRTNVAITLLEAGLAKLQTSFGSDRIPDFHLLDQAEQSAKRQKLKIWENFVEGEEVSNGAAVENKQQEVLKVIVTEVLGGGKFYVQTVGDQKIASIQQQLASLNLKDAPVLGAFNPKKGDIVLCYFHADKSWYRAMVVNTPRGPVESPNDLFEVFYVDYGNQEVVPYSQLRPVDPSVSAAPGLAQLCSLAYIKIPNLEEDFGQEAAEYLSELTLNSGKEFRAKVEEKDTSGGKVKGQGTGAILAVTLVAVDAEISVNAAMLQEGLARTEKRNRWDRKDRQTALDNLENFQDEAKTSRRGMWQYGDIQSDDEDTAPPPRKTGGGRK

SEQ ID NO: 159553 - protein, 132 aa, Glycine max
  Coding DNA Sequence Number=SeqID_42775
MEGLLPLVYKAIKRNKTRRQYECLSSGTSLGYNISMAEMYPQTQEHVLQNQTHAQKVFHHHHNESHKIGHRRYNSVGDHFDYGFQSSQMRTEPKGDVNVRHFLPKEPNLKEGNVKVKYNRITIRKPELKIHP

SEQ ID NO: 159554 - protein, 306 aa, Glycine max
  Coding DNA Sequence Number=SeqID_42776
  Gene Ontology: Cellular component=nucleus; Biological process =multicellular organismal development
  Homolog annotation: Hit_ID=Q3S4D9; Match level="QueryCoverage=85%, HitCoverage=43%, E-value=2e-46, Identity=40%"; Hit description =FRIGIDA
  Pfam annotation: Domain name=Frigida; Domain location=102-306; Score=- 2.8; E_value=1.3e-08; Accession=PF07899.2; Description=Frigida-like protein
METPENAAYCSSWLPPEDENDSGAKLAKSVNKLNDLAVAIQAFNNRYEELQKHLEFIEQAIDTRTKELRALGYNSTQGTAENGVVQSDSNPKPEEAKAVEKEKEKVKEEEKEKEDELITLCKTMNSRGLRKYVLTRLSETASLREQVPVALRSAAKPSRLVFECIGRFFLQGSKAYTKNSPMVPARQVSVLVLEHYLLSGCVGNEKDVEASLKREADSAAVAWRKRMFVEGGLLKAAEVDARGLILFVAGFGIPSVFKDEDIYNLVCVSNGREFSDALLQSQPLLKRVSGHGTLEGNVSALTSSIE

SEQ ID NO: 159555 - protein, 450 aa, Glycine max
  Coding DNA Sequence Number=SeqID_42777
  Homolog annotation: Hit_ID=Q1S6K4; Match level="QueryCoverage=18%, HitCoverage=53%, E-value=7e-32, Identity=78%"; Hit description=GCN5 -related N-acetyltransferase
  Pfam annotation: Domain name=Acetyltransf_1; Domain location=360-442; Score=49.6; E_value=1.1e-11; Accession=PF00583.14; Description =Acetyltransferase (GNAT) family
VADGMMKKGMAVKAVDLAYTFGFEEKYSPQTALTSFLQKSEETWKKAKQDARDFPSALVAHEKYLAALQSVVKCLEGHKIDPVKFLPGWQLKNKITNLEKDISDTNKKIDEKSMLKRKVDKNNSSNKMKIPEAKRARFTGKDASVLSPSLATLQEQRIFSRMDGNSSYDGSLSAHLLDGRSYGNYPNNYLTAASASDSLAEKYLGSAVASGANMLGGAMGGSFSGYQGDMYRYHGIGEGALSHDRSVGQSFVGQSASTLNNLYGKTSTEGFAGVPEHLSVGASSRSGGSDLYGFADAAQAACALRLGQRVFFTSFPSTSSERYSAAGAATLQGFIEDTSHRQSSLPLAHSSFFAVAPPKSPTQPRHSIIATGSVFMEKKFLRNCSKVRHIEDIVVDSSIRGKHLGKRIINFLSDHARSMGCYKLILNCSVQNKTFYEKCGFLQKSVQMAM

SEQ ID NO: 159556 - protein, 687 aa, Glycine max
  Coding DNA Sequence Number=SeqID_42778
  Gene Ontology: Mol. function=sequence-specific DNA binding; Cellular component=microtubule associated complex; Biological process =microtubule-based movement
  Homolog annotation: Hit_ID=Q6L512; Match level="QueryCoverage=98%, HitCoverage=98%, E-value=3e-64, Identity=30%"; Hit description =Putative kinesin-like DNA binding protein
  Pfam annotation: Domain name=HHH; Domain location=621-650; Score =17.7; E_value=0.016; Accession=PF00633.13; Description=Helix-hairpin- helix motif
  Pfam annotation: Domain name=Kinesin; Domain location=18-331; Score =128.1; E_value=2.5e-35; Accession=PF00225.13; Description=Kinesin motor domain
  Pfam module annotation: Pfam domain module=HHH::Kinesin; Domain location=621-650::18-331
MDSKQFDRASRKVRVVARIRGFSVGPEANSEPSASRAVEWVSVNRENLDDVTISFGDQSSSRYLVDYCYKEDEDNELIYSREVKPLVSAAFDGHNCTVIAHGARGSGKTHIIQGSAERPGLAVLAITEFLSVTEQNGKSIAVSFYEVDHQERPMDLLNPEKPPILVFEDRSRIQFKGLTQVPVKSIEEFQNLYSSACFALKGAPKKGGCERVHRSHMGLIVHVFSHNGSLLSKVNFVDLASYEDARKKSSDVSCLAETNKINKSIYALLNVCHALSTNESRVAYRESKITRMLQDSLRGTSKILLISCLNPSFCQDTIYMVSLASRSCHWIHRASLDSTKISASSAKQMVNSHKNQIPKSVSGTAKKLYGSSKLLDKKVVVAKKSAIKGRKLFDEASNSATKAEKEAQCISWYQTQDNSLSETGNDVILNSGVEKNTGNHVVINFGMEKDDSFSKASENGKHMQDDSIQDDSSLNANIEVELNPLADEGILVDEEDHQKDPYASNYSEALSKIVQEDHSMNKENNNSRAIGDHSSATISSPPISSQLRDLSNSLKMLYSSTPSCMQIPEKEPIPLDIVEPKTPTIEQNMSINRLDAMNAKSPWETFSMRGSGMKSSLVQEYLRFLNTANKEELKKLKGIGEKRATFILELREESPEPFKSLDDLKDIGLSAKQIKGIMKKEVGELFS

SEQ ID NO: 159557 - protein, 231 aa, Glycine max
  Coding DNA Sequence Number=SeqID_42779
  Gene Ontology: Mol. function=triacylglycerol lipase activity; Biological process=lipid metabolic process
  Homolog annotation: Hit_ID=Q1RN82; Match level="QueryCoverage=81%, HitCoverage=42%, E-value=6e-79, Identity=76%"; Hit description =Calmodulin binding heat shock protein
MFWHAKVYLHHLHPPPPLPPSCFRKNSMLGKDFIINWHAIKSLPCLLCLRCMRDTCIPEEKMLKDPRRLYAPGRLYHIVERKPFRMGRFPPVVRTAVPVDGRFEHIVLSCNATSDHAIIWIEKEAQRALDLMLEKDETIEAPAKQKMERQETLTRHNDEYKAALQRAKTLDVPHAYTPPSEYGTFNDEGEENSTRSQGESSNKSSVDESWDALIERHFDKDEHGHTVLKKE

SEQ ID NO: 159558 - protein, 89 aa, Glycine max
  Coding DNA Sequence Number=SeqID_42780
MKFLRSRIIVAEMIQMDLFLGCKEKASPTFDTKGEPRTELMATKKAWEALVCMATQLGISSCPIKRPPPKPPNSYSSIECDGMMGHHQR

SEQ ID NO: 159559 - protein, 116 aa, Glycine max
  Coding DNA Sequence Number=SeqID_42781
  Homolog annotation: Hit_ID=Q9LSI6; Match level="QueryCoverage=58%, HitCoverage=20%, E-value=3e-08, Identity=44%"; Hit description =Prolyl 4-hydroxylase alpha subunit-like protein
MTSISLLHALFVFFFLIATSLTESRKELRSKQETALQMLEHSIHYSNRINPSRVVQISWQPRVFLYKGFLSDKECDYLVSLAYAVKEKSSGNGGFSEGVETFLDIEDSRIVNTRPM

SEQ ID NO: 159560 - protein, 658 aa, Glycine max
  Coding DNA Sequence Number=SeqID_42782
  Gene Ontology: Cellular component=chloroplast thylakoid membrane
  Homolog annotation: Hit_ID=Q9FF91; Match level="QueryCoverage=99%, HitCoverage=65%, E-value=5e-73, Identity=33%"; Hit description =Arabidopsis thaliana genomic DNA, chromosome 5, P1 clone:MRO11
  Pfam annotation: Domain name=SLH; Domain location=518-574; Score =12.9; E_value=0.021; Accession=PF00395.10; Description=S-layer homology domain
  Subcellular localization annotation: CTP_CleavageSite=42; ConfidenceScore=5.30e-01
MASLTCTPTSLQLRLAFAAPKFPHPPHVRMRNFKLNRLRPLRAAQDGVSSEWAGPGPKLDGFSGWSDTDAEQRPNNAPKKDSYGGVVGVGVAGVLLLSGLTFAALSLGKQTGSRPEQHMKTLTTQQEELLSSDDHNDEITEQGNVDSMVEQGNGKMEGQIDISGDYSSAESSNFYSDNSIVDDSDIGSQLIYDSKNPSDGVDDATKHISVQEDLQDELAFGNKLVFASESPVPLESENTIDSFNAYGFRDFDSNPNVDTAESTANLKENLFNVDPGDAPNYDDAKPLHLNTEQHDEITSSSGSVSFGFSETYSSSGSDNETGIVSVLVNPESNNMISDPKFFNEAGQENILSASKNENLDLNKIPQVSAEGNEPSFEERSVPGNDLFEESSISSSVNTLVDEQVTNDNYEVDEVKSKSPNSGSFFSVPGIPAPSVVSASVQVLPGKVLVPAAVDQVQGQALAALQVLKVIEPDVQPSDLCTRREYARWLVSASSALSRSTVSKVYPAMYIDNVTELAFDDVIPEDPDFSSIQGLAEAGLIESRLSRRDIQLSAEEDDSPFYFSPESPLSRQDLVSWKMALEKRQLPEANRKVLYQVSGFIDTDKIHPNACPALVADLSSGEQGIIALAFVFTYAYNFGVGRGIGIFKVIQDCSSQINQ

SEQ ID NO: 159561 - protein, 259 aa, Glycine max
  Coding DNA Sequence Number=SeqID_42783
  Gene Ontology: Mol. function=triacylglycerol lipase activity; Biological process=lipid metabolic process
  Homolog annotation: Hit_ID=Q1RN82; Match level="QueryCoverage=91%, HitCoverage=52%, E-value=1e-120, Identity=81%"; Hit description =Calmodulin binding heat shock protein
  Pfam annotation: Domain name=Lipase3_N; Domain location=9-76; Score =100.0; E_value=7.2e-27; Accession=PF03893.7; Description=Lipase 3 N -terminal region
  Pfam annotation: Domain name=Lipase_3; Domain location=109-241; Score= 104.3; E_value=3.5e-28; Accession=PF01764.16; Description=Lipase (class 3)
  Pfam module annotation: Pfam domain module=Lipase3_N::Lipase_3; Domain location=9-76::109-241
MSILCGLPLVECVYCLACARWAWKRCLHTAGHDSENWGFATAEEFEPIPRLCRYILAVYEDDLRHPLWAPPGGYGISPDLLLLKKTYEDTRGRAPPYVLYLDHEHEDIVLAIRGLNLAKESDYAVLLDNKLGKKKYDGGYVHNGLLKAAGWVLDAECEVLRELVAKHPNYTLTFVGHSLGAGVAAMLTMVVVQNRDRLGNIDRKRVRCYAIAPARCMSLNLAVRYADVINSVVLQASYRFFFPIYLVVDEFRILCKSLI

SEQ ID NO: 159562 - protein, 144 aa, Glycine max
  Coding DNA Sequence Number=SeqID_42784
  Gene Ontology: Mol. function=binding; Biological process=thiamin biosynthetic process
  Homolog annotation: Hit_ID=Q2QU89; Match level="QueryCoverage=98%, HitCoverage=18%, E-value=2e-39, Identity=53%"; Hit description =Pentatricopeptide, putative, expressed
MRESKIVKEPGLSLVHIDQVAHEFVSGDNSHPQWEEITRFLGSVIDTVKLGGYTPSTKNVLHDIQEEEKEHSLGYHSEKLAVAFVLLYHRDRKTIRVIKNLRICYDCHSFMKHVSGFFDRDIVIRDRSRFHHFRKGSCSCRDFW

SEQ ID NO: 159563 - protein, 105 aa, Glycine max
  Coding DNA Sequence Number=SeqID_42785
MITVIVYTLPVFYYEKMMGYTLSSFADLVFIDEWIEMGLKRGKFNHPAWTNEKTGANEEDEKKGETHAATVVPTWKIPHQLNNIITQPISTLLITHHPVIHKGHP

SEQ ID NO: 159564 - protein, 573 aa, Glycine max
  Coding DNA Sequence Number=SeqID_42786
  Homolog annotation: Hit_ID=Q2QWE9; Match level="QueryCoverage=91%, HitCoverage=90%, E-value=1e-124, Identity=43%"; Hit description =Expressed protein
  Pfam annotation: Domain name=XS; Domain location=279-404; Score=-0.5; E_value=5.2e-06; Accession=PF03468.5; Description=XS domain
  Pfam annotation: Domain name=zf-XS; Domain location=209-247; Score =43.3; E_value=8.5e-10; Accession=PF03470.5; Description=XS zinc finger domain
  Pfam module annotation: Pfam domain module=XS::zf-XS; Domain location= 279-404::209-247
GIADTKLNSGQDDGEWEVYARKSKNKAGSSAAKPWAPPAHNSNPRAWGNAEMAQKPGIRGHGGLGRSSGNPWQTQNANFRRPAGRGNGRPQLATSGYESNYVPNPAIRPPLEHGWNWQSRPGALQSNARDEISPEDLQKNDDVDDDDGEEDSDAFEDTDDDLMSDDYDSDASQKSHETRKKIKWFKKFFEILDGLTVEQINEPERQWHCPACQGGPGAIDWYRGLQPLVTHAKTKGSKRVKIHRELAILLDEELRRRGTSVIPAGEVFGKWKGLKEEEKDHDIVWPPMVVIQNTKLEQDENDKWIGMGNQELLDYFSTYDAVRARHSYGPQGHRGMSVLIFEASASGYLEAERLHKHFAEQGTDKDSWFSRPILYLPGGNRQLYGYMATKEDMDFFNRHSQGFISSFLAVKGAKHTKALEESIGIMSEKLRKTMEENRIVRRRTKMQHEETKEEMYMQEQFFKDQIKIIHDSRDAKEEDFERMQQEEREKVKQSSTTGHVNAEEYRLKVEEYLKFVEVQDKEMENFVAEKEKLLHAHGTGYAAMKRRHWEEEVQYEQKFDEELANLMEKYSPS

SEQ ID NO: 159565 - protein, 875 aa, Glycine max
  Coding DNA Sequence Number=SeqID_42787
  Gene Ontology: Mol. function=binding; Cellular component =intracellular; Biological process=metabolic process
  Homolog annotation: Hit_ID=Q9FNN9; Match level="QueryCoverage=99%, HitCoverage=98%, E-value=0.0, Identity=46%"; Hit description =Selenium-binding protein-like
  Pfam annotation: Domain name=PPR; Domain location=147-181; Score=2.9; E_value=3.4; Accession=PF01535.11; Description=PPR repeat
  Pfam annotation: Domain name=PPR; Domain location=214-248; Score =32.8; E_value=1.2e-06; Accession=PF01535.11; Description=PPR repeat
  Pfam annotation: Domain name=PPR; Domain location=288-322; Score =20.9; E_value=0.0046; Accession=PF01535.11; Description=PPR repeat
  Pfam annotation: Domain name=PPR; Domain location=422-456; Score =23.9; E_value=0.00059; Accession=PF01535.11; Description=PPR repeat
  Pfam annotation: Domain name=PPR; Domain location=495-529; Score =10.6; E_value=0.41; Accession=PF01535.11; Description=PPR repeat
  Pfam annotation: Domain name=PPR; Domain location=558-592; Score =32.5; E_value=1.5e-06; Accession=PF01535.11; Description=PPR repeat
  Pfam annotation: Domain name=PPR; Domain location=658-692; Score =46.3; E_value=1e-10; Accession=PF01535.11; Description=PPR repeat
  Pfam annotation: Domain name=PPR; Domain location=693-727; Score =15.9; E_value=0.097; Accession=PF01535.11; Description=PPR repeat
  Pfam annotation: Domain name=PPR; Domain location=7-41; Score=4.8; E _value=2; Accession=PF01535.11; Description=PPR repeat
  Pfam annotation: Domain name=PPR; Domain location=79-113; Score=7.8; E_value=0.88; Accession=PF01535.11; Description=PPR repeat
  Pfam annotation: Domain name=PPR; Domain location=795-829; Score=0.9; E_value=5.8; Accession=PF01535.11; Description=PPR repeat
  Pfam module annotation: Pfam domain module=PPR::PPR::PPR::PPR::PPR::PP R::PPR::PPR::PPR::PPR::PPR; Domain location=147-181::214-248::288 -322::422-456::495-529::558-592::658-692::693-727::7-41::79-113::795 -829
MLGRDFKTWGSVIWSLCLEAKHSEALSLFHHCLKGHEAFKPDHTVLAAILKSCSALLAPNLGRTLHGYVVKQGHGSCHVTNKGLLNMYAKCGMLVECLKLFDQLSHCDPVVWNIVLSGFSGSNKCDADVMRVFRMMHSSREALPNSVTVATVLPVCARLGDLDAGKCVHGYVIKSGFDQDTLGGNALVSMYAKCGLVSHDAYAVFDNIAYKDVVSWNAMIAGLAENRLVEDAFLLFSSMVKGPTRPNYATVANILPVCASFDKSVAYYCGRQIHSYVLQWPELSADVSVCNALISLYLKVGQMREAEALFWTMDARDLVTWNAFIAGYTSNGEWLKALHLFGNLASLETLLPDSVTMVSILPACAQLKNLKVGKQIHAYIFRHPFLFYDTAVGNALVSFYAKCGYTEEAYHTFSMISMKDLISWNSIFDAFGEKRHHSRFLSLLHCMLKLRIRPDSVTILAIIRLCASLLRVEKVKEIHSYSIRTGSLLSNTAPTVGNAILDAYSKCGNMEYANKMFQNLSEKRNLVTCNSLISGYVGLGSHHDANMIFSGMSETDLTTWNLMVRVYAENDCPEQALGLCHELQARGMKPDTVTIMSLLPVCTQMASVHLLSQCQGYIIRSCFKDLHLEAALLDAYAKCGIIGRAYKIFQLSAEKDLVMFTAMIGGYAMHGMSEEALWIFSHMLKLGIQPDHIIFTSILSACSHAGRVDEGLKIFYSIEKLHGMKPTVEQYACVVDLLARGGRISEAYSLVTSLPIEANANLWGTLLGACKTHHEVELGRIVANQLFKIEANDIGNYIVLSNLYAADARWDGVMEVRRMMRNKDLKKPAGCSWIEVERTNNIFVAGDCSHPQRSIIYSTLQTLDRQVKEPVEFLA

SEQ ID NO: 159566 - protein, 259 aa, Glycine max
  Coding DNA Sequence Number=SeqID_42788
  Gene Ontology: Mol. function=protein binding; Cellular component =integral to membrane; Biological process=multicellular organismal development
  Homolog annotation: Hit_ID=Q9FNN8; Match level="QueryCoverage=78%, HitCoverage=33%, E-value=7e-72, Identity=63%"; Hit description=Cleft lip and palate associated transmembrane protein-like
  Pfam annotation: Domain name=CLPTM1; Domain location=24-256; Score= -224.8; E_value=3.5e-09; Accession=PF05602.3; Description=Cleft lip and palate transmembrane protein 1 (CLPTM1)
  Subcellular localization annotation: CTP_CleavageSite=32; ConfidenceScore=5.01e-01
MAPPTPAVEGAQAPQGRQQQPQGGFGLTGIIRMVVFWYFASKFFSPKKPTEPSALISNLFQKAQPLDMWLYLSEHEKFNDFGSESSLVWHETNVPYAVWGPESTRTHTLKYHPSESLKHNGSLYAHVFFAHSGFSPDPSDPEYQPQAAFGRTHPVVTYLPKSKADKKKSLLGSSPDSSEAQVASKVVDESEDDDDSSDDGDSNDDGPVEWASYWKPNITINLVADFTHLPSLEATSELLQLAISYSISVKLISNHQHAT

SEQ ID NO: 159567 - protein, 78 aa, Glycine max
  Coding DNA Sequence Number=SeqID_42789
MSVTLTNEMLWERIIGASGEKNAMASTRGKERKKRGGLLYHGMHDWRLKRTRLRSACGWERSEVENDTWKKKEEGRNK

SEQ ID NO: 159568 - protein, 643 aa, Glycine max
  Coding DNA Sequence Number=SeqID_42790
  Gene Ontology: Mol. function=DNA binding; Cellular component=nucleus; Biological process=porphyrin biosynthetic process
  Homolog annotation: Hit_ID=Q0WU91; Match level="QueryCoverage=80%, HitCoverage=90%, E-value=8e-92, Identity=39%"; Hit description=GTL1 -like protein
  Pfam annotation: Domain name=MAT1; Domain location=282-446; Score= -85.7; E_value=0.087; Accession=PF06391.3; Description=CDK-activating kinase assembly factor
MCERERQKSERERGWCVVCKLLACSILLILIYSEHRKEEVKKREVVTQNTNTNMFDGVPDQFHQFITPRTSLPLHLPFPLHTSGGTPNTTTFPSNFDPYNHPHQLPLQPNNLLHPLHHKDEDKEENTTVPMNLEIQRDQRQQLPELIDPWNNDEVLALLRIRSSMESWFPELTWEHVSRKLAELGYKRSAEKCKEKFEEESRYFNNINYGKNNNNNNNSSNYRFLSELEQLYHQGGSGDHHLENTTQPPLQKQDKMGHHALELEVEGDSRNVVDALVTKQNEQSDEALAVEKITKDRKRKRPDRFEMFKCFCESIVHKIMAQQEEMHNKLLEDMMKRDDEKFTREEAWKKQEIEKMNKELEMMAREQAIAGDRQANIIQILNKFSATSSPASHTLKKVNNDSNINTHITQNPNPSQTENPTLSVAQDTLQVIPSTSSTSTPALPQNPSTYSLNIQNNNNNIPVETNSVLNKGNEKDDVGRRWPKDEVLALINLRCTSVNNNNNEEKEGNNKVPLWERISQGMLELGYKRSAKRCKEKWENINKYFRKTKDVNKKRSLDSRTCPYFHQLSSLYNQGKPVLQSESHLNSPPNQNPEQVTPDQTTQAHESSSQVGSGGGFSVQQQQVDHGGEKTLMQVPSLDFDQF

SEQ ID NO: 159569 - protein, 155 aa, Glycine max
  Coding DNA Sequence Number=SeqID_42791
YIMSSVITVLYFDGRSNLHGDEDDDDDDDYLVSNSYVEESLEKDDNIDGISNTDDDDEVTDMIQPVRIVHPVEGVQGIQNPFWNDALHYNNINWSHPDEEDICGLEMPSSINVGQKLYVGMDFDSNDAVQNVVKQYVMKVHHSFKVVESKSNKYV

SEQ ID NO: 159570 - protein, 111 aa, Glycine max
  Coding DNA Sequence Number=SeqID_42792
MIRLTATSLVHPEEPACTLQQPVEWILPTPTPYRLVEPVQVIEVSSSEEDPEEDPKELPPEPAMDALDLPEDDEDPLPDVDSPEDIMSASEADSTEESGPGGTTISDDSSS

SEQ ID NO: 159571 - protein, 80 aa, Glycine max
  Coding DNA Sequence Number=SeqID_42793
MGFHPTKLNFVPSDADEAPPDVSICLHAFGIVGCGSFSGVKSCELNVGGLVPPLCSLKSVVSDDACPGACFVQRDATTLS

SEQ ID NO: 159572 - protein, 110 aa, Glycine max
  Coding DNA Sequence Number=SeqID_42794
MANIDPVNEPYDDNLYFDPSVLDQNEYEDFSHFFQVDIVFDSREELINWAKETAVSHCHRLICQSRRENAQYMTCDKYGHGRQTNIDMEDPRNTGTKKCGCPFKLIGKRS

SEQ ID NO: 159573 - protein, 41 aa, Glycine max
  Coding DNA Sequence Number=SeqID_42795
CSLQFKSILPPFAADKAVCELVFRGESPSPRKDTALLLFES

SEQ ID NO: 159574 - protein, 344 aa, Glycine max
  Coding DNA Sequence Number=SeqID_42796
  Gene Ontology: Mol. function=protein binding; Cellular component =integral to membrane; Biological process=multicellular organismal development
  Homolog annotation: Hit_ID=Q9FNN8; Match level="QueryCoverage=90%, HitCoverage=57%, E-value=1e-133, Identity=72%"; Hit description =Cleft lip and palate associated transmembrane protein-like
  Pfam annotation: Domain name=CLPTM1; Domain location=1-321; Score =303.7; E_value=3.4e-88; Accession=PF05602.3; Description=Cleft lip and palate transmembrane protein 1 (CLPTM1)
MSSYLNFGCPDLNVDPLTGNYYPIVYFNEFWLLRDKLIPLNETVTELSLNLEVGPISMTKWQLFLQIDQSFQIHRSYGSMLEGEADELKGILGRESLPPGNYHVFKKAPPIRKCIWIWLEVQLIIFLYLLDNDTSWMILASSGIGCVIEFWKIGKAMRIEIDRTGRIPMLKLRDRESYVRNKTKEYDDIAMKYLFYVLFLLVAGFSVYSLMYERHKSWYSWILSSLTSCVYMFGFIMMCPQLFINYKLKSVAHLPWRQMTYKFLNTIIDDLFAFVIKMPTLHRLSVFRDDLIFVIYLYQRWIYKVDKKRVNEFGFGGEDDQVVAETDATKEEENTTTEEEKKTN

SEQ ID NO: 159575 - protein, 115 aa, Glycine max
  Coding DNA Sequence Number=SeqID_42797
  Homolog annotation: Hit_ID=Q1T4S2; Match level="QueryCoverage=41%, HitCoverage=16%, E-value=7e-08, Identity=63%"; Hit description=HMG-I and HMG-Y, DNA-binding
MDLESIKMLEEGSESEWNACEGWSLTQELIEKTDRLCSEESRPDGEKTNNSRQRKTKKTIREVIKKDLEINGLNRSMLATTPCPVATVVSKEQVTLARFTGQWRNTSVDEIAIFL

SEQ ID NO: 159576 - protein, 282 aa, Glycine max
  Coding DNA Sequence Number=SeqID_42798
  Gene Ontology: Mol. function=binding
  Homolog annotation: Hit_ID=Q9FHV2; Match level="QueryCoverage=93%, HitCoverage=32%, E-value=7e-41, Identity=39%"; Hit description =Arabidopsis thaliana genomic DNA, chromosome 5, P1 clone:MJG14
MCTLEPDVIGIRGFELRLIRCTITFSQPSDSRHELESLDGHINDLLNSIERGNYVEALTSEPSFSLVFRLDGHESLPLDADRVYSELVHRAESFLRDAAAAEQRRRAILVMCIAIAAFLGFTQSNFTGPLKGTELSKCLLCLDGSDEWDNWARNQFMSAGSDLLGKFSNLQYLVLAKMLLMRMKDLSVEIGSLSWWLARVLLLQLRVLDERSSSLSDLLHVYMGEALQQFSTSKLVRSYWEDDLRDGESSAIVSVLHLEAGIMEYLYGRVDSCRLVAINSEP

SEQ ID NO: 159577 - protein, 532 aa, Glycine max
  Coding DNA Sequence Number=SeqID_42799
  Gene Ontology: Mol. function=protein serine/threonine kinase activity; Cellular component=cytoplasm; Biological process=protein amino acid phosphorylation
  Homolog annotation: Hit_ID=Q5XLG3; Match level="QueryCoverage=99%, HitCoverage=100%, E-value=0.0, Identity=79%"; Hit description =Calcium-dependent protein kinase 1
  Pfam annotation: Domain name=Pkinase; Domain location=31-311; Score =349.6; E_value=5.3e-102; Accession=PF00069.15; Description=Protein kinase domain
  Pfam annotation: Domain name=Pkinase_Tyr; Domain location=31-314; Score=-23.0; E_value=4.7e-11; Accession=PF07714.7; Description =Protein tyrosine kinase
  Pfam annotation: Domain name=efhand; Domain location=371-399; Score =39.3; E_value=1.3e-08; Accession=PF00036.22; Description=EF hand
  Pfam annotation: Domain name=efhand; Domain location=407-435; Score =29.9; E_value=8.8e-06; Accession=PF00036.22; Description=EF hand
  Pfam annotation: Domain name=efhand; Domain location=443-471; Score =31.4; E_value=3.1e-06; Accession=PF00036.22; Description=EF hand
  Pfam annotation: Domain name=efhand; Domain location=477-505; Score =33.0; E_value=1.1e-06; Accession=PF00036.22; Description=EF hand
  Pfam module annotation: Pfam domain module=Pkinase::Pkinase _Tyr::efhand::efhand::efhand::efhand; Domain location=31-311::31 -314::371-399::407-435::443-471::477-505
MSNSTTGTTAALPPKPTWVLPYRTENLREVYTLSRKLGQGQFGTTFLCTHNATGRTFACKSIPKRKLLCKEDYDDVWREIQIMHHLSEHPNVVRIHGTYEDAASVHLVMELCEGGELFDRIVQKGHYSERQAAKLIKTIVEVVEACHSLGVMHRDLKPENFLFDTVEEGAKLKTTDFGLSVFYKPVTIRSTGNPSMLCMLNTVIYFSGETFCDVVGSPYYVAPEVLRKHYGPEADVWSAGVILYILLSGVPPFWAETEQGIFRQILLGRIDFQSEPWPSISDSAKDLIRKMLDRNPKTRVTAHQVLWYKAVALMWFSVSGHPWIVDDNIAPDKPLDSAVLSRLKQFSAMNKLKKMALRVIAERLSEEEIGGLKELFRMIDADNSGTITFDELKEGLKRVGSELMESEIKDLMDAADIDNSGTIDYGEFIAATVHLNKLEREENLVSAFSYFDKDGSGYITIDEIQQACKDFGLDDVHIDEIVKEIDQDDDGQIDYGEFAAMMRKGNGGIGRRTMRSTLNFRDAFGIIDHGSD

SEQ ID NO: 159578 - protein, 389 aa, Glycine max
  Coding DNA Sequence Number=SeqID_42800
  Gene Ontology: Mol. function=molecular_function; Cellular component =cellular_component; Biological process=cell differentiation
  Homolog annotation: Hit_ID=Q5SNH3; Match level="QueryCoverage=95%, HitCoverage=95%, E-value=1e-107, Identity=55%"; Hit description =Putative pollen specific protein SF21
  Pfam annotation: Domain name=Abhydrolase_1; Domain location=75-332; Score=-11.0; E_value=0.056; Accession=PF00561.10; Description =alphabeta hydrolase fold
  Pfam annotation: Domain name=Ndr; Domain location=21-341; Score =330.0; E_value=4.2e-96; Accession=PF03096.5; Description=Ndr family
  Pfam module annotation: Pfam domain module=Abhydrolase_1::Ndr; Domain location=75-332::21-341
MGESSDSVSIDIDLIPLGGKECTVKTSKGSMSVLVCGDREKPALITYPDVALNYVSCFQGLLFCPEAASLLLHNFCIYHIDAPGHELGADVISSDEPLLCVDDLADQIAEVLDFFGLREVLCLGVTAGAYVLTLLAMKYKERVLGLILVSPICKSPSWTEWLYNKVLMNLLYFYGMCGVLKECLLQRYFSKVFFTFFPFIPHYEGGIISELRCSVQGAESDIILTCRRLLDERQGLNVMRFLQAINAIRIGNSCYSIQFILRDWRTKFYSVATDLLDFWQTNMACESSPFHAESVYMSSKMNHKICALVEVQACGSLVTEEHPNSMITPLERFLMGFGYHRQTHAASSSSNGSNPASPTSHSCIAPELLSPESLGIKLKPIRTRVDVQI

SEQ ID NO: 159579 - protein, 197 aa, Glycine max
  Coding DNA Sequence Number=SeqID_42801
  Gene Ontology: Mol. function=binding
  Homolog annotation: Hit_ID=Q9FHV2; Match level="QueryCoverage=91%, HitCoverage=22%, E-value=1e-25, Identity=34%"; Hit description =Arabidopsis thaliana genomic DNA, chromosome 5, P1 clone:MJG14
MNLSLENIRHVEALEGVQMILNMSNNKRVDCELLERITKEVEKRLSTSNVPPLITDNKPKTDQFCIVDPGSENQEQVSGASITGRSRETEQLLLLLGKVLQQIIKTGSGCGPEIWGLYAKWHRINGDLMMCSEALLKQVRSLQGSDTWKDRDRFKKFAKVSLELCQAQSFTDTEEFRDLQACYDEVKIKLQSNSMPS

SEQ ID NO: 159580 - protein, 80 aa, Glycine max
  Coding DNA Sequence Number=SeqID_42802
  Gene Ontology: Biological process=auxin mediated signaling pathway
  Homolog annotation: Hit_ID=Q1S0B8; Match level="QueryCoverage=81%, HitCoverage=60%, E-value=2e-12, Identity=48%"; Hit description=Auxin responsive protein
  Pfam annotation: Domain name=Auxin_inducible; Domain location=1-77; Score=52.9; E_value=1.1e-12; Accession=PF02519.5; Description=Auxin responsive protein
MPKYQCDADARKAPKGQFVVYVGEELRRFTLPLSYLKNPSFQQLLKKSAEEYGYSDSRGIVLPCDESTFESFFMNSKMRI

SEQ ID NO: 159581 - protein, 457 aa, Glycine max
  Coding DNA Sequence Number=SeqID_42803
  Gene Ontology: Mol. function=phospholipase C activity; Biological process=intracellular signaling cascade
  Homolog annotation: Hit_ID=Q53KW9; Match level="QueryCoverage=47%, HitCoverage=26%, E-value=4e-33, Identity=36%"; Hit description =Expressed protein
MDQWDAHHRLMFIGRHEEDGTADTSKGEESNDEEKISKTEPVFVPETKKRKRLSLSQLKEVKEESHGKQSSSKSKRKKHDSRDRWSAERYQLAEQNMWEVLKAEGATFENPITRPALRLAARKHIGDTGLLDHLLKHIDGKVAPGGTERFRRWFNTNGIMEYWLESADLDKVRQEAGVQDPYWIPPSTYREAGAPSQNIDSSGELKQLKIELMQMKKDMHELIAKKEEKSDINMVEHFMMFCFELLWQETHKESVKWKFMTDHRLTEIMTSLKDIQGKYGELMIWKTTVEQQLMEITDKLNDLQASRECTTNSPPSERWKDWIESTNLDNIQEDAFATWIGNPELLNVPQEVILEDPNTTIPTQPPSEELTNKRSDVLELVPGKLEDQPNVTPDSSTTVNSKSDHDNNSLIMFQHNVFNIYDVFSQEMFMDLYKWKEKMEQQLLEVSNTVYGMLAMK

SEQ ID NO: 159582 - protein, 97 aa, Glycine max
  Coding DNA Sequence Number=SeqID_42804
MVTTHIKEWDNVEENGNWVELLEGCCFYLTRTHERTREEPLKVASFLKFGEILSKKCYVKVECKFPIFGMYVFKGREGVKGSEAVPQKWSPHSRVKT

SEQ ID NO: 159583 - protein, 957 aa, Glycine max
  Coding DNA Sequence Number=SeqID_42805
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9LT02; Match level="QueryCoverage=100%, HitCoverage=79%, E-value=0.0, Identity=74%"; Hit description =Putative cation-transporting ATPase
  Pfam annotation: Domain name=E1-E2_ATPase; Domain location=2-231; Score=-65.4; E_value=1.2e-05; Accession=PF00122.10; Description=E1 -E2 ATPase
  Pfam annotation: Domain name=Hydrolase; Domain location=240-602; Score=39.1; E_value=1.6e-08; Accession=PF00702.16; Description =haloacid dehalogenase-like hydrolase
  Pfam module annotation: Pfam domain module=E1-E2_ATPase::Hydrolase; Domain location=2-231::240-602
MAKSRLKTLTELRRVRVDSQILMVHRCGKWVKLSGTELLPGDVVSIGRSSGQNGEEKSVPADMLLLAGSVIVNEAILTGESTPQWKETLSARQDKNHVLFGGTKILQHTPDKSFPLKTPDGGCLAVILRTGFETSQGKLMRTILFSTERVTANSWESGFFILFLVVFALIAAGYVLVKGLEDPTRSKYKLILSCSLIVTSVIPPELPMELSIAVNTSLIALARRGIFCTEPFRIPFAGKVDICCFDKTGTLTSDDMEFSGIVGLNGTTDLESDTSKVPLRTVEILASCHALVFVENKLVGDPLEKAALKGIDWSYKSDDKAVPKNPLSMFYPDMLSNFRGNGHPVQIVHRYHFASHLKRMAVVVRIQEEFFAFVKGAPEVIQDRLVDIPPSYVETYKKYTRQGSRVLALAYKSLADMTVSEARSLDRGIVESGLTFAGFVVFNCPIRSDSATVLAELKESSHDLVMITGDQALTACHVASQVHIISKPTLILGPAQNGEGYNWMSPDETENIRYSEKEVESLSETHDLCIGGDCIEMLQQTSAHLRVIPYVKVFARVAPEQKELIMTTFKMVGRLTLMCGDGTNDVGALKQAHVGIALLNALPPTQSGNSSSDSSKEEGSKSGKQKKSKPAADTSGKTAGEGTSKAKVASKSDSASHSSGNRHQAAVEMQRQKLKKMMDELNEEGDGRAPIVKLGDASMASPFTAKHASVAPTTDIIRQGRSTLVTTLQMFKILGLNCLATAYVLSVMYLDGVKLGDIQATISGIFTAAFFLFISHARPLPTLSAERPHPNIFCAYVFLSLLGQFSIHLLFLISSVKEAEKHMPDECIEPDADFHPNLVNTVSYMVSMMLQVATFAVNYMGHPFNQSISENRPFRYALVAAVVFFTVITSDLFRDLNDWLKLVPLPVGLRDKLLLWAFLMFLVCYSWERLLRWAFPGKIPAWKKRQRLAVSNLEKKQ

SEQ ID NO: 159584 - protein, 717 aa, Glycine max
  Coding DNA Sequence Number=SeqID_42806
  Gene Ontology: Mol. function=protein serine/threonine kinase activity; Biological process=protein amino acid phosphorylation
  Homolog annotation: Hit_ID=Q1SD79; Match level="QueryCoverage=93%, HitCoverage=95%, E-value=1e-164, Identity=46%"; Hit description =Tyrosine protein kinase, active site
MAVISASTVSGTSGLSQFLPISRRVLKGLKEYGRKLVDLELFSQYLEEWVLENLNGDSEDGMQSFRSPFTTDELCKLDLALEGVPFQQLVRMPFFADVSDELIEDQYLAAEDFLHAIIIGLWRTFWHKSGPLPLCVSCPSHIGSRFSSVEKAISRGRLREMRGLGLISKIATDSKFKWDHMVEFALFKPEVFLDNDSRLSASTICEALFYGFHVLVSRSLSKISSVNSDSVFLLVLDSKCGVVIKFSGDLGKLDLLNSSDPYLSVAEWIKTNAEICVTPVEPIWNRLGNPNWGDIGTLQVLLATFYSIAQWNGPPRKSVASLISDHSLRLQKRRTECCIIETENALVPYHETSDHQAGEIVELDQNELFSHNRASRLKLKCGDILALDDPQQGQKSFQIHESLVGGKYYLYSAVCLDHPSELLTLYVGAHPSRLEPSLEDMSLWYQVQRQTKVLNILRNQGILSKYLPEIVASGRILHSGPCKKESPGGRCDHPWCGTPILVISPIGEPLSSVVANEGSFSADEATRLCRDCLAALRSAAMANVQHGDICPENILRVVEKQGVRNQTMYVPISWGRGVLEDRDSPAINLQFSSSHALQHGKLCPSSDAESIVYILYFICGGTMSLQDSIESALQWRERSWAKRSIQQHIGQVSALLKAFADYVDSLCGTPYPIDYDIWLKRLNKAVEGSADKGKMIEEVPITLRLEDAAESSGASGP

SEQ ID NO: 159585 - protein, 219 aa, Glycine max
  Coding DNA Sequence Number=SeqID_42807
MHQHPLNCSSPDVKFLVTDWERLPGFGIGAQIAGMCGLLGIAINEGRVLVTNYYNRADHGSCKGSSRSSWSCYFFPETSLECRQRAFELMKSEEAWSKGIVTTKENYTTKHIWAGPTPRKWGLPWNYLQPTTDINGTLLASHRKMDRRWWRAQAVRYLMRFPTEYTCNLMNEARHASFGKLAAKMVLESLAGDWPKVVVKFALFFLLDVKELKSGSSTL

SEQ ID NO: 159586 - protein, 66 aa, Glycine max
  Coding DNA Sequence Number=SeqID_42808
MERWDTNSKKVVAWEGSVLANIKKRLMLESRNTNNWLPRMARDHLFEVILITQLEDKFTMNLQTQE

SEQ ID NO: 159587 - protein, 170 aa, Glycine max
  Coding DNA Sequence Number=SeqID_42809
  Gene Ontology: Mol. function=nucleic acid binding; Biological process= RNA-dependent DNA replication
MNGVSPEALQLRLFKHSLQGAAREWLQTRAPHSISPWAQLAQLFMNTYNSPTKTERIRCPNHGLQEWRQLQIFYDGLQDNSRTVLDSAAGGMFMSLTYDEAYELLERIARNKYMRASDRSNSGAVKTGGILELDGVTAITAQLEKLSKQVAALQTQQVHAVQAPDQSVDE

SEQ ID NO: 159588 - protein, 100 aa, Glycine max
  Coding DNA Sequence Number=SeqID_42810
MYVVLISLEAQRANSLGTTNPQRDNSHEEPTRSVLRTRNETTPTRSQLARYYEPTARQLPRGANSLGTTNPQRDNSHEEPNSLGTTNPQRDNSHEEPTRS

SEQ ID NO: 159589 - protein, 145 aa, Glycine max
  Coding DNA Sequence Number=SeqID_42811
  Gene Ontology: Mol. function=structural constituent of ribosome; Cellular component=ribosome; Biological process=translation
  Homolog annotation: Hit_ID=UPI0000166125; Match level="QueryCoverage =100%, HitCoverage=55%, E-value=1e-67, Identity=55%"; Hit description= ribosomal protein S1
  Pfam annotation: Domain name=S1; Domain location=5-78; Score=78.9; E _value=1.6e-20; Accession=PF00575.13; Description=S1 RNA binding domain
  Pfam annotation: Domain name=S1; Domain location=91-143; Score=2.8; E_ value=0.12; Accession=PF00575.13; Description=S1 RNA binding domain
  Pfam module annotation: Pfam domain module=S1::S1; Domain location=5 -78::91-143
EFFSEKKVVDIVEGTVKGISNAGVEVEISEGVRGFIPRRQLCYNTRISPEDLVKPGQNITAKIIELDKEKKNVILSLKRLMPDPWEKVEEKYPVGKVVNGEVISIHPFGFFVKLEPGVEGLEPRSEVFWGNTVKSLDNVMSAGDL

SEQ ID NO: 159590 - protein, 182 aa, Glycine max
  Coding DNA Sequence Number=SeqID_42812
KSKKFQGKRDDPTYGSKLVTFLLGPFHKNTAIPAEDREIPLIVGRPFLATSKTLIDCASGDLTMTVHDETIKFNVFYANKNPCENNECFTIELMDFTNHEKFDVSTLDHGKASLSAGDDDGKRNRKEHIYCADSSSTPPRDSQKSWGANGDERARRMWPPKKIKRASSGRGIQLPSDFGHVA

SEQ ID NO: 159591 - protein, 66 aa, Glycine max
  Coding DNA Sequence Number=SeqID_42813
  Gene Ontology: Mol. function=histone-lysine N-methyltransferase activity; Cellular component=nucleus; Biological process=chromatin modification
  Homolog annotation: Hit_ID=Q8VZJ1; Match level="QueryCoverage=91%, HitCoverage=17%, E-value=2e-18, Identity=67%"; Hit description =Histone-lysine N-methyltransferase ATXR5
MTLIAEYAGDVGYIRNREEDDCDSMMTLLSSVDQSKSLVVCADRLGNISRFVSGINNHTTVLIFKE

SEQ ID NO: 159592 - protein, 151 aa, Glycine max
  Coding DNA Sequence Number=SeqID_42814
  Gene Ontology: Mol. function=polygalacturonase activity; Cellular component=cellulose and pectin-containing cell wall; Biological process=carbohydrate metabolic process
  Homolog annotation: Hit_ID=Q2HUB1; Match level="QueryCoverage=99%, HitCoverage=38%, E-value=1e-63, Identity=75%"; Hit description =Glycoside hydrolase, family 28
IGSLGTRGETDIVEDVHVENCTLTETLTGVRIKTWQGGAGYARRITFEKIRFVRANNPIIIDQFYCPHRSDCQNQTRAIKISDVTYKGIVGTSLTDKAINLSCDQNVGCSNIVLDHVYITPSVPGQKVFSYCHNAHGIATHTKPSVKCLLK

SEQ ID NO: 159593 - protein, 141 aa, Glycine max
  Coding DNA Sequence Number=SeqID_42815
  Subcellular localization annotation: CTP_CleavageSite=28; ConfidenceScore=5.01e-01
SWQEYRGGGGGEKNGDVRVGGFNPKLMRSNSSVSWRNGQSMIGGVGGGFGNVSMRKSDVQGNELGLGLGGRKGRDEFVGLERNRSARYSSPNSIDNNGLLRLYLGGRRNGGIGALYAFGHGVFFFFCLYAAKGWLIGGVER

SEQ ID NO: 159594 - protein, 48 aa, Glycine max
  Coding DNA Sequence Number=SeqID_42816
MEKNVPQIQPSASAFTSFEVLTSVFPVWKTHRGDVRCKVNGKELLVFI

SEQ ID NO: 159595 - protein, 404 aa, Glycine max
  Coding DNA Sequence Number=SeqID_42817
  Pfam annotation: Domain name=DUF740; Domain location=1-404; Score =110.9; E_value=3.7e-30; Accession=PF05340.3; Description=Protein of unknown function (DUF740)
  Subcellular localization annotation: CTP_CleavageSite=87; ConfidenceScore=5.69e-01
TSSTAAAALKAIFRPSIAARNRPPPSSFLPELRRTKSFSASKNEALSGFFEPQRKSCDVRGRSTLFSLFNQEAAVAVEVETRHNLPSSSVVQKPVLESEEEEEQEQENNNIVVHNVNDNNNTRVPDSLQPQPEATNNTFTEHRVSVSEIVEEEPEIVLEPEADVAAAEEDTLKETKDHMDLDSSQTKKPSGGRDLKGSFWSAASVFSKKLQKWRQKQKNKKRERNGVVVGSGTLLPVEKPISRQFRETQSEIADYGFGRRSCDTDPRFSLDAARMSFDFEEPRASWDGYLMARTTSSFAAVPPRMPTMIEDAPAPVQVLRTDSLIPVEEPEYEDALILNLNLNPNPNLPGGSAQTKEYYSDSSRRRKSLDRSSSIRRTAAAVVAEMDELKAVANASANANANAR

SEQ ID NO: 159596 - protein, 137 aa, Glycine max
  Coding DNA Sequence Number=SeqID_42818
MVLPTLQGKDIDYPWKQDVIGDPTTNVITNWQVKDGELIQSELPPATQYQLPNIKDSNNKPVMAIPFKTKDVNEEVTSKDIKSLVEQANYTNKYLQALGETIKTKVVPKQKSIEEASPSIPIEKPLFKPFKVSEKAK

SEQ ID NO: 159597 - protein, 259 aa, Glycine max
  Coding DNA Sequence Number=SeqID_42819
MDPGLEPHHPSGYCDRHPEEQFIGYCPECLYEELTVHDENSSTSTQVESHATSSIISSTKAIFQPFTAMCGPNRPCSSSSFLLMLRRTKSLFGTFKSQRKSNNFPTHNTLLSLFNQDDEYKIPREEPEVEMLNLASSSSIVQEVEEDRGTREIKGNEIIEEELEVEAKETPEAMKDTMDLGSQANKSYGHDLKGIFQFVSLFKNGTLELRPHFETLDSEDGPKLLEASVNLGHKILIYQTTLHQEKVWLRKLKESASFV

SEQ ID NO: 159598 - protein, 199 aa, Glycine max
  Coding DNA Sequence Number=SeqID_42820
  Gene Ontology: Mol. function=transferase activity; Biological process= biosynthetic process
  Homolog annotation: Hit_ID=Q8P5K0; Match level="QueryCoverage=81%, HitCoverage=43%, E-value=7e-54, Identity=66%"; Hit description =Glycosyl transferase
  Subcellular localization annotation: CTP_CleavageSite=29; ConfidenceScore=5.09e-01
MVSAMPGNGHIATYASTHQGAQRPARSSRTMTAGSAGEVGIEAEGIALHGLQGKRDAGRQGRRLRQQGQRAFTQCVRIAQRHGTCGLQLPQQFADATVVPAQHRAAHRQRLDHSTAECFGLVRQLQHQIAGRIGLGDARGRCADLHGIHHAQSSGLPAQVGHVGFAARFIGAQHPQLCRYTGRAHIRQQLQRMSMSLQP

SEQ ID NO: 159599 - protein, 141 aa, Glycine max
  Coding DNA Sequence Number=SeqID_42821
KENSVDKGSELGETIAVCKEAFGSLDAAAESVLQLFLKLENVHGKEVATGAGAQFLDEATELLPLVVNKVNAVARLVQCRKNSKCETSRPSVQEIDQFGRFAAGRGTRERIGGGNENGCCGEEEDREKKRVSEGRRGRWGH

SEQ ID NO: 159600 - protein, 95 aa, Glycine max
  Coding DNA Sequence Number=SeqID_42822
  Subcellular localization annotation: CTP_CleavageSite=34; ConfidenceScore=5.15e-01
MDQLTVPGAETASTKSTTLATREAFKMANRSAVLAKKRVNRKYKTFLRLDVNYTGFGANQRHFRKHDAHCSGKPKGSSFGSNIYTFEGKIGKLSK

SEQ ID NO: 159601 - protein, 119 aa, Glycine max
  Coding DNA Sequence Number=SeqID_42823
  Homolog annotation: Hit_ID=Q00M75; Match level="QueryCoverage=30%, HitCoverage=6%, E-value=5e-10, Identity=83%"; Hit description=PPR -repeat containing protein
MIRNIPEGCANNQYIPNHQSKAVKHTADRIHVLEQKLISLSPVHPLCSVGTEAIQIESEQGCLLYRGSSLCEGIGEGCCTQPYPCICKEAVSGFEPMTNKSPKHNFTAAPGLALVKPIS

SEQ ID NO: 159602 - protein, 143 aa, Glycine max
  Coding DNA Sequence Number=SeqID_42824
PYDLDITVTSLEDQLYRDLSLSSTEDHPKGQCSCSPKSSGRSCTNTTHELNPSRSHLSRPISTRGHHRRRRHHLAGIGHPLADPFRVQGEIREEEDRRSKNRGAAHEPKPHGSPRTARRPHVSYTRRRGRRAAAAAPPAAAPG

SEQ ID NO: 159603 - protein, 189 aa, Glycine max
  Coding DNA Sequence Number=SeqID_42825
  Gene Ontology: Mol. function=nucleic acid binding; Cellular component= mitochondrion; Biological process=metabolic process
  Homolog annotation: Hit_ID=Q2HUC3; Match level="QueryCoverage=100%, HitCoverage=88%, E-value=4e-65, Identity=32%"; Hit description =Tetratricopeptide-like helical
  Pfam annotation: Domain name=PPR; Domain location=11-45; Score=14.6; E_value=0.14; Accession=PF01535.11; Description=PPR repeat
  Pfam annotation: Domain name=PPR; Domain location=121-155; Score =36.5; E_value=9.2e-08; Accession=PF01535.11; Description=PPR repeat
  Pfam annotation: Domain name=PPR; Domain location=156-189; Score =15.3; E_value=0.12; Accession=PF01535.11; Description=PPR repeat
  Pfam annotation: Domain name=PPR; Domain location=47-81; Score=15.7; E_value=0.1; Accession=PF01535.11; Description=PPR repeat
  Pfam annotation: Domain name=PPR; Domain location=86-120; Score=13.3; E_value=0.2; Accession=PF01535.11; Description=PPR repeat
  Pfam module annotation: Pfam domain module=PPR::PPR::PPR::PPR::PPR; Domain location=11-45::121-155::156-189::47-81::86-120
MKAQHLKPTREAFSALILAYAESGSLDRALQLFHTVREMHNCFPTFVASNLLLNGLVKSGKVDVALQLYDKMLQTDDGTGAVVDNYTTSIMVKGLCNLGKIEEGRRLIKHRWGKCCVPHVVFYNMIIDGYCKKGDLQCATRALNELKMKGVLPTVETYGALINGFCKAGEFEAVDQLLTEMAARGLNMN

SEQ ID NO: 159604 - protein, 102 aa, Glycine max
  Coding DNA Sequence Number=SeqID_42826
MGNPVERTREGSGRSPIEKLQTEFCVMDSVDDEMGNVGNDNLGFCEARFEGILPLVGFTSSKDLDDVGNEVVDAGRQRGGGTFGAVTRFDSRKNGLGHLKSS

SEQ ID NO: 159605 - protein, 490 aa, Glycine max
  Coding DNA Sequence Number=SeqID_42827
  Gene Ontology: Mol. function=nucleic acid binding; Cellular component= mitochondrion; Biological process=metabolic process
  Homolog annotation: Hit_ID=Q2HUC3; Match level="QueryCoverage=97%, HitCoverage=97%, E-value=0.0, Identity=41%"; Hit description =Tetratricopeptide-like helical
  Pfam annotation: Domain name=PPR; Domain location=11-45; Score=39.1; E_value=1.5e-08; Accession=PF01535.11; Description=PPR repeat
  Pfam annotation: Domain name=PPR; Domain location=116-150; Score =36.2; E_value=1.1e-07; Accession=PF01535.11; Description=PPR repeat
  Pfam annotation: Domain name=PPR; Domain location=151-185; Score =33.1; E_value=9.9e-07; Accession=PF01535.11; Description=PPR repeat
  Pfam annotation: Domain name=PPR; Domain location=186-220; Score =39.5; E_value=1.1e-08; Accession=PF01535.11; Description=PPR repeat
  Pfam annotation: Domain name=PPR; Domain location=221-255; Score =42.9; E_value=1.1e-09; Accession=PF01535.11; Description=PPR repeat
  Pfam annotation: Domain name=PPR; Domain location=256-290; Score =43.0; E_value=1e-09; Accession=PF01535.11; Description=PPR repeat
  Pfam annotation: Domain name=PPR; Domain location=291-325; Score =44.3; E_value=4.3e-10; Accession=PF01535.11; Description=PPR repeat
  Pfam annotation: Domain name=PPR; Domain location=375-409; Score =27.2; E_value=5.7e-05; Accession=PF01535.11; Description=PPR repeat
  Pfam annotation: Domain name=PPR; Domain location=46-80; Score=24.0; E_value=0.00055; Accession=PF01535.11; Description=PPR repeat
  Pfam annotation: Domain name=PPR; Domain location=81-115; Score=29.8; E_value=9.6e-06; Accession=PF01535.11; Description=PPR repeat
  Pfam module annotation: Pfam domain module=PPR::PPR::PPR::PPR::PPR::PP R::PPR::PPR::PPR::PPR; Domain location=11-45::116-150::151-185::186 -220::221-255::256-290::291-325::375-409::46-80::81-115
MAEMGCGPDITTYNIMINFSCKGGRIEEADELLEKAKERGLLPNKFSYTPLMHAYCKKGDYVKASGMLFRIAEIGEKSDLVSYGAFIHGVVVAGEIDVALMVREKMMEKGVFPDAQIYNILMSGLCKKGRIPAMKLLLSEMLDRNVQPDVYVFATLIDGFIRNGELDEAIKIFKVIIRKGVDPGIVGYNAMIKGFCKFGKMTDALSCLNEMNSVHHAPDEYTYSTVIDGYVKQHDMSSALKMFGQMMKHKFKPNVITYTSLINGFCKKADMIRAEKVFSGMKSFDLVPNVVTYTTLVGGFFKAGKPERATSIFELMLMNGCLPNDATFHYLINGLTNTATSPVLIEEKDSKENERSLILDFFTMMLLDGWDQVIAAYNSVIVCLCKHGTVDTAQLLLTKMLTKGFLIDSVCFTALLHGLCHKGKSKEWRNIISCDLNKIELQTAVKYSLTLDKYLYQGRLSEASVILQTLVEDSKFSDQVEKDLKVIARQ

SEQ ID NO: 159606 - protein, 159 aa, Glycine max
  Coding DNA Sequence Number=SeqID_42828
  Gene Ontology: Mol. function=ATP-dependent helicase activity
  Homolog annotation: Hit_ID=Q9C813; Match level="QueryCoverage=74%, HitCoverage=10%, E-value=1e-17, Identity=50%"; Hit description=RNA helicase, putative; 27866-23496
ALSEGSRSTERKGKVDPSREGHGSLSNEPSSFQNTSNRYSDHAKGETLLECKSSLAHAVAAAAALSLSNPFQMRIEDGTREDSNEKVVDIEEKPRKMNFSNSTSDALTIASALQCFELNEEEKVKIKEILRKAIFAGWADRVAKRMKGASILSQGGGIL

SEQ ID NO: 159607 - protein, 92 aa, Glycine max
  Coding DNA Sequence Number=SeqID_42829
  Homolog annotation: Hit_ID=P04671; Match level="QueryCoverage=46%, HitCoverage=20%, E-value=1e-09, Identity=65%"; Hit description =Nodulin C51 precursor
  Pfam annotation: Domain name=Nodulin; Domain location=3-77; Score= -102.3; E_value=0.073; Accession=PF02451.6; Description=Nodulin
MKGVGIDDKSINPAEDVDIGLFSEAEAYENPKFQRTCAHVTAHTCLTAPNLAASLLAACLIPSLNQCVNPTAGTPPIIGPSIVPLNDLRHKG

SEQ ID NO: 159608 - protein, 112 aa, Glycine max
  Coding DNA Sequence Number=SeqID_42830
  Gene Ontology: Mol. function=nucleic acid binding
  Homolog annotation: Hit_ID=Q2QQM2; Match level="QueryCoverage=80%, HitCoverage=66%, E-value=3e-21, Identity=50%"; Hit description =Expressed protein
  Pfam annotation: Domain name=Alba; Domain location=20-92; Score=24.3; E_value=6.5e-05; Accession=PF01918.11; Description=Alba
MEGITEGVNNININISDSYKKNRIQVSNTKKPLFFYVNLAKRYMQQHDEVELSALGMEITTSTVDIKDDSRGRPVQKAKIEIVLGKTENFDELMAAAAAEDGENRDVEEQSA

SEQ ID NO: 159609 - protein, 70 aa, Glycine max
  Coding DNA Sequence Number=SeqID_42831
MGVVQRVALRQVVVPMVLRNGVVMSSSSSNSESRREAESIDMKSEKVQKIIVLLIFHPLSRFCTACDCDT

SEQ ID NO: 159610 - protein, 326 aa, Glycine max
  Coding DNA Sequence Number=SeqID_42832
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-31, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=17; ConfidenceScore=5.05e-01
MLVSRVPKGANKVQGPTASTLGRNLGMTHALAFRGLHVLTFRGLHVLALKDYTSSPSKGYMPSPSEGYTPSPELHALPFRRLHTLTFRGLHALTIRGLHVLAFRGLHALAFRGLHAFAFRGLHVLAFRGLHALTFRGLHALALRTTCPPLERATRPRLQRTTRAPLQRTTCAPLQRTTRPHLQRTACPRLQRTTRSGLLGTSTLTFRGPHVFTLEGYTPSPSGGCMPSPSEDYTSSPSEGCTPSPSESYTPSPLEDSTSSPSEYCMFSPSEGYTSSPSEGCTPSPSERYTPSPSEDSTSSPSKDCMSSPLRGYTSSPSEDYTSSPS

SEQ ID NO: 159611 - protein, 67 aa, Glycine max
  Coding DNA Sequence Number=SeqID_42833
MIPLRLNLAILDPALIVVSKSALVLIVGDSFVLKPPTQIHIFCHFTMPPTSIRTVATRMLMPNNMLC

SEQ ID NO: 159612 - protein, 192 aa, Glycine max
  Coding DNA Sequence Number=SeqID_42834
  Pfam annotation: Domain name=Transposase_23; Domain location=19-80; Score=-7.1; E_value=0.0068; Accession=PF03017.5; Description =TNP1ENSPM transposase
MQSQGLAVPPEPLVGPGPSGPRILPVWLPWGRVYEGSTLVHNTPLLPGQVKVSVEEVIDADAPVPVPTDEVSLVGQALHTIFAWSTHLVAVSPPKPPPKPHPEVDDPLYLMTLTIQELFLRPYQVRWDATVFGVVNPDFPLYIKHEDLFEIAHGGQCLSISVLQLWIQHLTETCMRAGNSDIYEFLEQQSIQ

SEQ ID NO: 159613 - protein, 262 aa, Glycine max
  Coding DNA Sequence Number=SeqID_42835
  Homolog annotation: Hit_ID=O04892; Match level="QueryCoverage=48%, HitCoverage=33%, E-value=3e-25, Identity=44%"; Hit description =Cytochrome P450 like_TBP
  Subcellular localization annotation: CTP_CleavageSite=74; ConfidenceScore=5.12e-01
NWRCGMNRKLGYGAQLRANLDPTKGVGRLRQQDGGHGSRNPLRTPMSRRARRSLQNPGREPGRSGSSVQILVVVANIQMRTLKAEEGKGTGEARLIALCARTPKGNRPAHPGNGSAGGRVQRAGRAPHVAWCPVRPPAALENPEDRAREVGKMDPVTSGKGLALRAGHGGPSPEPVGCRWTARAASAARAGRRVPVGGRIGNGPFGASSLGVEQSTQNCALNVKVKKFNQARVNGGSNYDSLKRNHSQGNGLGGISGERRPC

SEQ ID NO: 159614 - protein, 45 aa, Glycine max
  Coding DNA Sequence Number=SeqID_42836
MWMDRFALTLNGSQELPRLLAKAKAMADTYSAPEEIHGLLSYYLA

SEQ ID NO: 159615 - protein, 105 aa, Glycine max
  Coding DNA Sequence Number=SeqID_42837
MTKLGLCVPSDTTVSEWQRGADNRKVSPRIMGISAYHGCRMTKLGLCVPSDTTVSEWQRGADNRKVSPRIMGISAYHGCRMTKLGLCVPSDTTVSEWQRGADNRK

SEQ ID NO: 159616 - protein, 236 aa, Glycine max
  Coding DNA Sequence Number=SeqID_42838
  Gene Ontology: Mol. function=oxygen transporter activity; Biological process=oxygen transport
  Homolog annotation: Hit_ID=UPI00006728AF; Match level="QueryCoverage =75%, HitCoverage=68%, E-value=4e-13, Identity=31%"; Hit description =Uncharacterized YfiH family protein conserved protein
  Pfam annotation: Domain name=DUF152; Domain location=3-235; Score =72.5; E_value=1.3e-18; Accession=PF02578.6; Description =Uncharacterised ACR, YfiH family COG1496
MDNRGPRSALLESQRWLEYAFQPAGQPAPAAAAYGQQRHSAKVVLAGQNRPPKSCESDGVISDDHQPVAVYTADCLPVLFADVKTHQVAAVHAGLQGTLGGVLSSALDQLLAGGATPASLLVAIGPAIGPCCYELGVDRIAQMQQRPDLPALSWSQQQPHNPQAIRPQAQAHHQGVWFDLPQLAQSLLLQRGIPAAQIDRVAVCTYCMAEAGSSYRYNTHFDSGYQSRFSWIRRRA

SEQ ID NO: 159617 - protein, 270 aa, Glycine max
  Coding DNA Sequence Number=SeqID_42839
  Gene Ontology: Mol. function=acid phosphatase activity; Cellular component=outer membrane
  Homolog annotation: Hit_ID=O66049; Match level="QueryCoverage=86%, HitCoverage=86%, E-value=1e-118, Identity=86%"; Hit description =Phytase
  Pfam annotation: Domain name=Acid_phosphat_B; Domain location=1-240; Score=322.2; E_value=8.9e-94; Accession=PF03767.5; Description=HAD superfamily, subfamily IIIB (Acid
  Subcellular localization annotation: CTP_CleavageSite=60; ConfidenceScore=5.00e-01
MMKNTSWLAAAGLIALTLTGCAQPQKQQAQQQLGQQSVLAVNWFQQSGEYQALSWQAFNTARMAFDNAPSLTGKPKAVIVDLDETMIDNSAYSAWQAKNGQPFSGKTWSAWTQARQATAVPGAVEFANYVNSHGGTMFYVSNRDQKDYAATVDNLNKLGFSGVSDKTVRLSTGNSNKQARFDAIKNAGYNVVLYIGDNLNDFGGATWHQGNAQRQQFVTLNHQRFGTQFIVLPNPLYGDWESGMAENYNKLTPEQQLQVRESRMKAWNGK

SEQ ID NO: 159618 - protein, 198 aa, Glycine max
  Coding DNA Sequence Number=SeqID_42840
  Gene Ontology: Mol. function=two-component response regulator activity; Cellular component=nucleus; Biological process=two -component signal transduction system (phosphorelay)
  Homolog annotation: Hit_ID=Q9AXD7; Match level="QueryCoverage=68%, HitCoverage=50%, E-value=7e-53, Identity=77%"; Hit description =Response regulator protein
  Pfam annotation: Domain name=Response_reg; Domain location=20-148; Score=82.7; E_value=1.1e-21; Accession=PF00072.14; Description =Response regulator receiver domain
MDTDGVVSFNHVSPEDSHEVHVLAVDDSLVDRKVIERLLKISACKVTAVDSGIRALQFLGLDEQRRTSESDGFVPDLKVDLIITDYCMPEMTGYELLKKIKESTMFREIPVVIMSSENILPRIDRCLEEGAEDFIVKPVKLSDVKRLKGYLTPKEVIKVDRRSDGYVNGGCQGGDGGGGGGVEINNNQRKLEEQDTSD

SEQ ID NO: 159619 - protein, 54 aa, Glycine max
  Coding DNA Sequence Number=SeqID_42841
  Subcellular localization annotation: CTP_CleavageSite=35; ConfidenceScore=5.40e-01
MLNQTAPSNFGTGDTKSQRTKTAFTTSFFTVPCLVAVYNVVEDMLMLEISPLRK

SEQ ID NO: 159620 - protein, 88 aa, Glycine max
  Coding DNA Sequence Number=SeqID_42842
MGVKYLEVVKRGSHPNKQMAQRTTGAKPESTYPSKGIDFKQMIDTDSRAHHSAYFRKRALEAARGEAFAEIPRFCKLIIVRVSSVMAG

SEQ ID NO: 159621 - protein, 167 aa, Glycine max
  Coding DNA Sequence Number=SeqID_42843
MTTLTWMTLLFSNILPSDHNANLPLQMDRAHKTPSGPGEVQQGPGEWHPQDTQWTRRSPIEPWGFQLWLRASVRCLFPPARSCHRDIGSHPQRHQVDPEKSNRALGFPVLGSRLQDTQWTRRSPTGSWSCQALITGLCQFYGVPVTSIKGIRPPTNRAFIKKYCVPR

SEQ ID NO: 159622 - protein, 295 aa, Glycine max
  Coding DNA Sequence Number=SeqID_42844
  Gene Ontology: Mol. function=zinc ion binding; Cellular component =intracellular; Biological process=anti-apoptosis
  Homolog annotation: Hit_ID=Q10CF1; Match level="QueryCoverage=90%, HitCoverage=28%, E-value=1e-59, Identity=49%"; Hit description =Expressed protein
MGLEAYITGNRVSSYRQGSDLPMGIQSARDSTRASSVIAMDTICHSVNGDSMESVENYPGDLDDVHFPSSSMYGNVDMNETSELNNSNQAQQSTCLQTATEVARGDVGVSSTNYGEELFNAETVTAQARDGISLGISGGSVGMCASHEAEIHGADIYVHRADSVVGEMEQRVEDAENQGQTGESVPDPGLMDEIIPDMNREDPIGDSQEMMSHSAGRTDSGSKIGCSTESVESGEKISQNCNLLPANSSHPSRSCNANIYSGCENTKEEIMKRDKSSFANNSALPESDFAIANGI

SEQ ID NO: 159623 - protein, 116 aa, Glycine max
  Coding DNA Sequence Number=SeqID_42845
  Gene Ontology: Mol. function=serine carboxypeptidase activity; Biological process=proteolysis
  Homolog annotation: Hit_ID=Q1EP77; Match level="QueryCoverage=54%, HitCoverage=13%, E-value=2e-16, Identity=70%"; Hit description =Serine carboxypeptidase (Carboxypeptidase D), putative
MALCSVFLNLHLLLFVCLTIEALGVAKPSVASYLSQEILAEQEADRVHGLPAQPPVKFNNMVVISLSMKLEEEHCSIGFSRPLTIQNKNPFSYGSMENHKHEGQEVSAAGVNIDNP

SEQ ID NO: 159624 - protein, 80 aa, Glycine max
  Coding DNA Sequence Number=SeqID_42846
MASDRMQLQNMCKKEHESFKEYAQRWMDLATQVAPIMMEREMITMIVDTLPVFYYGKMVGYMPSSFSDLVFTGKRIKVSL

SEQ ID NO: 159625 - protein, 123 aa, Glycine max
  Coding DNA Sequence Number=SeqID_42847
MKTTIKSFQEWTREGSRLVYQVTAAPKVVFPPQNVRVVVVGDTEGPPKCLAGVCHQTPAPQWHIRGKAWSRLEYGLGYFMCLPHGLKDLYLTRLGLLALNEYGSGVIDILIRSMCNIGWCIVG

SEQ ID NO: 159626 - protein, 117 aa, Glycine max
  Coding DNA Sequence Number=SeqID_42848
MSTVSTLGNQKISNSSNWGSRGSDVSATDESGGAATSFDDASEITIRGGDGGTASSSGEEGGFTTGDCGSVGSGLTCTGKKVSELWTSYPTVTDEGAGVDDDGMSSVLALFLDAICN

SEQ ID NO: 159627 - protein, 277 aa, Glycine max
  Coding DNA Sequence Number=SeqID_42849
GYTPSPWVLVTLTVRGLHVLALRGLLVLTIRGLHALTSRGLHVLALRGLHALTLGTSYPHRQRTTRPRLERTTRPHHQRAARPHLQRTIRPRLERATRPHLGGLHVLAVKGSCAFTFVRLHALTFRGLHVLTFRGLHVLAIRGLHGCTPSPLEDYASFLLSVPGPPPDIGGRPTVRAQPKRKAILQLLCIPGKNFARAAAKKQVRIVHTNMTNLTQIWMTLLLSNILPSDHNVDLPLRKGRTHKTPSGPEEVQQGPGVSNFGYGPLSFLQGARPPSK

SEQ ID NO: 159628 - protein, 145 aa, Glycine max
  Coding DNA Sequence Number=SeqID_42850
  Gene Ontology: Mol. function=methylmalonate-semialdehyde dehydrogenase (acylating) activity; Cellular component =mitochondrion; Biological process=valine metabolic process
  Homolog annotation: Hit_ID=Q1SFW2; Match level="QueryCoverage=76%, HitCoverage=59%, E-value=6e-29, Identity=40%"; Hit description =Aldehyde dehydrogenase
STPDVDEFERWQKEIEEVDIQVEGSEFGSLSGNVGRTGDKLALNVTTKQGKTLKDVQGDVFHGLDWCFYGIDTYNIREPLGVCAGASVMLAELAMEAGLPNGVLNIVHGTHANMGAKNHVVVMPNASGNATVNALVAASFGAAGQ

SEQ ID NO: 159629 - protein, 71 aa, Glycine max
  Coding DNA Sequence Number=SeqID_42851
  Gene Ontology: Cellular component=membrane; Biological process=proton transport
  Homolog annotation: Hit_ID=Q1SRL3; Match level="QueryCoverage=94%, HitCoverage=9%, E-value=4e-18, Identity=69%"; Hit description=V-type ATPase, 116 kDa subunit
MRPQSSNSSGLRFISGIICKSKVLRFERMLFCAMRGNMLFIQAPTDEQIMDLVSAEMVLFLLITSKQEPRF

SEQ ID NO: 159630 - protein, 142 aa, Glycine max
  Coding DNA Sequence Number=SeqID_42852
MRWRQFKSSLTTKYVHVDKDSEDNHDPSAKYGFDPKTWEQFAKSRQIPNWQGKRKNLKRFKNSMIAPTYCLVGGMIVDPPSPIARHVKWKMARTKRYGQMISTAAQEISDKIDILNTALGRAEHLGRVCVAGHGVTIGHYFE

SEQ ID NO: 159631 - protein, 516 aa, Glycine max
  Coding DNA Sequence Number=SeqID_42853
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=83%, HitCoverage=43%, E-value=1e-78, Identity=50%"; Hit description =Kinesin, putative; 56847-62063
  Pfam annotation: Domain name=Kinesin; Domain location=3-181; Score =80.4; E_value=5.5e-21; Accession=PF00225.13; Description=Kinesin motor domain
MALDFESAKDGDLTVMSNGSPKRTFKFDVVFGPRQAKQGDIFEDAAPFATSVLDGFNVCIFAYGQTRTGGQLVEWGMHENQVMVEDLAGSERVAKTEVHGNRLKETQNINRSLSALGDVISALATKSSHIPFRNSNLTHLLQHSLGAHSNALMFVQINSNENYLSETIFSLNFASRVRGIELGSTRKQLDTIELLRHKQMLEKVKQEVKLKDLQMKKLEETIHGLESKMKERDNKNKNLQEKSSFPEVDGFSWTSLANVSSLSIFTFKVKEPESQLLVERKLARQHVDSKIVEQHQMKHQEKQNNTLLRLALASRPLGSLKNFNDPVNGGWFKDQQINSAKPLTKKIILKPCIPISTMETSIKCIDHAEKENNGDMADKALLPKRLGRPSICMMTPHVPSAVASRRNSLIRLPSIPSLTQFQSPLLPKLTNQFDQKDANGESETNCVLAQTHFLCPKEVRSGAKRIGSILRRSLHKKIQEWRKLEFPLEVGEIGSRGGAKDIQQKNSQKEKERGWI

SEQ ID NO: 159632 - protein, 561 aa, Glycine max
  Coding DNA Sequence Number=SeqID_42854
  Gene Ontology: Mol. function=oxidoreductase activity; Cellular component=integral to membrane; Biological process=electron transport
  Homolog annotation: Hit_ID=O04163; Match level="QueryCoverage=87%, HitCoverage=96%, E-value=1e-137, Identity=51%"; Hit description =Cytochrome P450
  Pfam annotation: Domain name=p450; Domain location=33-497; Score =413.6; E_value=2.7e-121; Accession=PF00067.12; Description =Cytochrome P450
  Subcellular localization annotation: CTP_CleavageSite=79; ConfidenceScore=5.22e-01
MVAFTLFVLCSVHNLLSKWNNSSNTAIPKKTTPPSPPKLPIIGNLHQLGTLTHRTLQSLAQTYGPLMLLHFGKMPVLVVSTAEAAREVMKTHDLVFSNRPHRKMFDILLYGSKDVASSPYGNYWRQIRSICVLHLLSAKKVQSFGAVREEEISIMMEKIRQCCSSLMPVNLSDLFSTLSNDIVCRVALGRRYSGEGGSNLREPMNEMMELLGSSVIGDFIPWLEWLGRVNGICGRAERVFKQLDEFFDEVVDEHVNKRDHDDDVDGEAQNDFVDILLSIQRTNAVGFEIDRTTIKALILDMFVAGTETTTSILGWVVTELLRHPIVMQKLQAEVRNVVGDRTPITEEDLSSMHYLKAVIKETFRLHPPVPLLLPRESMQDTKVMGYDIGTGTQIIVNAWAIARDPSYWDQPEDFQPERFLNSSIDVKGHDFQLIPFGAGRRSCPGLIFSMAMIEKLLANLVHKFNWKIPSGVVGEQTMDMTEATGITSQRKFPLVAVSSIPSYIHMNDDRHFVTGTFVDGVALNALGLEDLLIVLRVFGSSFIEQQKLEAIDGSSVMVGQE

SEQ ID NO: 159633 - protein, 147 aa, Glycine max
  Coding DNA Sequence Number=SeqID_42855
  Gene Ontology: Mol. function=protein phosphatase inhibitor activity; Biological process=regulation of signal transduction
  Homolog annotation: Hit_ID=Q9LTK0; Match level="QueryCoverage=77%, HitCoverage=55%, E-value=1e-20, Identity=45%"; Hit description =Arabidopsis thaliana genomic DNA, chromosome 5, BAC clone:F17P19
MKMFNGILVLPISLMVQYISEKGRVRWDEANIGEIEANKPVRQKITEPKTPYHPMIDDDSINLLKISMYYLIFLGSLSPVRGSFDACIDNENRAEAIWSALNDVASSSRRGTGQSGGWTSSEDEPEAMEQDDDGTVLLFDIHLLFFT

SEQ ID NO: 159634 - protein, 113 aa, Glycine max
  Coding DNA Sequence Number=SeqID_42856
MKFFNLLESTTTLLEVSWLHYPRQISSSNTKSMQGNPEVARSTGKTLEVYARFSDRRILHNSDTWHDVTSGGIGLDALLTRALQDWMRRRCWSFSWRSACWRLRTRSACKRVR

SEQ ID NO: 159635 - protein, 139 aa, Glycine max
  Coding DNA Sequence Number=SeqID_42857
MIERFEQQQERGGSGGEGGTKKAIRSGWLVGDKAGGKVGNKKHWLWLGGGGEEWLGGGARAVFLKKLDPPGNLTRTVAPGKGTLTKAPGRQTQTKAPTPPKHPILKRPRQQRIQTCPTASHVMPRVTITGNVPIGKNAL

SEQ ID NO: 159636 - protein, 661 aa, Glycine max
  Coding DNA Sequence Number=SeqID_42858
  Gene Ontology: Mol. function=protein-methionine-S-oxide reductase activity; Cellular component=nucleus; Biological process=regulation of transcription
  Homolog annotation: Hit_ID=Q1PCS0; Match level="QueryCoverage=98%, HitCoverage=93%, E-value=1e-136, Identity=45%"; Hit description=GRAS1
  Pfam annotation: Domain name=GRAS; Domain location=291-594; Score =447.7; E_value=1.5e-131; Accession=PF03514.5; Description=GRAS family transcription factor
  Subcellular localization annotation: CTP_CleavageSite=55; ConfidenceScore=5.06e-01
MLSTDSLLENFPGSVNGFIFENGPVSVFSNQNPASGFEVDDSVSPSESATDSGPSSGASSNREHVESTKHSNPILRYISDILMDEEDDLERKPCMLQDCLRLQAAEKSFYDALVRSYPSSPRQFDDNPDQDDNFGGTTSSESFSSYTTDNSCESDWFNGASDFDSSFIQRSLIYSPEHAYVAPDPFRETQAGVHFSNGAWNLIHPQNKPRVIEDGVMQGSVTATGLREKRSYLMNDMSHEEERSNKLSSVYSDDSEPSSMFDEVLLCKDGKSPSIFYAGREPSPSQIADSGGSNGKKTRSKRGSNKGTRASVTTVDLWTLLIQCAQAVASFDQRTANETLKQIRQHSSPFGDGLQRLAHYFADGLEKRLAAGTPKFISFQSASAADMLKAYRVYISASPFLRMSNFLANRTILKLAQNESSLHIIDFGISYGFQWPCLIQRLSERPGGPPKLLMTGIDLPQPGFRPAERVEETGRWLEKYCKRFGVPFEYNCLAQKWETIRLEDLKIDRSEVTVVNCLYRLKNLSDETVTANCPRDALLRLIRRINPNIFMHGVVNGTYNAPFFVTRFREALFHFSSLFDMFEVNVPREDPSRLMIEKGVFGRDAINVIACEGAERVERPETYKQWQVRNQRAGFKQLPLAPEHVNRVKEMVKKGHHKDFV

SEQ ID NO: 159637 - protein, 132 aa, Glycine max
  Coding DNA Sequence Number=SeqID_42859
MEQRGHGMYYTLPTFSQYPSQMYQYPFEGYDTDMSASEHSYGGVAETHPHFSWLTMTPSQQHDAPMATSNAPLAPQWNVLICVTSFLSRLSNKDGDSAQEEILIVKPEGGIDHVAHPHAITDTIMTDFDVSI

SEQ ID NO: 159638 - protein, 57 aa, Glycine max
  Coding DNA Sequence Number=SeqID_42860
MASSLCNIHVAGGAGRRHVFSVIGLLFQRKRSCNYHWRVKGKLQLPLICLHKVSYLL

SEQ ID NO: 159639 - protein, 141 aa, Glycine max
  Coding DNA Sequence Number=SeqID_42861
MREAHEIPHHNLADFEPCLGYAIEGQVVGGVPLPNTLEGPQFFPQPQPLNFAVGRVPPAMAEKGKLDQIEERLRVVEGCGDYAFADMEDLCLVPNMVIPPKFKVPDFDKYKGTTCPKNHLKVYYRKMGAYAKDEKLLMHFF

SEQ ID NO: 159640 - protein, 105 aa, Glycine max
  Coding DNA Sequence Number=SeqID_42862
MIVRGQDIYSSQEETTSSPPSSGSEDEVRGEESSEEVYPHEEGDLLMANDKLSYLTLVVAQFERFFDVSEKDTENTQKGGQKGHLEAFSDPWLAQASLWLTWAPK

SEQ ID NO: 159641 - protein, 150 aa, Glycine max
  Coding DNA Sequence Number=SeqID_42863
MDLRNGSWWPSQILGLDHLSTSNLTSPRSGTPVKLLRKEDPNMAESTQGECAYCNFLADEESEYAFMDVVEYDSLEIGSTNVDSDSSEMELDMGDEMTTLSRRPVRVTLFCENVPTIWDQHRLKGALKPGVFTPKAYTPKSPSGPLPPDS

SEQ ID NO: 159642 - protein, 156 aa, Glycine max
  Coding DNA Sequence Number=SeqID_42864
MKTTDFHREDDHSEEEENALNEGEKLSLIHILEFRSRRRKMNHICCNAWKGTLIYSFALVQNQISEVWKCLPINERRSCFDTLVNNENYDNEQIVENDHIKAVSDHNQSLGLTTVKVRDPKVGKKFTNKYNAGGYSFNHGKRSSAVFFRIASNISP

SEQ ID NO: 159643 - protein, 173 aa, Glycine max
  Coding DNA Sequence Number=SeqID_42865
  Homolog annotation: Hit_ID=Q1RT00; Match level="QueryCoverage=43%, HitCoverage=14%, E-value=7e-15, Identity=51%"; Hit description =Cyclin-like F-box
  Pfam annotation: Domain name=F-box; Domain location=85-132; Score =36.9; E_value=6.8e-08; Accession=PF00646.23; Description=F-box domain
MTRQVRAAMVKQALWVTFGYYSWILNFFHLRGKLPCGRDKHLTRRFLKYKCEVSMEGKETEGMLKMTTDKRQQKRSRSDREEERDRLSELPDCVVLHIMEFMDTKYAVQTCVLSKRWKDLWKRLTYLGFNTTLFNNVVKFNKLVSRVLSGRDGSVSLLNLEFTRRGMGAQALQ

SEQ ID NO: 159644 - protein, 680 aa, Glycine max
  Coding DNA Sequence Number=SeqID_42866
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=96%, HitCoverage=96%, E-value=1e-146, Identity=44%"; Hit description =Putative SCARECROW gene regulator
  Pfam annotation: Domain name=GRAS; Domain location=283-587; Score =419.7; E_value=3.9e-123; Accession=PF03514.5; Description=GRAS family transcription factor
MEANFPRRAHQFGEEEESILYVSDSLGFAATDPSLRDPSLEDNDFSETAKFINQILMEDNVEQMPFYDSLNLQVTEKSFYNALTGNIPLSPNQHPLVLSPQAETTPTTSNSSNNSNHNFLDENSRELNPSPDSVSVLAFQFNPNSLSQPPSVTVNHGLSNLDSSTAKLLAHNIFNDADSLSQFRRGLEEATRFLPPGPKLVAGLDSKGEEPINTLGENSYGSKGRKNHEREDIDTREEEERRSNKQSALSLVDESDLSDAFDRVVLLSVENVCNEHCSLQSETVKAVEPGGVKGRPKNQATNKETVDLRNLLMMCSQSVYANDKRAANELLEQIRQHSSPSGDALQRLAHYFANGLEARLVGEGMFSFLKSKRSTAAEFLKAHQDFLSVSPFKKFTYFFANKMIMKAAVKAETVHIIDFGIQYGFQWPMLIKFLSNREGGPPKLRITGIDFPQPGFRPTEKIEETGCRLANYSKRYSIPFEYNAIASRNWETIQVEALNIETNELVAVNSLMKFENLMDETIEVDSPRNAVLHLIRKINPHIFTQCIVNGTYNAPFFTTRFREALFHFSTIYDLCDTVIPRENEWRMLIEREVLGREAMNVIACEGSERVERPETYKQWQARNMKAGFKQLPLNEELLAKFRNELRKSYHRDFVLDEDKNWMLQGWKGRILYASTCWVPA

SEQ ID NO: 159645 - protein, 856 aa, Glycine max
  Coding DNA Sequence Number=SeqID_42867
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=87%, HitCoverage=94%, E-value=1e-179, Identity=51%"; Hit description =Putative SCARECROW gene regulator
  Pfam annotation: Domain name=GRAS; Domain location=279-585; Score =466.1; E_value=4.3e-137; Accession=PF03514.5; Description=GRAS family transcription factor
SPVDEIDFSATVLRYINQMLMEEDLEAKPCMFHDSLALQAAEKSFYEVIGETYPSSSSSSSIQNYHNVDSPDESSFSGTTTSTGNSFGSQWNNVDLADYKPSILQTTFPTDFVFQASSIQSSMNTTSKFAVTNSEFLASSAAGFLGPGSTNLFSKSESVLQFERGVEEANKFLPKGNPLVIDLENPSFRMVPLQQEEIKAERDIDEISAESRGRKNHEREDEETDLQDGRSNKQSAVYIDDSEISELLDKVLLGTWCRNEPAPSCIGYTDLPSGPSLGKLEETNKSGGGKSRVKKQGNKKGVVDLRTLLILCAQAVSSDDHVSANELLKQIKQHASPLGDGTQRLAHCFANALEARLAGTGTQIYTALSHKRTSAADMVKAYQMYISACPFKKLSMIFANHTILQLAKEVETLHIIDFGIRYGFQWPAFIYRLSKQPGGPPKLRITGIELPQPGFRPAERVQETGLRLARYCDRFNVPFEFNAIAQKWETIKIEDLKIKENELLVANAMFRFQNLLDETVVVNSPRDAVLKLIRKANPAIFLHATVNGSYNAPFFVTRFREALFHYSTLFDVLDTNVAREDPMRLMFEREFFGRQVMNIVACEGSERVERPETYKQWQVRNMRAGFKQLPLDKHLINKLRCKLKGVYHSDFMLLEDGNYMLQDSFGGFPIIDPSSLEDNNDFSETAKFIMIMKAAAKAETVHVIDFGILYGFQWPNLVKFLSDREGGPPKLRITGIEFPNMAFAPQKELRKRVATWLTIITTGCFKVGSAAFCLLPLVGCQHNEKLLDSLRGIVPLALADHLSLEIFQHVAMVKLVLLVILFDVLVPTCLTFSCCGEDCTKLYIKLLRKIMARLFG

SEQ ID NO: 159646 - protein, 676 aa, Glycine max
  Coding DNA Sequence Number=SeqID_42868
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=99%, HitCoverage=97%, E-value=1e-143, Identity=44%"; Hit description =Putative SCARECROW gene regulator
  Pfam annotation: Domain name=GRAS; Domain location=275-584; Score =418.3; E_value=1.1e-122; Accession=PF03514.5; Description=GRAS family transcription factor
MESNFPGAYHLFGEDQGIPYLSDSLGFPTMDPSSPEDNDFSETVKFISQILMEENVDQRPFYDSLTLRVTEKSFYDALTGNQPPFVLCSEAETNTITSNNSGSNFLNENSRELNIPSPLSVSVSAIHFNPNPLSQPLPSVTVSDRVSVLDSSIAKLLAQNISIEVDSVSKFRRGLEEATKFLPPEPKLVTGLDLYREQAINSSGDTSYRLNSRKNHGCEVRDTREEEEEEGGRSNKQSALSLVDETDLSDAFDQVLLHEENLWNEHTCLQSEAEKVEGPNGGKGGSDKKVRKKKKTVDLRNLLLMCSQAVYASDIRAANELLKQIRQHSSPIGDASQRLAHYFANGLEARLVGDGTSTQGMYTFLSSKNNTFSELLKAYQVFSSSSPFKKFAYLFENTMIMKAAASAETVHIIDFGILHGFQWPMLIRLLSNREGGPPKLRITGIEFPQPGFRPTEKIEETGRHLANYCKRYNVPFEYNAISSRNWETIQLEALKIASNELVAVYCHQRFENLLDECTIEVNSPRNAVLHLIRKINPDIFTHSITNGSYNAPFFTTRFREALFHYSAISDKNDTVISRENERRLMVERELYGREIMNVIACEGSDRIERPETYKRWQVRNMKAGFKQLPLNEELMAKFRSKLKEYHRDFVLDENNNWMLQGWKGRILFASSCWVPA

SEQ ID NO: 159647 - protein, 184 aa, Glycine max
  Coding DNA Sequence Number=SeqID_42869
  Homolog annotation: Hit_ID=Q1SKA8; Match level="QueryCoverage=75%, HitCoverage=53%, E-value=8e-08, Identity=27%"; Hit description=Zinc finger, CCHC-type
  Pfam annotation: Domain name=zf-CCHC; Domain location=97-114; Score =26.0; E_value=5e-05; Accession=PF00098.13; Description=Zinc knuckle
MSLATLFGKLQEHEMEVTRLNQHEENDKKKKGVALKASSSIHEESDKKDMNEQNNLEEDDDFSLFVKKFNKFFRNKGNRRRSKFNPRKKGEDSSSVPKCYECDQPGHLRFDCPIFKRRMETSNKKTLKDKKGKKAYITWEDNDMDSSSDSKNEIVNLSLMAKNYESEEEMHSMICIKNLSNLPN

SEQ ID NO: 159648 - protein, 67 aa, Glycine max
  Coding DNA Sequence Number=SeqID_42870
MKVGYVLRNAIAHTFTVGMYEIIFVEGETESHEDSTSGGFNPFSVSLTFGNSIGAVRGKIGGISGNR

SEQ ID NO: 159649 - protein, 95 aa, Glycine max
  Coding DNA Sequence Number=SeqID_42871
  Homolog annotation: Hit_ID=Q9FRL4; Match level="QueryCoverage=54%, HitCoverage=12%, E-value=2e-07, Identity=61%"; Hit description=3 -methyladenine DNA glycosylase, putative; 31680-30045
MPNPAKFITETPISRLAGHIRHGKHGEEQLVIHVQNGRIEEYPILVHPGQIAKAIGLLPRNRNLLKMLGSYDDKDGTCGGDYEALGSTAGVSKGA

SEQ ID NO: 159650 - protein, 135 aa, Glycine max
  Coding DNA Sequence Number=SeqID_42872
  Gene Ontology: Mol. function=DNA binding; Cellular component=nucleus
  Homolog annotation: Hit_ID=Q8S8I2; Match level="QueryCoverage=42%, HitCoverage=25%, E-value=6e-14, Identity=55%"; Hit description =Protein ULTRAPETALA2
MTTGDPPQQKTSQGNEKKKEDENITQGDPPQRERSQKIGIKKKFKKMTQAFFLSLDVEVEYGDARQSSNRLARVLKVRITCDDDEERSSLKASRGYSRSSTCQVCSTCYCEGCIKCRFEDCNCQECRDFMLYAKP

SEQ ID NO: 159651 - protein, 49 aa, Glycine max
  Coding DNA Sequence Number=SeqID_42873
MEPALLLASRATQELIPVKVLFPHCRVFLRCLPKWNFVFIFAMNPYVSL

SEQ ID NO: 159652 - protein, 120 aa, Glycine max
  Coding DNA Sequence Number=SeqID_42874
GIFPVEFVVMDISEDIDIPVILGRPFMLTASCIVDMGKRKLELGFEDQQIDFDLFVEDKPALEHNVCLQVMGEGQEVLKEVDPTVEHEDMGGADGMDSLFSELAGAIPRIDEAMSFAEML

SEQ ID NO: 159653 - protein, 58 aa, Glycine max
  Coding DNA Sequence Number=SeqID_42875
MEEEARLHTHFGYICGITRSRSTFRQDAAIEVHEDVGDFSDDGDLMPFKITFYQDVIG

SEQ ID NO: 159654 - protein, 292 aa, Glycine max
  Coding DNA Sequence Number=SeqID_42876
MGLKLGPFSDSLCKNPSTTLGKLRARATNFIQREEMTTFRAQIHKEPSKKQVEREEKIKSGRSRGKSGANRLPQSKLGNYTPLIESHNNEGCTTLKDKIEKLRNFIDLLKTRNLLVMKIENEKRVEKVVELEKPLRHNNAMRIPNPKFGCEMTNSVEAKKKPTKSKPPITFPDEDLGNIEQCHNDHMVVKIEPRRGPSPTSKLASGGHPWCSDPKDAINVVLTSSNITIEGFYSSPSIVIFSHGFEAKDKGEEHGRCDSSTWEASLRSKKGSILGKRGRKLPLEATKKASAR

SEQ ID NO: 159655 - protein, 98 aa, Glycine max
  Coding DNA Sequence Number=SeqID_42877
MSLPSAVHVSSIIKRGASGDWEICSSVVFRIGSFAKHVKKEGVETRIVITERAGWTKSVSYLCFPLISDERYLAPFCCTICEVPRRAENQKEAGLRNP

SEQ ID NO: 159656 - protein, 50 aa, Glycine max
  Coding DNA Sequence Number=SeqID_42878
  Homolog annotation: Hit_ID=Q2HVI3; Match level="QueryCoverage=72%, HitCoverage=15%, E-value=2e-07, Identity=67%"; Hit description =Peptidase, cysteine peptidase active site; Ribosomal protein L30
KQFGDADPYSFVKQIFNGVFLKVKKATVNMLHKVEPYMTYEYVNFPAILI

SEQ ID NO: 159657 - protein, 153 aa, Glycine max
  Coding DNA Sequence Number=SeqID_42879
MARREKLWSFCTLLSSRGGNPDDMQRQIMVIPHTFSPFGDNCVRWHAKTNYGHYAPFCHPEAASPMTCGDKLWSFRTPFAIQIRSCPMACRYKLWSLCAFHHPKAASLLTCGNTLWSSAPFVNREERIRRYQDDVGSAGGKIDRLNDVPLERN

SEQ ID NO: 159658 - protein, 239 aa, Glycine max
  Coding DNA Sequence Number=SeqID_42880
  Gene Ontology: Mol. function=phosphopantetheine binding; Cellular component=nucleus; Biological process=metabolic process
  Homolog annotation: Hit_ID=Q1XME5; Match level="QueryCoverage=99%, HitCoverage=52%, E-value=9e-42, Identity=32%"; Hit description=Non -ribosomal peptide synthase:Amino acid adenylation
  Pfam annotation: Domain name=Condensation; Domain location=30-239; Score=27.0; E_value=8.4e-11; Accession=PF00668.10; Description =Condensation domain
MENPSIDLVAQKISGDVNVENFEPIPNVAEAKYYPITAAQYRFWVIQQNYEASATYNVSEAYKLKGDLEASKLEESFRLLVLPFDNIDFKIENIDLSSSQNKDQELAELLNTKKINFRLDEFPLFKVYLIKVDNDEYILWFNTHHIICDGWSSNLFASEIIKTYNSLVRNESPNLPDLKIQYKDYADWVNKKNVEESRDFWIKTLSDDIKRVELPFSGKRKKYQTFNGDKFAFVIDGEN

SEQ ID NO: 159659 - protein, 85 aa, Glycine max
  Coding DNA Sequence Number=SeqID_42881
FDEFKEELERCHWDKEWTDFGDGNIDVAIVKEFYVNLYDPEDKSPKLDPQELATKLCILGKGFELNVDGQPLKILGKNMTTLAQT

SEQ ID NO: 159660 - protein, 103 aa, Glycine max
  Coding DNA Sequence Number=SeqID_42882
  Gene Ontology: Mol. function=DNA binding; Biological process=DNA integration
  Homolog annotation: Hit_ID=Q1S9I4; Match level="QueryCoverage=78%, HitCoverage=8%, E-value=4e-17, Identity=46%"; Hit description =Integrase, catalytic region; Zinc finger, CCHC-type
MDDPQEELREPTRLNVRKNHPIAQIIGNPSESIQTRSSLKSQGHNALISEVEPKHIDKAMQDEKWVKTMQEELDQFQKNDIWKLVAQPKDKEVAGVKWVWTIR

SEQ ID NO: 159661 - protein, 74 aa, Glycine max
  Coding DNA Sequence Number=SeqID_42883
MNFLNCYIGSSWETPLKRKSPILSYPRSPPQMTPSEPSRELSSPIHLSDKFLIPIPYLLIYIGDNLVSNNLELE

SEQ ID NO: 159662 - protein, 62 aa, Glycine max
  Coding DNA Sequence Number=SeqID_42884
MEENIMFTSAQFIEVIEMLKQQKTMLEEHQKLIADLQTEKDDAQKEHSNAMEGEGDLLTRKK

SEQ ID NO: 159663 - protein, 252 aa, Glycine max
  Coding DNA Sequence Number=SeqID_42885
  Gene Ontology: Mol. function=nucleic acid binding
  Homolog annotation: Hit_ID=Q1RUD6; Match level="QueryCoverage=56%, HitCoverage=26%, E-value=9e-10, Identity=28%"; Hit description=Zinc finger, CCHC-type; Peptidase aspartic, catalytic
MDQYIRDIGNFLQKEKESLPKAWKRLQEMIKNCSYRGITQQRLVHILYGEVSSHNRTILDVVCGGNLMLKPHANAIKIIEGMCSNPYNNSGDIMNRGMHQVETYGSQTELGKQMQDLSMKIEILMRAQAHILITTPSFPTYDKCGIMHGPREGTIDDKLFAAMDEINFVGLKKEKTTPPPKVEVITEESQKENGEGEKKIQKQRQKEGQNGLFTKVSDPKFAQASIQQLAWAKDVTSTLSKQLAWANFPRPL

SEQ ID NO: 159664 - protein, 195 aa, Glycine max
  Coding DNA Sequence Number=SeqID_42886
  Homolog annotation: Hit_ID=UPI000044A741; Match level="QueryCoverage =23%, HitCoverage=11%, E-value=6e-09, Identity=69%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGDGVPRESSRHNIYIPLTLGNGYLGSCIDEERSEMRYLV

SEQ ID NO: 159665 - protein, 171 aa, Glycine max
  Coding DNA Sequence Number=SeqID_42887
  Homolog annotation: Hit_ID=Q6CQF2; Match level="QueryCoverage=23%, HitCoverage=50%, E-value=2e-10, Identity=73%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLR

SEQ ID NO: 159666 - protein, 178 aa, Glycine max
  Coding DNA Sequence Number=SeqID_42888
  Homolog annotation: Hit_ID=Q4UR32; Match level="QueryCoverage=75%, HitCoverage=43%, E-value=1e-37, Identity=60%"; Hit description =Glycine rich protein
  Pfam annotation: Domain name=DUF477; Domain location=43-166; Score =162.8; E_value=9e-46; Accession=PF04536.5; Description=Protein of unknown function (DUF477)
MQRAGQQTAAMTCLLLLLCLLPMAALAAIPVPALDDPVVDTANVLSAETRATLRRQALQLQVRKGAQLQVLVVPSVGNEGIEPYAQRVFDQWQLGRAGIDDGVLLLVAVQDRRVRIQTGYGLEGALPDAYAARIIDNAIVPRFREGDFDQGVLDGTTIMVALIEGEDLPAWEAPSASN

SEQ ID NO: 159667 - protein, 58 aa, Glycine max
  Coding DNA Sequence Number=SeqID_42889
MARSYGARNRINEDKKKYTRKRFEEMRRSRPTKFALLPRDIIKRKILLAIAAYYDYEI

SEQ ID NO: 159668 - protein, 119 aa, Glycine max
  Coding DNA Sequence Number=SeqID_42890
MRIKRSFKVVMGPRTRYGEIWNKWLNPKGIEEQRGITFEKQHFIQHACSELQNKERETRLKRAIKGINSRTHQQESSQGYCASNQWGKTHQMIIMMDGSNSHKGKIITFKLSFQNYHDM

SEQ ID NO: 159669 - protein, 111 aa, Glycine max
  Coding DNA Sequence Number=SeqID_42891
MKGQTRVSFSTETASQVENPLRYEGSSRCGSQRRTMAKCSRERKLRAHYRHLLKDPNGQIVDTCLVKLHTKFRDDPTVNKRWAAFLPRKLHVASSRSFIKRLPQEASPWLL

SEQ ID NO: 159670 - protein, 878 aa, Glycine max
  Coding DNA Sequence Number=SeqID_42892
  Gene Ontology: Mol. function=protein-tyrosine kinase activity; Cellular component=integral to membrane; Biological process=protein amino acid phosphorylation
  Homolog annotation: Hit_ID=Q1SX58; Match level="QueryCoverage=99%, HitCoverage=94%, E-value=0.0, Identity=43%"; Hit description =Tyrosine protein kinase, active site
  Pfam annotation: Domain name=LRR_1; Domain location=1-23; Score=9.3; E_value=5.3; Accession=PF00560.23; Description=Leucine Rich Repeat
  Pfam annotation: Domain name=LRR_1; Domain location=122-144; Score =18.5; E_value=0.024; Accession=PF00560.23; Description=Leucine Rich Repeat
  Pfam annotation: Domain name=LRR_1; Domain location=146-168; Score =14.7; E_value=0.33; Accession=PF00560.23; Description=Leucine Rich Repeat
  Pfam annotation: Domain name=LRR_1; Domain location=170-192; Score =10.8; E_value=2.7; Accession=PF00560.23; Description=Leucine Rich Repeat
  Pfam annotation: Domain name=LRR_1; Domain location=218-240; Score =9.1; E_value=5.6; Accession=PF00560.23; Description=Leucine Rich Repeat
  Pfam annotation: Domain name=LRR_1; Domain location=242-264; Score =10.9; E_value=2.6; Accession=PF00560.23; Description=Leucine Rich Repeat
  Pfam annotation: Domain name=LRR_1; Domain location=25-47; Score =12.0; E_value=1.6; Accession=PF00560.23; Description=Leucine Rich Repeat
  Pfam annotation: Domain name=LRR_1; Domain location=266-288; Score =11.2; E_value=2.3; Accession=PF00560.23; Description=Leucine Rich Repeat
  Pfam annotation: Domain name=LRR_1; Domain location=290-312; Score =14.9; E_value=0.29; Accession=PF00560.23; Description=Leucine Rich Repeat
  Pfam annotation: Domain name=LRR_1; Domain location=314-336; Score =12.3; E_value=1.4; Accession=PF00560.23; Description=Leucine Rich Repeat
  Pfam annotation: Domain name=LRR_1; Domain location=338-360; Score =16.0; E_value=0.14; Accession=PF00560.23; Description=Leucine Rich Repeat
  Pfam annotation: Domain name=LRR_1; Domain location=362-384; Score =14.6; E_value=0.36; Accession=PF00560.23; Description=Leucine Rich Repeat
  Pfam annotation: Domain name=LRR_1; Domain location=386-408; Score =17.0; E_value=0.068; Accession=PF00560.23; Description=Leucine Rich Repeat
  Pfam annotation: Domain name=LRR_1; Domain location=410-432; Score =13.5; E_value=0.78; Accession=PF00560.23; Description=Leucine Rich Repeat
  Pfam annotation: Domain name=LRR_1; Domain location=434-456; Score =18.7; E_value=0.021; Accession=PF00560.23; Description=Leucine Rich Repeat
  Pfam annotation: Domain name=LRR_1; Domain location=458-480; Score =9.0; E_value=5.9; Accession=PF00560.23; Description=Leucine Rich Repeat
  Pfam annotation: Domain name=LRR_1; Domain location=49-72; Score =11.9; E_value=1.7; Accession=PF00560.23; Description=Leucine Rich Repeat
  Pfam annotation: Domain name=LRR_1; Domain location=74-96; Score =19.3; E_value=0.014; Accession=PF00560.23; Description=Leucine Rich Repeat
  Pfam annotation: Domain name=LRR_1; Domain location=98-120; Score =14.1; E_value=0.5; Accession=PF00560.23; Description=Leucine Rich Repeat
  Pfam annotation: Domain name=NICE-3; Domain location=506-682; Score= -71.8; E_value=0.084; Accession=PF07406.2; Description=NICE-3 protein
  Pfam annotation: Domain name=Pkinase; Domain location=588-859; Score =139.9; E_value=7e-39; Accession=PF00069.15; Description=Protein kinase domain
  Pfam annotation: Domain name=Pkinase_Tyr; Domain location=588-859; Score=69.2; E_value=1.3e-17; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::NICE-3::Pkinase::Pkinase _Tyr; Domain ...
  Pfam module annotation: Pfam domain module=location=1-23::122 -144::146-168::170-192::218-240::242-264::25-47::266-288::290 -312::314-336::338-360::362-384::386-408::410-432::434-456::458 -480::49-72::74-96::98-120::506-682::588-859::588-859
MLEILRIAENNLFGSIPQEIGMLTNLKDIDLSLNLLSGTLPETIGNMSTLNLLRLSNNSFLSGPIPSSIWNMTNLTLLYLDNNNLSGSIPASIKKLANLQQLALDYNHLSGSIPSTIGNLTKLIELYLRFNNLSGSIPPSIGNLIHLDALSLQGNNLSGTIPATIGNLKRLTILELSTNKLNGSIPQVLNNIRNWSALLLAENDFTGHLPPRVCSAGTLVYFNAFGNRFTGSVPKSLKNCSSIERIRLEGNQLEGDIAQDFGVYPKLKYIDLSDNKFYGQISPNWGKCPNLQTLKISGNNISGGIPIELGEATNLGVLHLSSNHLNGKLPKQLGNMKSLIELQLSNNHLSGTIPTKIGSLQKLEDLDLGDNQLSGTIPIEVVELPKLRNLNLSNNKINGSVPFEFRQFQPLESLDLSGNLLSGTIPRQLGEVMRLELLNLSRNNLSGGIPSSFDGMSSLISVNISYNQLEGPLPNNEAFLKAPIESLKNNKGLCGNITGLMLCPTINSNKKRHKGILLALFIILGALVLVLCGVGVSMYILFWKASKKETHAKEKHQSEKALSEEVFSIWSHDGKIMFENIIEATDSFNDKYLIGVGGQGNVYKAELSSDQVYAVKKLHVETDGERHNFKAFENEIQALTEIRHRNIIKLYGFCSHSRFSFLVYKFLEGGSLDQVLSNDTKAVAFDWEKRVNTVKGVANALSYMHHDCSPPIIHRDISSKNVLLDSQYEAHVSDFGTAKILKPGSHNWTTFAGTFGYAAPELAQTMEVTEKCDVFSFGVLSLEIITGKHPGDLISSLFSSSSSATMTFNLLLIDVLDQRLPQPLKSVVGDVILVASLAFSCISENPSSRPTMDQVSKKLMGKSPLAEQFPTIRFGQLF

SEQ ID NO: 159671 - protein, 63 aa, Glycine max
  Coding DNA Sequence Number=SeqID_42893
MDGFIVNGLCIKKPFASLSAAAGCIRKTKRICQQARILMDTMIHVLQDFWASRIPSEAADSCK

SEQ ID NO: 159672 - protein, 129 aa, Glycine max
  Coding DNA Sequence Number=SeqID_42894
MHNLQELAHNRPIIPMEHFLEQVAWSEAQLPLVRPNEGSPPDPTPVQVDPEPAGPQSPVVNPPPSPELEVVPSSPPLIVISDASSDEVAALLDSLVGETADPPASPIEGIVDLSDSSSGEAVALTDSPV

SEQ ID NO: 159673 - protein, 142 aa, Glycine max
  Coding DNA Sequence Number=SeqID_42895
  Homolog annotation: Hit_ID=Q3SUA7; Match level="QueryCoverage=25%, HitCoverage=10%, E-value=4e-08, Identity=69%"; Hit description=Helix- turn-helix, Fis-type
MVKVGTSYVPINVSFSPKVGPGLPGINRDTRIYLFCEVIFRHSCPSCSATDGVGELELHRGGGRSRTSGSPGLQEFDVHPPPEHGIPDSPEQSHLPVRVTLEKLGITRATFYRWYDAYQRGGIKLIDTVDLEGGPGTSFCSL

SEQ ID NO: 159674 - protein, 65 aa, Glycine max
  Coding DNA Sequence Number=SeqID_42896
  Subcellular localization annotation: CTP_CleavageSite=26; ConfidenceScore=5.06e-01
MTKITLHVKMRLSHEVLKVTVELSSSAQQLSSARLSARLALSSNPLTCTEREGGAKRNIVNSEPI

SEQ ID NO: 159675 - protein, 93 aa, Glycine max
  Coding DNA Sequence Number=SeqID_42897
  Subcellular localization annotation: CTP_CleavageSite=45; ConfidenceScore=5.07e-01
MAFWLAKSASTSSDLRCLSCLNPPFPVDHSREKKKNRKEKLAGVVFEQKRRRIVVVVFVFEQTSSFNMFGMGKQTENYTSDEQCRRIKVKNKY

SEQ ID NO: 159676 - protein, 64 aa, Glycine max
  Coding DNA Sequence Number=SeqID_42898
HMQIAGGNGAFRLDAPPDSGVASFNDAAEAVSKGVAVCNAAGCCQLQWRFGWPKAPAPAAICVA

SEQ ID NO: 159677 - protein, 93 aa, Glycine max
  Coding DNA Sequence Number=SeqID_42899
MEFFASIKGLTIAKLYCGTQLLGNSRSFLPAQLSLYHLIWTLGVAFMDLVDCVIDDYKVIRHVDFFERTDLELLEEWESRSYCPLWEYGIYIA

SEQ ID NO: 159678 - protein, 44 aa, Glycine max
  Coding DNA Sequence Number=SeqID_42900
MVDGSMMGSPPRAGFGGLCRVHHGSFLVGLYGHVGGQEILYAEI

SEQ ID NO: 159679 - protein, 67 aa, Glycine max; identical to SEQ ID NO: 127419
  Coding DNA Sequence Number=SeqID_42901

SEQ ID NO: 159680 - protein, 142 aa, Glycine max
  Coding DNA Sequence Number=SeqID_42902
  Homolog annotation: Hit_ID=Q9SD67; Match level="QueryCoverage=28%, HitCoverage=5%, E-value=7e-11, Identity=80%"; Hit description=FtsH metalloprotease-like protein
MSRLLTPKQQCRPSICIGEIDNKVDTAHGHDSHMCRLSMLKHNLTLDETKLELHKAKPHGQIREGADEIEEKTAKLKGSEKALVARHEARHAVVGTAVANLLAGQPHVEVWTLGYLILEFIYLVLWWEIKEKYKSVMCDIKR

SEQ ID NO: 159681 - protein, 116 aa, Glycine max
  Coding DNA Sequence Number=SeqID_42903
  Gene Ontology: Mol. function=actin binding; Biological process =cytoskeleton organization and biogenesis
  Pfam annotation: Domain name=Transposase_21; Domain location=11-116; Score=-29.7; E_value=4.5e-12; Accession=PF02992.5; Description =Transposase family tnp2
MSKCPRCGVSWYKAKDDDECSSDESTTKGSLAKQKYMMLSMMISGPRQPRNDIDVYLSPLIEDLTKLWDEGVVVVDGYRNETFKLLVMLFCTINDFPTYENLSGYNVKGYHACPYL

SEQ ID NO: 159682 - protein, 91 aa, Glycine max
  Coding DNA Sequence Number=SeqID_42904
  Pfam annotation: Domain name=Transposase_23; Domain location=1-66; Score=-17.7; E_value=0.098; Accession=PF03017.5; Description =TNP1ENSPM transposase
MGDFEKCGLHVNENPPRLVALGRVYEGSNPVHNIPLGNDQVKVSIEEVRDANARVSIPTQKDKQRTEGSMKPADRLYPNVDPLYLMTLTIM

SEQ ID NO: 159683 - protein, 342 aa, Glycine max
  Coding DNA Sequence Number=SeqID_42905
MTKNRVLKEHNKTFLNWFKDIIFGGDNTSKTLRKLADGPKRNVITWQGYNINKFSFYMKSQDKKSTMQNNVCRWVDSNISVRIDDFRFTLVDLKKLAYQNEPFIMAEQAKQLFYVQDPCDERLSVAHGYTTISHPPPYESAVPSPSTSKKTRKATWLRSLATRSVRAEIPVVHVDLAIGKTDDSKEGEDDKVCQKYDISKEKWNQFCHNCKTLHGRDYDYLEEKSMEDKKKKRLEEAAQSESTNTIVDPLSLIRRHMKWKMTHTKKSGQMMSEATKEITDRIASQESFVTHGCQDVLTVVIRRPEYPGRVCATEASVTIKQYFRPTSRNSLMFTSMAPEDLE

SEQ ID NO: 159684 - protein, 83 aa, Glycine max
  Coding DNA Sequence Number=SeqID_42906
MAWHCSKQSISALGARVLYLAGQEQGLKDIKLGCIPQTGASMEHATRGTARRTRQHGSALDAGASGSDLPLGATGSAQRVGAN

SEQ ID NO: 159685 - protein, 237 aa, Glycine max
  Coding DNA Sequence Number=SeqID_42907
  Gene Ontology: Mol. function=protein binding; Cellular component =outer membrane; Biological process=aromatic amino acid family biosynthetic process
  Homolog annotation: Hit_ID=P0ADE4; Match level="QueryCoverage=99%, HitCoverage=44%, E-value=1e-102, Identity=79%"; Hit description =Hypothetical protein ytfM precursor
  Subcellular localization annotation: CTP_CleavageSite=57; ConfidenceScore=5.56e-01
MLRSPPAKKRRSGGTFSKSLVSIQPRLPRATKRCFSPSVRIHTFCACRIRKSTSEPQAAARTGAVQADARIEQHGGVGDAALSKVVETPAQVNRALPAGAAVPVTRHRQRGGVRFGVVEIGAFQAAGEGVVLLQRTFQQRHFIAEIKLLLRRGDIGAGGQAVAAVIDPRLFPRAFQPRSDVRRVTDTGFDGVLHARRHGGAERQHFGLAPFIELGCHDDRIKPAGGGEATIEFGQIA

SEQ ID NO: 159686 - protein, 202 aa, Glycine max
  Coding DNA Sequence Number=SeqID_42908
MVIRTPFCHPETIESGGTQRQIMVILHLTSSRGGEPDDMQRQIMVIRTPFRHLETIESDGMLRQIMVIMHIFSSRGGELGDMWRQIMVIRTRFRHPESIESGGMQRQIMVILHLLSSTGGEPDDMWRQIMVIRTRFRHPETIVSGGTQRQIMIILHLFSLSGCENDDMRRQIMVILHLLSSRGGEPDDMRRQIMVIRTPFTI

SEQ ID NO: 159687 - protein, 320 aa, Glycine max
  Coding DNA Sequence Number=SeqID_42909
  Homolog annotation: Hit_ID=Q1SW19; Match level="QueryCoverage=33%, HitCoverage=41%, E-value=3e-19, Identity=70%"; Hit description =Disease resistance protein
  Pfam annotation: Domain name=NB-ARC; Domain location=3-292; Score= -131.4; E_value=0.066; Accession=PF00931.13; Description=NB-ARC domain
AGFNLSALSSFYVLFVNVLELGFEGGALIWGKANGDADVNLSLLVVTAAQGLPWFVLSLLVLYCKFKVSERFPFLLRAWWFLSFVICLCTLYVDAAEATLRRRLHAYQKKDDFIPLESVITPLEGEVYEILKEKAKLLRGIHKDFSDIKDELESIQAFLKDADRRAADEANTNDGIRTWLGGKCPAELQGMSNNIVRKCEGLALAIVSIGGLLSTKSKTVFEWQKAEMQHLKDKLAISEITAKAESKLKDKLKLRLTLKLSANRRRTRKVVVKTTTTTSPTMLKKNAQQERAQEPRRRQPKNAQKKMKCSRGRKKKCWVH

SEQ ID NO: 159688 - protein, 243 aa, Glycine max
  Coding DNA Sequence Number=SeqID_42910
IHEGTLMSEVYGIKMVIDQSLFYDLTQLPSEGVPFEGALIDDWKFDFSVHDAHRLVCTNQADMTERLLAEDLIVMWAFHKGLQIDWAHLILDRFDGLQTFVGERFDTLELQVDMRFNEMESRITKVEEDNEFKMFKMFKMFKIESRTLQGSRGNLIPRIKNQDSRFKLPRIKIKIQESREDLIKIRYILCGTSRGYIYLGLTENKRGYISCGSVLVEGTSTRFKENKGAYIPCGSLLVKGFLQ

SEQ ID NO: 159689 - protein, 147 aa, Glycine max
  Coding DNA Sequence Number=SeqID_42911
  Homolog annotation: Hit_ID=Q1S5H4; Match level="QueryCoverage=46%, HitCoverage=15%, E-value=2e-16, Identity=56%"; Hit description =Glycosyl hydrolases family 17, putative
VTKLSIENLNDVLVNEKEGDHVSVEPGLCHRAILGDGADHVVGDCEEEGGVAVEEAAGDGGVNVFEAGGSCVEVAKPGGNALRGGGQVLQGGSGGGGRERKWDGNKSAVEKLIYNLFEFILAKEFRCFDVYAMIFYWVLTLCLRIPL

SEQ ID NO: 159690 - protein, 94 aa, Glycine max
  Coding DNA Sequence Number=SeqID_42912
MADGGWRKAKIPPYKHTIAPYGTTMAGLPSQIAFGESVKDLRDSGTPKRVSWGLDTPTNTAVTNPSDDDGEEQMAVTGCKRQSQVTNDGDRSCG

SEQ ID NO: 159691 - protein, 148 aa, Glycine max
  Coding DNA Sequence Number=SeqID_42913
  Homolog annotation: Hit_ID=Q1S5H4; Match level="QueryCoverage=46%, HitCoverage=15%, E-value=2e-16, Identity=56%"; Hit description =Glycosyl hydrolases family 17, putative
MTVKQGFFSLRGSLLFFAILTLLSLTYLSLKYSTPTQVTKLSIENLNDVLVNEKEGDHVSVEPGLCHRAILGDGADHVVGDCEEEGGVAVEEAAGDGGVNVFEAGGSCVEVAKPGGNALRGGGQVLQGGSGGGGRERKWDGKSTTYSF

SEQ ID NO: 159692 - protein, 118 aa, Glycine max
  Coding DNA Sequence Number=SeqID_42914
MAAEWRRKRERRRHFNEKMSLEEAHHHRRPWIRAWRKKEMNEAYVPKIYPKAHENLRVFSCISGPIFLESSIQCPWGVGLHQLRTWEITLTWRSRRRKCIARLIDSQIHDNLCIKSLD

SEQ ID NO: 159693 - protein, 92 aa, Glycine max
  Coding DNA Sequence Number=SeqID_42915
MELPWLMRALDTMKLAIMMETTIVSIRESDRRKTSWRWFIDIVDVDVPYGMEVVLVGLARLLSVGESSRNGVDHPSYLLGGFLFLRRLSIAS

SEQ ID NO: 159694 - protein, 96 aa, Glycine max
  Coding DNA Sequence Number=SeqID_42916
MKKILGLQAPLELTSLVTYTGHTNSNLQLKTLPLTSNLIGANLYTNEDEILCRVFPTSLKGATLTWYGGLPPRFIDNFDTLSSVSVRNMQPVGHNI

SEQ ID NO: 159695 - protein, 90 aa, Glycine max
  Coding DNA Sequence Number=SeqID_42917
QPPIDNTDNGVEKSPRDDTENGENVIEQPPINNTDNTNSHNFNQELEDNILEIGVEGNVEHNNTSSEVPTNIYDPGLWKNIDGKFRDLMI

SEQ ID NO: 159696 - protein, 80 aa, Glycine max
  Coding DNA Sequence Number=SeqID_42918
KSNRVLGFPTLIMGLFQLYGVPVAPSKAGVGRDTTTAWGWPTAGNRRTGATSKAPHLIYKGWSVAYDPWPTGRRPSPKPK

SEQ ID NO: 159697 - protein, 46 aa, Glycine max
  Coding DNA Sequence Number=SeqID_42919
MEFNGGGGHNPLFEDSPSESGSGAATVRYGLISNDTHEARCKCKAV

SEQ ID NO: 159698 - protein, 154 aa, Glycine max
  Coding DNA Sequence Number=SeqID_42920
SDSSISSGSLRFLQLFPDCSDRIPKRQRDGEEIEASTWYCLHAIPFSPSMNIIPQNPNGESVRNCISNNISKFHENPTINETGILKHDIKIPNGENARNWASNVVLKFHNDPTVNEFEIVIFLRQVRWPSGKREGFGRREKKRNCEAEENEESV

SEQ ID NO: 159699 - protein, 148 aa, Glycine max
  Coding DNA Sequence Number=SeqID_42921
  Homolog annotation: Hit_ID=Q1RU20; Match level="QueryCoverage=54%, HitCoverage=10%, E-value=3e-10, Identity=36%"; Hit description =Ovarian tumour, otubain
MDKWMNITDMSYVVASRYNVILVSLFLQQSMTFCPLRSQPPRDYFVHQVICIGHVLENHFVQVFLREACPLPPTTLLWSTYCHYHLHVELVRLGSSSSMDSFSSWKMNGSGMEKEEREEMPFQGEDESRRSSPLQEAMDKSLEEEGDE

SEQ ID NO: 159700 - protein, 48 aa, Glycine max
  Coding DNA Sequence Number=SeqID_42922
MAFSLTLLCHSLEGNAGELTNFEVLDFLRAKGASKDPTRVIAKVALLK

SEQ ID NO: 159701 - protein, 306 aa, Glycine max
  Coding DNA Sequence Number=SeqID_42923
  Homolog annotation: Hit_ID=Q47522; Match level="QueryCoverage=20%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIEDSYNYALKDNIEPGSTFKTISLLAAMDDGFIDENTTVNVGNGVWTYAKQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159702 - protein, 56 aa, Glycine max
  Coding DNA Sequence Number=SeqID_42924
  Gene Ontology: Cellular component=chloroplast
  Homolog annotation: Hit_ID=Q03943; Match level="QueryCoverage=89%, HitCoverage=15%, E-value=3e-19, Identity=100%"; Hit description =Membrane-associated 30 kDa protein, chloroplast precursor
LLESKIQEARSKKDTLKARAQSAKTATKVSEMLGNVNTSSALSAFEKMEEKGKKIH

SEQ ID NO: 159703 - protein, 160 aa, Glycine max
  Coding DNA Sequence Number=SeqID_42925
  Homolog annotation: Hit_ID=Q1SKD7; Match level="QueryCoverage=89%, HitCoverage=33%, E-value=3e-08, Identity=26%"; Hit description =Ankyrin
LEFDSHHFRSAKHQQRFDANRGWSFHRERRVQLREDEYTDFQEEIARRNWTSLLTPMTKFDPKIVLEFYDNVWPTEEAVRDMRSWVRGHWIPFDPDALSQFPGDLLILEEGQQCEFSQRRSQADGYDEEGFCPDHCREASADHAHQHDYLDPDMCRCNWL

SEQ ID NO: 159704 - protein, 95 aa, Glycine max
  Coding DNA Sequence Number=SeqID_42926
MSRNFTDCLTMGVKFLEAVKRRLRAIKQWSPDEIRISPHATDSLSLDDKGAEFVYACLPPNLLLLNDKGKNARPTGSRMSSGPPPLDDKRCRRRR

SEQ ID NO: 159705 - protein, 295 aa, Glycine max
  Coding DNA Sequence Number=SeqID_42927
  Homolog annotation: Hit_ID=Q2APU8; Match level="QueryCoverage=42%, HitCoverage=58%, E-value=7e-13, Identity=27%"; Hit description =Membrane protein, putative precursor
MANGESGARADLDDHRGDGVRDPGVAGGCPRHPYRCAVVGSGAALLAARRDGGRLGTRPRPSRGAVACGPGRARLSGDLGYRHHDPRAVHWLVPVLLPRPAAGERPDGVRGVVGDRARDVRRRRHGPRAHQQDAAARAPGQRCRGDHRCAPDACGGARGRKGLSDVEGERCEGGLDRLVLRELRELDGCRCTDDTDEDVLPGRRAQVDPGGDRHVGADGVPDRLVVLPERFVPPQPDRLDGAHAERGDRATVGERQRRVELDAAVLEHTERHGHDDAVERERLAGTQAHTHAGVV

SEQ ID NO: 159706 - protein, 98 aa, Glycine max
  Coding DNA Sequence Number=SeqID_42928
  Gene Ontology: Mol. function=helicase activity
  Homolog annotation: Hit_ID=Q9LTU4; Match level="QueryCoverage=93%, HitCoverage=9%, E-value=2e-15, Identity=34%"; Hit description =Helicase-like protein
MVESERLSYIRNNQKKLRVDKYSSLQTSLDTGTAKGLTKGKRVILPSTFVGSPRYMDQLYFDDRPDIISRIFRLKYEHMLSDLTKGQLLGKVVAYING

SEQ ID NO: 159707 - protein, 58 aa, Glycine max
  Coding DNA Sequence Number=SeqID_42929
MGQNTKTSRALKFINQFSSEHQLRGEGIEAFTPLSTCDEYFSLHRQYFENPNGEGVRK

SEQ ID NO: 159708 - protein, 78 aa, Glycine max
  Coding DNA Sequence Number=SeqID_42930
MARNFTNCLTMGAKYLEVVKRGSHPNNGWSPNEIRMEGYTPTHSCLVHYRGSIHGSIKSTEGSYLAEKSYYQPRIYTG

SEQ ID NO: 159709 - protein, 70 aa, Glycine max
  Coding DNA Sequence Number=SeqID_42931
AENDVSLCVLLGFSTYRQQKLYTDNHSGISARQRDSKVNMTDLVSAEDDVNLRMSTGLSAPIDEGRRRRP

SEQ ID NO: 159710 - protein, 283 aa, Glycine max
  Coding DNA Sequence Number=SeqID_42932
  Gene Ontology: Mol. function=glycine hydroxymethyltransferase activity; Cellular component=membrane fraction; Biological process =serine family amino acid metabolic process
  Homolog annotation: Hit_ID=Q9XB01; Match level="QueryCoverage=62%, HitCoverage=42%, E-value=1e-93, Identity=96%"; Hit description =Serine hydroxymethyltransferase
  Subcellular localization annotation: CTP_CleavageSite=43; ConfidenceScore=5.58e-01
SALASVAVTLRVNTTPAALNAPLQGASHSPFRLRNCWEGRSVRASSLLRQLAKGGCAARRLSWGELELHRGGGRSRTSGSPGLQEFDAFGAAGNDAQTAFDQFFRHRCGVDFHLFRVLFELGLQGFFERNGFGGDDVHQRAALQAWEDGRVQRFFMRVVSAQNHAAARAAQGFVGGGGHEVAEWDGVGVFAAGNQACVVCHIDKEVGTDFVGNFTEFRPVDLQGVGRCAGNDHFGFVFEREAFDFGVIEDFVFIQAVGNGSSLSIPSTSRGGPVPAFVPFSEG

SEQ ID NO: 159711 - protein, 218 aa, Glycine max
  Coding DNA Sequence Number=SeqID_42933
  Gene Ontology: Mol. function=glycine hydroxymethyltransferase activity; Cellular component=membrane fraction; Biological process =serine family amino acid metabolic process
  Homolog annotation: Hit_ID=Q9XB01; Match level="QueryCoverage=61%, HitCoverage=32%, E-value=1e-71, Identity=98%"; Hit description =Serine hydroxymethyltransferase
  Pfam annotation: Domain name=SHMT; Domain location=1-200; Score=-5.9; E_value=4.5e-16; Accession=PF00464.10; Description=Serine hydroxymethyltransferase
MIVAGASAYALQIDWAKFREIADKVGAYLFVDMAHYAGLIAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRERPPPRWSSNSPYSESYYNSLAVVLQRRDWENPGVTQLNRLAAHPPFASWRNSEEARTDRPSQQLRSLNGEWDAPCSGALSAA

SEQ ID NO: 159712 - protein, 197 aa, Glycine max
  Coding DNA Sequence Number=SeqID_42934
  Gene Ontology: Mol. function=transferase activity; Biological process= biosynthetic process
  Homolog annotation: Hit_ID=UPI0000689A19; Match level="QueryCoverage =95%, HitCoverage=53%, E-value=4e-29, Identity=36%"; Hit description =capsular polysaccharide biosynthesis protein
  Pfam annotation: Domain name=Glycos_transf_1; Domain location=6-179; Score=8.4; E_value=0.00046; Accession=PF00534.10; Description =Glycosyl transferases group 1
MALPGKKSTSELKIHDNSQRKLCKMGAINPFRGIDKAILAMHHIDDVVFKIAGDGPKKKEYEELVARENLQHKVEFLGKLVPEDLRKITLTADVGMSIEENGGDSYLYSLPNKVLDCIQARVPLIMADLPEMRNIRMQFDVGEIIKDHQPENIADAVFRILNKGRKGYQDELKKASELLCWENEELKLLEVFRKASQ

SEQ ID NO: 159713 - protein, 112 aa, Glycine max
  Coding DNA Sequence Number=SeqID_42935
AVRKLQTLNHTLVSRGKHQPCEENTKNKVAFSKSGTERKKKEEILKQAQSNRGAQRASGAKRATNWRRWAWQKPLRALSQPGAQRPIQQKHRPSVHGAPSARSERAKREVWR

SEQ ID NO: 159714 - protein, 288 aa, Glycine max
  Coding DNA Sequence Number=SeqID_42936
  Gene Ontology: Mol. function=DNA binding
  Homolog annotation: Hit_ID=Q1SDS1; Match level="QueryCoverage=71%, HitCoverage=38%, E-value=6e-23, Identity=34%"; Hit description=IMP dehydrogenase/GMP reductase
KGEWAPFIDILALLIFGGVLFPNVDGLVDLAAIDAFLAYHNHKESPVVAMLADLYDTFNRRCEKSNTKIVCCTPALYVWLVLHLFLQEVRHACPLEGHCSCTEKGGANWDQLLANKEGASINWFPRWKEGRVGVLISCGGFPNVPSMGTRGCISYNPVLAIRQLGYRMRGASLEEEIAPVISRGFNKTNVETLQKVRKAWEVVQKKDKELRGSLDWLPSLRTAKREEVEAPEEDEEVQALRAELEQAQTVKERFKSVALKIRKENAELRDINIATTKALEQETKRARR

SEQ ID NO: 159715 - protein, 176 aa, Glycine max
  Coding DNA Sequence Number=SeqID_42937
RIASTTMHTGARFHLCRCKEMSADHARQHDHSYIDIDNVATFCPTTAMLISPYGCISWSVSFRHRDRAHKTPNGLGGAQNVPGVSSSGYGPLSVLQGARFPQQGIVPTRYPVDQEDPNRALGFPALVTGLCQSYRVPVSPSKKYCDLRQAQGKTPQQPGDGRQRATDAPPPPLKFT

SEQ ID NO: 159716 - protein, 124 aa, Glycine max
  Coding DNA Sequence Number=SeqID_42938
MILCILREKDSFGLEEHSGIDLSGNTDAEHDISNNTQENACKKQVESPNNNIEAEDVKEISHVVYKETGKASKVEVKDVKLNHPKEVQVNSVSKGSNAAKTKNKSMLPTSKASPISTPKSSKPA

SEQ ID NO: 159717 - protein, 117 aa, Glycine max
  Coding DNA Sequence Number=SeqID_42939
  Homolog annotation: Hit_ID=Q1SIJ9; Match level="QueryCoverage=49%, HitCoverage=14%, E-value=1e-08, Identity=55%"; Hit description =Cyclin-like F-box; F-box protein interaction domain; Galactose oxidase, central
MNGAKVVAVFCYECDGGYKTQVKVLMLGTDLWRRIQEFPFGVPFDESRKFVSGTVNWLASNDSNSLVIGVGYFLLDTRKKGRKGWTTQWCLSTVVVSVGKAKEGEKGKKEKGEKVMI

SEQ ID NO: 159718 - protein, 247 aa, Glycine max
  Coding DNA Sequence Number=SeqID_42940
  Gene Ontology: Mol. function=metal ion binding; Biological process =metal ion transport
  Homolog annotation: Hit_ID=Q9LUE7; Match level="QueryCoverage=34%, HitCoverage=56%, E-value=7e-21, Identity=51%"; Hit description =Similarity to ATFP3
  Pfam annotation: Domain name=HMA; Domain location=80-143; Score=48.1; E_value=2.9e-11; Accession=PF00403.16; Description=Heavy-metal -associated domain
MDEVNPIASPMVGGCKLSKSGSETFSDPTLYRSVVALASGQENYQISEWDSNSGIKEKKDKGNKEEAKDKKKKEEPPPEIVLKVDMHCEACARKVAKALKGFQGVEEVSADSRTNKVVVKGKTTDPIKVCERLQKKSGKKLELISPLPKPQRRKKNHPKKNHQKWRKKYEGTFFVVQVEGTSTWVVVTEDKRGYISCGSVQVKGTSTWLFKENKGGYIPCGSLLVKDFTRWKEISRIGGCLGTGCRH

SEQ ID NO: 159719 - protein, 34 aa, Glycine max
  Coding DNA Sequence Number=SeqID_42941
MAPLGSMKVPFTRDCPKFGPIFMVKELVDDLGAW

SEQ ID NO: 159720 - protein, 104 aa, Glycine max
  Coding DNA Sequence Number=SeqID_42942
  Gene Ontology: Cellular component=cis-Golgi network; Biological process=ER to Golgi vesicle-mediated transport
  Homolog annotation: Hit_ID=Q5VMK0; Match level="QueryCoverage=78%, HitCoverage=95%, E-value=3e-32, Identity=80%"; Hit description =Synbindin-like
  Pfam annotation: Domain name=Sybindin; Domain location=4-93; Score =59.4; E_value=1.2e-14; Accession=PF04099.3; Description=Sybindin -like family
MAAIYSLYIINKSGGLIYYKDYGSAGRMDTNDSLRVASLWHSMHAISQQLSPVSGCLGIELLQADTFDLHCFQSLTEYYSTAKHITTKLVMGITEMPPKITEFH

SEQ ID NO: 159721 - protein, 169 aa, Glycine max
  Coding DNA Sequence Number=SeqID_42943
  Homolog annotation: Hit_ID=Q1SK64; Match level="QueryCoverage=91%, HitCoverage=17%, E-value=1e-18, Identity=31%"; Hit description =Transposase
MCTRYLTFQEVEGAHTRLKRLLRDSIRDLYTCWDAMNNMLILQHIELKVSFQNSINTIDHRFNKPFYKRLWDFVSTQAQSLIFDELNHSTTIGVDSSACGYTLRTTHSLSCAYELARFSQLDMDRKVTLNNKVYELAFSNTTSLCPPPEKVKTKGAPKSMESTKCTPLM

SEQ ID NO: 159722 - protein, 158 aa, Glycine max
  Coding DNA Sequence Number=SeqID_42944
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=79%, HitCoverage=39%, E-value=1e-30, Identity=50%"; Hit description =Similarity to MADS-box DNA-binding protein
MNEISTLCGIETCAIIYSPNDPQPEVWPSDSGVQRVLSRFMEMPEVRQSRKMLNQESFLRQMITKGQQQLTRQRNENRKKEMTNLMLQYLTAGKVVGNPSLVDLNDLSWLIDQNLNEIEKKITMLQIQEVVIPVIENEGHMNHVQGLESNMDTKKKQH

SEQ ID NO: 159723 - protein, 218 aa, Glycine max
  Coding DNA Sequence Number=SeqID_42945
  Homolog annotation: Hit_ID=Q1T1Y0; Match level="QueryCoverage=75%, HitCoverage=44%, E-value=4e-16, Identity=33%"; Hit description =Ankyrin
  Pfam annotation: Domain name=DUF1723; Domain location=69-118; Score =72.2; E_value=1.7e-18; Accession=PF08330.1; Description=Protein of unknown function (DUF1723)
MSKQRRHVEAHVVDPLEQPMLLSKWSLVSMLIMYSLQTNRSHNHLLSFLIRDVVKGSDLFPLTTCSHQTIDKELLSAFVERWRKETNTFHLPIGEMTIILDDVALLLNIPTTGAFYNFENMDKGEAILVLIDLLGVEYKDAFNETKKTRGGQERCQKRRWDEVARAYLFHLVNCTLFANKCETYVEDVRGIHWVTYLYEHLGDASFDGTKKIGGYATL

SEQ ID NO: 159724 - protein, 108 aa, Glycine max
  Coding DNA Sequence Number=SeqID_42946
MAFEPFKYSRKGSLYLLVFIRMCLSQPTLRREGDARLMGASSKKGLRAESPPTFILRKTSEKTGKDVVYELEVKGSGVVFTHGEGISTPRVRHKGRQPLIKCANMTSI

SEQ ID NO: 159725 - protein, 106 aa, Glycine max
  Coding DNA Sequence Number=SeqID_42947
  Homolog annotation: Hit_ID=O49235; Match level="QueryCoverage=46%, HitCoverage=22%, E-value=5e-18, Identity=86%"; Hit description=2,4-D inducible glutathione S-transferase
MGCLFTKGVVVIRLGRLFIKNTGLQKIIYDLGKKIWTSKGEEKEAIKNEFIEALKLLEEQLGDKTYFGGDNIGTHYLFSKHQFFIFANPPSVNTQYEFNKLIIILL

SEQ ID NO: 159726 - protein, 237 aa, Glycine max
  Coding DNA Sequence Number=SeqID_42948
  Gene Ontology: Mol. function=calcium ion binding
  Homolog annotation: Hit_ID=Q1SLX8; Match level="QueryCoverage=53%, HitCoverage=65%, E-value=8e-40, Identity=68%"; Hit description =Calcium-binding EF-hand
  Pfam annotation: Domain name=efhand; Domain location=171-199; Score =33.6; E_value=7e-07; Accession=PF00036.22; Description=EF hand
  Pfam annotation: Domain name=efhand; Domain location=207-235; Score =23.7; E_value=0.00067; Accession=PF00036.22; Description=EF hand
  Pfam module annotation: Pfam domain module=efhand::efhand; Domain location=171-199::207-235
MRKGRRVNKEPQRREKGVGGRRWRGRRRSCCKRERSRCGKEVSHSGGVGVMSFLKEVLELGKGWQWIRAGMSNSYPLSTHLEITQGVSSLWNWVSRNWKNCCTNNPRSDSNHEPENHSLKCIQHGVRLCKEEVIVVMQKLGISVELHGDGIEDFGEQEIANMFENDVSVEEVKEAFNVFDENKDGFIDAADLQRVLFRLGLERDFVQCQKMINIVDQNGDELIDHNEFFMLMEQSFC

SEQ ID NO: 159727 - protein, 106 aa, Glycine max
  Coding DNA Sequence Number=SeqID_42949
MEAWGTIMDCPIELDYEDRLKKFEVVYEPWHEFVVYALNHIVDEVHRMKFVSVDMSHCGCIVRSTHGLPCVYELVRYVLGGIPLQVVHLYYTMLSLNNMGQYASVP

SEQ ID NO: 159728 - protein, 85 aa, Glycine max
  Coding DNA Sequence Number=SeqID_42950
  Gene Ontology: Mol. function=ribonuclease H activity; Cellular component=nucleus; Biological process=regulation of transcription, DNA-dependent
MAELWGLYEELKLAFSKGISCLEVHVDSKSMVDSIKGGIQQLLAQEWTIKLVSIFKEANKCVDAIANEACEMEEDLMIFSNLRPF

SEQ ID NO: 159729 - protein, 221 aa, Glycine max
  Coding DNA Sequence Number=SeqID_42951
MESEKRTTSSWGVGGSSSMTRMVFVIVKHESLKHVGIRGGACERECEFEKESVGEGLTLMDGKVKGLELKAGRRFGWRSVIDKCSFHDATQTNRGGFDRGLSKEKEFGLGGLNMDGQITRTRSMASTSRDATPPFPKTARLMTKMIKLGDQMRKMNYENEERMERMRKENEESFRRIHKSSEVLNVRIENTEQRSENISSNSSHGEDEGYEEDERGKRNER

SEQ ID NO: 159730 - protein, 526 aa, Glycine max
  Coding DNA Sequence Number=SeqID_42952
  Gene Ontology: Mol. function=metalloendopeptidase activity; Cellular component=cell surface; Biological process=proteolysis
  Homolog annotation: Hit_ID=Q10LS9; Match level="QueryCoverage=97%, HitCoverage=49%, E-value=1e-174, Identity=72%"; Hit description =Insulinase containing protein, expressed
  Pfam annotation: Domain name=Peptidase_M16; Domain location=114-248; Score=135.3; E_value=1.7e-37; Accession=PF00675.10; Description =Insulinase (Peptidase family M16)
  Pfam annotation: Domain name=Peptidase_M16_C; Domain location=271 -455; Score=98.3; E_value=2.3e-26; Accession=PF05193.11; Description =Peptidase M16 inactive domain
  Pfam module annotation: Pfam domain module=Peptidase_M16::Peptidase _M16_C; Domain location=114-248::271-455
MGMKGAPVCLSVDDNVVLKSPNDRRLYRLIHLPNGLRALLVHDPEIYPEGPPKHAPNEDEVEEEEEDDEEDGEYDDDDDDDEDEEEEEEGEEEEEEEEEEEEEEEMDGVKGGGAVAAQSKKAAAAMCVGMGSFSDPDEAQGLAHFLEHMLFMGSDEFPDENEYDSYLSKHGGSSNAYTETEYTCYHFEVKREFLKGALKRFSQFFISPLVKMEAMEREVLAVDSEFNQVLQSDACRLQQLQCHTSAHNHPLNRFFWGNKKSLVDAMEKGINLREQILKLYKDYYHGGLMKLVIIGGESLDVLESWVVELFGAIKKGQANPVFTVEGPIWESGKVYRLEAVKDVHILDLSWTLPCLHQEYLKKPEDYLAHLLGHEGRGSLLSFLKSRGWATSLSAGVGEEGIYRSSIAYVFVMSIHLTDSGIEKIFDIIGFVYQYLKLLREDTPPEWIFKELQNIGNMDFRFAEEQPPDDYAAELAENLHFYPPEHVIYGDYVFKTWDEQLLKQVLGFFVPENMRVDVVSKSFLKSE

SEQ ID NO: 159731 - protein, 355 aa, Glycine max
  Coding DNA Sequence Number=SeqID_42953
  Homolog annotation: Hit_ID=Q1SKJ3; Match level="QueryCoverage=15%, HitCoverage=6%, E-value=7e-08, Identity=38%"; Hit description=Zinc finger, CCHC-type; Endonuclease/exonuclease/phosphatase
MVVEEGKMRDLLYVEELLHCWKNLKCPVFKYLFSSYSEEAMQIVEGIGEFGLGVTRGTGLASATGDLSSVEQDLLGRSKKKIKGDGEGFFGESSQHVSYVGIHEPIEDKMVGLKGDEYKNALLGGSDEEFSLLIEEDMDDDWNVDEEENKELENIKVEDILHMIDIGNDYFLVYFSHKEDMMKAQIEGPWLIYDHYLVVREWMPNFHPSSEALEKVVVRDYPMVQEIGKSQLDPQNRKMDFQEGREDLRHSSRSPDQGIETLDKLPLDFPNIIVGRVSSRIRVMDIVMETIPLQGADRGRREESLLSRSLQMFRVEFLDHHPILISLDEKNSWQNDGPFMNNIQLKNNLVVWRMK

SEQ ID NO: 159732 - protein, 146 aa, Glycine max
  Coding DNA Sequence Number=SeqID_42954
  Gene Ontology: Mol. function=RNA polymerase II transcription factor activity; Cellular component=nucleus; Biological process =transcription initiation
  Homolog annotation: Hit_ID=Q765H9; Match level="QueryCoverage=100%, HitCoverage=80%, E-value=9e-23, Identity=44%"; Hit description=TATA box-binding protein associated factor 10
  Pfam annotation: Domain name=TFIID_30kDa; Domain location=30-116; Score=72.2; E_value=1.7e-18; Accession=PF03540.4; Description =Transcription initiation factor TFIID 23-
MNQNPQSSDGRNDDDSALSDFLASLMDYTPTIPDELVEHYLAKSGFQCPDVRLWPYPCICKEAVFGFEPMTNKSPRHNFTAAPDEICKLTRLVAVATQKFVAEVAGDALQHCKARQATIPKDKRDKQQKDKRLVLTMEDLSKALRE

SEQ ID NO: 159733 - protein, 88 aa, Glycine max
  Coding DNA Sequence Number=SeqID_42955
  Gene Ontology: Mol. function=transmembrane receptor activity; Cellular component=membrane; Biological process=apoptosis
  Homolog annotation: Hit_ID=Q1T1A2; Match level="QueryCoverage=82%, HitCoverage=8%, E-value=6e-14, Identity=49%"; Hit description=TIR; Disease resistance protein; AAA ATPase
MVQHLKFIMAEQQIFSDFASSSNSSRKYGVFLSFRCEDTRKNFTSHLYEALMQKKIETYMDYQLEKGDEISPAIVKAIKDSHASVVIF

SEQ ID NO: 159734 - protein, 229 aa, Glycine max
  Coding DNA Sequence Number=SeqID_42956
MGGIGKTTLATALYVKLSHEFEGGCFLTNGTDVVEGIILDLDTLTRDLGLSSDSLAKITNIESLHVHSKSLCELDLNGSLSLKEFSVISEEMMGCNNLNTELSLSFLQALPHKIANLSSLQMKLMSLPELPSSLKEMRAFNCTSLETDFTQRLVLQHMLQSHLHNLPDGEDYDSGYFIFSGDHVTDELYPSELGLKLFGSSSKEIFELEIITQISDNESQSRAIGNGVG

SEQ ID NO: 159735 - protein, 882 aa, Glycine max
  Coding DNA Sequence Number=SeqID_42957
  Gene Ontology: Mol. function=DNA binding; Cellular component =membrane; Biological process=DNA integration
  Homolog annotation: Hit_ID=Q1S1B7; Match level="QueryCoverage=99%, HitCoverage=61%, E-value=3e-78, Identity=39%"; Hit description =Integrase, catalytic region
KYAVEIIERAGMSSCKPSPTPVDMKPKLNANSNTPYIDPSHYRSLAGALQYLTFTRLDIAYVVQQGTFDHDLHLYPSFTSTLLSYIDANWGVANVVLESYWLQNLLLELHCPIRKATLVYYDNASAIYLSTNLVQHQRTKHIEMDIHFVHEKVSRGEVQVLHVSSRYHIAYIFTKGIPLVLFEDFRNTLSVQQPPALTVGMNEEQDESLSFHSSYYLHSSENPAIALVSPLLHPRNYNSWSRSALTALSAKNKVEFVYGSLPRPTLNHRLYGAWKRANNMVVSWIVHSVATSICQSVLWMDNAIDIWKDLKAQLLIRKIWDELESYRPDPMCTCASKCGCDALVEVKKRKDQDRIMEFMCGLNDQYNHFRSNILMMDPLPLINKAFSYMAQQERQFASSNALGNLSLVNAAANTRLSNSCSYCGRDNHTVETCYKKNGIPPNFFSNRGGGGRGFGRGGTGGKSTNGKVCTHYGITNHTVDEFYKKHGHPPGQKFYNPQGASINNTVKEEENVSSSETSNHGQDIKITQQQYQANNNSSHGSQANHTWILTDLPPNKYVIGCKWVYKVKHKADGSVERYKARLVAKGYTQIKGQDYLDTFSPMAKITTVRLLLALAAVNNWHLKQLDVNNAFLHRNLNEEVYMTLPPDDIVLSGNDLLEIKYITQLLDEVFKIKDLGDLKFFLGLKVAHSKQGINICQRKYALDILHDASMLGSKPVSTPIDYVLKAFSDSDWAGCIDTRQSITGYSVYLGNSLISWKSKKQATVPRSSSEAEYRALASATCELQWLIHLLNYFGIVYTRPTLLFYDNRSILHIATNLVFHERTKHIEIDCHIVQEKLHSGLIKLLLIAFAQQLADIYTKALPLGAFNFLQCNMRMSDIHSPA

SEQ ID NO: 159736 - protein, 37 aa, Glycine max
  Coding DNA Sequence Number=SeqID_42958
MEARQQVVGWARPVGPVGLSLAERSNGGPHKGRVHRP

SEQ ID NO: 159737 - protein, 168 aa, Glycine max
  Coding DNA Sequence Number=SeqID_42959
MGEHAQLVNPVFLDEVVGATPINQVTTWWLAIEPNNLKGGIGVILFIICNKQKHLLEAFVAAMWWEEGTRPRGKGSACLRTSLPGVVLSQWPGLVLEVARPRLRGGSPVGSSYWVGANRVCKACRNPGQEAQGNGVVEEDTGIVGEWQVWLWHLQGEESVGFEGQWPP

SEQ ID NO: 159738 - protein, 334 aa, Glycine max
  Coding DNA Sequence Number=SeqID_42960
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=24%, E-value=1e-72, Identity=40%"; Hit description=Chromo
MKFSRDGRVVEFCGDTSSTLSLLTPPQLCRLVRKSGASALFHIRILPTTIPSDQTTPTQLPLEIQTLITKFIALFQPPTSLPPSWQTNHHIHILPQSNPVNVRPYCYPHFQKQEIEAQVDAMLEHGVIRPSTSPFSSPGYHQILMHEEDIYKTAFKTHHNHYEFTVMSFGLCNAPSSFQATMNSLFRPYLRRFIIVFFDDILIYSQSFNDHLLHLELAFQVLLQGQFFIKLSKCSFAHNEVEYLGHVVSSHSVAPITQKIQAIQQWPTPRTARALRSFLGLVRFYHRFIKGYATLVAPLTQLTTQDPFEWSTTTQSAFDKLKSALTSAPNSCSS

SEQ ID NO: 159739 - protein, 149 aa, Glycine max
  Coding DNA Sequence Number=SeqID_42961
  Homolog annotation: Hit_ID=Q1SAI8; Match level="QueryCoverage=61%, HitCoverage=6%, E-value=5e-26, Identity=75%"; Hit description =Integrase, catalytic region
MAQGIVRSTQERRRTSVEQLSCLQMVVGLTEAYNGVATLICQSDPLPPFYQAHSMLTLEEVGLTKKVLAGGGAAMGVHDNDDSHSLSKNSHQNWNHGGKKDQNHNNGGKNNGGNRGGSRVAMVVVTIVADNNNPASNNRGTSNGLPDNG

SEQ ID NO: 159740 - protein, 137 aa, Glycine max
  Coding DNA Sequence Number=SeqID_42962
  Gene Ontology: Mol. function=chromatin binding; Cellular component =chromatin; Biological process=chromatin assembly or disassembly
  Homolog annotation: Hit_ID=Q1SAV4; Match level="QueryCoverage=60%, HitCoverage=20%, E-value=5e-17, Identity=50%"; Hit description =Integrase, catalytic region
  Pfam annotation: Domain name=Chromo; Domain location=94-136; Score =17.0; E_value=0.0096; Accession=PF00385.14; Description='chromo' (CHRromatin Organisation MOdifier
MSPYEITFGKKPFTLPEYLVGMSTVAAIDDMLSYREVVFAAVQNKLLKAQALPEGARIHPVFHCSLLKPFHASNDTTDSPLQLPKNFIDNHPLVTPLFILGTRQDPSCANSKVQVLVQWKGLPLDDTTWEDWEHLQP

SEQ ID NO: 159741 - protein, 84 aa, Glycine max
  Coding DNA Sequence Number=SeqID_42963
MEHGWVGIGSGKPSPTCDYATGLENPSCLTQKTTQPKGNHHGGWHAAPDTASVGPDNKRSPQGRRQHDDNKGFAVVQTKKREKK

SEQ ID NO: 159742 - protein, 82 aa, Glycine max
  Coding DNA Sequence Number=SeqID_42964
  Homolog annotation: Hit_ID=Q1PEY6; Match level="QueryCoverage=68%, HitCoverage=36%, E-value=8e-16, Identity=63%"; Hit description =Allergen-like
MKYERRIEHGLVYFEGKTKVSLDWARRFLGGPGSSPPQCTSKCGKCTPCRPVHVTVPPGTPVTAEYYPEAWRCKCGNKLSMP

SEQ ID NO: 159743 - protein, 68 aa, Glycine max
  Coding DNA Sequence Number=SeqID_42965
MEVEHMQLACQIKAYDNVVIYVNAMHEYDAGTICPLRCHEEMHDAIKEYAKMRLHCDQASQRPSMTID

SEQ ID NO: 159744 - protein, 99 aa, Glycine max
  Coding DNA Sequence Number=SeqID_42966
GVTDAIGTAAHAWLKERGPCQGWTGWACIRDVERRGWGGPRVVRNGESVYSKNLTSISAHKTPTCITQKHNFKSRALVTHPVVTLITRSTISVVKSLSH

SEQ ID NO: 159745 - protein, 171 aa, Glycine max
  Coding DNA Sequence Number=SeqID_42967
MGEIKEVQERMKADMEAMKEQMATIMEAMMSMKKILEVNAAAVATTIVVDEAAPILCKELGKYATEGQAVGVLAAMVERGRFDHIEERLRAIEGGGDYAFADMEDLCLVPNVVIPPKFKVSDFNKYKGKTCPKNHLKIRPKMEGYDNSSSAANDGEGDDNNDSRHITSVLL

SEQ ID NO: 159746 - protein, 305 aa, Glycine max
  Coding DNA Sequence Number=SeqID_42968
  Subcellular localization annotation: CTP_CleavageSite=35; ConfidenceScore=5.14e-01
MGNNRFRLSDMMPNAWFYKLKDMSKSRKRNVPHVMKNKVASPTTSQRSQPRYSHYFSIEPNIAGKLYKSPIFYTKHSDNTFTDSPRSSKRKAKRKTIYKPSPTVVSSPVMESFSCHSTNNWIKPNEPQSPDYYLSSLESSFSSESNLNDEYVSSESECDKFTIPDLLNGVASECSCRVSSSTNDIIIDMKNEPFTGNSDSLDGFDTISQLGLAPILTKPVKFDDKVIEATELRRSTKFDELKSHQSLSVKISKEESRRSKRERKTSPVARISSANSTGIKLRVNSPKLASKKVQAYARRSVSSNA

SEQ ID NO: 159747 - protein, 156 aa, Glycine max
  Coding DNA Sequence Number=SeqID_42969
  Gene Ontology: Mol. function=binding; Cellular component=nucleus; Biological process=photosynthesis
  Homolog annotation: Hit_ID=Q5NRN1; Match level="QueryCoverage=85%, HitCoverage=24%, E-value=1e-27, Identity=42%"; Hit description=TPR domain containing protein, putative
MSVNWGIHCKCKRCRFEGEVFSKQEIREIEIGLERGMDVGGVVFKLEEQMKRMKVRGKEKGYLRASFWEAYSEAYRSERAMKRWGRRIPTMEAVVDSISDVVGGDHRLLKMMVEELKKNGGGVVEREKVFKMARDVFGKVVKKQAMKTLLELCIGD

SEQ ID NO: 159748 - protein, 84 aa, Glycine max
  Coding DNA Sequence Number=SeqID_42970
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=98%, HitCoverage=13%, E-value=7e-22, Identity=61%"; Hit description =Mitogen-activated protein kinase
MEKLQLNDDSPRTEMSITGKLNPEHHSFFLKVQISDKDGSCRNVYLPFGIYNDTLIDDAMEMVKELEITDLKSSDIANMIEGEM

SEQ ID NO: 159749 - protein, 148 aa, Glycine max
  Coding DNA Sequence Number=SeqID_42971
  Gene Ontology: Mol. function=protein serine/threonine kinase activity; Cellular component=cytoplasm; Biological process=protein amino acid phosphorylation
  Homolog annotation: Hit_ID=Q9XFS5; Match level="QueryCoverage=85%, HitCoverage=22%, E-value=4e-48, Identity=74%"; Hit description=MAP kinase
  Pfam annotation: Domain name=Pkinase; Domain location=1-147; Score= -84.1; E_value=0.0015; Accession=PF00069.15; Description=Protein kinase domain
  Pfam annotation: Domain name=Pkinase_Tyr; Domain location=1-129; Score=-167.3; E_value=0.033; Accession=PF07714.7; Description =Protein tyrosine kinase
  Pfam module annotation: Pfam domain module=Pkinase::Pkinase_Tyr; Domain location=1-147::1-129
MGLVVLTESSDKFSLGTLSAYEDLKCGNIFVNGHLGQVKIGDLGLAAILHGSEPAHSVIGTQEFMAPEFYKEEYNQLVDVYSFGMCVLEMLTSGYPYSECANPAQIYKKVTSGKLPASFFRIEDIEAQMFIGKMSNDCSKETISKRIV

SEQ ID NO: 159750 - protein, 81 aa, Glycine max
  Coding DNA Sequence Number=SeqID_42972
MEALYPLTMVVKIGIGNMDGLDFNIGCSKDLNTDYPPEMNVLEKWAGVACMNPCDKQNLYNRFFFCCFIGDLTPKTCIQMP

SEQ ID NO: 159751 - protein, 212 aa, Glycine max
  Coding DNA Sequence Number=SeqID_42973
  Gene Ontology: Mol. function=chitin binding; Cellular component =extracellular region; Biological process=chitin metabolic process
  Homolog annotation: Hit_ID=UPI00006A17C9; Match level="QueryCoverage =56%, HitCoverage=100%, E-value=5e-14, Identity=40%"; Hit description= UPI00006A17C9 related cluster
GYTSSPWVLVTLTVRGLHALTLRGLHVLTIRGLHALTSRGLHVLALRGLHALTSRGLHVLALRGLHVLTIRGMHALTSRGLHVLALRGLLALALGTSYPHLQRTTRPHLERTTCPHHQRAARPHLQRTTRPRHERATRPHLEYYLPSPLEDYTSFLLTVPGPPPDIGGGSTVRAQLEREAITLLLCILGQDFTRAAAKRRVRIMRTNMTTLT

SEQ ID NO: 159752 - protein, 87 aa, Glycine max
  Coding DNA Sequence Number=SeqID_42974
  Homolog annotation: Hit_ID=Q2R1R7; Match level="QueryCoverage=81%, HitCoverage=4%, E-value=2e-11, Identity=50%"; Hit description=AT hook motif-containing protein, putative
HIVSQLSEMLDEYNVHAKTFRMARDRLQDAQVDNIKLKLIVNREKDGCTYNVPTVPEVAALIIGDFDANSKRDMDIDLISYIAVDQM

SEQ ID NO: 159753 - protein, 155 aa, Glycine max
  Coding DNA Sequence Number=SeqID_42975
  Homolog annotation: Hit_ID=Q2HUA9; Match level="QueryCoverage=96%, HitCoverage=87%, E-value=1e-26, Identity=44%"; Hit description =Lipase/lipooxygenase, PLAT/LH2
  Pfam annotation: Domain name=ATS3; Domain location=25-152; Score =69.8; E_value=8.5e-18; Accession=PF06232.2; Description=Embryo -specific protein 3, (ATS3)
MDALNLTLILTFCIIAALSQATHHLAIKSSKLNQTQQQLDEGCSYVATIKTSCSSTFYARGEIDLIFGDAYGNQVYVPELPGHFDDCSTNSYDVIQHGACTHQICHLQLYWTGDSDLILETVSIYNHLDDPVTFYYHTVIPPAGGPYGFDDCHDY

SEQ ID NO: 159754 - protein, 135 aa, Glycine max
  Coding DNA Sequence Number=SeqID_42976
MEAQSHGFNAESSDSNKLMVKTEMCRRFRRGVVVISQPSHTVALKEVKQAWPQVGKLDPYSSPESKRMRTCAAAPSDDGCSSAEQRIMQTSAAADAATNASTSTVATKNEPSYPVKFIFKNNDLQRISRIYADWI

SEQ ID NO: 159755 - protein, 76 aa, Glycine max
  Coding DNA Sequence Number=SeqID_42977
MKRKRENRGKEDSHEAIENVKQKECVSQRRVKGSEVKKVKSIRVRSEGKKTTEEERQQHRMNELRLDGYSWAGLPS

SEQ ID NO: 159756 - protein, 87 aa, Glycine max
  Coding DNA Sequence Number=SeqID_42978
  Gene Ontology: Mol. function=enzyme regulator activity; Cellular component=nuclear ubiquitin ligase complex; Biological process =response to DNA damage stimulus
  Homolog annotation: Hit_ID=Q4SEG4; Match level="QueryCoverage=60%, HitCoverage=20%, E-value=1e-15, Identity=71%"; Hit description =Chromosome undetermined SCAF14621, whole genome shotgun sequence
MDWIQHSKNGSVTALIWGASPQTRSDRRKDRVETNPEQLAAASALADRMTTSTGRTTRVIGWYHSHPHITVLPSHVAHRKFLTLGML

SEQ ID NO: 159757 - protein, 275 aa, Glycine max
  Coding DNA Sequence Number=SeqID_42979
  Homolog annotation: Hit_ID=Q2QLN8; Match level="QueryCoverage=54%, HitCoverage=60%, E-value=2e-32, Identity=50%"; Hit description =Expressed protein
  Pfam annotation: Domain name=NUC189; Domain location=133-219; Score =81.3; E_value=3e-21; Accession=PF08162.2; Description=NUC189 domain
METKIAKTRQAISDPHLPITTNTLDFDELSPIIILRSIFFIFLLILESDVDQGEVAVGILHDVDSSEPTMGEKLAALSFPDENKFRSDKEQDSSAPTKPPSADSVHVLLRQALNADDRTLLLDCLYTQDEKVITKSIAQLNSPNVLKFLHSLISITESRGAILACALPWLKCLVLHHASVIMSQESSLHVLNSLYQLIESRVSSFESAVHLSSCLDIHYTRVVDEVVDDDVLTVPVIYEDDSSEESEELETDEDDNDEAFEGFSDIEDINDMMSE

SEQ ID NO: 159758 - protein, 384 aa, Glycine max
  Coding DNA Sequence Number=SeqID_42980
GETSCLRGSVELYHTELDDFKTELERRNFHKRLTNLVDGSIDLALVKEFYANLYSFEGPSPKQARVRGHLVKIDADNLNTFLATPMVLTEGESLPTYSRYCRLPKDYREIEAALCITGRGVLSYSNLAPTSCTSDLIVDRARQIFGLVSCMDMNVGALISGQITSIAQSNSCRLGFPALITALCRARGVVSNSLTFVRLSSVINLVYIRKNYWNPDDLTVSIRGARRVRAMPAELPSTSAAPTPASTSAAPSVPAQRSIPTIEQFLASVAWPEAQPSLHREDEGPIAQVAQHMEDESSEATIPEPFIAKEEAGHFRASCTSGGPILASVEEHAVDPSAPILEILEDSTTLVQTLNTSPLATPVLHLTDDEDVQTQDTQDQSQEF

SEQ ID NO: 159759 - protein, 68 aa, Glycine max
  Coding DNA Sequence Number=SeqID_42981
MKKMQDSDAPLYPEEEGYGGLGIKLSDYRVQLQPLRRVSMKRREVKTKTKAGNLYEQRESKQSRAEHN

SEQ ID NO: 159760 - protein, 125 aa, Glycine max
  Coding DNA Sequence Number=SeqID_42982
MQPLEENEHAIGSMTENVSQFVRLIVKECIDRIPMRVVGEHHPQEAWFKANLSQIWESNYQGKYGVGMNEKVKVYLWMNALLEPKLCRNKASRIILMMPRNFKDHSRWISRMKKARCQAKAKISR

SEQ ID NO: 159761 - protein, 87 aa, Glycine max
  Coding DNA Sequence Number=SeqID_42983
  Subcellular localization annotation: CTP_CleavageSite=64; ConfidenceScore=5.50e-01
MKNLSLPDILTANFRKNVLRNVSGISFFRKNSSVFRKKLLPEVFRKKLLPEAVFYCAIFLSSSVCFVSSSVCCGFGGGPFSSLLVVP

SEQ ID NO: 159762 - protein, 199 aa, Glycine max
  Coding DNA Sequence Number=SeqID_42984
  Gene Ontology: Mol. function=D-alanine-D-alanine ligase activity; Cellular component=cytoplasm; Biological process=peptidoglycan biosynthetic process
  Homolog annotation: Hit_ID=Q8PDW3; Match level="QueryCoverage=99%, HitCoverage=53%, E-value=1e-71, Identity=66%"; Hit description=D -alanine--D-alanine ligase A
  Pfam annotation: Domain name=ATP-grasp; Domain location=1-157; Score=- 60.8; E_value=0.0019; Accession=PF02222.12; Description=ATP-grasp domain
  Pfam annotation: Domain name=Dala_Dala_lig_C; Domain location=1-183; Score=314.7; E_value=1.7e-91; Accession=PF07478.3; Description=D-ala D-ala ligase C-terminus
  Pfam module annotation: Pfam domain module=ATP-grasp::Dala_Dala_lig _C; Domain location=1-157::1-183
RAALDVQTVIARFGLPLFIKPANQGSSVGVSKVTQPDEFDAALDLAFRFDRKVLIEQGISGREIECAVLGNEAPEASPCGEIVVHDAFYSYDTKYISESGAQVVVPADISAEASEAIRAVAITAFQALECFGMARVDVFLTETGDIIVNEVNTLPGFTNISMYPKLWQAAGLSYSDLITRLIELAQQRHQQSSQLKSSV

SEQ ID NO: 159763 - protein, 747 aa, Glycine max
  Coding DNA Sequence Number=SeqID_42985
  Homolog annotation: Hit_ID=Q8XTJ5; Match level="QueryCoverage=33%, HitCoverage=48%, E-value=3e-51, Identity=41%"; Hit description =Probable sulphate transporter; transmembrane protein
  Pfam annotation: Domain name=GGDEF; Domain location=569-732; Score =151.5; E_value=2.2e-42; Accession=PF00990.12; Description=GGDEF domain
  Pfam annotation: Domain name=Sulfate_transp; Domain location=1-186; Score=-66.3; E_value=6.3e-06; Accession=PF00916.10; Description =Sulfate transporter family
  Pfam module annotation: Pfam domain module=GGDEF::Sulfate_transp; Domain location=569-732::1-186
MSALVAELETPDWLAWQNPSVWVVAITLALVASLETLLSQEALKKLRPQHPAPSPNKEMFAQGIGNLTAGLLGAMPITAVIVRSSVNVSVGAQTKLSILLHGVLLLICGLWFSALLNAIPLASLAAVLLYTGYKLATPRLFVEQIRMGAQQYVPFLATIGGIIVFGMLAGIGIGIATQILCSIYQSHRNALQLTRYDDHYVLRFQQNLTFMHNPKLQGLLAEIPENSVVIVDHDNAEYMDPDVKAVLQDFGDSAESDIPDIRFFYLYGIIAAHCACLFHMLPAGLVAHLWLSWQSERRSVAEQGDEYRVTGFRRMRVKLFEENNVKKNALSLCLITLFFCFVGSHLRIPEEFSLFWPVNALIAGLMVRNPFLHTTSSYLVCFAAMIFNDTVFSGWALPAVTINFANILFILVSVSMLIKHLQSPTANSQVFNAMRIFPACLLGAAACATWGAWAQDIDFNARFVRAVLYLADAAPGDADASAAQRAAADAGTPGQAAAAARRGAVADGGGADWWRGQSDLPGTGADLGDDSLLPISHLTSARLGVATVALSPLLVAVSMDAIRQLNHRLALRANYDFLTQLLSRSGLYENLRQQPFSLQREAGVIMLDVDYFKAINDNFGHDAGDGVLEEIARRIQHVVGSRGLVCRFGGEEFVVVVFDYTHSQLFQLAEVIRQAMVKEKFWIQGNTVTVTVSLGLARGGAVNEREWPGVINRLVSAADKHLYVAKRNGRNQTSPAIAPRSMAHDVA

SEQ ID NO: 159764 - protein, 183 aa, Glycine max
  Coding DNA Sequence Number=SeqID_42986
MEAMKEQMTTMIEAMMSMKKIMEANVVAIAATSVVSKVNPTPSPGFNQMNHPISYMVAKDLGSTGDPHDVQIQNEHAFPPYGLPSNYTPPNVAYTPDEDVNNSARILIESRQPHHAHVSQPMGQTYEIPHHNLANFEACLGYATEGQAVGGIPLQNTLEGPQFCPQPQPCILQRLKSLLLWEK

SEQ ID NO: 159765 - protein, 181 aa, Glycine max
  Coding DNA Sequence Number=SeqID_42987
  Gene Ontology: Mol. function=RNA-directed DNA polymerase activity; Biological process=RNA-dependent DNA replication
MALLGKWKWRMLQEDYSLWNRILVSKYGGWRALDVERVNRQESLWWRDLKKSCGVSAVGEWFSKGMKLKIGCGSRDRWMWVAGSENIYTVRGAYAWLYEAAGVQVVPREHFLQHWYCESGRIDGQRQMVLWAAVTWCIWRHRNKYIFNNQEFRGETVLDDAMFFIWSWLNALEKGFNVPFQ

SEQ ID NO: 159766 - protein, 119 aa, Glycine max
  Coding DNA Sequence Number=SeqID_42988
  Gene Ontology: Cellular component=nucleus
  Homolog annotation: Hit_ID=Q6K882; Match level="QueryCoverage=72%, HitCoverage=43%, E-value=2e-09, Identity=30%"; Hit description =Putative nucleolar essential protein
MVSVNSAPAGGTTPKNFISSDNMRSPAIFILDNASLKKGLVKKALRCILDSPLNKAGMVGAIYVKMDQRGVFEVKPHEPITRHLPVNSHIVGLSYTSEKLVDIEEYVSVWSNDLSPVFV

SEQ ID NO: 159767 - protein, 93 aa, Glycine max
  Coding DNA Sequence Number=SeqID_42989
QWRWWQQTGGIVGSDDNNSGGWNSVSQGNGGGGGDNNIKMMMVVTIMTMWNSDSDINDDSDSGIVLAKLVEVVAIVALDGGCGGGSVMVAVEW

SEQ ID NO: 159768 - protein, 75 aa, Glycine max
  Coding DNA Sequence Number=SeqID_42990
MEPAVFDEFNGVEDAIRRVVMHNEGSRSLATKPRPLDKLEEDAPRSGIFVGKLAKNKFWRQLMIIGGCQKGQRAH

SEQ ID NO: 159769 - protein, 115 aa, Glycine max
  Coding DNA Sequence Number=SeqID_42991
MGILDETGMLDCKLVDPSIYPNVNLLLGDIGGYIYLGLTENKRGYISCGSVLVEATSTRFKENKGGYIPCGSLLVKGFLQGCTGKSSHSATPDPYDWSPAGQPHATYKVPSSACE

SEQ ID NO: 159770 - protein, 147 aa, Glycine max
  Coding DNA Sequence Number=SeqID_42992
  Gene Ontology: Mol. function=metal ion binding; Biological process =metal ion transport
  Homolog annotation: Hit_ID=Q84L61; Match level="QueryCoverage=99%, HitCoverage=100%, E-value=5e-42, Identity=53%"; Hit description =Farnesylated protein 3
  Pfam annotation: Domain name=HMA; Domain location=28-88; Score=48.7; E_value=1.9e-11; Accession=PF00403.16; Description=Heavy-metal -associated domain
MGFLDNLQEWFTACTKPKEKLVPKKTVNVRVKMDCEGCERKVKNAVKDLEGVESYDVNRKLQRVSVTGYVDSEEVLEEVRNTGKTADLWPFVPYDLVAFPYVKGAYDIKAPSGFVRNVPDAMGDPKSPEMKLMRAFDDDNPHACSIM

SEQ ID NO: 159771 - protein, 90 aa, Glycine max
  Coding DNA Sequence Number=SeqID_42993
MAPDPVLVWDAVFLDEGPINMRPDDLAGGDGHSVGLVETRDQSGKRHPYMCKGGHAGAHDSHPSPCGGPGEVLPRCPRNWLRASASKGIH

SEQ ID NO: 159772 - protein, 253 aa, Glycine max
  Coding DNA Sequence Number=SeqID_42994
MQRPTWSSASFVEGSMSVDRDYFSLPFVSQRRTSTLTCRDQHETIKSDDTQRPIWSSARFVKGTMFVDRDYFSLPFAIQGQATPMARGDKLWSPTTFAIQRQSSLRTRGDQRGHLLFPSKTQCLSTETTEVSPFTIQRRSNPIACRDYNGRSLSLFRHYQSPLSSRDKQVRWGVSFSTGPIRKQPARLGEHVASGGSLQLAWVSWAATSSPIFSINGRWGLRGRGSTPCVFRFHLKLVRRRRKKEKIMAEALP

SEQ ID NO: 159773 - protein, 92 aa, Glycine max
  Coding DNA Sequence Number=SeqID_42995
MPPPAQEEVPSLRSIPDRLQRIELQMHRAEAAEQDVLSLQPAPVKSGPQSFPLAHSRAVRGHGGLAWGRDRSRGGDEAQDNEDMVDMLDFLL

SEQ ID NO: 159774 - protein, 92 aa, Glycine max
  Coding DNA Sequence Number=SeqID_42996
MSGHRIRHLGSCSFNASLDFYLALYSNSSILEQDPTFLNSVVLSTNTDFQGEIPHRHWAPLVTPMANFDPEIVMEFYANAWPIEEGVHDMRS

SEQ ID NO: 159775 - protein, 185 aa, Glycine max
  Coding DNA Sequence Number=SeqID_42997
MEDILSSMLRHQRLLSSQLKKLFEHVEIMRLGVSHPQLVNCDICEGKHFNDSCHLYSMENYWWEQEIHPYNQYDEERLSNLENVLMQFIETSQDSFKANQNTIQNPESWEENLVEVKAHEESLAEEHDSRERDEEKKKKESSFPLSAGDTSSIGDDDATNVEADDDYVVDITDARTAWDPQPTQD

SEQ ID NO: 159776 - protein, 207 aa, Glycine max
  Coding DNA Sequence Number=SeqID_42998
MTPTPQPFVYEECGEIGHVVVGCPYTQALEEVNYVGGKSFTIMDINEDEEIPIILGQSILNTGGTLIDVRERKLTWRLGDEEEVFKVFGTVKSSFSPPSYNYKSLTRWKSLWLSLTQVWGRKTLPGTKSFQKTLDGVRTREITSPFMLLALEWVIIPKDRCKKARDVKQALPRRQLVGSIGISRPKVDYVFLQLSKSHADPTRPMVN

SEQ ID NO: 159777 - protein, 53 aa, Glycine max
  Coding DNA Sequence Number=SeqID_42999
MGGGEGGVRVWVAFGEEERILLSEIISLSGSPLFVLSATPSALSLAQCNSLSG

SEQ ID NO: 159778 - protein, 229 aa, Glycine max
  Coding DNA Sequence Number=SeqID_43000
  Gene Ontology: Mol. function=nucleic acid binding
YILCGTSRGYIYLGLTKNKRGYISCGSVLVEGTSTRFKENKGGYIPCGYLLVKGFLQDPYAHLATYIEICNTVRLAGNSLKTWDEVVEKFLKKYFPESKTAEGKAAISSFHQFVDESLSEALERFHGGKTKIKNPKEAMELIENMAANDHAILRDRAHIPTKRSLLKLSSQDALLAQNKLLSKQLEALTVTLSCVIYGGAHDSRCCIPIEDTTHEVNYMGNQPRPNFNA

SEQ ID NO: 159779 - protein, 101 aa, Glycine max
  Coding DNA Sequence Number=SeqID_43001
  Gene Ontology: Mol. function=DNA topoisomerase (ATP-hydrolyzing) activity; Cellular component=mitochondrion; Biological process=DNA unwinding during replication
  Homolog annotation: Hit_ID=Q5YLB5; Match level="QueryCoverage=98%, HitCoverage=10%, E-value=2e-38, Identity=77%"; Hit description=DNA gyrase subunit A, chloroplast/mitochondrial precursor
  Pfam annotation: Domain name=DNA_topoisoIV; Domain location=1-101; Score=-320.5; E_value=0.00039; Accession=PF00521.10; Description=DNA gyrasetopoisomerase IV, subunit A
DLTEAMLLTDLEQDTVDFVPNFDNSQKEPSLLPARLPTLLLNGSSGIAVGMATNIPPHNLGEVVDVLCVLIHNPEATLQELLEYMPGPDFPTGGLIMGNLG

SEQ ID NO: 159780 - protein, 46 aa, Glycine max
  Coding DNA Sequence Number=SeqID_43002
  Homolog annotation: Hit_ID=Q5YLB5; Match level="QueryCoverage=91%, HitCoverage=4%, E-value=1e-12, Identity=86%"; Hit description=DNA gyrase subunit A, chloroplast/mitochondrial precursor
MGLKELLQAFLDFRCSVVERRARFKLSQAQERRHIVEVLLKDLWAK

SEQ ID NO: 159781 - protein, 81 aa, Glycine max
  Coding DNA Sequence Number=SeqID_43003
MDFNIHLGSKFQPEIQSPKLKFTIDTIIRKPKSSRKGSQSKTLRILHEHCRNLPFGGRATRDSRDACSTKGIRAELPPTFI

SEQ ID NO: 159782 - protein, 251 aa, Glycine max
  Coding DNA Sequence Number=SeqID_43004
PLEEPAQEPLNIVLDLGLPVPKTPKVTPPPPQEMPAPEPVPQPKPKPPPKAEPKLPKKIIQSQRPDSPFKVPEPKPQPRQEQSQPTPAPPAEDFSSFIKRKQTDRNADEMAAKQINDAAAAAERGPSEDERRMKNILNNLKVGTNGLFQIRRMDPYNATFSFKGWVDDYTSANTQYFEVEARSGEDIRLVMIRRMIAIIREHYNGDFDWISNRLGRTVTLSARNGDNAALEDFLMREFFGNNYKSQDIYGR

SEQ ID NO: 159783 - protein, 107 aa, Glycine max
  Coding DNA Sequence Number=SeqID_43005
MHEQRLTINSWGYGLDGGGCMNDNQFMGLRIRFDGGSCMNRTWQSIGGAPDSMVRLAINSWGSGLDGGGCMNGYQFMGLRIRFDDGGSTNSARESIRGASDTMVEDT

SEQ ID NO: 159784 - protein, 129 aa, Glycine max
  Coding DNA Sequence Number=SeqID_43006
MDLIENMAAIDIAILRDRAHIPTKKSLLELTSQDALLAQNKLLSKQLEALTETLNSSMDSNTTNNRDNGGTILRINSIKTRGNHPQGHNNKGPSLYDHTTKLEDTLAQFMPVSKSNQKSTESAIKNLEV

SEQ ID NO: 159785 - protein, 97 aa, Glycine max
  Coding DNA Sequence Number=SeqID_43007
MRIFETGNVRFIENGEISKSTVPRDVEIEEVRVQVLLACVSSSKVIDPLVVVLNNNEEEQQNNEPMIHNKPIVEEPQEVSLRRSQREMCHGDVVEDK

SEQ ID NO: 159786 - protein, 49 aa, Glycine max
  Coding DNA Sequence Number=SeqID_43008
MVHDISVKVKLEVTGTSTALNVFGSRRRSDKWVYDPNMVGSWGKRKGHA

SEQ ID NO: 159787 - protein, 340 aa, Glycine max
  Coding DNA Sequence Number=SeqID_43009
  Gene Ontology: Cellular component=integral to membrane; Biological process=protein secretion
  Homolog annotation: Hit_ID=Q56886; Match level="QueryCoverage=76%, HitCoverage=77%, E-value=2e-85, Identity=61%"; Hit description =Flagellar biosynthetic protein flhB
  Pfam annotation: Domain name=Bac_export_2; Domain location=113-340; Score=-44.4; E_value=9.5e-11; Accession=PF01312.10; Description=FlhB HrpN YscU SpaS Family
AEPYGLHQRPAAGDHDGAGLPGSDRSGDQAHDGRGAGDRKAAADGADGKHAGAAGEGKTAKRQPAQRPAARPERRRRDRQPGADPAFPRTDLGTDAALGPGDHPDVRQQHGATAGGDAHAGLELRPRHGGAGAVANHGGAGAGGARRADAVGGHPVQRQVDQVRLETAEPVVRVEAHLFQPGAGRAAERDPESDAGRLGDRSLSVAQLGGDAASDDPAAARRAGQCAADDSVLRFSGGAGIDADGGDIRDEFKDQEGDPHVKGRIRQQQRAIARRRMMADVPKADVIVTNPTHYAVALQYNDKKMSAPKVLAKGAGEIALRIRELGAEHRIPMLEAPPLA

SEQ ID NO: 159788 - protein, 257 aa, Glycine max
  Coding DNA Sequence Number=SeqID_43010
  Pfam annotation: Domain name=Transposase_23; Domain location=3-66; Score=2.0; E_value=0.00069; Accession=PF03017.5; Description =TNP1ENSPM transposase
MGLYVQRQNTTVLVALGKICEGGSAIHNVTYADDVVRVSVDKVIEGDAEVPFPTSEIQYVKQALQTFIAWPTNLVKKVSHEESDTSPKKLPETDERGTNDFDHDPLRQLIKSLYFMYDTPVELKWDGSKFGLSNVDASFFLTFSDVNEIVAGYKCLNISILQLWMLFLDEWSSTLGHASVYGFLEPQSIHNAKDRRAECEHYLQAWLKESQREVYLGAYLNQGHWQLVVLCPATNVVAWFCSLRKKPDTHIKTAINK

SEQ ID NO: 159789 - protein, 78 aa, Glycine max
  Coding DNA Sequence Number=SeqID_43011
MLNSRQSLKSEIHRGKEHSKEAKFLSFRKICEFLSDCEVPRGGGDIPTPLGFSIERCIVSLELDRAGLGYRMSGHGVR

SEQ ID NO: 159790 - protein, 153 aa, Glycine max
  Coding DNA Sequence Number=SeqID_43012
MEQATIFLTSSGFLKNLLDGVVRLDYHLMTREVRLESLGQGNEWAELITSSISERYKSKGALGLDRLKDGSVVMVFLKARKAWMLAYVELLNFLYVGWAMHHPYDSAFVGDFFLVRHMLGVCIFGACPVQFNVVDAHAPFAVGLFDHDDIGEL

SEQ ID NO: 159791 - protein, 121 aa, Glycine max
  Coding DNA Sequence Number=SeqID_43013
  Gene Ontology: Mol. function=RNA-directed DNA polymerase activity; Biological process=RNA-dependent DNA replication
  Homolog annotation: Hit_ID=Q1SKJ4; Match level="QueryCoverage=93%, HitCoverage=19%, E-value=1e-19, Identity=38%"; Hit description=RNA -directed DNA polymerase
MGNQCTDDLGKYLRVPIFHKKVSRGTFQLIMDEVHQRVTLAKSVLQALPFHMMQITLLPKAVCDDIDKACHRFILGDIDNGKKIHLVTWDTVFSPKDKGSLCLRKARDVNMAFMFRANWRF

SEQ ID NO: 159792 - protein, 134 aa, Glycine max
  Coding DNA Sequence Number=SeqID_43014
MVQLISDTIYCLQESHPQRHPVDPEKSNRALRFPALVTGLCSPTGCPFPPARSRHHRDRACKTPSEPEEFYGVLVTSGKGIRPPTNRAFVKKYCVPRQAQGETPQQPLWIFACKRIFTRLKRNLKDRRSLGDWM

SEQ ID NO: 159793 - protein, 55 aa, Glycine max
  Coding DNA Sequence Number=SeqID_43015
ECLELKLSSHGRKVEKFDRPALEIGGLVAATGLSHLIACSLDTGDQGLISAFAER

SEQ ID NO: 159794 - protein, 112 aa, Glycine max
  Coding DNA Sequence Number=SeqID_43016
  Homolog annotation: Hit_ID=Q1T0Y0; Match level="QueryCoverage=60%, HitCoverage=7%, E-value=5e-09, Identity=44%"; Hit description =Ovarian tumour, otubain
MVKLMCGSHNHELAKSLVGHPYVGRLTKDQKIIIADMTKSMVKLRNILLTLKEYNVNSYTTIKQVYNARNSYHFSIRGDDDKGDDKKLKDQSRTIQEFKIRIKKNSRLKKKV

SEQ ID NO: 159795 - protein, 106 aa, Glycine max
  Coding DNA Sequence Number=SeqID_43017
PKRSLSQRLCETESNMLAIVQQVPRKELNLTTAHEHKVANEYARVYAKKDARGRVIDSLHQEATMWMDRFALTMNGSQELPQLLAKAKAMADTYSAPVEIHDFSAI

SEQ ID NO: 159796 - protein, 257 aa, Glycine max
  Coding DNA Sequence Number=SeqID_43018
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=7e-29, Identity=29%"; Hit description= UPI00006A17C9 related cluster
GLHALTSRGLHILALRGLHALTFRGLHVVANRGLHALTLRGLHVLANRGLHVLTLRGLHVLANRGLHALTFRGLHVVANRGLHALTLERATRPRQQRTACPHLERITRRRLDRTTRPHHQRAALPHLIFRGLHVLTLRGLRALSFVGLHALTFRGLHVLTFRGLRALTFVGLHALTIRGLHVLTLRGLHPLAIRGPHVLTFVGLHALTFRGPHVLTFRGLHALAIRGLHVLTSVGLHALTFRGLNVLTNRGLHALTL

SEQ ID NO: 159797 - protein, 63 aa, Glycine max
  Coding DNA Sequence Number=SeqID_43019
MECLEGAWETLEGNARCRFRGTIRLTATSLVHPEEPARTLQRTVTSFEEDPEEDPEELPLQPA

SEQ ID NO: 159798 - protein, 55 aa, Glycine max
  Coding DNA Sequence Number=SeqID_43020
MPDGRLIEKNAAEKDDRKTTIGDIGRQIQPTDIRRETSSKIIYQERLFFGRHCAK

SEQ ID NO: 159799 - protein, 79 aa, Glycine max
  Coding DNA Sequence Number=SeqID_43021
  Gene Ontology: Mol. function=RNA-directed DNA polymerase activity; Biological process=RNA-dependent DNA replication
EDAPASLMPPSHRRVGCDNRFPLNPGCSPVKQKLRRMKPEMSLKIKEEVRKQFDAGFLAVARYPEWVANIVPIPKKDGK

SEQ ID NO: 159800 - protein, 176 aa, Glycine max
  Coding DNA Sequence Number=SeqID_43022
MVKRKVIHTRRPNQLALLCLLGSFYCLTNTEHAYTNPLKNLRIARHGKFGENSARSSVLAWVYRPTKPRPNDFGRKPIELVQPSRPNSIQARLIPLVQPNSAEGSSANTAEFGASRTFLDGSANMIQASQALQVQPNFTQHVPYSHSWPNQVHPPLPINCLLESLFGGLESKNTCS

SEQ ID NO: 159801 - protein, 217 aa, Glycine max
  Coding DNA Sequence Number=SeqID_43023
MPISPTEVSVGLCCRDIGKDRAHKTPNGPGEVQQGPGVSSSGYGPLSVLQGARPPQQGITPTRHSVGPEKFNRVLGFPALITSLCQFYRVPVAPSRVIRPLLTGLSSRSTAPPSRRRARHHSSGQQTHRHHLQSSPQLIHKKAGALPTTHGRLACDQVQSQRSSPRSGPGRAPLKRIPVWPHKPTQALTNTDSKAWNISSISRPLRDGHSSYRDRGS

SEQ ID NO: 159802 - protein, 107 aa, Glycine max
  Coding DNA Sequence Number=SeqID_43024
MGRVPPATVEREKFDHIEERLRAIEGGGDYTFADMIELCLVPHVIIPPKFKVPDFDKYKGTACPKNHLKMYYRKMGAYEKDEKLLMHFFQESLTGAAITWYTNLELS

SEQ ID NO: 159803 - protein, 199 aa, Glycine max
  Coding DNA Sequence Number=SeqID_43025
TPGISKRLTKGCMSTSNNPRTKLGYDMIDGRFSTKSAYDLLACPDVQSDPSLRNCLWKIPGRPTTRDFPENKYRHIRGMAEHNDWPLCDLEPESELHLRPNVFNMDLATWVELNITLKGVMGVQDNVSQRALRGRARARLTGALSKEGKMRGVATNEGISTSYVDKSGAFAPTYPPLERKSDLRSSFLSVNQAILLLEE

SEQ ID NO: 159804 - protein, 61 aa, Glycine max
  Coding DNA Sequence Number=SeqID_43026
MPWRLLIVLECLLCNRCAYSCMTQRMSTCTLSSAYCATFRLNDRLLCPGLVQRLNTEWLPM

SEQ ID NO: 159805 - protein, 173 aa, Glycine max
  Coding DNA Sequence Number=SeqID_43027
  Homolog annotation: Hit_ID=Q9FGN7; Match level="QueryCoverage=50%, HitCoverage=15%, E-value=9e-17, Identity=61%"; Hit description =Arabidopsis thaliana genomic DNA, chromosome 5, P1 clone:MFG13
  Subcellular localization annotation: CTP_CleavageSite=24; ConfidenceScore=5.37e-01
MSPPHVCSFPPRSTPWRKSDVGSRATRLDGSGGGGAMGTRRVPPEERGNRESSEVPQSHMLKRCVVFPIIEQLLLKSIPFCFELKCRAYSLLNQCYHLVGAIPLQKQVLHKGLELIASIGYETRRKVALRNIRRDALKAYDKLEKVDKSGAFAPTYPPSKRKSDLRSSFLRVN

SEQ ID NO: 159806 - protein, 98 aa, Glycine max
  Coding DNA Sequence Number=SeqID_43028
  Gene Ontology: Mol. function=structural constituent of ribosome; Cellular component=large ribosomal subunit; Biological process =translation
  Homolog annotation: Hit_ID=Q1H160; Match level="QueryCoverage=59%, HitCoverage=100%, E-value=4e-27, Identity=89%"; Hit description =Ribosomal protein L32
  Pfam annotation: Domain name=Ribosomal_L32p; Domain location=41-95; Score=67.8; E_value=3.5e-17; Accession=PF01783.13; Description =Ribosomal L32p protein family
MALPIAVMHEEACADLQQSAGEKPNPFAVLKQLKLDNNNMAVQQNKKTPSKRGMHRSHDFLTNPPLAIEPTTGEVHLRHHVSPNGFYRGRKVMPAKGE

SEQ ID NO: 159807 - protein, 108 aa, Glycine max
  Coding DNA Sequence Number=SeqID_43029
IKWESTTSEKQLLVLVQWSGLFLEDTSWEKWENLTKDYNLKDKVVLEARGDVMNEKQNTKQYVPTKHYAELNEDDATITEHEAEPREEDKRPKRESNRPRYLEDYVAK

SEQ ID NO: 159808 - protein, 98 aa, Glycine max
  Coding DNA Sequence Number=SeqID_43030
MFSQAADAPPPHQAGPTGSFDTEQYLRHLLSLSLQSQGFTSFPCPTPDQFRADVAWPGDWPEARAGETPAEAPDEADEAREDEEMTDLLDFLGGSGAT

SEQ ID NO: 159809 - protein, 134 aa, Glycine max
  Coding DNA Sequence Number=SeqID_43031
MCEKEHKSFKGYAQRWRDMAAQVAPPMTEREMITMIVDTLPVFYYEKMVVYTPSSFTDLVFTGERIELSLAHQWAKRASITKCNFSALSATEDSGRASISRSRIKREISVLSAVVVFSQAQRTTGTKLKSTYLR

SEQ ID NO: 159810 - protein, 199 aa, Glycine max
  Coding DNA Sequence Number=SeqID_43032
MVPDRTCSRLPICDEGKRRTSSCTSTLKCPIENIKFNWSIIKLPKEKFEARVMHFFEQQKPNRAIYEQKWKDMLEAKQRKKAKTKKNPEEDVAMIQNIIVDLEQSGAMEIGQEMDASILDLVAKEPIHETNQVVHSHEVTSTQQEIVVYSTSSSNPKEVAPINYVDPIVVTEERILEMLTQALLKKKEETQQKLKVFAK

SEQ ID NO: 159811 - protein, 57 aa, Glycine max
  Coding DNA Sequence Number=SeqID_43033
MKNEEFSKVQGMLRIRKEASTYLRIADVELQGMLELVVVIKPNSSSSCGFSGVEQDM

SEQ ID NO: 159812 - protein, 67 aa, Glycine max
  Coding DNA Sequence Number=SeqID_43034
  Subcellular localization annotation: CTP_CleavageSite=41; ConfidenceScore=5.02e-01
MPLFRLARHAESPHVAIGTGGTCQRGQSRHWRLRNTVSFVVCFLLCAPWFKFGAWLPFLQVCAHPYL

SEQ ID NO: 159813 - protein, 88 aa, Glycine max
  Coding DNA Sequence Number=SeqID_43035
MLDIPGGRNIVESLITHGQCIDGAHVSYFILHGNSINIVIFLSESVVRTCLGYFLTNGTTLHFRVEVKSACFILSMIDWNYGRMMTTC

SEQ ID NO: 159814 - protein, 291 aa, Glycine max
  Coding DNA Sequence Number=SeqID_43036
  Pfam annotation: Domain name=DUF740; Domain location=2-291; Score= -141.1; E_value=0.0093; Accession=PF05340.3; Description=Protein of unknown function (DUF740)
  Subcellular localization annotation: CTP_CleavageSite=32; ConfidenceScore=5.21e-01
MNPPQPPQPHRPSTSCPRHPDEAFTGFCPSCLCERLALLDPNNNPSTANSSSSSSWKPASTAAALKALFRPPSLPELRRTKSFSASKNEPFSSFEPQRKSCDVRVRNTLSNLFHQDITIHINPPRVVEPHPQQNDNPPRVLDQPEQQEEEGEEEEEEEEDREEIRVLEEPEPKPYVNEIEELEVEILKQKEKEEELVAIVKEEDEGLKTMKDHIDLNSSQNNKQQKARDFKELAGSFFSAASVFSKKLQKWRQKQKAKKRRSGGALPVEKPIGRQFRDTQSEIADYGFGRR

SEQ ID NO: 159815 - protein, 344 aa, Glycine max
  Coding DNA Sequence Number=SeqID_43037
MSFDDPRYSIDEPRASWDGYLVGRSAFPRMPTMLSVVEDAPVPVPVAVNHVVRTDMQIPVEEGSNEDESVPGGSAQTREYYDSGSRRRKSLDRSSSARKSISLEVDELGNNGNENGNGNGNGNAKVAPAGVDYVQGVRMGFNDREFGSNSMREDCCSDKMFDVGVIGNGKGGKKGRRWRWSIWGFIHRRGGNKDGDEDRYSRVNGVERSYSESWGGGGSGFNGRMLRSNSSVSWRNVQGIGNGGGSGGGFGGFRRNGVQSNGNGKKGKDELVLERNRSARYSPNNIDNGLLRKSSNGWNLKIKTLAFGLTETVNSGVDIRRVVNRNKTTVKEYIGVRVQKAGPP

SEQ ID NO: 159816 - protein, 167 aa, Glycine max
  Coding DNA Sequence Number=SeqID_43038
  Pfam annotation: Domain name=Transposase_23; Domain location=82-152; Score=-7.6; E_value=0.0078; Accession=PF03017.5; Description =TNP1ENSPM transposase
TRRDPSWKDVRKKAQAIQKQNTGPQVSSNTLDWLHGRPGPATGVHHRKRDATAHGIVQPDVVPDSVPGTCTASRASGNDPETGDLDRCGLYIEADPNCLVALGRVYEGSTIVHNTPLLPGQVKVGVEEVTDADAPVPVSTDEVSLVGQAIHTFLAWPILLVKSLSQQ

SEQ ID NO: 159817 - protein, 166 aa, Glycine max
  Coding DNA Sequence Number=SeqID_43039
  Homolog annotation: Hit_ID=Q1T493; Match level="QueryCoverage=97%, HitCoverage=33%, E-value=1e-14, Identity=31%"; Hit description =Nucleic acid-binding, OB-fold, subgroup
MDLKENCTYVMHNFEVLKNNDQYRVYDHQFKLVFIGVIVVRQCVLDDLPFRKYSKFEPGLLVDVNGVVEEVVFHHVSGKGRRVVFKPKDLSQQLLSCTLWDDYCLQFLKDIPNYKVLLTHGRIKEAQGSYPPSVSNSFKASKLVINQPVMEIQEFIERLAELGIEA

SEQ ID NO: 159818 - protein, 48 aa, Glycine max
  Coding DNA Sequence Number=SeqID_43040
MTRAELITSSITERYKSKGALGLDRLKDGSVVMVFLKARKACSQVSFH

SEQ ID NO: 159819 - protein, 87 aa, Glycine max
  Coding DNA Sequence Number=SeqID_43041
MEDESSETTTPEPLVRRKKTDQTQEAAATSEKSLEATYEPSEPVADTASVQQTVDPFTPEDHTRPVLSLSTSHTATLVLHLTDEEDV

SEQ ID NO: 159820 - protein, 56 aa, Glycine max
  Coding DNA Sequence Number=SeqID_43042
MWDLGISQYTPFMPNTYWAWCVNIKWWVLVAAEAKARSQDIEVGKPPLMLVSPQRI

SEQ ID NO: 159821 - protein, 264 aa, Glycine max
  Coding DNA Sequence Number=SeqID_43043
  Gene Ontology: Mol. function=serine-type peptidase activity; Cellular component=membrane; Biological process=proteolysis
  Homolog annotation: Hit_ID=Q4AI98; Match level="QueryCoverage=97%, HitCoverage=46%, E-value=2e-80, Identity=55%"; Hit description =Probable acylaminoacyl-peptidase
  Pfam annotation: Domain name=Peptidase_S9; Domain location=110-263; Score=-59.1; E_value=0.0019; Accession=PF00326.11; Description =Prolyl oligopeptidase family
MENVWGYRSIQKAKNAEEYILVKESYTESPDIFATSDFLEQQKLSNTNPQQALYNWGTNELVNWTTPKGNSSTGVLYKPEDFNPNKKYPMIVYFYEKLSDNLNRYVAPAPTPSRLNISYFVSNGYLVFTPDISYTDGFPGESAMEYINSGVEKLKQNSWVDGTKIGIQGQSWGGYQVAYLIAHTDMYAAAWSGAPVVNMTSAYGGIRWTSGMNRQFQYEKSQSRLGKNLWEAPDLYIKNSPLFTINKVKTPVVIMSNDKDGAVP

SEQ ID NO: 159822 - protein, 136 aa, Glycine max
  Coding DNA Sequence Number=SeqID_43044
MHDEEIIRYASGKYHMKPQEFNKMKPSKVSYQNIKHKMKFSNQELPVLTNEFHYPRVPLLTIASPSRKGYTVFVLLSGPHKGVYTNFKDLYLAKKGIQSPTYKGFYSREEAEKVLELNITNINKIKKALEPEPMDV

SEQ ID NO: 159823 - protein, 109 aa, Glycine max
  Coding DNA Sequence Number=SeqID_43045
MAKKRGFPLAERLKLWISSQESSKTWCVLPFCFLLQTLMGCLKSQLVSFLVSSSSKENLSKNLKEVLQLLQQEEDEGSSSKKKDTNSSEDDDPFYQNEEDCFGISLNND

SEQ ID NO: 159824 - protein, 143 aa, Glycine max
  Coding DNA Sequence Number=SeqID_43046
MAPRKLSAKRSRKDKAAEGTSAAPEYDSHRFRSAEHQQHFEAIKGCSPAMDIAGYLHGQVRPRHSPGILCQCLAYTRGRARYVILGEGDDEYTDFQEEIARRRWTSLVTSMAKGQWIPFDADALSQFLGYPLVLEEGQECEYG

SEQ ID NO: 159825 - protein, 118 aa, Glycine max
  Coding DNA Sequence Number=SeqID_43047
  Homolog annotation: Hit_ID=Q1SE10; Match level="QueryCoverage=37%, HitCoverage=4%, E-value=5e-08, Identity=70%"; Hit description=CHASE; Lantibiotic regulatory protein
MALHTNSTNAPTKIMQALKAAPERKKRRNLREREKFVNTLQQELDTLENKKEDFIGDFSEVASESYDQVTLMVSVEDIGIGIPFSAQDRIFMSFVEFLGEAELIKIKAQELKGKEVSD

SEQ ID NO: 159826 - protein, 44 aa, Glycine max
  Coding DNA Sequence Number=SeqID_43048
MEDNLPSTVLDGTVVGIKFGMATRQEIWQLATPCTQATNQAMLK

SEQ ID NO: 159827 - protein, 153 aa, Glycine max
  Coding DNA Sequence Number=SeqID_43049
MGNENNEQVQKTPQWRTDNGDQWRTATELAAQFEPHTRVKEVRMKLATAFGMKEEMMNVYSVMRIQTNMHRLSSSPSKLRLCDSISLYSLIATMTPHHRTQSEREGEDYRRKWWLIQVVTSEQRMGDIRYTFWSYGHTWSYPQVAKQTMLRTS

SEQ ID NO: 159828 - protein, 67 aa, Glycine max
  Coding DNA Sequence Number=SeqID_43050
MSKADETAKTMNRSTIAMFMVADDVIELARIEPLLVEKKRKMRRIVRMQKTFKMNVCHAFPDKTAIN

SEQ ID NO: 159829 - protein, 89 aa, Glycine max
  Coding DNA Sequence Number=SeqID_43051
  Homolog annotation: Hit_ID=P37615; Match level="QueryCoverage=96%, HitCoverage=73%, E-value=9e-31, Identity=73%"; Hit description =Hypothetical protein yhhM
MDNDAAPLLQKRVVVSNKREKVINDRRSRQQTVTPAGSEMRYEASFRPENGGLEVVFRLDAPQYHALSVGDRGMLSYKGSKFVEFVADN

SEQ ID NO: 159830 - protein, 180 aa, Glycine max
  Coding DNA Sequence Number=SeqID_43052
MGSSQKPSFKKRFYQVKIKSLEVTSLRELGQLMGQLQRQAFRKAYGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESGFYLHAKDVQMFP

SEQ ID NO: 159831 - protein, 235 aa, Glycine max
  Coding DNA Sequence Number=SeqID_43053
MVKGTTSGSGKVLVKKAGTSYAKTDDVTHQVFDNFSECSADFESFPKVSCTLGDNDSTTDDDSSHSYGSKSSPQLDDNKAPTPWVNLFKDNRNPSKGFGMKFSSPPSDDEVLLEETDLQPLGEAWGHSLIGYVAGRFPGKKALLDCCQKWGVKLSYSAHESGWLVFKFESENDLNQVLSAGPYFIFQIPLLLKIMSAFFDFGYEELSKIPVWVKLKNLSLELWNPQALGKILSKI

SEQ ID NO: 159832 - protein, 330 aa, Glycine max
  Coding DNA Sequence Number=SeqID_43054
MVLKQQSCLEIVDSMEFVESNPLFQNPKSMSYFVLLLQLGVGLAFGGLICKDKSAFFGGGGGGEWEGVGMDEDGGEGTLKMGEMGCEYTSQPTAFKTNRPELLSGGGCASKGRMGVVPQLQNMSVGCERMGSIAEILIEALVRLKEFNGHEGLHSKFNGDDVFMLEESLLITHTTLVTEIKEIKEKQQKQDDIFQSITVGNKQPLIPHLVLNAGSTLTDEEAARDLEFLDHIVHSFHVSLGLWLSTNLLLGEFLVDATMFEDKKEISHVVYKETGKASEVEVKDVKLNHPKESKVKFVSKGSNAAKTKKKSMLPTSKASPISAPKSSKPA

SEQ ID NO: 159833 - protein, 64 aa, Glycine max
  Coding DNA Sequence Number=SeqID_43055
VHCEGCQGMAQDLGAIVEDLERVINLRMVTEGTNLHEIMTHCPRRARGDAVDESLRPCQRRRID

SEQ ID NO: 159834 - protein, 79 aa, Glycine max
  Coding DNA Sequence Number=SeqID_43056
  Gene Ontology: Mol. function=translation elongation factor activity; Cellular component=intracellular; Biological process=translational termination
  Homolog annotation: Hit_ID=Q40581; Match level="QueryCoverage=95%, HitCoverage=14%, E-value=2e-22, Identity=71%"; Hit description=EF-1 -alpha-related GTP-binding protein
MGLVYLRPLMLLKFHHDPSGPFRMPIIDRVKDMGAVVMGKVESGTVRVGDSLLLMPNKDQVKVVAIFIDEDRVKCAGVS

SEQ ID NO: 159835 - protein, 562 aa, Glycine max
  Coding DNA Sequence Number=SeqID_43057
  Gene Ontology: Mol. function=binding
  Homolog annotation: Hit_ID=Q7EY18; Match level="QueryCoverage=99%, HitCoverage=32%, E-value=1e-162, Identity=49%"; Hit description =Putative tetratricopeptide repeat(TPR)-containing protein
MAPRNSRGKPKGEKKKKEEKVLPVVIDITVKLLDETHVLKVRGPRLKDTVDVSALKPCLLTLVEEDYDEDRAVAHVRRLLDIVACTTSFGPSSLPPPKNDSGTVPKSGKPEAPPAKQSAKDAEAAAATVDIEGEISHSCPKLENFYEFFSLSHLTAPIQYVKRGSRRRVEEILEEDYLFSLDVKVCNGKVVHVEACRKGFYSVGKQRILCHNLVDLLRQLSRAFDNAFDDLLKAFSERNKFGNLPYGFRANTWLVPPVAAQSPSYFPPLPVEDEMWGGNGGGLGRDGKYDLVPWANEFSFIASMPCKTAEERQVRDRKAFLLHSLFVDVAIFRAIKAIKHVMEEPNFSCSVVENNIIYTERVGDLNINVLKDGSVASCKIDTKIDGVEATGVNQKDLLERNLMKGITADENTAAHDITTLGVINVRYCGYVVVVKVEGGVNENVDSPSQQNIELFDQPEGGANALNINSLRLLLHNTTSPENNKPVSQIQTFESEELGASHAFVEKLIKENLAKLEEEEPGIDYFVRWELGACWVQHLQDQNNTEKDKKPSSEKAKNEMKVE

SEQ ID NO: 159836 - protein, 131 aa, Glycine max
  Coding DNA Sequence Number=SeqID_43058
  Gene Ontology: Mol. function=GTPase activity; Cellular component =intracellular; Biological process=translation
  Homolog annotation: Hit_ID=Q41137; Match level="QueryCoverage=81%, HitCoverage=75%, E-value=1e-24, Identity=60%"; Hit description =Eukaryotic release factor 3
  Pfam annotation: Domain name=GTP_EFTU_D3; Domain location=27-131; Score=64.0; E_value=4.8e-16; Accession=PF03143.7; Description =Elongation factor Tu C-terminal domain
MADSNMTAMLILYICALWGFPFAANPIPALTEFVAQLVIPHPQHLDGTRLFCTSTVVEECEIVELLQQIDTKTKKPLKKKVLFVKNGAVVVYHVQVNNSICIEKFSDFPQLGRFTLRTEGKTVAVGKVTGL

SEQ ID NO: 159837 - protein, 48 aa, Glycine max
  Coding DNA Sequence Number=SeqID_43059
  Homolog annotation: Hit_ID=Q40581; Match level="QueryCoverage=77%, HitCoverage=7%, E-value=9e-12, Identity=86%"; Hit description=EF-1 -alpha-related GTP-binding protein
MEGCMAYILNTNEEERVKGKTVEVGKAHFETETTRFTILDAPVSICIA

SEQ ID NO: 159838 - protein, 734 aa, Glycine max
  Coding DNA Sequence Number=SeqID_43060
  Gene Ontology: Mol. function=DNA binding; Cellular component=beta -galactosidase complex; Biological process=DNA integration
  Homolog annotation: Hit_ID=Q1SDN3; Match level="QueryCoverage=98%, HitCoverage=54%, E-value=0.0, Identity=54%"; Hit description =Polynucleotidyl transferase, Ribonuclease H fold
  Subcellular localization annotation: CTP_CleavageSite=52; ConfidenceScore=5.19e-01
MIKVFGCLCYASTHNQTQKFQPRSRKGAFLGFQNGTKGYVVLDINTREIFISRNVVFHESFFPFHTNQNLSTSEAQPHSHIDPISHTLHIDPISHTLPTPPQFTPSTPITTNTQPIIPQPNGSPSPFPNPSTPPTIDTPNPNIIDQHIQESPSNHALPRRSNRDTHPPSYLSDYQFQIPSLKSTQSSSTCTYPIQSFLSYTHVSPSHRHFLMTLSSEHEPTSFHEAVKHQCWCDAMKCEIKALQLNQTWDIVQTPSHVRPIGCKWVYKIKRLPNGSIERHKARLVAKGYSQIEDIHYFETFSPVVKMATVRVVLALASINRWHLHQLHVSNAFLHGDLREDVYMEIPPGLLGYTSSQSCKLKKSLYGLKQSNRQCLFIKAHNFEFTALIVYVDDIVLIGNSFAEIECIKHILQTNFHIKDLGKLKYFLGIEVAHFDKGISLCQRKYCLDLLKDSGMLGCKPSSTPMDSSLRLHNDSSGFLNDPLSYRRLVGRLVYLTSTRPDIAFATQQLSQFMSKPTKAHHAAAIRVLRYLKGCPGKGLFFPRTCSPHLLGFSDADWATCIDSRRSITGYCFFIGNSLVSWKTKKQTTVSRSSSEAEYRALASATFELQWLSYLLRDLRIPFSKTPILYCDNHSALHIAANPVFHERTKHLDIDCHLVHEKSQVGLMLLLPVPSSNQLADIFTKALPPQSFNTNLSKLQLQNIFAPLACGGLIEETYNPSLNKETYNPNLNAT

SEQ ID NO: 159839 - protein, 72 aa, Glycine max
  Coding DNA Sequence Number=SeqID_43061
MKEGGDRGVARVEEEELLGGDDGLDVLQVDNDGPLMAQNSMDAVGAKRVRGEESMRFSSIIGYMLEVRDAKG

SEQ ID NO: 159840 - protein, 299 aa, Glycine max
  Coding DNA Sequence Number=SeqID_43062
  Gene Ontology: Mol. function=transferase activity; Cellular component= integral to membrane; Biological process=biosynthetic process
  Homolog annotation: Hit_ID=Q2QN13; Match level="QueryCoverage=89%, HitCoverage=93%, E-value=1e-67, Identity=65%"; Hit description =Glycosyl transferase, group 1 family protein, expressed
  Pfam annotation: Domain name=Glycos_transf_1; Domain location=92-273; Score=82.3; E_value=1.6e-21; Accession=PF00534.10; Description =Glycosyl transferases group 1
MMIITALITAIIAGLCIGPINGRRRRKRAVGFFHPYTNDGGGGERVLWCAVRGIQEESPDLDCYVYTGDHDATPQSLMARALDRFGVTLLSSPKVLPLERSAEIPVLISVAQFRPEKAHTLQLEAFSAAIKRLDPTLPKPKFQIVGSCRNKSDEDRLQMLKEKAIELNVNEHVEFHKNVTYRDLVGLLGGAVAGIHSMTDEHFGISVVEYMAAGAIPIAHNSAGPKMDIVLDEDGQQTGFLACTVEEYADAMVRIVSMSEMERLKMAAAARRQARRFSEQRFYDDFKAAVRPILSHTSR

SEQ ID NO: 159841 - protein, 217 aa, Glycine max
  Coding DNA Sequence Number=SeqID_43063
  Gene Ontology: Mol. function=ion channel activity; Cellular component= integral to membrane; Biological process=ion transport
  Homolog annotation: Hit_ID=Q8H6U3; Match level="QueryCoverage=94%, HitCoverage=60%, E-value=6e-67, Identity=59%"; Hit description =Cyclic nucleotide-gated channel A
  Pfam annotation: Domain name=cNMP_binding; Domain location=19-119; Score=20.3; E_value=0.0038; Accession=PF00027.19; Description=Cyclic nucleotide-binding domain
MFEDMDNQLSDALCDKLKPILYTEKSYIVREGDPVDEMLFIMRGKLATATTNGGRTGFFNSFEIKAGDFCGEELLTRALDPNSSSNLPISTRTAETISEVEAFALMPDDLRFYSLQWKTWGACFIQAAWHRYKKKKAEKLAREAEERIQALENEEGSSPSFAATVYASRFASSVLCHLRSGKRSRVPQPKRLLPLMPQKPAEPDFSAYICRHSNSSV

SEQ ID NO: 159842 - protein, 603 aa, Glycine max
  Coding DNA Sequence Number=SeqID_43064
  Homolog annotation: Hit_ID=Q1PFR9; Match level="QueryCoverage=47%, HitCoverage=96%, E-value=1e-52, Identity=42%"; Hit description=Zinc finger family protein
  Pfam annotation: Domain name=F-box; Domain location=42-89; Score =22.8; E_value=0.0012; Accession=PF00646.23; Description=F-box domain
  Pfam annotation: Domain name=zf-C3HC4; Domain location=546-587; Score= 34.1; E_value=4.9e-07; Accession=PF00097.15; Description=Zinc finger, C3HC4 type (RING finger)
  Pfam module annotation: Pfam domain module=F-box::zf-C3HC4; Domain location=42-89::546-587
MGKRLQNATSSGGEIPPEKRIRRSKTICSCNSPRPPFLSAHSTFSWFEEDIWTEIAKFLDGKSLVMLAATSRWFRRAIMDDGIWKFVCLRDLQVPPPECVAFRWCKLYTSTFAVLAERLILPGKIRNGETMEKMLRSQGCCVLDNVKTGIWIADLQLVRCPVCDLNTCDGTMQTLDARHIELFLCEGFQNGSWDYQLVGSRDIKKRADGAAGAIFDMKHLKDSSTSVHKEITFCLALWNQKAVFDYKSWIGRANDWQPKAMIAFHAVAVNTNLQENEGLHVKYHAMRAGADGEVVSIRISQQLLINYLTQKIQVYDPDDCLPKRLLSLNISGSPFIPTFTRDYTFLSCPFQNAGSQFIPIDCLSNSTSFVSAIPTLSLINPLNESCYVITRVSVPVSGPEQQYEKNFRDELIEDLRLTWDTPDCKYCESRQQLCGFDPNNNGQLFCFSGYQTGTSRRGTQVFRIITLCIAGPAAVFAIVMACCVCYKDRLANIRNSAITRSAPAATISPEPQITTTGLDESTIESYEKVVLGESRRVPGPNNNGCCWICLSEYNSKETIRLIPECKHCFHADCIDEWLRINTTCPVCRNSPSPSPIHVTSIDP

SEQ ID NO: 159843 - protein, 78 aa, Glycine max
  Coding DNA Sequence Number=SeqID_43065
  Gene Ontology: Mol. function=ion channel activity; Cellular component= integral to membrane; Biological process=ion transport
  Homolog annotation: Hit_ID=Q8H6U3; Match level="QueryCoverage=91%, HitCoverage=26%, E-value=7e-13, Identity=56%"; Hit description =Cyclic nucleotide-gated channel A
  Subcellular localization annotation: CTP_CleavageSite=49; ConfidenceScore=5.29e-01
MLIFPGSIPRDGGNGQHVSFKHLGADTRKSRLRAKFASNALRHLPSGKRNNRVPKPRRLLPLMPQKPAEPDFTAQKNH

SEQ ID NO: 159844 - protein, 607 aa, Glycine max
  Coding DNA Sequence Number=SeqID_43066
  Gene Ontology: Mol. function=ion channel activity; Cellular component= integral to membrane; Biological process=ion transport
  Homolog annotation: Hit_ID=Q9LD40; Match level="QueryCoverage=92%, HitCoverage=83%, E-value=0.0, Identity=63%"; Hit description =Putative cyclic nucleotide-gated ion channel 13
  Pfam annotation: Domain name=Ion_trans; Domain location=111-380; Score=56.2; E_value=1e-13; Accession=PF00520.21; Description=Ion transport protein
  Pfam annotation: Domain name=cNMP_binding; Domain location=481-581; Score=30.5; E_value=5.7e-06; Accession=PF00027.19; Description =Cyclic nucleotide-binding domain
  Pfam module annotation: Pfam domain module=Ion_trans::cNMP_binding; Domain location=111-380::481-581
MTAKEKKFVRLDWKSLSSSSIEHNDSSNDGFLKRKVRPSLSSLIDGSITNSSCQSHVLDPQGATLQKWNKIFVITSVMAVSVDPLFFYIPMIDDKKQCLALDGTLKITASVLRTFFDLFYILHIIFQFRTGFIAPSSRVLGRGELVNDPWAIVMRYLSSYFIIDILSIIPLPQMVILATVSIPKCSVPYVGKDLLKYTIITQYVPRLLRIYPLFKEVTRTSGILTETAWAGAAFNLFLYMLASHVVGAFWYLFSVESRLRCWRRQLKTTMIFHESYLSCGRNNPIVLSLLKYSCPYIDPESIENLATFNFGMFVEALKSRVVESTTDFTHKFFYCFWWGLRSVSSVGQGLETSSYVGEIIFAILIAVFGLVLFASLIANMQKYLQSTSVRVEEMRVKRRDAELWMSHRMLPDLLKERIRRYEQYKWQENKGAEEETLIRNLPKDLRRDIKRHLCLELLRKVPMFEDMDNQLLDALCDRLKPVLYTEKSYIVREGDPVDEMLFIMRGKLATATTNGGRTGFFNSFEIKAGDFCGEELLTWALDPNSSSNLPISTRTVQTISTVEAFALMSDDLMFVASQFRRLLNSKQLQHTFRCCRNYILVTSLIMF

SEQ ID NO: 159845 - protein, 90 aa, Glycine max
  Coding DNA Sequence Number=SeqID_43067
  Homolog annotation: Hit_ID=Q9SKD8; Match level="QueryCoverage=76%, HitCoverage=14%, E-value=2e-11, Identity=72%"; Hit description =Expressed protein
MGYDLGALGNYPGSPFLPSDSDILLESPDQQDIGYYETLQNLLKRGKTETEGKWMTSLLILSPHALNRMRRNLEVRRVACFTLIVRLGKN

SEQ ID NO: 159846 - protein, 92 aa, Glycine max
  Coding DNA Sequence Number=SeqID_43068
MGNSFLFLFFPIFLLPLPLFPFWPNLLSRRSMKKQLKWHQVKQPLIALRICDREQSRKITQTYPQLEPPNRAKPPNFDSFQIWNHACFRIPT

SEQ ID NO: 159847 - protein, 171 aa, Glycine max
  Coding DNA Sequence Number=SeqID_43069
  Gene Ontology: Cellular component=microtubule
  Homolog annotation: Hit_ID=Q9FM06; Match level="QueryCoverage=99%, HitCoverage=100%, E-value=2e-22, Identity=39%"; Hit description =Arabidopsis thaliana genomic DNA, chromosome 5, P1 clone:MQB2
MGNCQAVDAAALVIQHPSGKIERLYWPVSASEVMRTNPGHYVSLIIPLAVPDDQGQINQEQQKAVLFTRVKLLRPNETLTLGHAYRLVVKAVKAKKHAKMRKPQVKAMEGMQIVQLEKPVSDSESTGGMLDTRNIYQAMRTDRYRLMSSTHAALKLKSWRPSLQSISESAS

SEQ ID NO: 159848 - protein, 97 aa, Glycine max
  Coding DNA Sequence Number=SeqID_43070
MEVQDIVDNLKGCSKNKHWILEAYLVNRALASSYLIFSEFLHKEYGGPGTLLVEPFTDMMVALKKKKLPGAALAARASLLWAQNFVDKDWEVWNSKI

SEQ ID NO: 159849 - protein, 88 aa, Glycine max
  Coding DNA Sequence Number=SeqID_43071
  Gene Ontology: Mol. function=dimethylallyltranstransferase activity; Cellular component=chloroplast; Biological process=carotenoid biosynthetic process
  Homolog annotation: Hit_ID=Q43133; Match level="QueryCoverage=94%, HitCoverage=22%, E-value=6e-18, Identity=51%"; Hit description =Geranylgeranyl pyrophosphate synthetase, chloroplast precursor (GGPP synthetase) (GGPS) ...
  Homolog annotation: Hit description=[Includes: Dimethylallyltranstrans ferase (EC 2.5.1.1); Geranyltranstransferase (EC 2.5.1.10); Farnesyltranstransferase (EC 2.5.1.29)]
MDASIVLREPKKCHKDMCYSLFIDSKRVNPILFITVYKLIGRTEATVLPTRYVVEINHTMWHIHDNLPCMDNDNLCREKPNNHRDAKE

SEQ ID NO: 159850 - protein, 142 aa, Glycine max
  Coding DNA Sequence Number=SeqID_43072
  Homolog annotation: Hit_ID=Q9FGS2; Match level="QueryCoverage=88%, HitCoverage=25%, E-value=3e-34, Identity=60%"; Hit description =Arabidopsis thaliana genomic DNA, chromosome 5, TAC clone:K6A12
MAKACKSHEEILSGATKHGLKALQKCHLLEEAAHAPAILALSRPIGSEWKEKVENLQVELQQCYKAQSWLSEQLVVEVAESRASKALVQEKEDAAAYLQKELTELREGCSQLKVDLGEKIKSLEVVVSEKSELKSTTGADDY

SEQ ID NO: 159851 - protein, 2122 aa, Glycine max
  Coding DNA Sequence Number=SeqID_43073
  Gene Ontology: Mol. function=nucleic acid binding; Cellular component= chromatin; Biological process=DNA integration
  Homolog annotation: Hit_ID=Q8W0Q5; Match level="QueryCoverage=32%, HitCoverage=87%, E-value=0.0, Identity=41%"; Hit description =Putative vegetative storage protein
  Pfam annotation: Domain name=Helicase_C; Domain location=1206-1281; Score=90.0; E_value=7e-24; Accession=PF00271.21; Description =Helicase conserved C-terminal domain
  Pfam annotation: Domain name=PPR; Domain location=1384-1418; Score =29.1; E_value=1.6e-05; Accession=PF01535.11; Description=PPR repeat
  Pfam annotation: Domain name=PPR; Domain location=1485-1519; Score =18.8; E_value=0.019; Accession=PF01535.11; Description=PPR repeat
  Pfam annotation: Domain name=PPR; Domain location=1586-1619; Score =14.1; E_value=0.16; Accession=PF01535.11; Description=PPR repeat
  Pfam annotation: Domain name=PPR; Domain location=1622-1656; Score =12.1; E_value=0.27; Accession=PF01535.11; Description=PPR repeat
  Pfam annotation: Domain name=PPR; Domain location=1688-1722; Score =40.0; E_value=8e-09; Accession=PF01535.11; Description=PPR repeat
  Pfam annotation: Domain name=PPR; Domain location=1789-1823; Score =45.1; E_value=2.3e-10; Accession=PF01535.11; Description=PPR repeat
  Pfam annotation: Domain name=PPR; Domain location=1824-1858; Score =2.4; E_value=3.9; Accession=PF01535.11; Description=PPR repeat
  Pfam annotation: Domain name=PPR; Domain location=1860-1894; Score =5.2; E_value=1.8; Accession=PF01535.11; Description=PPR repeat
  Pfam annotation: Domain name=rve; Domain location=473-626; Score =32.1; E_value=1.9e-06; Accession=PF00665.16; Description=Integrase core domain
  Pfam module annotation: Pfam domain module=Helicase_C::PPR::PPR::PPR:: PPR::PPR::PPR::PPR::PPR::RVT_2::rve; Domain location=1206-1281::1384 -1418::1485-1519::1586-1619::1622-1656::1688-1722::1789-1823::1824 -1858::1860-1894::780-930::473-626
MASASTPPLSLPLPLSLANSSKTFTLSISHKLHLKNYLLWIQQVEPVIHNLHLEGYVINPQIPPKYALVEDCDSNKVTSEYRVWYEQDQFLLAWLQSTISGEILPCIVDCRSSWQLWDHILSHFQSLTCTKIRQVRDELQNLSLDNRSISDYLLCVQTLVNVLTSIGEPVSNFEHVNLILDGLPDVYALSILLITNRFDPFFVDEVETLLLAREVRDVVSDSVQFVNPNSQGQVNLTTQSVSEDNSSNDYAGNHFFNGRGGWGSGQNNRGGQNPNHGSGGCGGGCFADVQCQICYKFGHGGSYCYHRLEENYVPTLPPPAYLAPASTHTSAAVQLAPVKVHNAQPAHSQTTVASVQTQYVYIQPPQTTQLASKHPQVYPASSSHTPTQGQSWYPGASHHVTNQVYPASSSHTPTQGQSWYPDSGASHHGPDQITIGNAQGLNINSSGVSSFSSPLNPKFSLVLSNLLFVPSITKNLISDSKHVLLKGLVGSDGLYQFPQLLSSVPNVVQSPLVNTVTSKSDFQSFSSNKAAVVDAVQSDWGREFRPFTKFLTDYGIQYRLICPHTHHQNGIVECKRRHVVELGLTVLSQAKLPLHYWDHAFVSSVYLINGLPSSAIGNEIPYQKLFNKQADYFFLKISRMLFLGYSPSHKGSKCLAADGRSYISKDVTFNESAFAYPSLFPEPALLTSEVLDTASSLTVLPSAVSVHLTNASPSAATENSASSSDQQPPSPHISHAQPLSVSNTALPAQPNSPSIPTQTTFQPTNRPDNAHPMCTRAKSAMQSEYDALMRNDTWTLVDLPASRTTIGCKWVFRVKENPDGSVNKYKARLVAKDFHQQLGFDYKETFSPKLDVNNAFLNGVLEEEVYMIQPPGFVSSNKQQDLGELDYLGIEVQRQQDGSLILTQSKYIRDLLTKTNMDESNPISSPMFGGCKLTKFGFEDFSDSTLYGSTDLLLVPCSTVSLGLHFQAASLQQPFPLHAYCDAYWASDPDDRRSTSGAVTLIGPNLISWWSKKKSVVACSDTKAEYKSMALIAAEVTWIQSLLSELQVLHAYCDAYWASDPDDWRSTSGAVTFLGPNLISWWSKKKSVVACSSTKSEYRSMALIAAEVTWIQSLLSELQVPHTIPVILCDNTSTVSLAHNPVLHSRTKHMELEQKWIEVTVDTQVDELIKAVNHRFRSEDLVNAGGIHRTMVFANTVEAVEAVAKILLHSGIECSRYHKNCTLEERAQTLVDFHDKGGVLVCTDAAARGVDIPNVLHVIQVDFATSAVDFLHRVGRTARAGQFGLVTSMYTESNRELVNAVRRAGELDQPVMQRCLKPKEALFRNSKNQLPSSHSQIQRNTINQHISNDNNTHILDNLTRFHVARNQVEHARHVFEKIPKPSVVLWNMMIRAYAWNGPFLQSIHLYHRMLQLGVTPTNFTFPFVLKACSALQAIQVGRQIHGHALTLGLQTDVYVSTALLDMYAKCGDLFEAHTMFDIMTHRDLVAWNAIIAGFSLHVLHNQTIHLVVQMQQAGITPNSSTVVSVLPTVGQANALHQGKAIHAYSIRKIFSHDVVVATGLLDMYAKCHHLSYARKIFDTVNQKNEICWSAMIGGYVICDSMRDALALYDDMVYMHGLSPMPATLASILRACAKLTDLNKGKNLHCYMIKSGISSDTTVGNSLISMYAKCGIIDDSLGFLDEMITKDTVSYSAIISGCVQNGYAEKAILIFRQMQLSGTDPDSATMIGLLPACSHLAALQHGACCHGYSVIRGFTENTSICNAIIDMYAKCGKIHISRQVFDRMKKRDIVSWNTMIIGYAIHGLYIEAFSLFHELQESGLKLDDVTLIAVLSACSHSGLVVEGKYWFNTMSQDLNILPRMAHYICMVDLLARAGNLEEAYSFIQNMPFQPDVRVWNALLAACRTHKNIEMGEQVSKKIHMLGPEGTGNFVLMSNIYSSVGRWDDAAQIRSIQRHQGYKKSPGCSWIEISGAIHGFIGGDRSHPQSVSINNKLQELLVQMKKLGYHADSGFVLHDVEEEEKEQILLYHSEKIAIAFGILNTRFLVRKRKGGIVGLFRITQWQKFFLCHLLPEPAIAKACKSHEEILSGATKHGLKALQKCHLLEEAAHAPAILALSRPIVLYLL

SEQ ID NO: 159852 - protein, 91 aa, Glycine max
  Coding DNA Sequence Number=SeqID_43074
MPKFTMSSLRVYSSPTMVHHCQFLYLLKLLTRIQSLKHLQFLIGNGLMMLMDQNSRSSSSGLGFTLKKPRRKATIILNDLDLEEILMPLPP

SEQ ID NO: 159853 - protein, 187 aa, Glycine max
  Coding DNA Sequence Number=SeqID_43075
  Homolog annotation: Hit_ID=Q1SAU1; Match level="QueryCoverage=38%, HitCoverage=82%, E-value=7e-33, Identity=90%"; Hit description =Splicing factor 3B subunit 10
  Pfam annotation: Domain name=SF3b10; Domain location=5-80; Score =153.9; E_value=4.1e-43; Accession=PF07189.2; Description=Splicing factor 3B subunit 10 (SF3b10)
MQASDRFNINSQLEHLQAKYVGTGHADLNRFEWAVNIQRDSYASYIGHYPLLGFFAIAENESIGRERYSFMQCSTVLGEFMREVEWGTITSVVTEAVYRIYSSNYVHAPPDSGPREPETESEKSRASQTKIPCNNYIREEASAQWEMAKILGMTSGEEQSTIIDKITTMEIRDRKEAEALGKRNISS

SEQ ID NO: 159854 - protein, 267 aa, Glycine max
  Coding DNA Sequence Number=SeqID_43076
MGVVVGYATGVDVGVAAGGEDLGEATGASDFGTVEGAWATVVAGVFDDAAVGDCPSMPVTTMQMIARENAIAIANEIFIRIKGIKPPPTMPLPCRFSLSRVDLLAIVMALAAPLNPIANLLNYPFFFLLFPCMIWLKFVVVESTRAHLLGSSAVQIWGLREGNLCSCEVVQHVRDDGGVIDGCDRDDNHPGLGAHRGDLVCGEEDDERDPRSCAVTGECDGGSGRGCGRCGVEEKKKKVVFGGWLELKGSYLCSVVGKDSPRMLDSF

SEQ ID NO: 159855 - protein, 562 aa, Glycine max
  Coding DNA Sequence Number=SeqID_43077
  Gene Ontology: Mol. function=hydrolase activity; Cellular component =chloroplast; Biological process=RNA processing
  Homolog annotation: Hit_ID=Q8VX11; Match level="QueryCoverage=99%, HitCoverage=100%, E-value=0.0, Identity=80%"; Hit description =Diphosphonucleotide phosphatase 1 precursor
  Pfam annotation: Domain name=Metallophos; Domain location=237-453; Score=56.4; E_value=9.4e-14; Accession=PF00149.18; Description =Calcineurin-like phosphoesterase
MMSGMGNSRVLIFSLLVLATFQQVVSDEHQPLSKVAIHKTTLALDERAYIKATPSVLGLKYQYANFSSHGYKNTGKGSLKLQLINQRSDFSFALFTGGLTNPKLVAVSNKVSFINPNAPVYPRLAQGKTWDEITVTWTSGYGISDAEPFVEWGPKGGNLVKSPAGTLTFDHNTMCGAPARTVGWRDPGYIHTSFLKELWPNQEYKYKLGHRLFNGTIIWSQEYQFKASPFPGQNSLQRVVIFGDLGKAEADGSNEYNNFQPGSLNTTKQIVQDLKDIDIVFHIGDLCYASGYLSQWDQFTAQIEPIASTVPYMTASGNHERDWPDTGSFYGTLDSGGECGVPAQTTFYVPAENREKFWYSVDYGMFRFCIANTELDWRKGSEQYKFIENCLATVDRQKQPWLIFLAHRVLGYSSAGFYAAEGSFEEPMGREDLQYLWQKYKVDIAMYGHVHNYERTCPVYQNICTNKEKNNYKGSLDGTIHVVVGGGGASLAEFAPINTTWSIFKDHDFGFVKLTAFDHSNFLFEYKKSSDGQVYDSFRISREYRDILACTVDSCPATTLAS

SEQ ID NO: 159856 - protein, 375 aa, Glycine max
  Coding DNA Sequence Number=SeqID_43078
  Gene Ontology: Mol. function=ribonuclease H activity
  Homolog annotation: Hit_ID=Q1SCU9; Match level="QueryCoverage=47%, HitCoverage=88%, E-value=6e-71, Identity=63%"; Hit description =Ribonuclease H; Ribosomal protein L9 N-terminal-like
  Pfam annotation: Domain name=RnaseH; Domain location=267-375; Score= -24.6; E_value=0.011; Accession=PF00075.14; Description=RNase H
CEGSRESDKFDAIFVTIRVKRLRGTGGGFGGEGSDGTWVGFLIGLDKGIAYTKGEIEHPVHAENRATMKFVHSSTSIETMPKQVMVMGQGLLKTTMQLSSYTAAIVGSTVRLIANRSLRHRCCSFPAKPEYRGIRSFRSEFALTAARCYSAKKGRKSKAEPEVPAVVMEQEKDAFYVVRKGDVVGIYNSLADSQAQVGSSGYSLSKDTEEYLVSHGLKNALYTIRATDLKEDLFGMLVPCPFQEPSTKEGTSNKDVSKQRSLGVLAQDERTCFVEFDGASKGNPGKAGAGAILRANDGSLICRVREGVGIATNNAAEYRAMILGMKYALKKGFTGICIQGDSKLVCMQVMFTRPPPTIPYCWFHFKCAIDCELLI

SEQ ID NO: 159857 - protein, 155 aa, Glycine max
  Coding DNA Sequence Number=SeqID_43079
  Homolog annotation: Hit_ID=Q10AH5; Match level="QueryCoverage=38%, HitCoverage=13%, E-value=5e-07, Identity=48%"; Hit description =Pentatricopeptide, putative, expressed
MSSPPPNTTMPTSTPTSSPHFVVRVEGDGGVPNDDISVRRWDLEEELVGEGEGEAGAVESEEGRGDEGVTKEGGLGGMGVERGGEEGEVEGGAGLEGEGEEESMEASRARRRLEYTKKLKDTTIDWRLSPLGSLIVGFKRRASSKRWRRSGGKWR

SEQ ID NO: 159858 - protein, 135 aa, Glycine max
  Coding DNA Sequence Number=SeqID_43080
MSILALGRKFPIKQWEKEKRRKFPIKEWEKAKKKENSRSNIGRKQKKYAERMKHLPMSMVVILPNENVVTWFCSLHNRPDNYLKGIINSALKGLDDTQQSKSKPTARWIVVKCNRQKGSTEYGYYVMHGMSTIIL

SEQ ID NO: 159859 - protein, 83 aa, Glycine max; identical to SEQ ID NO: 147971
  Coding DNA Sequence Number=SeqID_43081

SEQ ID NO: 159860 - protein, 75 aa, Glycine max
  Coding DNA Sequence Number=SeqID_43082
MCLGPLMMGLRTQIRLKEKFSTPGRVHVDVVESGPNWGSKRGKVWPALILRVSKWLQKVSHQQRDADTMKKGDGS

SEQ ID NO: 159861 - protein, 262 aa, Glycine max
  Coding DNA Sequence Number=SeqID_43083
  Gene Ontology: Mol. function=catalytic activity; Biological process =trehalose biosynthetic process
  Homolog annotation: Hit_ID=Q7XI41; Match level="QueryCoverage=92%, HitCoverage=64%, E-value=9e-75, Identity=58%"; Hit description =Putative trehalose-6-phosphate phosphatase
  Pfam annotation: Domain name=Trehalose_PPase; Domain location=47-262; Score=181.9; E_value=1.6e-51; Accession=PF02358.7; Description =Trehalose-phosphatase
MIPVSLEKSDENGELRSYASWLGKHPSALGNFEEVMSIAEGKQIVVFLDYDGTLSPIVDDPDKAYMSDVMRAAVCEVANCFPTAIVSGRSKDKVYEFVKLENVYYAGSHGMDISTPSGSSKYEEQEHQIKAVDEKGNPVVHCHPAIEFLPTIQEIVKVLKENTRRIKGSMIEDNTFCVTVHYRCVKNEEEVGVLKKMVKTIMKAYPDFYISGGRKVMEIRPTVNWDKGRALTYLLDTLGFDNFSNVLPMYLGDDRTDEDAFK

SEQ ID NO: 159862 - protein, 72 aa, Glycine max
  Coding DNA Sequence Number=SeqID_43084
MANAQSLGVRERGGGRWILAEILSGFGCTPSRDTCSMAQIRNGWHFKGAFWTNGQRIDYPDITEKPPQDGLI

SEQ ID NO: 159863 - protein, 362 aa, Glycine max
  Coding DNA Sequence Number=SeqID_43085
  Homolog annotation: Hit_ID=Q6FNG2; Match level="QueryCoverage=31%, HitCoverage=22%, E-value=1e-12, Identity=44%"; Hit description =Similarities with sp|P08640 Saccharomyces cerevisiae YIR019c STA1
  Subcellular localization annotation: CTP_CleavageSite=46; ConfidenceScore=5.75e-01
MPTKLFSQLRLLHPLLPMKPRTLPLLSRAFFFPSSKFLRTAPFKVRAFSSRAHSREKLPLRSSKSLVDDEADLSNWVDDLRSTRTDEMRPARDSELRSGRTNEFRSGRGNGVRTGRGDGFRSDRGSEVRSGRGNGVRTGRGDRFADSGRGNGVRTGRGDRFADSGRGNGVRTGRGDRFADSGRGNGVRTGRGDRFADSGRFGSNNDGEREFRPPRNNSDRASALGKRRGEDLRKGRQSGNARRKFQPRSDDDDDDEEEEEEIVGGRKLKGSGVGAFLSEDQDDDEDEESEGSEEEEILNKSRAALFGQQNGLNRRTTVPTPRPSSPGGGSDSYLSETSSACYSLQPASGHVACFATSQSCEP

SEQ ID NO: 159864 - protein, 71 aa, Glycine max
  Coding DNA Sequence Number=SeqID_43086
MVEQRCRDWEEKNSREQKFEVLMPWGIHKSRKASFLGQHHCFFNIHVTTLMGYPQQYKEQLKDNKLKFGYK

SEQ ID NO: 159865 - protein, 326 aa, Glycine max
  Coding DNA Sequence Number=SeqID_43087
  Gene Ontology: Mol. function=transcription regulator activity; Cellular component=nucleus; Biological process=regulation of transcription
  Homolog annotation: Hit_ID=Q67U21; Match level="QueryCoverage=77%, HitCoverage=69%, E-value=1e-47, Identity=43%"; Hit description=Basic helix-loop-helix-like protein
  Pfam annotation: Domain name=HLH; Domain location=7-84; Score=24.2; E_ value=0.00039; Accession=PF00010.16; Description=Helix-loop-helix DNA- binding domain
MDCSAARKTQKADREKLRRDRLNEQFVELGNILDVLMIYITSSLLCPPPFLSLTLACPGENPDRPKNDKATIIGDTIQLLKDLTSQVSKLKDEYATLNEESRELTQEKNDLREEKASLKSDIGNLNNQYQQQLRTMFPWTAMDHSVMMAPPSYPYPVPMAVPPGPIPMQPYPFFANQHPAVISNPCSTYVPYLAPNTIVEQQSTQYVSPPLHPCGRSNVSGKQESKSKSSRESKAEKNEDSNDVTTDLELKTPGSSADQDLSSRQRKSSKLSRRESSCTEGSSLAHRAVWRQAERIMNEKVDKLVKFSCLEAAEIFHCASAATLEV

SEQ ID NO: 159866 - protein, 167 aa, Glycine max
  Coding DNA Sequence Number=SeqID_43088
  Gene Ontology: Mol. function=zinc ion binding; Biological process =cell redox homeostasis
  Homolog annotation: Hit_ID=Q1SUE6; Match level="QueryCoverage=59%, HitCoverage=58%, E-value=5e-15, Identity=42%"; Hit description=Zinc finger, RING-type; RINGv
  Pfam annotation: Domain name=zf-C3HC4; Domain location=121-163; Score= 41.1; E_value=3.9e-09; Accession=PF00097.15; Description=Zinc finger, C3HC4 type (RING finger)
MPFNQDLFDFLFAPTQALNSQGEEVHMPIVDDASYNSLDLGHNNLENNDDETLTEEDISNLIDLLLEDDTYIFDFIELDDDNHNTGNNGVSRVEFANQVSIQNLERIRIHENPEQSSDLMCSICLEEFLIGTITIRLPHPCYHIFHEHCITRWLNMNNTCPLCRRTI

SEQ ID NO: 159867 - protein, 256 aa, Glycine max
  Coding DNA Sequence Number=SeqID_43089
MQFPQGFVPPLTPYFPGIGMTSSPQDLLETNNENFSSVEMNIAEADNNYWHEQERGSASEVEVDNGNFEMLPEDRQQSTSDSYNNSAPLSRVGSSNSNSSARVQQKFTKENRGSTREEHVDNFHYQDGRRNEVYFDDRTANSELSSAPPLSSFKSRTSSESSWDGSSAKSSKSTRERRGRKNTSSIASPVYAKGKNVSETSSNRVDDENREWTPLSTMASNISERSIWPTSSPSMHVPRNQISGFETAQTSGSDSP

SEQ ID NO: 159868 - protein, 153 aa, Glycine max
  Coding DNA Sequence Number=SeqID_43090
  Subcellular localization annotation: CTP_CleavageSite=76; ConfidenceScore=5.66e-01
MATNCKFCFFLLLPPRLLSSPSSQVLQPKRITFFTTAFFTPMTFPLCHRIPFPNLAWVCIPDGSSEPNAVSWSFLPSGYGKNGFVEECNEFTSPNTLTTCSMKKRDLNLGWLWLEGSSMENLLWQEEWRKKKEKEIYEATKYFVKTKTIIGSL

SEQ ID NO: 159869 - protein, 615 aa, Glycine max
  Coding DNA Sequence Number=SeqID_43091
  Gene Ontology: Mol. function=nucleotidyltransferase activity
  Homolog annotation: Hit_ID=Q10Q39; Match level="QueryCoverage=96%, HitCoverage=40%, E-value=1e-169, Identity=56%"; Hit description =Nucleotidyltransferase domain containing protein, expressed
  Pfam annotation: Domain name=NTP_transf_2; Domain location=107-204; Score=5.5; E_value=0.055; Accession=PF01909.13; Description =Nucleotidyltransferase domain
MGEHEGWAQAPSGLLPNGLLPNEAASVIQVLDSERWLKAEQRTAELIACIQPNPPSEERRNAVADYVQRLIMKCFPCQLKVVVTCDQLRHHYCMMKVLNNTIMLLQVFKLSGARSEIPVCSEKVFTFGSVPLKTYLPDGDIDLTAFSKNQNLKDSWAHQVRDMLENEEKNENAEFHVKEVQYIQAEVKIIKCLVENIVVDISFNQLGGLCTLCFLEEVDNLINQNHLFKRSIILIKAWCYYESRILGAHHGLISTYALETLVLYIFHVFNNSFAGPLEVLYRFLEFFSKFDWENFCVSLWGPVPISSLPDVTGLSCVLIAFLPSLTLSTAEPPRKDGGDLLLSKLFLDACSSVYAVFPGGQENQGQPFVSKHFNVIDPLRVNNNLGRSVSKGNFFRIRSAFAFGAKRLARLLDCSEDELFSEVNQFFFNTWERHGSGERPDVPSIDLRHLSLSSHDQLQRFENLRNNNHKIGSASNHESNEEEHVSQSGLSQYSNLSSEKTTRNVVSTVSHSQNQKSYGSQNNSRTFDQVRRETNSNPGPHVDKVQRNVKADNLVSDVQGRFLFARTCSSPELTDSYGDVSTQGRRTKATESSKGQTSFAKLENSRRKHVEPDVA

SEQ ID NO: 159870 - protein, 83 aa, Glycine max
  Coding DNA Sequence Number=SeqID_43092
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=77%, HitCoverage=8%, E-value=2e-23, Identity=80%"; Hit description =Kinesin, motor region; Prefoldin
MLEIYNETIRDLISTTTRMENGTPRKQYTIKHDANGNAQVSDLTVVDVHSAKEVAFLLNQPANSRCSKLLHLLAIYEGDAMLS

SEQ ID NO: 159871 - protein, 170 aa, Glycine max
  Coding DNA Sequence Number=SeqID_43093
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=35%, E-value=3e-32, Identity=74%"; Hit description =Kinesin, motor region; Prefoldin
  Pfam annotation: Domain name=Kinesin; Domain location=26-169; Score= -168.8; E_value=0.00097; Accession=PF00225.13; Description=Kinesin motor domain
  Pfam annotation: Domain name=Prefoldin_2; Domain location=11-101; Score=-9.7; E_value=0.1; Accession=PF01920.10; Description=Prefoldin subunit
  Pfam module annotation: Pfam domain module=Kinesin::Prefoldin_2; Domain location=26-169::11-101
SSQEEAIKQKDVLATEVSSLRGELQQVRDERDRQLSQVQTLSSELEKVKESRKHSSTELDSLTLKANDLEEKCSLKDKQIKTLEEQLATAEKKLQASQEEAFVEISQLVQSALDGYKVCFFAYGQTGSGKTYTMMGRPGHLEEKGFIPRSLEQIFQTKQSQQPQVWKYEM

SEQ ID NO: 159872 - protein, 178 aa, Glycine max
  Coding DNA Sequence Number=SeqID_43094
MIRGDTLRLSAPPLPFRHSRVRWQAETKFGHSAHMIRGDTLRLSAPPFAIQTQSCSMASRDQVWSFCTHDTRRYLTVIRPPLPFGHSRVQWQAETKFGHSAHMIRGDTLRLSAPPLPFRHSRVRWQAETKFGHSAHMIRGDTLRLSAPPSAIQTQSCSMASRDQVWSFCTHDTRRYLT

SEQ ID NO: 159873 - protein, 109 aa, Glycine max
  Coding DNA Sequence Number=SeqID_43095
MYPLLELIHKRCTLSCSQSTTQVDVPSTCTTKDVPSNVLRQSSQAVKPLKLSEWGYKRILRREKGDTKEFRRLVLHSFGKERRKTQKEFRWLVLSEFFLAKGEGNEKDE

SEQ ID NO: 159874 - protein, 139 aa, Glycine max
  Coding DNA Sequence Number=SeqID_43096
  Homolog annotation: Hit_ID=Q1SWX1; Match level="QueryCoverage=78%, HitCoverage=22%, E-value=3e-09, Identity=29%"; Hit description=IMP dehydrogenase/GMP reductase
MGQLQRQPFRKAYGKIWDLAMVEVSAEAIASLAQYYYLSLRCFTFGDFQLSPMVEEFEEILGCPLGGRRPYLFSGFYPSLARISKIVQISAQELDHRKQVENGVVGIPRKYLEAKARILAGKGEWVSFIDTRKARSSHY

SEQ ID NO: 159875 - protein, 66 aa, Glycine max
  Coding DNA Sequence Number=SeqID_43097
MAPSGSWARSNNVWHMTLSMIDFQTLQSFHVTGKPGPTPKIKPVNTNGATHVSLGYEASGGNFTDP

SEQ ID NO: 159876 - protein, 34 aa, Glycine max
  Coding DNA Sequence Number=SeqID_43098
MLEPPLNLPSMPIYRKMSTWGNGSLPRRIISNWA

SEQ ID NO: 159877 - protein, 112 aa, Glycine max
  Coding DNA Sequence Number=SeqID_43099
  Gene Ontology: Mol. function=DNA binding; Cellular component =chromosome, pericentric region; Biological process=chromosome organization and biogenesis (sensu Eukaryota)
  Homolog annotation: Hit_ID=Q6T367; Match level="QueryCoverage=57%, HitCoverage=39%, E-value=2e-13, Identity=60%"; Hit description =Centromeric histone 3
MEANHCILKIHKVPNPKQSQKEEEEKCRNRNRKSNPKREEVKKIKTLPETQGRKKMRNRQGTVALREIRHLQRSCELLIPAAPFIRCVKQITNQFSSEVSRWTPEAVVALQE

SEQ ID NO: 159878 - protein, 450 aa, Glycine max
  Coding DNA Sequence Number=SeqID_43100
  Homolog annotation: Hit_ID=Q6ETQ7; Match level="QueryCoverage=85%, HitCoverage=87%, E-value=4e-70, Identity=40%"; Hit description =Hydroxyproline-rich glycoprotein-like
  Subcellular localization annotation: CTP_CleavageSite=61; ConfidenceScore=5.56e-01
MEALNAAGLTPLSVLSDAKTTRTKHPSVSVCKVSNFSTSTNKKQTLLQSCISKTLHGGLILAASVVNGGAATALTYDEALGQPLSLPGAGDFDVNGFVESVTGFAAENPAILAGGVAVLAVPLVLSQVLFKKPKAWGVESAKNAYAKLGADGNAQLLDIRALVEIRQVGSPDVGGLKKKAVSIPYKGDDKPGFLKKLALKFKEPENTTLFILDNELVMEARFDGNSELVAELVTVNGFKAAYAIKDGAEGPRGWKSSGLPWIEPRKTLSFDNLTDAISEAIGDTTDGVAVTLGVAAAAAGLSLLAFSEIESILQVVGSAALIQFASKKLLFAEDREQTVKQLGEFLNTKVAPKELVDEIKDIGKALLPSSTDNKALPAPAEKSSELATADSTVQRAVATPESKAEAVATPEPKVDAVAPEVNSVPKTEVKAEESLPVQPRPLSPYPYVKS

SEQ ID NO: 159879 - protein, 37 aa, Glycine max
  Coding DNA Sequence Number=SeqID_43101
MSLKGVPNRVTCLQVPAFFLMKNHSMKHEHHQCTDLE

SEQ ID NO: 159880 - protein, 88 aa, Glycine max
  Coding DNA Sequence Number=SeqID_43102
MSCFGVSDIVVTRRVIIVTKQYLSVLRIRGSLRVVLENNCKPRVEGLGSSSSMDSFASWKMNGSGMEKEEREETPLQGEDESRRSSPP

SEQ ID NO: 159881 - protein, 81 aa, Glycine max
  Coding DNA Sequence Number=SeqID_43103
MNACPKNMCKPNCPMACFPTKNHALMPLRHFTEHLSTKRRSKYTNEKLESLGMEYLLIGDEQKRETESKNAKNDDPRAANS

SEQ ID NO: 159882 - protein, 238 aa, Glycine max
  Coding DNA Sequence Number=SeqID_43104
  Homolog annotation: Hit_ID=Q47522; Match level="QueryCoverage=20%, HitCoverage=59%, E-value=1e-21, Identity=97%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPVTTLNSISLTNFCVVKSLIKGKKPWLAALLRQQDHSCKKRNVHFLKEQPKKINPPDSNANEAEENEVGERGARYQLLFPLVRVNFELGVIMVIAVSFGKPVVPAALMNRPTRGERRFAYWALAECILAYYVGTDEGVSEVLHVAGEKRLH

SEQ ID NO: 159883 - protein, 93 aa, Glycine max
  Coding DNA Sequence Number=SeqID_43105
  Gene Ontology: Mol. function=RNA-directed DNA polymerase activity
  Homolog annotation: Hit_ID=Q1S1X7; Match level="QueryCoverage=60%, HitCoverage=4%, E-value=2e-11, Identity=57%"; Hit description =Integrase, catalytic region; Zinc finger, CCHC-type; Peptidase aspartic, catalytic
FEELANLVSFALFTSARDPSTFQEVMNNHEKDNMGIDYDEISSSIVRHTSIKAVLASVANRDMHLEQMDVKITFLDNDVEQQIYMKQPERFSK

SEQ ID NO: 159884 - protein, 59 aa, Glycine max
  Coding DNA Sequence Number=SeqID_43106
MGFGEWKKEAYILDEDNVGGGDGDDYAAEDGDRAGKETPLPIDHLLLLALILSLSDFYT

SEQ ID NO: 159885 - protein, 396 aa, Glycine max
  Coding DNA Sequence Number=SeqID_43107
  Gene Ontology: Mol. function=sequence-specific DNA binding; Cellular component=nucleus; Biological process=regulation of transcription
  Homolog annotation: Hit_ID=Q6R7N3; Match level="QueryCoverage=93%, HitCoverage=92%, E-value=8e-72, Identity=46%"; Hit description =Putative WRKY transcription factor 30
  Pfam annotation: Domain name=WRKY; Domain location=129-214; Score =97.6; E_value=3.6e-26; Accession=PF03106.6; Description=WRKY DNA -binding domain
MEENMKCELVGLIDELMQGKELAKQLCDHLVSLSSSSSHETNEVLIEKILSTYEKALAMLNCKANVGESKANINGSMMDSPCSFTNGSPKSEVMEPEIKNKDVFKKRKTMSTCTEQVKVCLGTAHEGSLDDGYSWRKYGQKDILGAKFPSFLINAQSVINSEAPHDGLKGCGRGYYRCTYRNVQGCLATKQVQKSDEDPMICEITYKGRHTCTQASHLNKTVIPPSKTKVNLLGENKHQTHQIKNQPRQEKIEQQPPETFFTFGSSSGLEVKIEDIDHKEGIFPSFCFSSPSIVGSENGDDNNSSIFSYTMIENNLMESFSPAFISPTTSDIESNTFCHWGSTGLGQSVQSSGSDITDIVSAPTSVTNSPIMDLDFFFDKIDFDTDFPLSTMELCT

SEQ ID NO: 159886 - protein, 892 aa, Glycine max
  Coding DNA Sequence Number=SeqID_43108
  Homolog annotation: Hit_ID=Q6K2T0; Match level="QueryCoverage=98%, HitCoverage=97%, E-value=1e-104, Identity=32%"; Hit description =Extra-large G-protein-like
MEDSTKLRLVRCPKCQNVLPELANYTVYQCGGCNTVLRGKPKGSEGGGRLWQASDEEQGGGDQDASGSFLRKGVVDLSDNSDVDVRSSGGSSREGQRRDLKKSNKGHERFLDDSRDGDEKGVLEDGFNVNKDKRGKSIGREQQEQKTHMGGDQFYGRMSNLPIGERGEMEGFWRKPQADMEDVRFATLNYPDEGSSNSYSSFSYNYGEQWRNYKDMDGVSRVQHLEQDRAEILRKLDELSNQLNKSCEVVSNPKEKVLPEGKMVPPDPFSGPETRFPDGSSAMNRSSRQFFGPTSNKHMAGSPYFNYQDPYAYRSGHEMAMHNFYPSMHNPNYVPGYGDPFVSEMMRGSHPLPRQFPQQPMHPYFPGRYTDTGPDSYDACAQNAMLHPPSCPCFRCYDNKRRGPVPAPAAFGNSRFPHTPNDSMLYRHEIPGAVGPHVHNARTAIPAVSLHEKQLHTRWPRDYNSEMGGFVGSRPRKVVPGSGGRHCLPIAGGSPFITCHICYELLQLPKKTLVMVKNCQQKMRCGACSSEIKFAVIDKKLVFSPHSQTEETTTSTRVDDATNEVVNSRVFHARGDVNTGAANFSSDDYSGYDFHSVDRESPVLAADPSLNSTKSRERQSFHSSSPSTSNDENSSEVMAAPSEALKSIHQPTKASQSSPGGSFNNAVNRLGKGNQSSRSDQETEKIEKNASRQNSLKELVLATEMDVIDYSNNGISQDLGDASGEHDHPRSSKRGESFLANIIKKDNEKNNVTVNGQPISDCMIKKAEKLAGPIQPGNYWYDSRAGFWGVMGGPCLGIILPFIEEFRHPMPDKCAGGNTGVYVNGRELHQKDLDLLSRRGLPRDSNRYYIVEISGRVQDEDTGEDLDSLGKLAPTVEKERRGFGMKVPRAAA

SEQ ID NO: 159887 - protein, 96 aa, Glycine max
  Coding DNA Sequence Number=SeqID_43109
MEIKNSIQLRSTSTNSEHNNRKDYNEKKKATNVILQSYRCEKDAPSIFKFGCILVMTSAEYMRRFFSIPAPNTYMGHILDDPVVFSCDTLYPLHIY

SEQ ID NO: 159888 - protein, 51 aa, Glycine max
  Coding DNA Sequence Number=SeqID_43110
MSVMEKRKGDNGLDLAMAIDGFEKRYKEINQKGAIPTVLHDHGTHICLLVN

SEQ ID NO: 159889 - protein, 582 aa, Glycine max
  Coding DNA Sequence Number=SeqID_43111
  Gene Ontology: Mol. function=ligase activity; Cellular component =cytoplasm; Biological process=response to auxin stimulus
  Homolog annotation: Hit_ID=Q3LFT5; Match level="QueryCoverage=98%, HitCoverage=98%, E-value=0.0, Identity=69%"; Hit description =Putative auxin-regulated protein
  Pfam annotation: Domain name=GH3; Domain location=12-567; Score =963.6; E_value=7.5e-287; Accession=PF03321.4; Description=GH3 auxin -responsive promoter
MLEKVEEFNIERVMEEFERVTKDAERIQKETLKRILEDNASAEYLLNLGLNGRTDPESFKAFVPLVTHKDLEPYINRILDGDFSSVLTGKPITTMSLSSGTTQGKPKYVPWNDKLFDTTLQIYHTSFAFRNREFPINGGKALGFIYSSKQFKTKGGVLAGTATTNVFRNPGFRHAMKTTQSPFCSPDEVIFGPDFHQSLYCHLLCGLIFREEVQLVSSTFAHSIVYAFRTFEQVWEELCVDIKEGVLNSKVTVPSVRAAMSKLLKPDPELANLIHSKCMGLSNWYGLIPELFPNVKYVHGIMTGSMEPYLKKLRHYGGELPLLTSDYGSSEGWIGTNVKPTVPPELATYTVLPQIGYFEFIPLRELEGAKGDSSFLCMEAKPVGLTEVKIGEEYEIVVTNPAGLYRYRLGDVVKVMGFHNSAPEIKFVRRSNLLLTINIDKNTEKDLQLAVEAASELLAEEKLEVVDYTSHIDLSKEPGHYVIFWEISGEASEEVLGGCCNGMDKSFVDAGYTSSRKVNCIGALELRLVRRGTFQKILEHSLALGAAVSQFKTPRCVGPTNTKVLQILNENVVKSYLSTAFN

SEQ ID NO: 159890 - protein, 160 aa, Glycine max
  Coding DNA Sequence Number=SeqID_43112
MLKFIYRKLRRNQSKKNKLASKGNQAMIMNSPTPKGKANEIEEDQEEKAMPIWDCGSPLYDSYELVSLDHIIDRHLMAFPSSHESSMSIITRFTHHDMVPHKVDSTEKSKGSFVVTSLSKFKVKIMRKKRKNNEERGKKNNEMRRGFAEFVVDLLFVWRK

SEQ ID NO: 159891 - protein, 42 aa, Glycine max
  Coding DNA Sequence Number=SeqID_43113
MASPMSTTCYLDKDEAGQSVDIKKYRDIKPIPKNLTLVPSKE

SEQ ID NO: 159892 - protein, 136 aa, Glycine max
  Coding DNA Sequence Number=SeqID_43114
EKRGGGCRTARPVYKTKVERKDIELVEEEEPRIGANCSSATSNKSDIYKEEAGNAAQKHKAKRVESVDADAEAFGDHWESLDCSMHSEAEALEHMKKRDTGHQSVSLENKTGDSIVLKIGDSAKVVMKTRHEGRRA

SEQ ID NO: 159893 - protein, 153 aa, Glycine max
  Coding DNA Sequence Number=SeqID_43115
MTSRQPLQEPESRIKDMVEEPMEHFIDQNYWQVLANGGKKKSKTMSNSPMKNSKSAAVVLSDNCIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 159894 - protein, 53 aa, Glycine max
  Coding DNA Sequence Number=SeqID_43116
MTPLDDKTRMIETEMAFVGLCFAPIHCGTHTKMQHLRNNVLTCAHEWTYTCTV

SEQ ID NO: 159895 - protein, 267 aa, Glycine max
  Coding DNA Sequence Number=SeqID_43117
  Homolog annotation: Hit_ID=UPI00005F7DD5; Match level="QueryCoverage =72%, HitCoverage=100%, E-value=3e-48, Identity=49%"; Hit description= COG0265: Trypsin-like serine proteases, typically periplasmic, contain C-terminal PDZ domain
MDIALFPGQNRRQWADTMINLEARKLVNTANTVAAMHITDSLTRLKFVDEIRQVIMQQFEAARRATSDEDCIACLKILRSENTSLLEQSRMLKTGYARIYAEVRYVTDQNKIVGYFISGIKVVLAGVQAVFGGAMIISMTPVGMLAGAILIGDAFNTISREAARQLLNAPASQGMFADSAMSIAEFMGFSRDVGLGVYNATTLAASVYGVFGLTGKAEAWRLFRYLPGDYYRKVQTMSPGKLSMKVLGWGVSAKVVLELLTHDDQNR

SEQ ID NO: 159896 - protein, 516 aa, Glycine max
  Coding DNA Sequence Number=SeqID_43118
  Homolog annotation: Hit_ID=Q2KUQ0; Match level="QueryCoverage=24%, HitCoverage=30%, E-value=5e-49, Identity=76%"; Hit description=ABC transporter, substrate-binding protein precursor
MGERYARDTGYPIQYQWTLLKGVNDGDDELDAIPRLLKGKFGVLNVIPFNSLEGDDYQRPETERIREIVRTLHRRGVLTKVRNSAGQDVDGGCGQLRARAVGAERVPLPVQDRHPAIVGLQYAFPRQPGQGGVAALARHAAQAGDLFLRDLEAAIGAGMLLGVQLRGDGAGHGGVDVQQHVARVAGHQPVDALRQVHHQRLGELDIVVPQAFAGVARQDRDLARSQRHHFVFERLAADHGGLAEPAAGAEASQRQRFAVRAARRPFHQAVHHAVPAQGLRTLAEQAPLYQGTTASIRSTGSCLGRRFGPAGSWPVPAAAARMGCPRSAVDEGAQVNPRALCQHDDCSHLGPVREYSGPQSQKTIRGDRFSRAVLAGAIAGALLHAGAAQAQVSDDVIRIGFITDMSGVYSGPDGPGGAEAIKMAIEEMGGEINGKKIELLTADHQNKADIASAKAREWFDQRGLDMLIGGTNSSTALAMSKVAADKKKPIIVVGAGAPAMTNEQCTPYTLNYAYDT

SEQ ID NO: 159897 - protein, 205 aa, Glycine max
  Coding DNA Sequence Number=SeqID_43119
SGTWRYVAGIKRPWGRQGDRALVIDYQLGVIDYIVLPATERKSLEKDILTMHSRYGTHCNIAMAAQLIHDGVVMECLEGVWETLEGNERCRFRGTIRLTATSLVHLEEPAHTLQQPVEWILPTATPYRLVELVQVIEVSSSEEDLEEDPEELPPEPATNALDLPEDDEDPLLDVDSLEDIMSASEPDSTEESGPGGTANSDNSSS

SEQ ID NO: 159898 - protein, 232 aa, Glycine max
  Coding DNA Sequence Number=SeqID_43120
  Homolog annotation: Hit_ID=Q2HV05; Match level="QueryCoverage=26%, HitCoverage=6%, E-value=7e-22, Identity=85%"; Hit description =Peptidase S8 and S53, subtilisin, kexin, sedolisin; WD40-like
MVQKGKDAEKYFKHGSHLKRPEGAVSRESISAVKKLGHLKDEVCNATKFDLPNKDRKDSQGICFLGKVCGVSSSFTSYIFHGAGFGSKRKYMFRKVTIQLKLVEGDSAGTGPFLSQCIELFSSADNPICINELNITSLGIMEILICLGGSISSTGSTLYVLIMKFLYRIGGDGPLVAFGASDGVIRVLSMMTWKLVRRYTGGHKGSISCLMSFMAASGEVFRMTDYLYILLL

SEQ ID NO: 159899 - protein, 278 aa, Glycine max
  Coding DNA Sequence Number=SeqID_43121
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=95%, HitCoverage=67%, E-value=7e-89, Identity=56%"; Hit description =Lustrin A-like
  Pfam annotation: Domain name=DUF231; Domain location=118-275; Score =261.5; E_value=1.7e-75; Accession=PF03005.6; Description=Arabidopsis proteins of unknown function
MDALWKKKLQFNGEDFLTRLRGKSIMFVGDSLGLNQWQSLTCMLHIAVPQAPYSLARNGDVSIFTFPTYDVKVMFSRNALLVDIVGESIGRVLKLDSIQAGQTWKGIDVMIFDSWHWWIHTGRKQPWDLIQVGNHTYRDMDRLVAYEIALNTWAKWVDYNIDPTRTRVFFQGVSPDHQNPAQWGEPRANLCEGQTRPIFGFRYPGGPLPAELVLEKVLRAMQKPVYLLDITTLSQLRIDGHPSVYGFGGHLDPDCSHWCLVGVPDTWNELLYASLIKN

SEQ ID NO: 159900 - protein, 116 aa, Glycine max
  Coding DNA Sequence Number=SeqID_43122
  Homolog annotation: Hit_ID=Q6ZC63; Match level="QueryCoverage=50%, HitCoverage=19%, E-value=9e-07, Identity=49%"; Hit description =Putative survival motor neuron domain containing 1; splicing factor 30, survival of motor neuron-related
MVDPANVRSIEEGSVDALLEAERVAEATKQAIKRKIAQAASIDLQSRSLPAKLRIEADDPEDVGDDKEKAGGGGEDPEERPGGKIQKATSSRAKLEKMQFLSSSPPQRHHFTLGHF

SEQ ID NO: 159901 - protein, 143 aa, Glycine max
  Coding DNA Sequence Number=SeqID_43123
MNNNNGDDKLEMVSLVVPHVTDAIQEWIESVAQNQLMKKKAQLMFVSELGGNIVARGAHLRAELEHAAETGAGPRDRHRGTEQERGEEAEETVGRGVEEEERIGVDLGGSEPLRLRDSAPDHTRVCDKEKGRYKATMRERKVK

SEQ ID NO: 159902 - protein, 74 aa, Glycine max
  Coding DNA Sequence Number=SeqID_43124
MISLTSEVPDYGMTFVNGTSSKACCHPLMLHTICANMNGVLIEKFSLRCLMIAFGGLPGLEESIEEDDNLKIWP

SEQ ID NO: 159903 - protein, 288 aa, Glycine max
  Coding DNA Sequence Number=SeqID_43125
  Homolog annotation: Hit_ID=Q47522; Match level="QueryCoverage=21%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIIANIKRQEVSLRIRKHTGREIRQESNLTHQYEESPIRMMGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159904 - protein, 169 aa, Glycine max
  Coding DNA Sequence Number=SeqID_43126
  Gene Ontology: Mol. function=hydrolase activity, hydrolyzing O -glycosyl compounds; Biological process=carbohydrate metabolic process
  Homolog annotation: Hit_ID=Q1S4V5; Match level="QueryCoverage=50%, HitCoverage=23%, E-value=2e-17, Identity=42%"; Hit description =Glycoside hydrolase, family 10; Galactose-binding like
NNDGFDKEVVGEVKKKIEPVAGYFGIAGNDPKCLAHPQKSLYNGGIIQKPGNWIMDFKAWIQVSEGSDVPVTAVVKRTTRLKFAGAIFAESNCWSMLKGGLTVEESGPAELYFEGSDFVAKAVDLAARELITSASLGQVTQVQLDRAKVSTKSAVLMNLESEYALSNSH

SEQ ID NO: 159905 - protein, 433 aa, Glycine max
  Coding DNA Sequence Number=SeqID_43127
  Gene Ontology: Mol. function=nucleic acid binding; Biological process= DNA integration
  Homolog annotation: Hit_ID=Q1RWN2; Match level="QueryCoverage=85%, HitCoverage=36%, E-value=2e-43, Identity=30%"; Hit description =Peptidase S8 and S53, subtilisin, kexin, sedolisin; Integrase, catalytic region; Zinc finger, CCHC-type
QQQRMMAMANFVQPAIPRFDGHYDHWNLFMENFLRSKEYWQVVSDGIPVAEASMAMIDARKIENRRIAFHEEEIPRFRTSKEAVTSNTSFRTEDTIVVEKILRSLTTKFNFVACVIEEAHDIEELSLDELQSSLLGKKDEARVEPTEAEVEEAMIVEANKNMATNENINNTMRINSKEEEESECWTNLNKDNGERANFAEKEKEQVVSILMEVFSELDETFHNTVKFGDNSTIFAMGRGMVTLYAKENSTHTISNVLLVPDLKTNLLSVGQLQEKGYEISIKDGVCQIRDEKLGLIAQVNMTPNHMFPLYLHYTGHSCFSTKLKDDAWLWHFHCGHLNFGGLKTLWQKNMVMGLPQITTSSEFWICDKDSVQQHIQVDFDGGNREERQQPSENVQPITIEQQPAGSPHISTVETEDERPQRVKQRPAWMADFM

SEQ ID NO: 159906 - protein, 812 aa, Glycine max
  Coding DNA Sequence Number=SeqID_43128
  Gene Ontology: Mol. function=nucleic acid binding; Cellular component= intracellular; Biological process=DNA integration
  Homolog annotation: Hit_ID=Q1RWN2; Match level="QueryCoverage=99%, HitCoverage=98%, E-value=1e-157, Identity=48%"; Hit description =Peptidase S8 and S53, subtilisin, kexin, sedolisin; Integrase, catalytic region; Zinc finger, CCHC-type
MDDGNYVQPTIPRFDDHYDHWTIEEDSKLKDLKAKNYLFQAIDRSIMETTLNKNIAKEIWDSMKQKYQGSTKVKRAQLQALMREFEILGMKEGESVDEYFVRTLAIVTKMKSHGEKVEQLTIVEKILRSMTAKFDYVVCSIEESNNVTTMTIDELQSSLMVHEQRMRWHKEEEQVLKITNAGRTGGKGRGRGRGGRGCNNHMCGIKDWFFDFDDKFKESVKLGDNLRMKVKGKGKKSVALDIFKKFKIMVEKDYGNSICCLRTDRGGEFNSCEFNSFCSNNAVKWTIHVLNRSPTLAVKNVTPEEAWNGTKPLVKHFRDFGCIAYAHVPDAQRKKLDDKSIKCVHLGVSEESKAYKLYDPITKKVIVSRDVIFAEKEKWKWNKEEIGENKNLEECKDDNETADSPNPAQGRNRRQPAWLEDYVTTDDLHNLVIFSTAENPNTYEEAMQNNVWRKAMDVEIEEIERNNTWELTNLPSGVKTIGVKWIYKTKCNEDGTVEKYKARLVAKGYTQQHGIDYNEVFAPVARWDTIRTILALATVKGWNVFQLDAKSAFLHKELSETVYVDQPLGYQKRGFVKCSHEHTLFVKTGNEGTLLIVSLYVDDLIFTRNDEEMFVVFKQSRKEEFDMTDLGKMKYFLGIEDEDGKAIDASLYKKMVGSLMYLTATRLDLMFAVCLVSRYMEIPKGMHLAAVKRIFRYLRGVTEFGIMYRRGKEVVTLSTTEAEFIAVASCACQSVWLRRILELLGHPQLKPTTVYCDNSSTIKLSRNPVFHGRSKHIDVRFHFLRDLNKDEVIKLVQCNSQEQISDIMIKPL

SEQ ID NO: 159907 - protein, 42 aa, Glycine max
  Coding DNA Sequence Number=SeqID_43129
MKKNGAQQATGRSTWTPEWVVHLAKQVRNAHGNFEIKAQLKC

SEQ ID NO: 159908 - protein, 112 aa, Glycine max
  Coding DNA Sequence Number=SeqID_43130
  Gene Ontology: Mol. function=metal ion binding; Biological process =metal ion transport
  Homolog annotation: Hit_ID=Q1S7A8; Match level="QueryCoverage=89%, HitCoverage=90%, E-value=5e-09, Identity=40%"; Hit description=Heavy metal transport/detoxification protein
MEAQKITVKGYGLEEKKVLKAIKRAGKAAEPWPFPGHAHFSSFYKYPSYIVNHYYDAYKSEATNGVHTFFHTPAVYSVAVASDEAFASLFSDDNPHACTIMFLFEEKVKKKS

SEQ ID NO: 159909 - protein, 244 aa, Glycine max
  Coding DNA Sequence Number=SeqID_43131
  Gene Ontology: Mol. function=structural constituent of ribosome; Cellular component=ribonucleoprotein complex; Biological process =translation
  Homolog annotation: Hit_ID=O23049; Match level="QueryCoverage=80%, HitCoverage=88%, E-value=1e-88, Identity=80%"; Hit description=50S ribosomal protein L6, chloroplast precursor
  Pfam annotation: Domain name=Ribosomal_L6; Domain location=154-229; Score=114.9; E_value=2.4e-31; Accession=PF00347.13; Description =Ribosomal protein L6
  Pfam annotation: Domain name=Ribosomal_L6; Domain location=74-146; Score=63.5; E_value=6.7e-16; Accession=PF00347.13; Description =Ribosomal protein L6
  Pfam module annotation: Pfam domain module=Ribosomal_L6::Ribosomal _L6; Domain location=154-229::74-146
MTSSVTSSFRISHFVNLCLEFNEVAVALRIFDEMLVSGITNKFRVSTVPGAHVGFIRKTVECKESRIGKQPIPVPSNVTVKLEGQDIQVKGPLGELALSYPREVLVEREESGTLRVKKAVETRRANQMHGLFRTLTDNLVIGVSKGFEKKLQLVGVGYRAMVEGNEVVLNLGFSHPVKMIIPDGLKVKVEENTRITVSGYDKSEVGQFAASIRKWRPPEPYKGKGVKYADEVVRRKEGKAGKKK

SEQ ID NO: 159910 - protein, 57 aa, Glycine max
  Coding DNA Sequence Number=SeqID_43132
MSTISIISTQRCSNFIGNRGGAGGVASKSMGTDRGETEERIEAFIASNKKSYFHLPV

SEQ ID NO: 159911 - protein, 118 aa, Glycine max
  Coding DNA Sequence Number=SeqID_43133
  Gene Ontology: Mol. function=DNA binding; Cellular component =mitochondrion; Biological process=DNA integration
  Homolog annotation: Hit_ID=Q1T6H9; Match level="QueryCoverage=97%, HitCoverage=24%, E-value=7e-49, Identity=78%"; Hit description =Stomatin
VRSSAEAEYRSMASTTCELKWIKGVLSSLGISHSMPIQLYCDSQAALHIAKNPVFHERTKHIDVDCHFIRDEIVRHTLQPSYVPTHAQLADTFTKALGRAQFHSLLGKLGIWSPHAPT

SEQ ID NO: 159912 - protein, 79 aa, Glycine max
  Coding DNA Sequence Number=SeqID_43134
MRKNNEVQEVVVITPRQEEIQGSGGHIRNSKDGIWWPVTKTLPRSTAVLLFPVVLIIAALAYTRTLDTHRHVAEFLSNR

SEQ ID NO: 159913 - protein, 1070 aa, Glycine max
  Coding DNA Sequence Number=SeqID_43135
  Gene Ontology: Mol. function=nucleic acid binding; Cellular component= beta-galactosidase complex; Biological process=DNA integration
  Homolog annotation: Hit_ID=Q1S0A6; Match level="QueryCoverage=98%, HitCoverage=85%, E-value=0.0, Identity=63%"; Hit description=Zinc finger, CCHC-type; Peptidase aspartic, catalytic; Polynucleotidyl transferase, Ribonuclease H fold
  Pfam annotation: Domain name=rve; Domain location=490-615; Score= -10.3; E_value=0.043; Accession=PF00665.16; Description=Integrase core domain
  Pfam module annotation: Pfam domain module=RVT_2::Retrotrans _gag::rve; Domain location=784-1039::65-179::490-615
MASEQGPDGKKSVVNVGVVKKTPSPYDLNSNDNPGSIITQVQLRGIVKKPNEESPEMEDWWTVQSMVVSWILNTIESSLRSTISYMENAKELWDDIKERFSVANGPRIQQLKSELAECKQEGMSMVNYYGKLKALWDELGNYHQIPTCTCEGCKCNIKAKLEKQREEEKVHQFLMGLDDVVYGTTRSSLLVTNPLPSLNRVCATLIQEERVKAISRTKEERTEIVGLAVQTGGRARGRGDTKDKGIVCSNCNRTGHDTMGCFQIVGYPDWWGDRPRHETKADARMKGQQQERSANSGRGRGMGVRANAAQATIGRTVEAAAGVDNGGLAGLSTEQWQTLMNMLDSQKGNPSERMTGKEDWIIDTGASNHMTGNLRLLQELKEVQGCPIGLPDGQKLGATKEDRTSRMLIGLGERIDGLYYFKGTRNEKAFKIDSGLSLDIWHRRMGHPSLKITKLVSNNSSRNNDYENKACDVCQRAKQTRDSFPLSNNNAADVFELVHCDIWRPYKTPSSCGAYYFLTIVDDYSRAIWIFLLLDKREAPRALLNFIALVEKQYEKYLINRTPTPLLNGKCPYEVLNGKPPTYKHLRVFGSLCYAHNQGRKGDKFASRSRKCVFVGYPHGKKGWKLFDLDTNTYFVSRDVDFFEAEFPFGQEPVISSGESMTHMLDGEALADDENVHREQFVNVELPREESHDDVRGELDRGKRAKIPSTRLQDCVTNTVKTSESPSASSPISQHQTKVRYPIAHYTNYEKFSLHHRKFLAAVVVDREPMSFAEAIKDSRWRLAMQQEIQALEDNNTWKVCSLPTNKKALGCKWVYKIKYHSDGTIERFKARLVILENHQVEGINYNETFAPVAKMVTVRIVLAVAAAKRWELHQMGVHNAFLHGDLKEEVFMKFPPGFHSSQPGMVCKLQKSLYGLKQAPRCWFAKLSSALKDYGFVRSYSDYSLFTLQDKDIRLVVLVYVDDLIICGNDHDSIQCFKDYLRRCFHMKDLGKLKYFLGVEVARSPKGVFLCQRKYALDIISEVGLLGAKSASTPLEQNHHLSLSNSELLPDPDRYRSNRKLSIGMLLCE

SEQ ID NO: 159914 - protein, 116 aa, Glycine max
  Coding DNA Sequence Number=SeqID_43136
  Gene Ontology: Mol. function=RNA-directed DNA polymerase activity; Biological process=RNA-dependent DNA replication
MPYESSCAHATDAWEGQHDDSEKRERVVYYLSKKFTACEMNYSLLGRMCCALVWAAHCLRQYMLSHTTWLAIKGSALADYLAQEPLNDYQPRHPEFPDEDIMALFEEEVEDEDRDK

SEQ ID NO: 159915 - protein, 72 aa, Glycine max
  Coding DNA Sequence Number=SeqID_43137
MAPKKLSAKRSRRDTAAEGTSAATEFDSHHFRSAEHPQCFEAIKGWSFHRERRVPLRDDEYTDFQEEIAHRH

SEQ ID NO: 159916 - protein, 90 aa, Glycine max
  Coding DNA Sequence Number=SeqID_43138
MPMLDQFHLCIHDSIKNIVDVKANSNGGYHAIVVLLSMSEDSWALVCNHLLKELAKWSDKYINLFGGIDKFEELKRSLLVDRLSIVIMDK

SEQ ID NO: 159917 - protein, 121 aa, Glycine max
  Coding DNA Sequence Number=SeqID_43139
MSSPPCLFKDHQSLLFQRLSESFVETSMSPLLCKTTRSFVDIPDGSYALSLLTGFTAWASTGGRSDDEIAQMKLGRIELLNTNCRAIHKVFRCFGKKCGKYPKGRSKWSLGDLARLGHQKA

SEQ ID NO: 159918 - protein, 113 aa, Glycine max
  Coding DNA Sequence Number=SeqID_43140
MGVAPQSSLYLPLSVSHKFTDLGFGVANLELPLLYFDLLFDLDSAIDKDTKNVADLLLFFSLFGNLLELYILESKICGSVHTLLCPLAFLFQIHDGSFINVFHTRCLPSDLAW

SEQ ID NO: 159919 - protein, 134 aa, Glycine max
  Coding DNA Sequence Number=SeqID_43141
MIIQCFDQECKKYEKGGKRVFSLVFLDPSSPRLASGLPGPPNSFMVKKPTHLGELQLPQSEPLPINRCPRGSKGQKWRELREERKKKKKEEEMKPRRYRIVTVIVPTLFLVLCSCDCRLKELRRSKFLIAPEDT

SEQ ID NO: 159920 - protein, 125 aa, Glycine max
  Coding DNA Sequence Number=SeqID_43142
  Gene Ontology: Cellular component=integral to membrane
  Homolog annotation: Hit_ID=Q6DAY2; Match level="QueryCoverage=99%, HitCoverage=28%, E-value=2e-45, Identity=69%"; Hit description =Putative membrane protein
MAFLSLVPAIGSAIVWVPAAIFLFATHQIWQGLFIVGFFVIVVGLVDNILRPLLVGKDTKMPDYLILISTLGGMELYGINGFVIGPLIAALFIACWNLFSGRDHEGNAEELDADFIEEGKKPPDL

SEQ ID NO: 159921 - protein, 42 aa, Glycine max
  Coding DNA Sequence Number=SeqID_43143
MLGGIAWCINSTLTSQQRRDNSTEEARPLTPSGIGPGSMRPP

SEQ ID NO: 159922 - protein, 382 aa, Glycine max
  Coding DNA Sequence Number=SeqID_43144
MTMRFIMKELPTPAQKRGVLELNSHDSILAQNNLLTQQLDALTKKISKIPQLQSGQAPQSGAQQVLSCALCGGGHPSDQCFMLGGSQEEMNCMGNQNCQGIYGNPPYSNAFNQGWRNNNNLDDEEGEIEEESEKKCKGSEKVESEKKKKNEEEREKEVWRDLLDLEASINLLTFSLLAKNSDLDLKSTWMTLQLVGRSIKHPYGVVEDVLVKVDKTIFPVDFVVMDMEEDSKVPFILGRTSMHAAKILLNVHNGQTKLRVLIDTFEALNEEEEKVIGECLPSLDALKEIPPHEVKKKEEGMKVKKKIKKVKDELHMLPLGLKYVSFKEDDEKQAIMSKLKSNFYKSIARKLKSKLSKHSTIQNSKPYGVVELEEPTSQKNWV

SEQ ID NO: 159923 - protein, 93 aa, Glycine max
  Coding DNA Sequence Number=SeqID_43145
MVLKEELVACSRSKRSLSQRLCETETNMLAIIAKYQEELGLATAHEHRIVDEYAQVYAEKEARGRINGSGMEKEEREETPLQGEDESRRSSPP

SEQ ID NO: 159924 - protein, 245 aa, Glycine max
  Coding DNA Sequence Number=SeqID_43146
  Gene Ontology: Mol. function=hydroxypyruvate isomerase activity
  Homolog annotation: Hit_ID=UPI00005FA7F9; Match level="QueryCoverage =97%, HitCoverage=96%, E-value=5e-99, Identity=71%"; Hit description =COG3622: Hydroxypyruvate isomerase
AAFRGGERFVFTADPAAVTHAIQLREDKLAVDFAGARLVPPRVVGDLNVVDLRQQALKGLRQLSLHALHVVKVVLQIQVGAADRFDQFDRLPGGLQVELRHVVAVDRFDQQADILPRQGVGGVAQVLLHPFVGGVAADGGIRIADQAVDAIAAQRLRILDRAPDAVAELRFAPRQAGDTPFARRPVAGRQVEQHLAQAMRLQFAAQRGDRVVIGKHVFHRAEALLLRPAEALHEIDFGEQHGQVG

SEQ ID NO: 159925 - protein, 300 aa, Glycine max
  Coding DNA Sequence Number=SeqID_43147
  Gene Ontology: Mol. function=DNA binding; Cellular component =chromatin; Biological process=DNA integration
  Pfam annotation: Domain name=rve; Domain location=1-90; Score=-13.1; E_value=0.074; Accession=PF00665.16; Description=Integrase core domain
  Pfam module annotation: Pfam domain module=RVT_2::rve; Domain location=160-297::1-90
MRSDNAKELALTEFLQNVGVVHQFSFPHRPQQNSVVERRHQHLLNVARALMFQAQLPIYFWGECVSTTAYIINRTPSSNMQNQSPYDLLYGKVPAYDLMKAFGCLCYAATIPTQRHKSTPQPPPEPEPQLEIKPDLAQPDVQPNAHFYHQAVRFPEWRQALNEEIQALEMNNTWVVQPLPPDGSLDKYKARLVAKGYTQQAGIDFLDTFSPVAKLTTMRVLLSVVAHRNWNMLQLDINNTFLNGHLIKEIYMDMSLGYPVKNDNMLPDNGFTSSPPPFLIKDFSNAMQITLCSLEGVEQL

SEQ ID NO: 159926 - protein, 84 aa, Glycine max
  Coding DNA Sequence Number=SeqID_43148
MEEKNTKREKERCFPPSSPRQAGLLPPEATFSPESFGWAKMGPIAIYTPILLNTPSFSCFWLISFQNVAELYGLRDDACLSVPK

SEQ ID NO: 159927 - protein, 126 aa, Glycine max
  Coding DNA Sequence Number=SeqID_43149
  Homolog annotation: Hit_ID=Q1SMF0; Match level="QueryCoverage=95%, HitCoverage=23%, E-value=6e-10, Identity=30%"; Hit description =Tetratricopeptide-like helical
MDEDWYMHDSIMSEEVHMNEQNKDDAGVNEEHIDCFDAFNTSSVFASRDDVLHWVRFVAYEISFVTVIMRSDTNTDIRGKTLFVLIGCERSGQYRARKKDLVTTVTRSRKCGCPFKLRAKPVVGGE

SEQ ID NO: 159928 - protein, 156 aa, Glycine max
  Coding DNA Sequence Number=SeqID_43150
MDFYKVERNLKDRRSLGDWIKGAQEKPITKHQRSTKHDPSYWEYVDALHSMQNSNFSVKHSASSSDQARPRRTLSMLDLFHPCFHDSIENIVDVKVDGMGEDSWSLVHNNLLKELAKWSNEYITLLGGINRFEELKQSLLVDELSMYIIFSYVLMD

SEQ ID NO: 159929 - protein, 174 aa, Glycine max
  Coding DNA Sequence Number=SeqID_43151
  Homolog annotation: Hit_ID=Q5XM22; Match level="QueryCoverage=34%, HitCoverage=35%, E-value=5e-16, Identity=66%"; Hit description =Resistance-like protein HAAS-2
VPVAKDVHHMNDVANKVHEQPQEVIPDAQGEVTITLDNVASLLYPPIIDAFHSFETLHVDEAVLFKCDAAHWTVAAQAYLLHLLGCTLFANKTHMHVVFLDAFRDLTQSGSYALGASALVHMYDNLNDASKRNDLMVFRYGCSTFNRVTTVDNGVDAEEIGVDVPLGEVKLAVL

SEQ ID NO: 159930 - protein, 99 aa, Glycine max
  Coding DNA Sequence Number=SeqID_43152
MKLTSMSEKNERNTGGNGRRRRRTSIMALKTNTRHLAEEKRNAKHLEEEDEYKELAEEEDERKKLRKKKMNGRRVALFYLKLMKDNFVHSLKVLGAPTM

SEQ ID NO: 159931 - protein, 120 aa, Glycine max
  Coding DNA Sequence Number=SeqID_43153
MENGCMYEEENGAASTEATTEGGVLPDAPLVQSPTARGHRGADGGTTTMAAEISQWCKQIKREKETKTKVIWPLTPPATGPRARNYHGIVAEGGGGMDRGIAASLELAIKKRKTLISQNK

SEQ ID NO: 159932 - protein, 235 aa, Glycine max
  Coding DNA Sequence Number=SeqID_43154
  Gene Ontology: Mol. function=RNA-directed DNA polymerase activity; Biological process=RNA-dependent DNA replication
MVTSKKPQKKGLTRLSKLPPRVGIALNVLVSLREFPSRVGIALSAHVSLNCDGSLEEPKCRGGGAYVFKEKLKGVKVSLRKWNLEEFGMTQRKQQLIVKEMNELDILEELGSLDEESSKRRLQLQEDLWKVEKFNESLLLKKSRVRWIKEGDCNSKLFRSIINWRRRKSLLKGMDVDEEGVEDPGRVKEEVENVFFEKRFKEDNLYRPKVDGVAFKQILIEDNSLLEAVFEEEEV

SEQ ID NO: 159933 - protein, 113 aa, Glycine max
  Coding DNA Sequence Number=SeqID_43155
MWKILVEIQIRFLWGGDDESKKIPWGHWEDICKSKEMGDPSSPRLAYGSPEPPNSFMVKKPARLGVHGSKVERIERREKEEEERRGNKAEALPNHDCDRSLHRSLFGVLRATV

SEQ ID NO: 159934 - protein, 42 aa, Glycine max
  Coding DNA Sequence Number=SeqID_43156
FHEEKYCSWGHVTQFGSSLRLKLITMGKKLLVHDRVTSTLVA

SEQ ID NO: 159935 - protein, 718 aa, Glycine max
  Coding DNA Sequence Number=SeqID_43157
  Gene Ontology: Mol. function=protein binding; Cellular component =outer membrane; Biological process=pathogenesis
  Homolog annotation: Hit_ID=UPI00005F9489; Match level="QueryCoverage =87%, HitCoverage=76%, E-value=6e-67, Identity=30%"; Hit description =COG3468: Type V secretory pathway, adhesin AidA
  Pfam annotation: Domain name=Pertactin; Domain location=420-540; Score=-12.4; E_value=0.00013; Accession=PF03212.5; Description =Pertactin
  Subcellular localization annotation: CTP_CleavageSite=63; ConfidenceScore=5.60e-01
DTSGDQSNGVTASNAGTKVNLDNSKVTTAGASAFGLYASGASTLDASNVQVTTSGDKAYGVVSESAGTALTFTGGEVTTGGQGAYGLYARTNSTLNVGNVIVNTAGKNAHGGYVTGEGSVLNVDNSSFIVSGAEANGLQADGKSTLNATNTAIEITGDGSGTYASGTGTVLNLSDSHIHMGQNAGNAALGKYNSTTNLKNVEIITDASNAALAVGYGATLNSDNVNVQARSGGFGIQVQDGSTFSGNNITIQKSGTDSEGFNAAINMTNLYYPDARNTLFLSDAAINVSGENATGILSRRQATLADIKLANTTITATDGTAVNVLTGTSMNIDADNSVLSGSTLLKTGYNTAEGSTAGSVVLNGSNRSLFIGDVDIDRSQTTDSQINLSGSSVWTGASSGLNTLTLNDNSQWNIMDNSSVDALTANNSVINVAHNTANFTVLTVNGNYTADNATLVMNAALGGDTSATDRLHVLGDVNGNTDVVVNNAGGSGAQTIQGLQLIQVDGATNGEFRQKGRIVAGAYDYNLVKGADQHGWYLVSDKNSSEPDPVVTPGEGEGGQIVEPPVNQHNMIVRPEAASYSANLAAANTLFTTSMDDRPAETFYTDANGQQQSTRLWLHNSAGHSRVKDSSGQLKSDTNRYAIQLGGDLASGTLTGSDSLRLGVMAGYGNAQSKSRSAVSGYQSRGQVNGYSLGVYGSWLQNAAEQSGAFVDSALSYG

SEQ ID NO: 159936 - protein, 184 aa, Glycine max
  Coding DNA Sequence Number=SeqID_43158
  Gene Ontology: Mol. function=chromatin binding; Cellular component =chromatin; Biological process=chromatin assembly or disassembly
  Homolog annotation: Hit_ID=Q1SAV4; Match level="QueryCoverage=74%, HitCoverage=34%, E-value=9e-28, Identity=48%"; Hit description =Integrase, catalytic region
  Pfam annotation: Domain name=Chromo; Domain location=86-143; Score =24.6; E_value=0.00036; Accession=PF00385.14; Description='chromo' (CHRromatin Organisation MOdifier
VLFKLRPRRQSTATGSQYSKLAKRFYGPFQIVQRIGPVAYKLDLSESSRIHPIFHCSLLKPYRQSTTQPEAPLSLPPLLEEHQPLITPLFILDTKWTQSGEDKDLLVLVQWDGLLSEDTSWEPWAQLKSDYNLEDKVILEAQGDVKSRNTQAEEADTEQQAARKQHGKAKKGEGQRLKREIHKP

SEQ ID NO: 159937 - protein, 90 aa, Glycine max
  Coding DNA Sequence Number=SeqID_43159
  Homolog annotation: Hit_ID=Q94CI5; Match level="QueryCoverage=52%, HitCoverage=10%, E-value=1e-07, Identity=57%"; Hit description =Protein kinase AtSIK
MRTIVEHLETVQDLKYSCRFPLQEPAKEMSRSPSLNGIICHAPPRLSFSPSAASVVARPSVSSPRWSARSGGVPTLHLPLHACSSSSSPR

SEQ ID NO: 159938 - protein, 225 aa, Glycine max
  Coding DNA Sequence Number=SeqID_43160
  Gene Ontology: Mol. function=protein-tyrosine kinase activity; Cellular component=integral to membrane; Biological process=protein amino acid phosphorylation
  Homolog annotation: Hit_ID=Q94CI5; Match level="QueryCoverage=66%, HitCoverage=27%, E-value=3e-49, Identity=63%"; Hit description =Protein kinase AtSIK
MEQRLSSPQPLPLPSHQGGGALKAIDSFKSGIASVSLYASGPAPDVAEQDAFSSVEYEELEGLKHRVGLMKEQCSSIPQPLHLPPTGLIRNFTYEEIAAACHNFSSDRCMSERLSSTIYSASFGDDASSAKKFEATVTRLHSSTHGLKEFINEVNTLASLQHPHLCKLLGFHACDGSEPRMLVYERLCHGSLDRQLFGRSDGSSIDWNSRMKIVICAAQRSYFLA

SEQ ID NO: 159939 - protein, 768 aa, Glycine max
  Coding DNA Sequence Number=SeqID_43161
  Gene Ontology: Mol. function=zinc ion binding; Cellular component =mitochondrion; Biological process=regulation of transcription, DNA -dependent
  Homolog annotation: Hit_ID=Q6Z3U3; Match level="QueryCoverage=90%, HitCoverage=75%, E-value=1e-168, Identity=50%"; Hit description =VP1/ABI3 family regulatory protein-like
  Pfam annotation: Domain name=B3; Domain location=226-343; Score=73.0; E_value=9.8e-19; Accession=PF02362.12; Description=B3 DNA binding domain
  Pfam annotation: Domain name=zf-CW; Domain location=510-555; Score =56.0; E_value=1.2e-13; Accession=PF07496.5; Description=CW-type Zinc Finger
  Pfam module annotation: Pfam domain module=B3::zf-CW; Domain location= 226-343::510-555
IASNEKPNGSGTSKVQNVSTQQQCTSLANQLTVRGMQVGHYAENDELQCWFKTHNVETDGPFAEMKPEILPSVGELGNTLISQFHCESNGSSKASKAENCKPETEMRDIYESLAQTNLSMTLAAPLGNSNPFHSAVVDEREQSKTSPLLLGSRSHHLLPKPARSTIGTSLEANAGMVSQIRVARPPAEGRGRNQLLPRYWPRITDQELQQISGEYPTFSNSTIVPLFEKMLSASDAGRIGRLVLPKACAESGNLLKLKEETIVQAYFPPISQPEGLPLRIQDVKGKEWMFQFRFWPNNNSRMYVLEGVTPCIQSMQLQAGDTVTFSRMDPEGKLIMGFRKATNSTAVQETLPSNMPNGSHSSETSYSGVYVNLPILSGYSGLLQLQKGCSETHLNALSKKWNSAGGDMSWHNIDMPESRKRDELPLPPVMVPEKKRTRNIGSKSKRLLIDSQDALELKLTWEEAQDMLRPPPTVKPSIVMIEDHVFEEYEEPPVFGKRSIFVVRSTGVNEQWTQCDSCSKWRKLPVDVLTPPKWTCVENLWDQSRCSCAAPNELNPRELDNLLRLNKDWQQARDWPWNMNLQDWMLWQMQQYWVMMQVTLAGHQLLAPQNILGIDLGALALSVSSHQKRQSEREAEIAQRNQLSWRTKDESEVDSTLRHLTPVDRLENEVRVQNELDSRSQNHAVAEAAKGQLDLNCQPDREDVQAWPNNLSMTSLLEEANLPLETYLKRNGLSSLISEQQTNSASNVQAQTTNDSEGKHNEDCGTAL

SEQ ID NO: 159940 - protein, 266 aa, Glycine max
  Coding DNA Sequence Number=SeqID_43162
MTPRINHLSRFALLRPDPQELAAKLYIPGRGFELNVDGQPLKILRKNMTTLAQTWSVLSFSNLIPTSHTFDVTLDRAKLIYGIIMKMDMNLGYLISHQISLIAQHDTSRLGFPTMITSLCIARSVQSDSRSLENLSPAINMAYIKKNCWNLDDPIVTFGGLRKARGKRSEVPTTSTPPETPIPSSSTAPVPLIQTPAISPTFTQLPLPAPLSAGPSNFIFTPQMLHFMLQSIHRGQSIIIQSLQGLSLPSIMSMDEFDLQVAWLGA

SEQ ID NO: 159941 - protein, 151 aa, Glycine max
  Coding DNA Sequence Number=SeqID_43163
  Homolog annotation: Hit_ID=Q8W4L5; Match level="QueryCoverage=26%, HitCoverage=5%, E-value=3e-08, Identity=56%"; Hit description =Putative VP1/ABI3 family regulatory protein
MFLIHCCVPYIHVSNSRVNFNSRSSIRNLEHHYPHLSQRSANSPDRRAQPLRHRIVVEVAHATFMQLLDSIYNSNSTQTLQKKSEKSERKTLTVTSPARSTPDVKSSSGEATVPKLSRRGSSSGSSGRRKFARGSSGRRKLIFKRRRGGEW

SEQ ID NO: 159942 - protein, 95 aa, Glycine max
  Coding DNA Sequence Number=SeqID_43164
MRVSRIVGESRRGLVNDVARTVVFSKRGWVDDDVGSMTSLGSNTWTTLGAVWTLWIHRNAVIFKEENSELEKMVELVKVRSWMWLSSKAKGFLAK

SEQ ID NO: 159943 - protein, 80 aa, Glycine max
  Coding DNA Sequence Number=SeqID_43165
  Subcellular localization annotation: CTP_CleavageSite=28; ConfidenceScore=5.16e-01
MDSSGALSGMIPRSANMHSSSFFQILPRAQPKECFFLTLSLKNGVLSGWLAKPTDWLSEHIKISTSQTCLINLKLKGNDY

SEQ ID NO: 159944 - protein, 174 aa, Glycine max
  Coding DNA Sequence Number=SeqID_43166
MQKGLWTRQYLNSTELSPSNQEKGNHDLKWSSPFDCQPKSCALETFSPRTKQTQKEKAETLKAKFPTKKKQTIPKKNVSSKWSFRNEMLNIQNLIYGYEKISSAYSPSPIDTLFFIQKAYVALISWKFCLFTKACSHFDKENTETIFSLTVVKNYVGLSSSSQIERKTAKVNML

SEQ ID NO: 159945 - protein, 158 aa, Glycine max
  Coding DNA Sequence Number=SeqID_43167
MTTQSSNASNAIVIKFFVLPCLLFSFLVYVRYCAYLSSPFNGAHQIHCCLQLCTDLRPHSMLTRMSLRFLYSYHRQWYPNYPTYVLFKYKGEEHFIKLHKYGNRYFFGDELKGLRRTHDIYKSVIMHFVAWDKNTTFHVEVMGPLYRRTRERFYYQRL

SEQ ID NO: 159946 - protein, 111 aa, Glycine max
  Coding DNA Sequence Number=SeqID_43168
  Subcellular localization annotation: CTP_CleavageSite=66; ConfidenceScore=5.17e-01
MENGCMFCKSELGPKRKEESFLILPFSFFLSFFRAFPQAASSSSVSCACVFREPPCFIREVVVLIPQVASSSLLRVPLLLPFFRELPFVRSSSSAVCRYVVDPLKDLGHPL

SEQ ID NO: 159947 - protein, 108 aa, Glycine max
  Coding DNA Sequence Number=SeqID_43169
MKWKKARTKKTDQMTSEAAKEITDTITSQGSFVAHERQDVQTVAIGRPEHPGRYLKIDVNLIDQRVMEFCGKKIQGIGDTYTNLGILKLDSKQVDWFTTEKGKEVKKS

SEQ ID NO: 159948 - protein, 177 aa, Glycine max
  Coding DNA Sequence Number=SeqID_43170
MPTTIRLPLDTLSLYFFEIDHLIGEEFVVRWWQFVEVHVDVVFHGGGLWRQNEVVKKMKSCQTQVNVPSTCTTKDVPSNVLRQRSQAVKPLILCEWGYKRILRREKGDTKEFRRLVLCSFGKGRKETQKEFRRLVLGEFFLAKGEENEKMNSTSFQGLENQKAFGTKKKKKFKEIQG

SEQ ID NO: 159949 - protein, 169 aa, Glycine max
  Coding DNA Sequence Number=SeqID_43171
FCKSRLGPKRKEEVLQKWIRPKTEKGCSVRLKPGQSDSTQSAITQQGWKTLVATRREWRDHYGSHHEGRRAARGTTGAKSSGTRPPWGTTVMAAEISLWGKKKINKIGRISLAGGHGRVTMEGDAMRCYERKKKKRKEEEEEEEEEEEEEEEEEEEETLERKREESQNA

SEQ ID NO: 159950 - protein, 317 aa, Glycine max
  Coding DNA Sequence Number=SeqID_43172
MQPAPSLVMDIWRCNIYGGAHESGMSMAQDDTSKEGGNFFQGQGWRSHPKNNFNKDQGGPSNWPLNQGLNLYDKTTKLEDTLTQFMQVSLSNHKSTESAIKNLEVQVGELAEKSIGNFVANTEKNPKKECKIVLTKSQTKENVEKEKRVEGALEDVNDEEGEDTLQKEAFFPQNFSHGLIPSEIFEFWTEFFPWNSFRRKYNLPTDGYPQRSVRQKFDSFPEDYFNGICIRRNLKIFPNIKTPTLIASHSLFNLISFLPPTASSLTPILSPMLPHRHCKPTLGLSPPTVFLHWGCNVINYGSLRPPQGIVTPANITL

SEQ ID NO: 159951 - protein, 63 aa, Glycine max
  Coding DNA Sequence Number=SeqID_43173
MEKEEKCFERCICRREMKGANPRKADTWKPIVNQVAKRLSSWKHKTLSLVERVVGKMECGDGV

SEQ ID NO: 159952 - protein, 227 aa, Glycine max
  Coding DNA Sequence Number=SeqID_43174
  Homolog annotation: Hit_ID=Q4TVR0; Match level="QueryCoverage=58%, HitCoverage=15%, E-value=3e-08, Identity=33%"; Hit description=NRG1
  Pfam annotation: Domain name=RPW8; Domain location=1-140; Score=7.1; E_value=2.9e-05; Accession=PF05659.2; Description=Arabidopsis broad -spectrum mildew resistance protein RPW8
MDAALGALFGELLKAILLAKDKAIMFKETMDHLESTLKSIEPVIRKIEKHNKKLGRPKEELESLKTKMENGAKLVSKCSEIHKLDFVTKIRYQSKLEALEDSLTKFFVIDLAAQTARDQKETLRKVRRMVNAAKKLPFNSVDESNPKPAGEVIESEIEAESDYDDAVSVDSAPICENESDTISHSDEQQIVEEAEPFDSNENGVDSEEDGVVEFCVSDLGGEHDEKG

SEQ ID NO: 159953 - protein, 270 aa, Glycine max
  Coding DNA Sequence Number=SeqID_43175
MTAHNRWQVFRGKSDQADDLIFNIQEHHMIQLKTKLDVFLAKNTEENDCDFRVKGTWSGISYVVYAVPSNNIIAQNHNHSNIPNPPSHTIDNNNNIDLTTHSTTKPKKNPKTRNRFRGGQGEKPETDGGKGKERAVVGRWILMHCDTVLVGLISSFKTRSGGGLLSREWFQNPRLSLCLSGIWTPWLCMARNTRVTTTTTARATTTLVDDSGLFKGEKMKMESRWRVVETEREKGEGGKVVRRILELGKALGMKYDGNEEILLRLWCPWN

SEQ ID NO: 159954 - protein, 63 aa, Glycine max
  Coding DNA Sequence Number=SeqID_43176
MRNNGVDVSVLEPSTADNFPEYAHKLIKRKVKRETMEDSRFVVGQMEKAQEQPIDLESRVVTH

SEQ ID NO: 159955 - protein, 197 aa, Glycine max
  Coding DNA Sequence Number=SeqID_43177
  Homolog annotation: Hit_ID=Q1SFC5; Match level="QueryCoverage=63%, HitCoverage=16%, E-value=2e-07, Identity=31%"; Hit description =Asp/Glu racemase
  Pfam annotation: Domain name=DUF1723; Domain location=125-174; Score =19.5; E_value=0.0025; Accession=PF08330.1; Description=Protein of unknown function (DUF1723)
MVGSSQRKSPTNQDEFANIGKSTPLPTPMVSRNQTKSLSPYYPKLDYEAINSWFPTYEDEYPIVHKETIRSDFLKEKSGIFKASPPKDRKTIFSWLAGVEAKKSQHWKNIDIYDLIQLSKYDIVSLDMPMLMASFLFWNRSLHALKLPYGPISLTLSAIAANTSLKPLEDICLGKFLLASVYKVKEKAIKIMDTPEK

SEQ ID NO: 159956 - protein, 124 aa, Glycine max
  Coding DNA Sequence Number=SeqID_43178
MHASSTQTASTTGEFGHSEGIAPCNSDMAMHRELPVVGAQAGGRRAGCSSAAVVQDGGAAAYQNRQYDWRIHLQRNRQPGWRFALFKKFSPFPYKKKKLPSAQASLLALRYSSKFSQDSNSLFS

SEQ ID NO: 159957 - protein, 93 aa, Glycine max
  Coding DNA Sequence Number=SeqID_43179
MAPNKSDHVKVPIINNIESAKKVFPKDWFIIGKWVNFQSLMEEGSIVNSIFDHANQTPFLGTSKQDRVNIQGVFNGKKGIISPKTLITVIGSP

SEQ ID NO: 159958 - protein, 84 aa, Glycine max
  Coding DNA Sequence Number=SeqID_43180
MARQLLEHQSHNCFCHNSQDFRRLCFTELSCIFKNTKGGVMAPVRRHMENWRWTFRRQRSRIFKAHSHQELHAGWIITRGSEDE

SEQ ID NO: 159959 - protein, 941 aa, Glycine max
  Coding DNA Sequence Number=SeqID_43181
  Gene Ontology: Mol. function=protein kinase activity; Cellular component=integral to membrane; Biological process=protein amino acid phosphorylation
  Homolog annotation: Hit_ID=Q84XU7; Match level="QueryCoverage=94%, HitCoverage=94%, E-value=0.0, Identity=52%"; Hit description =Receptor-like protein kinase
  Pfam annotation: Domain name=LRRNT_2; Domain location=30-70; Score =55.0; E_value=2.6e-13; Accession=PF08263.3; Description=Leucine rich repeat N-terminal domain
  Pfam annotation: Domain name=LRR_1; Domain location=123-146; Score =13.5; E_value=0.77; Accession=PF00560.23; Description=Leucine Rich Repeat
  Pfam annotation: Domain name=LRR_1; Domain location=158-180; Score =10.3; E_value=3.3; Accession=PF00560.23; Description=Leucine Rich Repeat
  Pfam annotation: Domain name=LRR_1; Domain location=182-204; Score =18.6; E_value=0.023; Accession=PF00560.23; Description=Leucine Rich Repeat
  Pfam annotation: Domain name=LRR_1; Domain location=206-228; Score =13.4; E_value=0.84; Accession=PF00560.23; Description=Leucine Rich Repeat
  Pfam annotation: Domain name=LRR_1; Domain location=230-252; Score =9.1; E_value=5.7; Accession=PF00560.23; Description=Leucine Rich Repeat
  Pfam annotation: Domain name=LRR_1; Domain location=254-276; Score =9.4; E_value=5; Accession=PF00560.23; Description=Leucine Rich Repeat
  Pfam annotation: Domain name=LRR_1; Domain location=278-300; Score =15.2; E_value=0.24; Accession=PF00560.23; Description=Leucine Rich Repeat
  Pfam annotation: Domain name=LRR_1; Domain location=302-323; Score =9.5; E_value=4.7; Accession=PF00560.23; Description=Leucine Rich Repeat
  Pfam annotation: Domain name=LRR_1; Domain location=326-348; Score =13.8; E_value=0.64; Accession=PF00560.23; Description=Leucine Rich Repeat
  Pfam annotation: Domain name=LRR_1; Domain location=349-371; Score =5.4; E_value=28; Accession=PF00560.23; Description=Leucine Rich Repeat
  Pfam annotation: Domain name=LRR_1; Domain location=377-399; Score =13.8; E_value=0.62; Accession=PF00560.23; Description=Leucine Rich Repeat
  Pfam annotation: Domain name=LRR_1; Domain location=401-423; Score =16.1; E_value=0.13; Accession=PF00560.23; Description=Leucine Rich Repeat
  Pfam annotation: Domain name=LRR_1; Domain location=425-447; Score =13.3; E_value=0.9; Accession=PF00560.23; Description=Leucine Rich Repeat
  Pfam annotation: Domain name=LRR_1; Domain location=449-471; Score =4.6; E_value=39; Accession=PF00560.23; Description=Leucine Rich Repeat
  Pfam annotation: Domain name=LRR_1; Domain location=473-495; Score =17.0; E_value=0.068; Accession=PF00560.23; Description=Leucine Rich Repeat
  Pfam annotation: Domain name=LRR_1; Domain location=497-519; Score =13.5; E_value=0.76; Accession=PF00560.23; Description=Leucine Rich Repeat
  Pfam annotation: Domain name=LRR_1; Domain location=521-544; Score =11.0; E_value=2.5; Accession=PF00560.23; Description=Leucine Rich Repeat
  Pfam annotation: Domain name=LRR_1; Domain location=75-97; Score=0.5; E_value=2.3e+02; Accession=PF00560.23; Description=Leucine Rich Repeat
  Pfam annotation: Domain name=LRR_1; Domain location=99-121; Score =13.0; E_value=1.1; Accession=PF00560.23; Description=Leucine Rich Repeat
  Pfam annotation: Domain name=Pkinase; Domain location=674-941; Score =101.3; E_value=2.8e-27; Accession=PF00069.15; Description=Protein kinase domain
  Pfam annotation: Domain name=Pkinase_Tyr; Domain location=674-941; Score=56.1; E_value=6.5e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=30-70::123 -146::158-180::182-204::206-228::230-252::254-276::278-300::302 -323::326-348::349-371::377-399::401-423::425-447::449-471::473 -495::497-519::521-544::75-97::...
  Pfam module annotation: =99-121::674-941::674-941
MKQVQLILLLSVSLVLLGPILVISIDLSSFNDDVLGLIVFKAGLEDPKGKLSTWNEDDYSPCNWVGVKCDLANNRVSSLVLDGFSLSGHIDRGLLRLQFLQILSLSRNNFTGTIAPDLLSIGDLQVVDLSENNLYGPIPDGIFQQCWSLRVVSFANNNLTVVNFSSNQLHGELPSGMWFLRGLQSIDLSNNFLEGEIPEGIQNLIDLRELRLGSNHFTGRVPEHIGDCLLLKLVDFSDNSISGRLPESMQKLTSCTFLSLQGNSFTGGIPHWIGEMKSLEVLDLSANRFSGWIPKSIGNLDLLSRLNLSRNQITGNLPELMVNCIKLLTLDISHNHLAGHLPSWIFRMGLQSVSLSGNRFSESNYPSLTSIPVSFHGLQVLDLSSNAFFGQLPSGIGGLSSLQVLNLSTNNISGSIPMSIGELKSLYILDLSDNKLNGSIPSEVEGAISLSEMRLQKNFLGGRIPAQIEKCSELTFLNLSHNKLIGSIPSAIANLTNLQYADFSWNELSGSLPKELTNLSNLFSFNVSYNRLQGELPVGGFFNTISPLSVSGNPLLCGSVVNHSCPSVHPKPIVLNPNSSYSNSGSSLQNNHHKMMLSISVIIAIGAAIFIVIGVVVVTVLNIHARSSMLSSAAPFVFSGGEDYSGSPANDPNYGKLVMFSGDAEFVDGAHNILNKDSEIGRGGFGVVYCTVLRDGHCVAIKKLTVSTLTKSQEDFEREVKMLGKIKHQNLVALEGYYWTPSLQLLIYEYLARGSLQKLLHDDDSSKNLLSWRQRFKIILGMAKGLAYLHQMELIHYNLKSTNVFIDCSDEPKIGDFGLVRLLPMLDHCVLSSKIQSALGYMAPEFACRTVKITEKCDIYSFGILILEVVTGKRPVEYMEDDVVVLCDKVRSALDDGKVEQCVDEKLKGNFAAEEAIPVIKLGLVCASQVPSNRPDMAELL

SEQ ID NO: 159960 - protein, 184 aa, Glycine max
  Coding DNA Sequence Number=SeqID_43182
MVCGTGLGISDTRWVPDEYGDETINSNPSDIGYGYEDMFRSRASNATFPCIKKMILQQQFQKQQAMDEVAKIRKRFGDEQSTLLDQFERLSFETHLNKAMLQRSLSEPGFPRRVSQPRHVNVTPTTIPLLNNQGKQRRCRVSGFNKVLKKLLRPILGRKSSGGERKHAPDPRNPLSWKNFSRSL

SEQ ID NO: 159961 - protein, 137 aa, Glycine max
  Coding DNA Sequence Number=SeqID_43183
MSGFSKDMPAVDEDQQEDDVHANRTDHDEGLWENIPMLMASPPPSPNATDNPLKDDLKKLVWEDILRKLDIPEGENAKKKVMSTVASKWRQFKSHLTSKFVFADNEGQASSEPTVKHGIDLATWAEFAKSRQTPNWQ

SEQ ID NO: 159962 - protein, 88 aa, Glycine max
  Coding DNA Sequence Number=SeqID_43184
  Subcellular localization annotation: CTP_CleavageSite=60; ConfidenceScore=5.82e-01
MTKEVIHGHNSATPRLHFSSSSSSSSSSSSSTIFSSFQAAEKAIQCRGNSPKRAACLGLKVSARPGELELAPVNDLLRIEVFSLAQAS

SEQ ID NO: 159963 - protein, 430 aa, Glycine max
  Coding DNA Sequence Number=SeqID_43185
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-56, Identity=31%"; Hit description= UPI00006A17C9 related cluster
RATRLHLHRAARPRLQRTTRPPLQRTTRLAFRGLHALAFRGLHVLAIRGLHALTFGGVQDLTFRGLHVLIYRGLDALTFRGLDVLAFRGLHALTIRGLHVLAFRGLHIISFRGLLALAFRGLHVLSFRGLHNLTFRGLHVLAVRGLHALTIRGLHVLAFRGLDVLAFRGLHALTIRGLHVLAFRGLHVLSFRGLLVLAFRGLHVLSFRGLHTLTFRGLQVLALIGLHVLAFRGLHVLTFRRLHVLAFRGLHVLPFKGLEVLPFRGLHVHAFRVLHIFAFRGLHALIFRGLHVLAFRGLHALSFRGLHALTFRGLHVLAFRGLNALTFKGLNVLAFRGQHALAFRVKHALTFRGLHALAFRGLHVLTFRGLHVHAFRGLHAFTFRELHVLAFRRLHVLAFRGLHALAFEDYMPSPLEGCTSSPSEGYTPSS

SEQ ID NO: 159964 - protein, 233 aa, Glycine max
  Coding DNA Sequence Number=SeqID_43186
  Gene Ontology: Mol. function=RNA-directed DNA polymerase activity; Cellular component=integral to membrane; Biological process=RNA -dependent DNA replication
  Homolog annotation: Hit_ID=Q1S7B8; Match level="QueryCoverage=77%, HitCoverage=20%, E-value=4e-30, Identity=39%"; Hit description=RNA -directed DNA polymerase
LVNGSPAEEFRMHRGLWLGYPLAPFIFLCMAEGLAGLMREVVDKNLFLSMKIRRNHMEVDLLQFVDDTLFFAKPSMEHVMTLKTILRCFELVLGLKINFFKSKLAGVAVESATNEIYASLLNCKGGKIAWVKWNRICWPKEEEGLGVKDIHLFNLALLSKWKWRLFSNEEALRERIIMSKYGEGVERACGNRKNGKSFDENTTMPYSLNEVVDGKCGVGSGNGGKGVLNRNMS

SEQ ID NO: 159965 - protein, 111 aa, Glycine max
  Coding DNA Sequence Number=SeqID_43187
  Gene Ontology: Mol. function=RNA-directed DNA polymerase activity
MDERRGRLKIEVGGTEMNEFNNFIQNMEPEDAPLVRRRFTWVLSCWLQDGKFKELVEDSWKGMNMRGWAGYVSKERLTLLKGELKRWNKDQLGKFQQKKRELVEKIHEIDL

SEQ ID NO: 159966 - protein, 89 aa, Glycine max
  Coding DNA Sequence Number=SeqID_43188
RPFPPASSCRPDIGKDCARKTPSGPKEGQQGLGVACSKYGSLSVIGSACRPQQGHQAPLLIELSSRSTAPPGRPRAKHHNSIGMAGSRQ

SEQ ID NO: 159967 - protein, 93 aa, Glycine max
  Coding DNA Sequence Number=SeqID_43189
MEAIKVKSLGDNLALLSIKGDIKIEMALKNNAEWWKKIFGHMISSESECSSFDEEIKDERVLGRCRKRKRSQRRTTIVGQGESTGGEKFKWAK

SEQ ID NO: 159968 - protein, 65 aa, Glycine max
  Coding DNA Sequence Number=SeqID_43190
MLLCAPAEFLICSRERSSMRGAHSLLCHFGGDVLFMVVHRQVMVVLVIDLAINDGGMVFDLVYFE

SEQ ID NO: 159969 - protein, 172 aa, Glycine max
  Coding DNA Sequence Number=SeqID_43191
MDEDQWMHDSIISEEVDMNEQNEHEAGVNEEHVFATHDDVLDWTRSVAYEIGFMAVIMRSNTNIGIRGRTSFVLIDCERSGQYRTKKKDLDEKIIVSDMTKSMVTRNILLTLKEHNANSYTTIKQIYNARNVYHSSIRGSNTKMQQPMKLLEWDQYIHWHRLKDEDVAHDIF

SEQ ID NO: 159970 - protein, 702 aa, Glycine max
  Coding DNA Sequence Number=SeqID_43192
  Gene Ontology: Mol. function=RNA-directed DNA polymerase activity; Cellular component=chromatin; Biological process=chromatin assembly or disassembly
PPGCRFPVDKCPEILLYHMIHHLCLAVCLRMIGCAHFELSATKLEKFLPKSTHEQGIAIGDEAAGHAVNLSGGLHEYLSHCSSSVVHRKYPHMHPFGETVHHDQDRQGRQANYKVEGEVLPRSHEQLDILLHRWPDEICTDASQGLCNSHVAASGSVVEFCEDGGDGLKTFGKPYTTLLKDEVMTIVLNVAAKVHEGGIAEKLLFKFLQKKGSLEQLAEKIGEGWLFVAVRGHRLLHWISWHDSELCSHCLVIVSGSIAVQVGNGGELPYVRGGTKELRTEGFAEEDDWVDWGTTQSFLQTEEGCASISVLVEGVLSEESRFEGIEELANSGQLRSLSAPVPLLGTTRYARDIPPEKLQRSTSKASEKIGVSSGLRRPCGGSATKLVEELINCWDRESILDHDGVQGPVVYTKPPGAVLLLNQEHRVAVWSDGDWRCVGLKEDGVISRPRRGKGVWLLEQGCELGEQGGDIRVGGCGGSGGRRDPYVKEFTGTIGLDQSSELRCGDGFQVLGSITLELNDRAAMDKFHGQGVIVCQYWTKGLQPMHTEDHIGSANCGGEVQVADQSGLHKVVRAPAVDEDHDRLVGDAAQQAERFWSGLTRQRFFLLLFICDEEKEMRGAAVPAGKPLIAVEAKAALLPVCHLGGGQALQRGEEGDGVERAEPWVLRPAWTSWRMSGTKPEMKQLKRSDGGRPTILFARASN

SEQ ID NO: 159971 - protein, 118 aa, Glycine max
  Coding DNA Sequence Number=SeqID_43193
MADSPRAKSPLEHIKEAISQLASSQIFVTEKLEDLLLRVANLENPSHSTASPSSSSPNPVPKTTIINTPKMKLDVPKFDGTDPSGWVFKITQFFAYHSTLELECLTITSFTMEGTALA

SEQ ID NO: 159972 - protein, 455 aa, Glycine max
  Coding DNA Sequence Number=SeqID_43194
  Gene Ontology: Mol. function=binding
  Homolog annotation: Hit_ID=Q287W6; Match level="QueryCoverage=80%, HitCoverage=86%, E-value=1e-103, Identity=54%"; Hit description =Pentatricopeptide repeat protein
  Pfam annotation: Domain name=PPR; Domain location=153-187; Score =11.1; E_value=0.36; Accession=PF01535.11; Description=PPR repeat
  Pfam annotation: Domain name=PPR; Domain location=258-292; Score=9.0; E_value=0.63; Accession=PF01535.11; Description=PPR repeat
  Pfam module annotation: Pfam domain module=PPR::PPR; Domain location =153-187::258-292
MEINSLSLPSCRMPILLKDSHSGSPQQQNKLIWWQNEKGVIGGKDNSVDCSSLAQNSSRKRMIHQSDGSLHDIKVEGYMPKQTSLCVSMLYYTENGFFPQAQTLWEQLVNSSFVPSVQFISRLFDAYAKHRKFDVVIDILRYVDMRNFSILPDVYWLAISCFGREGQLELMEDMANEMASSGVHIYSRTANAFLLYYSLFGTLEEMENTYGRLKKSRFLIEKEVIRAVASAYIKERKFYELGEFLRDVGLRRKNVGNLLWNLMLLSYAANFKMKSLQREFIGMVESGFRPDITTFNIRALAFSRMALFWDLHLSIEHMEHTKIIPDLVTFGCVVDAYLDRRLGRNLDFALNKMNLDDSPRLLTDPFVYEALDIHSVVNLKQTSTYGVMVDALEVKSFGDDKEEEAIAEEGGGGADDEEEPRGELVAGEAGEEVEVFADVNGDAEERDVALVEAEN

SEQ ID NO: 159973 - protein, 51 aa, Glycine max
  Coding DNA Sequence Number=SeqID_43195
  Homolog annotation: Hit_ID=P29677; Match level="QueryCoverage=75%, HitCoverage=7%, E-value=8e-13, Identity=92%"; Hit description =Mitochondrial-processing peptidase alpha subunit, mitochondrial precursor
DQAQLNRAKQATKSAILMNLESRMVVSEDIGRQILTYGERYGSMMTFYNFS

SEQ ID NO: 159974 - protein, 153 aa, Glycine max
  Coding DNA Sequence Number=SeqID_43196
  Gene Ontology: Mol. function=protein serine/threonine kinase activity; Cellular component=chromosome, pericentric region; Biological process=protein amino acid phosphorylation
  Homolog annotation: Hit_ID=Q1S0R7; Match level="QueryCoverage=98%, HitCoverage=55%, E-value=5e-67, Identity=86%"; Hit description =Protein kinase
  Pfam annotation: Domain name=Pkinase; Domain location=1-138; Score= -19.8; E_value=2.2e-07; Accession=PF00069.15; Description=Protein kinase domain
  Pfam annotation: Domain name=Pkinase_Tyr; Domain location=1-140; Score=-171.8; E_value=0.063; Accession=PF07714.7; Description =Protein tyrosine kinase
  Pfam module annotation: Pfam domain module=Pkinase::Pkinase_Tyr; Domain location=1-138::1-140
LTKALAYCHEKHVIHRDIKPENLLLDHEGRLKIADFGWSVQSRSKRHTMCGTLDYLAPEMVENKAHDYAVDNWTLGILCYEFLYGAPPFEAESQVDTFKRIMKVDLSFPSTPNVSLEAKNLISRVTAGKRLFTKALTSEDNGASLDNQECRSQ

SEQ ID NO: 159975 - protein, 426 aa, Glycine max
  Coding DNA Sequence Number=SeqID_43197
  Gene Ontology: Mol. function=oxidoreductase activity; Cellular component=membrane; Biological process=electron transport
  Homolog annotation: Hit_ID=O64631; Match level="QueryCoverage=96%, HitCoverage=85%, E-value=1e-155, Identity=61%"; Hit description =Putative cytochrome P450
  Pfam annotation: Domain name=p450; Domain location=38-424; Score =46.8; E_value=4.2e-13; Accession=PF00067.12; Description=Cytochrome P450
MDFLHTLLSLIAFSFLGIFLVFCFIMLTIIIGKSIGDPDYAPVKGTVFNQLLYFNTLHDYHAQVAKTNPTFRLLAPDQSELYTADPRNIEHILKTNFDKYSKGKYNQDIVTDLFGEGIFAVDGDKWRQQRKLASFEFSTRVLRDFSCSVFRRNAAKLVRVISEFSHQGQVFDMQDILMRCTLDSIFKVGFGTELNCLDGSSKEGSEFMKAFDESNALIYWRYVDPFWKLKRFLNIGCEATLKRNNVKEDILSRFLIESKKDQKTMTDQYLRDIILNFMIAGKDTSANTLSWFFYMLCKNPLIEEKIVQEVRDVSCSCSHESEPNIEEFVAKITDDTLDRMHYLHAALTETLRLYPAVPADGRTAEAHDILPDGHKLKKGDGVYYLAYGMGRMCSIWGEDAEEFRPERWLNNGIFQPESPFKFVAFH

SEQ ID NO: 159976 - protein, 93 aa, Glycine max
  Coding DNA Sequence Number=SeqID_43198
  Gene Ontology: Mol. function=histone serine kinase activity (H3-S10 specific); Cellular component=chromosome, pericentric region; Biological process=protein amino acid phosphorylation
  Homolog annotation: Hit_ID=Q1S0R7; Match level="QueryCoverage=77%, HitCoverage=36%, E-value=6e-19, Identity=54%"; Hit description =Protein kinase
MAWFQGRLKIADFGWSLQSRSKRHTMCGTLDYLAPEMVENKAHDQWRIQDLKIMKVDLCFPSTPNVSLEAKNLISRVTEIWMTPLPVKEDKSG

SEQ ID NO: 159977 - protein, 123 aa, Glycine max
  Coding DNA Sequence Number=SeqID_43199
MTILVSACQSDLVSPNDEVWIIVRCLHMLPDSRVAGYQRVCAGYHQVSPHATRLLGHDNKRSASLDTGYGELDDATSIVATCPSRASEGEAHGCAFQRRKDARSRHQRLFVENVGKTEGNWSR

SEQ ID NO: 159978 - protein, 232 aa, Glycine max
  Coding DNA Sequence Number=SeqID_43200
  Homolog annotation: Hit_ID=Q3BM75; Match level="QueryCoverage=82%, HitCoverage=24%, E-value=7e-14, Identity=31%"; Hit description =Putative membrane protein
  Subcellular localization annotation: CTP_CleavageSite=45; ConfidenceScore=5.06e-01
MIGLSVAIQIPGFIGLGHHLKPDLVLLVNNAIASMAGVLFAVILTALMRNKRPSWTARRAVRHGLRELLRFIKEIERNGSSLLGRQRFIGLMLDKVNVVLPRLHLDPQSDMAPAGMLLTEVWLGVNSFDYYARHQALLSRYQLDSGQMFHELGLFLKRRLKSLQTPPHEDLQEELDVLLMQLEQLAQRDEALLLPLFHLFSIRLYLFPQLSWPVATPRQAERLQQHRYRLQA

SEQ ID NO: 159979 - protein, 77 aa, Glycine max
  Coding DNA Sequence Number=SeqID_43201
MEESSGTRQMRRKLCVGRLKIQVKYNTYCTYQNLELGHVKVDVAKVNFWTSHVDFKSSLCQEHKRGDLQNKGTLMFK

SEQ ID NO: 159980 - protein, 81 aa, Glycine max
  Coding DNA Sequence Number=SeqID_43202
MKMLLIPHDVAPCGACRPWIFFINGFLCFLRSDCSRMEKEKDEWRRHFKIMRQALKSVVFHLVAKPIFWLSEHPLSATLMG

SEQ ID NO: 159981 - protein, 45 aa, Glycine max
  Coding DNA Sequence Number=SeqID_43203
MHRRDQGGLVRAHALSAIMDRLAHISEFWLSACLSRLADGLKRCA

SEQ ID NO: 159982 - protein, 67 aa, Glycine max
  Coding DNA Sequence Number=SeqID_43204
MVIGKIKIMGERDHIHHSHIKRHKIQRCSRERDEKTPEQLRSVINTIAKGFLEGGATTSTGKGHLHQ

SEQ ID NO: 159983 - protein, 320 aa, Glycine max
  Coding DNA Sequence Number=SeqID_43205
  Homolog annotation: Hit_ID=Q47522; Match level="QueryCoverage=13%, HitCoverage=53%, E-value=1e-18, Identity=100%"; Hit description=LacZ protein
GPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPEFDLSRLGCHHRHEASAQVEVRHLVQIPTAPPVQLDEKQQQDAPIQLLSLWKSKTFLNLRFGIPKSFHGQHTIGWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 159984 - protein, 186 aa, Glycine max
  Coding DNA Sequence Number=SeqID_43206
  Gene Ontology: Mol. function=protein serine/threonine kinase activity
  Homolog annotation: Hit_ID=Q6AFN2; Match level="QueryCoverage=92%, HitCoverage=49%, E-value=3e-22, Identity=35%"; Hit description =Macrolide 2'-phosphotransferase
NDRRFEAPQLVIAHDLPPSDREPHGHPSGGCRGVDQAGHLVARLLCGPGREPGAAHDRDGQRVHGRDGRSHGLRRPATGRHEGRVDLEPGEELGHQCRCISQPCLADVAGGVEGQHRPGAGRQRAQCDGLGGQLPRRLIVVGDADGEFATVGQRGDSGVEAAVPVGGQGAGARDLSTGKCGRHRRG

SEQ ID NO: 159985 - protein, 169 aa, Glycine max
  Coding DNA Sequence Number=SeqID_43207
  Gene Ontology: Mol. function=carbamoyl-phosphate synthase activity; Cellular component=cytoplasm; Biological process=pyrimidine nucleotide biosynthetic process
  Homolog annotation: Hit_ID=Q8L6J9; Match level="QueryCoverage=100%, HitCoverage=14%, E-value=3e-81, Identity=86%"; Hit description =Putative carbamoyl phosphate synthase large subunit
  Pfam annotation: Domain name=CPSase_L_D3; Domain location=102-168; Score=5.6; E_value=5e-09; Accession=PF02787.9; Description=Carbamoyl- phosphate synthetase large chain, oligomerisation domain
MAAKLSVGYSLDQIPNDITKKTPASFEPSIDYVVTKIPRFAFEKFPGSQPILTTQMKSVGESMAVGRNFQESFQKAVRSLECGYSGWGCSQVKEMNYDLEQLKYSLRVPNPERIHAIYAAMKRGMHIDEIFELSYIDKWFLMQLKELVDVESFLLSHNLSDLTNIDFYE

SEQ ID NO: 159986 - protein, 327 aa, Glycine max
  Coding DNA Sequence Number=SeqID_43208
  Gene Ontology: Mol. function=helicase activity; Biological process =protein amino acid phosphorylation
  Homolog annotation: Hit_ID=Q9LTU4; Match level="QueryCoverage=99%, HitCoverage=23%, E-value=5e-90, Identity=51%"; Hit description =Helicase-like protein
  Pfam annotation: Domain name=DUF889; Domain location=107-326; Score =317.8; E_value=1.9e-92; Accession=PF05970.5; Description=Eukaryotic protein of unknown function (DUF889)
  Subcellular localization annotation: CTP_CleavageSite=46; ConfidenceScore=5.18e-01
TFVWKTLSSTIRSTGGIVLTVASSGIASILLPGGRTTHSKFAIPVPATQNSTCNIHQGSDLAELLQITKLIIWDEAPMCHRYSIEALDKSLRDIMHNGNPFGGKVIVFGGDFRQILPVVPRSNRSNIVYATLNASYIWNHCQILKLTKNMRLQSNPTDHSNFDELKQFSKWLLDIGDGKLVEPNDGYGEITIPDEFLIKEFQDPIQEIVEATYLDLLHNYNNGDFLQKRAVLVSTKGVVDKINNYVLSLIPGEEKEYCSVDCVDKSDELLSPAFGVLTTEFLNSLKTSGIPNHKLRIKVGTPIILLRNLDQTDGLCNGTRLIVTRLF

SEQ ID NO: 159987 - protein, 151 aa, Glycine max
  Coding DNA Sequence Number=SeqID_43209
  Subcellular localization annotation: CTP_CleavageSite=59; ConfidenceScore=5.41e-01
MDTSEPYTGAMKGTMHKPQANLGADQKFSPNRFPATRFTTSNVQSFEFGMTGPLDESIYCFLIRVDPWVLVPIAYRRLHILNFRGLHVLSFKGLHVLAFKGLQVLAFRGLKILDFRGLFILAFRGLHTLAIRGLHVLAFRGLHILAVRGLH

SEQ ID NO: 159988 - protein, 83 aa, Glycine max
  Coding DNA Sequence Number=SeqID_43210
MEIHKSRDNKFTTYIGGTFQVMKMELRGELQREVVTEIEEEEQQLNPIKAVIGNNFFMVFDHKNRGGVGSFTSRFEAEDHENR

SEQ ID NO: 159989 - protein, 194 aa, Glycine max
  Coding DNA Sequence Number=SeqID_43211
  Homolog annotation: Hit_ID=Q9SDN6; Match level="QueryCoverage=43%, HitCoverage=9%, E-value=3e-15, Identity=50%"; Hit description=FH protein NFH1
  Subcellular localization annotation: CTP_CleavageSite=70; ConfidenceScore=5.93e-01
SRVFHVDKFGSRSFTSRTPSYPRSNSLSFSRSPSLNFSPPSVKSLPPNNNPASPSFSSSSSSPREEWHVPSQGKNSPAATDLPTPPPPPPPPPPQFWEAPVDKSVTFRNESEETPKPKLKALHWDKVKASSDRVMVWDRLGPSSFQLNEDMIETLFMVNNNNNNSKEGFGVAIRDNHNPRRQVVHSASPNALGE

SEQ ID NO: 159990 - protein, 208 aa, Glycine max
  Coding DNA Sequence Number=SeqID_43212
  Homolog annotation: Hit_ID=Q1T1Y0; Match level="QueryCoverage=49%, HitCoverage=29%, E-value=2e-12, Identity=42%"; Hit description =Ankyrin
  Pfam annotation: Domain name=DUF1723; Domain location=81-130; Score =42.8; E_value=1.2e-09; Accession=PF08330.1; Description=Protein of unknown function (DUF1723)
MEAPADAEDIVPDIPADTGAEALEDEHQGFPGGPSDPSDRPELKLSSHGRKVHSLGRPIPAIEGLIAGTGLSPLIACLVDTGDRGLFSAFVEWWHQETSSFHLPVGELTIMLDDVSSLLHLPVIGDLHAFQPLHVDDASLPGLRQPSVVDRTYACNGYVIYMSADAIQVIGQLQLTHIFSIFWVALYLLTRVQPMCMLSTWRPFVTSV

SEQ ID NO: 159991 - protein, 124 aa, Glycine max
  Coding DNA Sequence Number=SeqID_43213
  Subcellular localization annotation: CTP_CleavageSite=42; ConfidenceScore=5.02e-01
MVVVMMVVMMVVTIVVMVMVRMVTMMTTMIVMSGETLVVTMMEMMVETIVGVTMIVMVVIMVAMVIAVTMVECGCYDKDGGGDNDDSNRGGGGIDSVGGSGDGDRVGDDDNGDNYNDDGDNMRW

SEQ ID NO: 159992 - protein, 268 aa, Glycine max
  Coding DNA Sequence Number=SeqID_43214
  Gene Ontology: Mol. function=peptidase activity
  Homolog annotation: Hit_ID=Q6YUU0; Match level="QueryCoverage=98%, HitCoverage=57%, E-value=9e-51, Identity=46%"; Hit description =Putative Cgi67 serine protease
MGGVTSSMAAKLAFFPPHPASYKVVKDELTGLLLLSPFPHRENVEILKLPTRRGTEIVSMYVRHPMAASTVLYSHGNATDLGQMYELFIQLSIHLRVNLIGLVLFEDGNRGHLSFGCLEEGIVDDLECWEMGVYQNAVVLVSCVFEGKEKMEAFVGGYDYSGYGQSSGKPSEQNTYADIEAVYKCLEESYGTKQEDIILYGQSVGSGPTLDLAAKLPQLRAVVLHSPILSGLRVMYPVKRSYWFDIYKNIDKIPLVNCPILIIHTFSC

SEQ ID NO: 159993 - protein, 243 aa, Glycine max
  Coding DNA Sequence Number=SeqID_43215
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-42, Identity=35%"; Hit description= UPI00006A17C9 related cluster
FRGLQVLTFRAQHALTLKGLHALAFRGLPVPAFKGLHVLSFRGLHFLALRGLHVLAFRGLHVLSYRGLHVLPSRGLHVLTSRGLHVLTSRGLHVLTSRGLHVLTSRGLHVLTSRGLHNLTSRGLHALPFRGLHALAFRGLHVLPFRGVHVLTFRVLHALAFKGLHALTFRGLHDLTFRGLHTLTFKGLHVLAFRGLHSLAFRGLHVLAFRGLHVLAFRGLLALTFRGLHVLAFRGLHDLSSRG

SEQ ID NO: 159994 - protein, 138 aa, Glycine max
  Coding DNA Sequence Number=SeqID_43216
  Subcellular localization annotation: CTP_CleavageSite=47; ConfidenceScore=5.03e-01
MSLGTALDTSVAGNSNSERFITKTTINHRTKKKRRVFERVENNGTLLVMTDSGDDGDNDSDDVGGGDGGSNVNGVVDDDGGNDNGNSVGDDDDGDGSGSGIDRDGDGSGDNESNSGGDIGSSGGNNAGGGDSDVNNNS

SEQ ID NO: 159995 - protein, 123 aa, Glycine max
  Coding DNA Sequence Number=SeqID_43217
MELSDIKKRQDRREPLPPPPLPRIPAKDDGDGGESCWELEPLLLPLLSGASSSSLLRCQWLLFLFSPTVVLVPVFVVVRGCYCGAFVFFGRCSFGLLDRLRVLLASSFSFPCPCFFVFVLPCP

SEQ ID NO: 159996 - protein, 476 aa, Glycine max
  Coding DNA Sequence Number=SeqID_43218
  Gene Ontology: Mol. function=translation elongation factor activity; Cellular component=cytoplasm; Biological process=translational elongation
  Homolog annotation: Hit_ID=P13905; Match level="QueryCoverage=91%, HitCoverage=97%, E-value=0.0, Identity=94%"; Hit description =Elongation factor 1-alpha
  Pfam annotation: Domain name=GTP_EFTU; Domain location=5-227; Score =361.1; E_value=1.8e-105; Accession=PF00009.17; Description =Elongation factor Tu GTP binding domain
  Pfam annotation: Domain name=GTP_EFTU_D2; Domain location=248-315; Score=90.8; E_value=4.2e-24; Accession=PF03144.15; Description =Elongation factor Tu domain 2
  Pfam annotation: Domain name=GTP_EFTU_D3; Domain location=322-430; Score=206.7; E_value=5.3e-59; Accession=PF03143.7; Description =Elongation factor Tu C-terminal domain
  Pfam annotation: Domain name=MMR_HSR1; Domain location=8-156; Score= -2.7; E_value=0.0018; Accession=PF01926.13; Description=GTPase of unknown function
  Pfam module annotation: Pfam domain module=GTP_EFTU::GTP_EFTU_D2::GTP_ EFTU_D3::MMR_HSR1; Domain location=5-227::248-315::322-430::8-156
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVVKPGMVVTFGPTGLTTEVKSVEMHHEALTEALPGDNVGFNVKNVAVKDLKRGFVASNSKDDPAKEAANFTSQVIIMNHPGQIGNGYAPVLDCHTSHIAVKFSEILTKIDRRSGKELEKEPKFLKNGDAGMVKMVPTKPMVVETFSEYPPLGRFAVRDMRQTVAVGVIKSVEKKDPTGAKVTKAAAKKKVLGVCFTSYILKCPPISCSRSLQNWVLDR

SEQ ID NO: 159997 - protein, 116 aa, Glycine max
  Coding DNA Sequence Number=SeqID_43219
  Gene Ontology: Mol. function=RNA-directed DNA polymerase activity; Cellular component=intracellular; Biological process=RNA-dependent DNA replication
MKPDMSLKIKEEVKKQFNTGFLVVARYPEWVANIMSVPKKDGKIKMAPEDMEKTTFVTLWETFCFKVMSVGLKNAGATYQRAMVALFHDMMHKEIEVYVNDMIAKSKTEEEHLVNL

SEQ ID NO: 159998 - protein, 140 aa, Glycine max
  Coding DNA Sequence Number=SeqID_43220
PKIHKGCTPPLFSLNNQVDVPPLERIHKRCTLSCSQYNNPSRCTLYLYHKGCILQCVKTKDSQAVSPSNLCKGKQKISQAVSPLKSFVKGEGKNQKNSQAVSPLNLLEREKGDTKEFRRLVLLFFWQRENRMKKKSSTSF

SEQ ID NO: 159999 - protein, 115 aa, Glycine max
  Coding DNA Sequence Number=SeqID_43221
  Gene Ontology: Mol. function=RNA-directed DNA polymerase activity; Biological process=RNA-dependent DNA replication
MPGLSPDIVQHQLPLNPRCSPVKQKLRRMKFEMSLKIKEEVKRQFEAGFLAIAWYPEWVANIVSVPKKDGKLGKLLGFIVSQKGIEVDPNKVKAILEMPEPLTEKQVQGFLGRLN

SEQ ID NO: 160000 - protein, 78 aa, Glycine max
  Coding DNA Sequence Number=SeqID_43222
MLWNFTDCETMFPFDFRMPRHFTDYLTMGVKYLEAVKQRLQAIKQWSPDKIRVCHHQKGGDCGSKASKLILMMPKTQV

SEQ ID NO: 160001 - protein, 148 aa, Glycine max
  Coding DNA Sequence Number=SeqID_43223
  Gene Ontology: Mol. function=DNA binding
  Homolog annotation: Hit_ID=Q1SFS3; Match level="QueryCoverage=95%, HitCoverage=27%, E-value=5e-50, Identity=68%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)
MDIPLRSTRKYLFKKTDLLRLRELASLVSDPVDFQAHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAA

SEQ ID NO: 160002 - protein, 72 aa, Glycine max
  Coding DNA Sequence Number=SeqID_43224
MLGRTAAGDLALINWEIETTCRRNNAVRKRREQEAQGRSQTSPPPSPQSYIQMEEEHARRMTLEDYSSTTTP

SEQ ID NO: 160003 - protein, 180 aa, Glycine max
  Coding DNA Sequence Number=SeqID_43225
  Homolog annotation: Hit_ID=Q9AVH2; Match level="QueryCoverage=96%, HitCoverage=72%, E-value=2e-59, Identity=60%"; Hit description =Putative senescence-associated protein
HVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSHLSYTSQVISQSRTRVKLNRGLLSPPDSAKPVPLAVVSLDSRQGTVGNL

SEQ ID NO: 160004 - protein, 230 aa, Glycine max
  Coding DNA Sequence Number=SeqID_43226
  Gene Ontology: Mol. function=kinase activity; Biological process=D -ribose metabolic process
  Homolog annotation: Hit_ID=Q2K4U5; Match level="QueryCoverage=99%, HitCoverage=74%, E-value=3e-37, Identity=40%"; Hit description =Probable sugar kinase protein
MQQRGKKTGVKAVAGTDGVDHRDRATRLLQAVLTLPAARALRTAFHHAAAAPAEPLRQQVRAGVQIICATQPERFDFIEQQPVALRQPAGDLRAYLIAPALRRPAGIDGGDKPALLQFGQQLRVVVIQLQAEKRAAQQHDIAAAGLRRELAQHVLRAEPHNVTEIAEERSLVIGVRNANGERGFAGVARPVRRAVRKMARQPCAEAIIALISDGAMAHLHRFQRQRAVAR

SEQ ID NO: 160005 - protein, 406 aa, Glycine max
  Coding DNA Sequence Number=SeqID_43227
  Gene Ontology: Mol. function=nucleoside-triphosphatase activity; Cellular component=membrane; Biological process=transport
  Homolog annotation: Hit_ID=Q982U5; Match level="QueryCoverage=87%, HitCoverage=100%, E-value=2e-89, Identity=51%"; Hit description=ABC transporter, ATP-binding protein
  Pfam annotation: Domain name=ABC_tran; Domain location=29-210; Score =213.8; E_value=4e-61; Accession=PF00005.17; Description=ABC transporter
  Pfam annotation: Domain name=TOBE; Domain location=291-348; Score =24.0; E_value=0.00052; Accession=PF03459.7; Description=TOBE domain
  Pfam annotation: Domain name=TOBE_2; Domain location=282-349; Score =30.2; E_value=7.1e-06; Accession=PF08402.1; Description=TOBE domain
  Pfam module annotation: Pfam domain module=ABC_tran::TOBE::TOBE_2; Domain location=29-210::291-348::282-349
MAGVELVKVAKRYGKQSVLHPLDLTIPDGSFTVLVGPSGCGKSTLLRLLAGLESLSDGAILMDKVQINDRDPADRDIAMVFQSYALYPHLTVAENLAFHMQVKKVRRDEQQQKIARIAAILGIDKLLQRYPRALSGGQRQRVAMGRAMVRNPQVFLFDEPLSNLDAQLRMELRAEIKSLHQRFKTTMVYVTHDQVEAMTLADQIVVMKEGRIVQQGAPLAIYDRPADTFVARFIGSPPMNLLPAQLLTHDGVPGVQCQDWWQPLPAQWQAVAREREGAAVTLGVRPHDLCEVQDGAPARVNVVEITGESTLLHLDWHGHALHMQMAGRHAASSGATLRIGFNPQKIHLFDAESGLRLAEKRADFFPSGVSLQPVTGLERSRAVDGWSAPTSRYPSSANSTGPAVPA

SEQ ID NO: 160006 - protein, 248 aa, Glycine max
  Coding DNA Sequence Number=SeqID_43228
  Gene Ontology: Mol. function=sequence-specific DNA binding; Biological process=signal transduction
  Homolog annotation: Hit_ID=Q1LNG2; Match level="QueryCoverage=92%, HitCoverage=83%, E-value=1e-59, Identity=54%"; Hit description =Transcriptional regulator, XRE family
MSTAQTLTPAELNNRKLLGTFLRTRRESLDPNRLGLPRMRQRRTPGLRREEVAQLADVGVTWYTWLEQGRDIKASTKTLTAIASALQCNDVETQHLFSLAGHTLPSTRVAAACCKLAGHNQQMLDAIQLPAIIETPRFDILGYNQAWCALMGVDLAQIAPEDRNCIWLAFNHAGWRNVMTDWDEVMPQMVAMFRVPMSSRTPGSATNWARWKPRKALLPCRSGRNDAAPEQLVVGVTQRRSPAGVCAG

SEQ ID NO: 160007 - protein, 167 aa, Glycine max
  Coding DNA Sequence Number=SeqID_43229
  Gene Ontology: Mol. function=DNA binding
  Homolog annotation: Hit_ID=Q6D6K4; Match level="QueryCoverage=65%, HitCoverage=100%, E-value=3e-45, Identity=80%"; Hit description =Putative growth inhibitory protein
  Pfam annotation: Domain name=PemK; Domain location=65-167; Score =131.2; E_value=2.8e-36; Accession=PF02452.8; Description=PemK-like protein
  Pfam annotation: Domain name=SpoVT_AbrB; Domain location=7-52; Score =35.6; E_value=1.7e-07; Accession=PF04014.8; Description=SpoVT  AbrB like domain
  Pfam module annotation: Pfam domain module=PemK::SpoVT_AbrB; Domain location=65-167::7-52
MTTVTLKKWGNSPSIRIPSSVMQSASLSVDDKLELSVEDGKLILVPLREKVGQGKNLMVSRFVPDAGDLIWLDFDPTLGHEQGGHRPAVVLSPFAYNNKVGMLLCVPCTTQVKGYPFEVSLTGSRDSVALADQVTSIDWRARKVVKKSHVTADELSEIRAKAKALIG

SEQ ID NO: 160008 - protein, 64 aa, Glycine max
  Coding DNA Sequence Number=SeqID_43230
SGREAVFPKWGTHKSPKWKHRWWNSVARGKGGSSEGLGLREEGRGLLGWRKSEFGVGERGVGGE

SEQ ID NO: 160009 - protein, 81 aa, Glycine max
  Coding DNA Sequence Number=SeqID_43231
GQDHLELPSGVETKHEQQKPIKVLRNGCKWGWGHDRLIVAPFSALNKQRTSLQGSPVSFVFAVFFYYLFVLKISNQRLILT

SEQ ID NO: 160010 - protein, 150 aa, Glycine max
  Coding DNA Sequence Number=SeqID_43232
  Gene Ontology: Cellular component=integral to membrane
  Homolog annotation: Hit_ID=Q9LJI2; Match level="QueryCoverage=76%, HitCoverage=16%, E-value=9e-20, Identity=47%"; Hit description=Na/Ca, K-exchanger-like protein
MEMMTRRMKREKRKKMTSLMKLALPIAISFEVTRKLMTPKTALETKNAPPRMLLRPTAPSLDLVKETTLAKKSGAPFPRESKVTPAMVGDNLKIAAINTDVTEHSSMVEDLMQSYPARALARRLQVDWARDPRKGPRVLMSLRVDFEPMG

SEQ ID NO: 160011 - protein, 79 aa, Glycine max
  Coding DNA Sequence Number=SeqID_43233
MKKLALENQQSNAPIQKHGRIQILKNQPQPMYENEEEMMVDTFEFGFGDSLEDITRTIFILPAKCEEQYQTSASYLEFG

SEQ ID NO: 160012 - protein, 408 aa, Glycine max
  Coding DNA Sequence Number=SeqID_43234
  Homolog annotation: Hit_ID=Q1STZ2; Match level="QueryCoverage=52%, HitCoverage=47%, E-value=3e-12, Identity=28%"; Hit description=IMP dehydrogenase/GMP reductase
HPCPLQSYCSCAEKGRVDWDQHLAGIGGSTINWFPRWKEGKEGVLFSCGDYPNVPLIGTRGCINYNPALAIRHLGYPMRGAPTEESLSPFLVRNLGTQSLKAIQRIHKAWRSPLRKDKELRGIRNGVIGGYHGWLRIHTRGLDWLSKLKVINEENFEAPEEDEEVRALKLELGKARLAKEKFKSAATHIRKECTELQEENAATTRALEQETKRARKEEYGREKFRGALWGSNNELKLRREERDRFTATEQSMLAIIRQYKEELNQSMAHEQKLVEDFAQVYAEKEARGRVIDALHQEATMWMDRFALTLNGSQDLPRLLAKAKAMAEEQMKADLSALKDQMASISEVMLKLQKTIEDKATATASSTVREAEPVLQPALNPGLDRNTAVFGRRYSPQAYPYGLPPDFTT

SEQ ID NO: 160013 - protein, 247 aa, Glycine max
  Coding DNA Sequence Number=SeqID_43235
  Gene Ontology: Mol. function=two-component response regulator activity; Cellular component=intracellular; Biological process=two -component signal transduction system (phosphorelay)
  Homolog annotation: Hit_ID=UPI00005F8BDD; Match level="QueryCoverage =66%, HitCoverage=76%, E-value=4e-42, Identity=52%"; Hit description =COG2197: Response regulator containing a CheY-like receiver domain and an HTH DNA-binding domain
MPQYLEFLGRQAVDALADELVARGQRTLALETGRIVFAAQLQRVQRGDDLAQVVALEHHGLDAGVVQRRNDHGIGHHGQHDDAGAGKVADQVLDQADAVAVDLVARHRIIGDDDLRQIALHVLHQRGGAGQRRHDVEAQVLVQQVGHAHQHERMVIGDDDAESLHARRSQVGRDGIRIILHQDPDLNQNVSKPGRKTESYRRLRIRTIRRISKIGDSHCRLIRSLGREAIAGASRGPAAPAVCARRD

SEQ ID NO: 160014 - protein, 198 aa, Glycine max
  Coding DNA Sequence Number=SeqID_43236
MAVEWRRKRERRCHFKEKMGQEEAHHHWKPWIRVWRKNEMNEGRRREERKILERFDYFSPGVDVLSYSNLVPTSHTSDLTVDRARLIFGLVSRMDMNVGALIFGQMTFIAQYNSSRLGFPTLITALCRARGVVSDSLTFERLSPVINLAYIRKNCWSLDDLTVSIRGARRVRARPAKLPSTSVAPTPASTSAAPSVPA

SEQ ID NO: 160015 - protein, 94 aa, Glycine max
  Coding DNA Sequence Number=SeqID_43237
  Homolog annotation: Hit_ID=Q9ZUM2; Match level="QueryCoverage=43%, HitCoverage=13%, E-value=5e-09, Identity=58%"; Hit description =Expressed protein
MSRNPNGSGNRNLAETASYESNGGNDSIEDGEEVEDSILPERGAVDVPPPVGGSRQVKGGNSHRRHRRHTSRHHGIVEWNNGRSLRSIFFFFFC

SEQ ID NO: 160016 - protein, 174 aa, Glycine max
  Coding DNA Sequence Number=SeqID_43238
  Subcellular localization annotation: CTP_CleavageSite=79; ConfidenceScore=5.17e-01
MRTLKEILHSPPFFPSSMNCVFIHVSSTFEFGAVFHDCLSADPQGNPPFSPFFRSSMNCLFVHVSSTFEFRAVIHDCLSADPQGNPPFFPFFRSSMNCVFVHVSSTFEFGAVFHDCLSADPQGNPPFSPFFRSSMNCVFVHVSSTFEFGAVFHDCLSADPQGNPPFSPFFFGAP

SEQ ID NO: 160017 - protein, 49 aa, Glycine max
  Coding DNA Sequence Number=SeqID_43239
MEELITKHNSLSQNNSNVIMSARRFLTRILLPTPCFCHSAPTNKVCDHH

SEQ ID NO: 160018 - protein, 130 aa, Glycine max
  Coding DNA Sequence Number=SeqID_43240
  Subcellular localization annotation: CTP_CleavageSite=35; ConfidenceScore=5.17e-01
MAHEMVLRIESGCSGSRNGSCSTTFAARGFGTRPYAAGGGSGGEAGSRSTFAESTESTARSTDSTMSFFIDCFHQQNRRNQPALLKQLLTLDLLLEDMNIGIGKGMVKGNRSGCFTQSRSRFTHSRYIGY

SEQ ID NO: 160019 - protein, 82 aa, Glycine max
  Coding DNA Sequence Number=SeqID_43241
MPWNEKPRRPKRKNTCQQSFEGLYRAAIVSSNSEELSETEGNMWAIIDECKEKLNLAATHEQRLEDEYAKISAESKAREEGN

SEQ ID NO: 160020 - protein, 189 aa, Glycine max
  Coding DNA Sequence Number=SeqID_43242
MLTSMNTLTQMWMTLLLSNVLPSDHNSDLPLSKCQLVYAILTRMSVHVAQLIADAIYLFAGMPPTRHPLDPDKSNRALGFPALITGLCQSFGVPVTPSKGDAPQAADALLPPHHADPTGSLGMERYLQHLVRQQAANHRGQCRAEVAWPEDWPEAQAGEAPAGAPGDAEEARMDEEKMDLLGFLGGSGA

SEQ ID NO: 160021 - protein, 169 aa, Glycine max
  Coding DNA Sequence Number=SeqID_43243
  Subcellular localization annotation: CTP_CleavageSite=60; ConfidenceScore=5.22e-01
GSHPQRHPVDLKKSNKALGFPALVTGLCRPYRAPVPPSKFMSSWHRDRARKTLCGPGEVQQGLGVASSDYGPLSILRGACRPQQGVGRNTTAALGWPVSGNRHTATTSRVHLSSSTKRLERCLQHMADQQATKSKAKDKQKYYVSDKQVIRRPAQDVKEALLGRQPSTF

SEQ ID NO: 160022 - protein, 257 aa, Glycine max
  Coding DNA Sequence Number=SeqID_43244
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=69%, HitCoverage=55%, E-value=4e-36, Identity=44%"; Hit description =Similarity to MADS-box DNA-binding protein
  Pfam annotation: Domain name=SRF-TF; Domain location=9-60; Score =59.2; E_value=1.3e-14; Accession=PF00319.9; Description=SRF-type transcription factor (DNA-binding and dimerisation domain)
MARKKVKLAFIANNSKRKTTYNKRKQSLLKKTEELSTLCGIEACAIVYGPNDPRPEIWPSESGVINVLGKFKSMPQWEQTKKMANQERFIAESIVKGKEKLKKLADENKEKEMSLFMVQWLKTGKVQPEHNMTMADFNVLSSMIDQNLKDIAKKMEMLNVNEVIPNQPQMQTPAFQPDIPTSSFEPQMQNPSYQPQMQTPAFQTLMQAPALVAYQPQMPTLTPEEMTLLNNGYGSDMNANPMQSQGFMDWLNGNGDD

SEQ ID NO: 160023 - protein, 91 aa, Glycine max
  Coding DNA Sequence Number=SeqID_43245
MGSGNRTRLASGSGYSQNQSQGIKLDVYKEKVGAETEGMTPAGVITGGVLWHGQSKGKGSHGRQPWAMNAQEERRFWKLLHCYVRDGNERE

SEQ ID NO: 160024 - protein, 210 aa, Glycine max
  Coding DNA Sequence Number=SeqID_43246
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=77%, HitCoverage=50%, E-value=9e-39, Identity=50%"; Hit description =Similarity to MADS-box DNA-binding protein
  Pfam annotation: Domain name=SRF-TF; Domain location=7-58; Score =38.3; E_value=2.6e-08; Accession=PF00319.9; Description=SRF-type transcription factor (DNA-binding and dimerisation domain)
MKKVKLVYITNDSKRKATSKKRKNGLIKKLDEIGTLCGIEACAIIYNPNDPQSEVWPSDLGIQSLLSRFRRIPELQKSKKMFDQESFLRQSIIKAQEQPKKQKNENRKHEMTHLMFHYLTIGKIFNNPNLIDLNYLSWLIDQNLNEIEKKINRILTQEVTPVIENGGEKAYTNHVPGQGSNMNAMQKHWSMEFIMVVPGMRCYHSEMLMP

SEQ ID NO: 160025 - protein, 229 aa, Glycine max
  Coding DNA Sequence Number=SeqID_43247
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=70%, HitCoverage=50%, E-value=7e-27, Identity=40%"; Hit description =Similarity to MADS-box DNA-binding protein
  Pfam annotation: Domain name=SRF-TF; Domain location=9-60; Score =61.1; E_value=3.6e-15; Accession=PF00319.9; Description=SRF-type transcription factor (DNA-binding and dimerisation domain)
MTRRKTKLTFIANDTERKTSYKKRKKSLLKKTEELSTLCGIEACAIVYGPDDPQPETWPSEAGVKNVLGKFSTIPEWEQGKKMANQESFIAESIQKGRDKVKKIGKDNKEKEMTMFMYQCFNTGTVHPDNNMAIADLNVLSSVIEQKLRDISRRMETLNVNETTPQQPEMQTPALPVAPEETTTTPLNYGPDESDVNADPLESQWFMDLLNGNGDETPMTPFGDVNLPL

SEQ ID NO: 160026 - protein, 167 aa, Glycine max
  Coding DNA Sequence Number=SeqID_43248
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=97%, HitCoverage=50%, E-value=4e-28, Identity=42%"; Hit description =Similarity to MADS-box DNA-binding protein
  Pfam annotation: Domain name=SRF-TF; Domain location=9-61; Score =50.9; E_value=4.4e-12; Accession=PF00319.9; Description=SRF-type transcription factor (DNA-binding and dimerisation domain)
MARKKVNIRYISNPAKRKATFKKRKNGLFKKVSEICTLCAIEAYAIIYSPDEPAKPEVWPSDQGVRSVIFCFREVSELEQSKKTLCQENLLLRNNLSKAQEQPKKLKNENRKKEMSLLMCQYFIVGKNLENANTIDLNDNTFLTDKKIGENENEIRDAPSPGDDTSY

SEQ ID NO: 160027 - protein, 136 aa, Glycine max
  Coding DNA Sequence Number=SeqID_43249
  Homolog annotation: Hit_ID=Q1SEN7; Match level="QueryCoverage=40%, HitCoverage=19%, E-value=4e-10, Identity=44%"; Hit description =Peptidase M, neutral zinc metallopeptidases, zinc-binding site
MHSLLEDDDGGGGVVNDGDVTHVEAELPGGLRGKDGARAVAKAVVVDSGDAAVVVGEFLTDLGLENDKVSTRVCDEGIAAVVDGDVTGGIDLFGGEGGEEEAAAGAGAEVVGSEGVERRDPRRKCCGGDGMCGILV

SEQ ID NO: 160028 - protein, 463 aa, Glycine max
  Coding DNA Sequence Number=SeqID_43250
  Gene Ontology: Mol. function=metalloendopeptidase activity; Cellular component=extracellular space; Biological process=proteolysis
  Homolog annotation: Hit_ID=Q10LS9; Match level="QueryCoverage=99%, HitCoverage=42%, E-value=1e-168, Identity=61%"; Hit description =Insulinase containing protein, expressed
  Pfam annotation: Domain name=Peptidase_M16_C; Domain location=60-264; Score=66.6; E_value=8.3e-17; Accession=PF05193.11; Description =Peptidase M16 inactive domain
MEAMEREVLAVDSEFNQVLQSDACRLQQLQCHTAAHNHPLNRFFWGNKKSLVDAMEKGINLREQILKLYKEYYHGGLMKLVVIGGVISSNGSSQGSRVGLKLIYGESLDVLESWVVELFGAVKKGQANPVFTVEGPIWKSGKVYRLEAVKDVHILDLSWTLPCLHQEYLKKPEDYLAHLLGHEGRGSLLSFLKSRGWATSLSAGVGEEGIYRSSIAYVFVMSIHLTDSGVEKIFDIIGFVYQYLKLLSQDSPQEWIFKELQNIGNMDFRFAEEQPPDDYAAELAENMHFYPPEHVIYGDYVFKTWDKQLLKQVLGFFIPENMRVDVVSKSFLKSEDFQYEPWFGSRYVEEDIGQSFMELWRNPPEIDVSLHLPSKNEFIPSDFSIRASDTCVDDFANSTSPRCIIDEALIKLWYKPDSTFKVPRANTYFRITMKGGYADVKSCVLSELFIHLLKDELNEITYQ

SEQ ID NO: 160029 - protein, 270 aa, Glycine max
  Coding DNA Sequence Number=SeqID_43251
SSGKDNHGFVHEPGGWPPAGEPNAANTALYQMIQLDQPDEVAARLLSQRALLRASEGKAHGCAFQKRKDARSRHQRLFVENVGKTEGNRSTKAGLLLLRSSSFRGESNDSFYLEGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 160030 - protein, 438 aa, Glycine max
  Coding DNA Sequence Number=SeqID_43252
  Gene Ontology: Mol. function=metalloendopeptidase activity; Cellular component=extracellular space; Biological process=proteolysis
  Homolog annotation: Hit_ID=Q10LS9; Match level="QueryCoverage=98%, HitCoverage=42%, E-value=1e-119, Identity=49%"; Hit description =Insulinase containing protein, expressed
  Pfam annotation: Domain name=Peptidase_M16_C; Domain location=146 -332; Score=31.7; E_value=2.6e-06; Accession=PF05193.11; Description =Peptidase M16 inactive domain
MSPEECLYNFLDFTFILLQLNKVFFLVFNGNWPLISLLGKNWQNGILKHLKASIAKLETSVTYVGDMLELKVYGFNEKLPVLLSKFFSVSKSFVPTDDRFKVIKEDMKRALKNTNMKPLSHSTYLRLQVLCESFYDADEKLCYLNDLFLDDLKAFIPGLLSQIYVEGLCHGNLSKEEAINISKIFKMSFPVNPLPIELRHAERVICLPSSANLVRDVNVKNKSEKNSVVELYFQIDQDFGLGSIKLKALIDLFDEIVEEPFFNQLRTKEQLGYVVECSPRVTYRVFGFCFCVQSSEYNPVYLQGRIENFLNGLEELLDGLDGDSFENYKSGLVAKLLEKDPSLTYESNRLWNQIVEKRYIFDLSKKEAEELKNISKHDIVEWYKTYLKPSSPKCRQLLIRLWGCNTDLKEAEALPKSVLAITDPAAFKMQSKFYPSFC

SEQ ID NO: 160031 - protein, 61 aa, Glycine max
  Coding DNA Sequence Number=SeqID_43253
MTEDIVVFEMHAMTEDIFVFKMCVNYRIGHLRMSSDSPSLDDKGADDDVSLGVSIGSLASG

SEQ ID NO: 160032 - protein, 184 aa, Glycine max
  Coding DNA Sequence Number=SeqID_43254
  Gene Ontology: Mol. function=ribonuclease H activity; Biological process=DNA integration
  Subcellular localization annotation: CTP_CleavageSite=31; ConfidenceScore=5.57e-01
MSSPQKLQISFSPVLRRTRRPLFVRFKKNVKMKMKKRRNFNVFMPSRVLLLGLALVADRRVLGISLLKVEATELAWASWAATTSLVLLKNGKRLVAMSHGRLYQKRVKNAFDKKVRTRRFSEGDLVLKKVSQALKDNRGKWAPNYEGPFVVRRAFSGGALVLANMDGEELPSPVNSDVVKRYYA

SEQ ID NO: 160033 - protein, 63 aa, Glycine max
  Coding DNA Sequence Number=SeqID_43255
MAMGQDGDGYCLPNLRLRLPNIFSYPFLKLDGWNVFERVPTHTGFIGMSNHNLASSSHKLILF

SEQ ID NO: 160034 - protein, 48 aa, Glycine max
  Coding DNA Sequence Number=SeqID_43256
MAIQDIMPNKVSKVLDPVKFDDLENEAAIILCQLEMYLPPAFFDIMIH

SEQ ID NO: 160035 - protein, 275 aa, Glycine max
  Coding DNA Sequence Number=SeqID_43257
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-38, Identity=37%"; Hit description= UPI00006A17C9 related cluster
RTTCLAIRGLHDFTFRGLHVLAIKGLHALTFRRLHVLAFRRLHVLTFRGLYVLAFRGLHILDFNRLHVLTFRMLHAFTFKGLHALTFRALHVFTFRGLHALALRGLLIPAFRGLHVLAFRGLHFLAFRGLHILTFRGLHALAFIGLHVLTFRGLRALAFRGLQALAFRGLHVLAFRGLHALAFRGLHVLAFIRLYVLTFRGLHALSFRGLHTLSLRGLHVFTFRGLHALAFRGLHALTFRGLHILAIRGLCSLTFRGLHALSFRGLHVLSLRGLH

SEQ ID NO: 160036 - protein, 275 aa, Glycine max
  Coding DNA Sequence Number=SeqID_43258
  Homolog annotation: Hit_ID=Q47522; Match level="QueryCoverage=21%, HitCoverage=77%, E-value=4e-19, Identity=74%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGHTIAHMKNLYNDYFGQIVIVFGNFIIHMEDHTSYNHHMFTIARGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160037 - protein, 125 aa, Glycine max
  Coding DNA Sequence Number=SeqID_43259
LGYPMRGVPSDESITPFIAWGFSDHNARDRELRGSSNGIIGGYHKWLRVRTQGLDWLPNLKTVRDNEVKASEESDEVQALKAKLERARVVKEKFKAAIVSSSSEEVKGIITGQRHDLEGRAKGLP

SEQ ID NO: 160038 - protein, 164 aa, Glycine max
  Coding DNA Sequence Number=SeqID_43260
  Homolog annotation: Hit_ID=Q3SK58; Match level="QueryCoverage=87%, HitCoverage=81%, E-value=5e-15, Identity=32%"; Hit description =Hypothetical protein precursor
  Pfam annotation: Domain name=SH3_3; Domain location=32-77; Score =27.5; E_value=4.6e-05; Accession=PF08239.2; Description=Bacterial SH3 domain
MIKKSLFCLLTAFACSQAAAAETGVALKADQLRAETFSDAKVVGSVNKNDAVEILNKKGAWLQIKAAGKTGWVRLLTVKRNSSSGNNVAGVVGVATGRSGTGKVVSTTGIRGLSAEDLKTAQFNEAETKKLESNTVSAEEAKQYAISGGLSSHQYPYFTEGGQQ

SEQ ID NO: 160039 - protein, 447 aa, Glycine max
  Coding DNA Sequence Number=SeqID_43261
  Pfam annotation: Domain name=NACHT; Domain location=245-388; Score= -16.1; E_value=0.001; Accession=PF05729.3; Description=NACHT domain
  Pfam annotation: Domain name=NERD; Domain location=28-124; Score=5.4; E_value=0.0024; Accession=PF08378.1; Description=Nuclease-related domain
  Pfam annotation: Domain name=Sigma54_activat; Domain location=230 -363; Score=-168.7; E_value=0.002; Accession=PF00158.16; Description =Sigma-54 interaction domain
  Pfam module annotation: Pfam domain module=NACHT::NERD::Sigma54 _activat; Domain location=245-388::28-124::230-363
MARHGGHGVRLFIGERIEHASDRDVLVTVFDALEKGTEWAYIFANFNVNGRQVDAVVFSATTTLVIEAKGYTLPIKGGVNGRWTQFGSYGSRQLRNGYTQALDAKNALRDAIAELFGALSDYPNALLAIVPAIPSGSSLPPSDFKVKSGGLDAIKVALNTKSGALLSEEQCQEFATHLNLERVSGRDAAIHETVLLSERAVTSYESTFLEFHGPIGSQLAEDQYHLGDKLISASNILKMAMSSQSALLIRGPSGCGKSLLSSRIATECIQFGMLPIHIQGKNFEGKLQKIIDVELRLLSTSVRDLLRASRFLARHIVLFLDGYNECPEHLQVALTRSLQAFSLRYGAGIVITSQGALARPELLLVEEIQVRPPQPALKSLLAKLSQEDENFTNCQALLEIALSGLEAELIGQAAASLPAGASTFVLFDTVARMRLSSFATEGIRALA

SEQ ID NO: 160040 - protein, 180 aa, Glycine max
  Coding DNA Sequence Number=SeqID_43262
  Homolog annotation: Hit_ID=Q84VI1; Match level="QueryCoverage=63%, HitCoverage=16%, E-value=8e-42, Identity=77%"; Hit description =Envelope-like protein
MATSPKETSASGSPAVPSSPHQEQPEFNIQPIQIIPGQASVPEKLIPRRQQGVKIAEKASLATSPREVDTEMDKKIRGIVSSILKDASVPDAEKDVPTSSTPDVSVPDVNKDVPTSSAPNAEALPSPSEEESTEEEDQASEETPAPRAPEPAPDLPWKENWEELPWIARRSWTSSRLLDC

SEQ ID NO: 160041 - protein, 187 aa, Glycine max
  Coding DNA Sequence Number=SeqID_43263
  Gene Ontology: Mol. function=transcription factor activity; Cellular component=intracellular; Biological process=regulation of transcription, DNA-dependent
  Homolog annotation: Hit_ID=UPI00005F7A99; Match level="QueryCoverage =98%, HitCoverage=53%, E-value=2e-57, Identity=54%"; Hit description =COG1609: Transcriptional regulators
  Pfam annotation: Domain name=Peripla_BP_1; Domain location=1-187; Score=-2.3; E_value=1.4e-06; Accession=PF00532.11; Description =Periplasmic binding proteins and sugar b
LEKVDSLRPDNSQAARMATEYLIKQGHQRIAWVGGLGSSLTRAERIGGYCATLLQYGLPFRPDWIIECDDRQQSVSALTQALLHQHPRITAILAHNASTTLGCYFGALRSGRTLGEDAVDSYYTQQLALVGFNDDPQPELNDPALTFVSSEARIVGRRAAERILQRLAQPQADVQTLIVPPQLVQGR

SEQ ID NO: 160042 - protein, 399 aa, Glycine max
  Coding DNA Sequence Number=SeqID_43264
  Gene Ontology: Biological process=biosynthetic process
  Homolog annotation: Hit_ID=UPI000038DC01; Match level="QueryCoverage =63%, HitCoverage=63%, E-value=1e-17, Identity=30%"; Hit description =COG0438: Glycosyltransferase
  Pfam annotation: Domain name=Glycos_transf_1; Domain location=156 -340; Score=-4.0; E_value=0.0032; Accession=PF00534.10; Description =Glycosyl transferases group 1
MKIIVNGKGYPEKRNIIVNDSHHYLNLKYKNIWFYRNAVRQKIRKANKLFIFAPLPFSVPDDAQIIHLFNEVACTKKRWMATFETEIPRVLPVPGMAKLHNPQLQKQLKLIAAPQCTALLAISDATKKIQIKLLQAFPQQAAAILPKLHTLHPPQAIICDRVRPVNQARLTFSFVGNEFYRKGGAEVVLAFSELLAEGIIHPESVQVNLTGNLKHRYNIAHGAQQDDAQFHQRIEDLINQQAIFRHETFLQNDRLMKMLEQTDVGLLPTWQDTYGFSVLEMQACGCPVITTNVRALPEINPASAGWLIDCPLNDMFEIAIGSAQEKQAIRARIIAQLKQIIMQMMAQREAISTRSARALQRIKDQHDPARFRASLDAFYQLAGEADRASGVNAPKRVDI

SEQ ID NO: 160043 - protein, 107 aa, Glycine max
  Coding DNA Sequence Number=SeqID_43265
  Subcellular localization annotation: CTP_CleavageSite=32; ConfidenceScore=5.23e-01
MAEPSKKRKGSTSRSQRHSGSQETPIPPSIPSGSLFSSEEQRIRYTNLFSSRSIVDPKFIDMEFFSNENFECFQALENSNLIPFMSLKLPVYSELVKAFYSNLEIHE

SEQ ID NO: 160044 - protein, 117 aa, Glycine max
  Coding DNA Sequence Number=SeqID_43266
  Homolog annotation: Hit_ID=Q6CQF3; Match level="QueryCoverage=47%, HitCoverage=58%, E-value=3e-07, Identity=71%"; Hit description =Kluyveromyces lactis strain NRRL Y-1140 chromosome D of strain NRRL Y- 1140 of Kluyveromyces lactis
MCASQRASKPVRRKEADWWDPPVAGRSQRKLWWRPAAILTIAGARGRVLSGRCGCSVEPRHGIESSKWAIFGKQNWRCGMNRKLGYGAQLRANLDPTKGVGRLRQQDGGHGSRNPLR

SEQ ID NO: 160045 - protein, 304 aa, Glycine max
  Coding DNA Sequence Number=SeqID_43267
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDFMVGLPLSSMIGSPISGWIMRAFDGAHGLGGWQWLFLLEALHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160046 - protein, 121 aa, Glycine max
  Coding DNA Sequence Number=SeqID_43268
MPIDIREIEVALCIPGQGFILNVEGQLGKILRKDLTTLAQLDMNAGALISGQITSMAQSNSSRLKFPALITALCRTRGVASNSLVFERLSPIINLAYISKNCWNPDDPTIIIRGAKDQGQG

SEQ ID NO: 160047 - protein, 131 aa, Glycine max
  Coding DNA Sequence Number=SeqID_43269
MPSRHMACLPTIHHPMWRTLPMRMSITPLPYSLRANKLNLIMHIYTTKGKAVDGVPLPNILEGPQFRPQPQPLHFAAGRVPPAMVERGIFNHIEERFRAIERGKDHAFADMAELYKCAIIFSYFLTLFVPF

SEQ ID NO: 160048 - protein, 178 aa, Glycine max
  Coding DNA Sequence Number=SeqID_43270
  Gene Ontology: Mol. function=pyridoxal phosphate binding; Cellular component=cytoplasm; Biological process=cysteine biosynthetic process from serine
  Homolog annotation: Hit_ID=Q668K7; Match level="QueryCoverage=55%, HitCoverage=38%, E-value=6e-36, Identity=73%"; Hit description =Cysteine synthase B
  Subcellular localization annotation: CTP_CleavageSite=37; ConfidenceScore=5.26e-01
STLEDPTDRRGVAGRQPNPGARRPLLRRQPQCAAVCRRSTAATCCVSQKRLIGFSCPFIQGNPRVAFLLYAHQHTGKDRDNARTMHREYPAGTTATAGRPGGQRGSRCVGDDPAGGAARRDQARRRADRGHQRQHRHCAGDDRRVQRLYAEAADAGEYEPGAAGGDARLRRRADPGQP

SEQ ID NO: 160049 - protein, 230 aa, Glycine max
  Coding DNA Sequence Number=SeqID_43271
MIRGDTLRLSAPFCHPEAAGPMTSRDKNWPFCTLVSSRGGGPDDTRRYLTVIHTLVSSRGGGPDDTRRYLTVICTLLSSRGGGPDDTRRYLTVIRTLLSSRGGGPDDKQRQNLAAGPMIRGDTLRLSAPLCHPEAAGPMIRGDTLQLSAPFCHPEAAGPMTSRDTIWSFCTLVSSRGGGPDDTRRYLTVIRTLVSSRGGGPDDTRKYPSGYPYKHSFAICKTERLIACRD

SEQ ID NO: 160050 - protein, 91 aa, Glycine max
  Coding DNA Sequence Number=SeqID_43272
DADEAPLDVSILPACLWVLWGVVRLVVSSLAKREDPFHPGLFVGDAGGFQSPTREPLNVGGLVPPHCSLKSVVSDDACPGACFVQRDATTL

SEQ ID NO: 160051 - protein, 88 aa, Glycine max
  Coding DNA Sequence Number=SeqID_43273
MHQPQTLRSTYSRPAPRFQWHLTPPLHAMDDYDGYEAIAQRLEHVLNLRMVIAGTELYDIMQDCLTIARGGASADGSVRARQRRRTEH

SEQ ID NO: 160052 - protein, 558 aa, Glycine max
  Coding DNA Sequence Number=SeqID_43274
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=7e-38, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTIFALSGLHVPTFRGIHVLAFRGLHALTLRGLHVLAFRGLHVLGFRGLHVLTFRGLHVFAFRWLQFLAIRHLHVLAFRGLHVLTFRGLQALTFRGQHILTFRGLDVLAFRGLHILAFRWLHTLAIKRLHALALLSEDYMSSPSEDYTSPPSKCYTSPAFRGLHVLAIRVLHVLAVKGLHVLALKGLHGSRPRLQRATRPFHQKDTRPHHAFRGQHIDAIRGLHIQTFRGLHALEYRGLHILAFKGLHVPSFIGLHVLAFRGLHVLAFRGIHVVAFRGLHVLAFRGLHVLAFRGLHVPAFRGLHVLAFRRLHVLAFRGLHRTTCPRLQRATRSRHQRATRPHYQKATRPCHAFRGQHIVGIRGLHDLGFRGLHVLSFRWLHVTPSEDNTSSPSEDYTSSASEDYTSSPSDGYTSTLSEDNTSSPSEDYTSSPSDGYTSKPKEDNTSSPKEDYTSSPSEGYMPSPLEHNTGLHVLAFTGLHALAFRGLHVLGFRGLYVLALRGLHALALLSEDNKSSPSKDYTSSPSEDYTSLPSEDYTSLPLEGYTSWLSEDYTPSP

SEQ ID NO: 160053 - protein, 277 aa, Glycine max
  Coding DNA Sequence Number=SeqID_43275
  Gene Ontology: Mol. function=3'-phosphoadenosine 5'-phosphosulfate transporter activity; Cellular component=integral to membrane; Biological process=positive regulation of I-kappaB kinase/NF-kappaB cascade
  Homolog annotation: Hit_ID=Q9FN90; Match level="QueryCoverage=71%, HitCoverage=58%, E-value=2e-72, Identity=67%"; Hit description=UDP -galactose transporter related protein-like
  Pfam annotation: Domain name=DUF6; Domain location=63-194; Score =13.6; E_value=0.011; Accession=PF00892.11; Description=Integral membrane protein DUF6
  Pfam annotation: Domain name=TPT; Domain location=54-194; Score=0.6; E_value=0.00051; Accession=PF03151.7; Description=Triose-phosphate Transporter family
  Pfam annotation: Domain name=UAA; Domain location=2-200; Score=80.4; E_value=5.7e-21; Accession=PF08449.2; Description=UAA transporter family
  Pfam module annotation: Pfam domain module=DUF6::TPT::UAA; Domain location=63-194::54-194::2-200
MWQVWGTAIMQNRYRETDYLLALVVTLGCSVFILYPAGTDISPYGRGRENTVWGVLLMLGYLGCDGFTSTFQDKMFKGYNMEIHNQIFYTTLSSCILSLTGLIIQGHLLPAVEFVYIHKDCFFDIALLSTVATASQFFISYTIRTFGALTFATIMTTRQLVSILLSCVWFAHPLSWQQWIGAVIVFGAIYAKSFLRKAPEKTTSVEHVVANALYEGGLTYRKPPILYPSHNIGELDWSLVPHFLTGEIYNIDPNQKNVYKLKYVQCVASSMVFLAYP

SEQ ID NO: 160054 - protein, 234 aa, Glycine max
  Coding DNA Sequence Number=SeqID_43276
IYAHNQLNERKKLWKDLEEIHDMQQGPWCVVGDYNNVAKSQDRVGGKLVTEAEYEDLQAMMDATVGFNSFVERSWNQPARGTPMQRLWYKLHRLRPHLLKLNKFTNDIQKNKLAAREKLDQAQQDLRNNIMDAPRIEEVKRQNAKRIKVIHKDDGTILTTQKEITQEVLVFYGKLMGHDSRSLQHVDIDALRRGDHLTMVQREDLVRHVTVKEIEDALNGISDLKSPGVDGYSS

SEQ ID NO: 160055 - protein, 90 aa, Glycine max
  Coding DNA Sequence Number=SeqID_43277
MLSLDIAVTHALYVGLVFCHGKPEDPYHLLKLHTWGTAPPNAQVRRDNFSGPRVRKCIHIMHRISISSWHHNEHIVPAFVHYHIPASHFA

SEQ ID NO: 160056 - protein, 105 aa, Glycine max
  Coding DNA Sequence Number=SeqID_43278
MQIFIEAIDLNIWEAVELGPHIPTTVDEHDMELQRLNQNEENDKKKRSIALKAASSIQEENEEEDSDDEEDFSFFVKKFQKFIKKRRIDRRQNFNNGRKSQDDSQ

SEQ ID NO: 160057 - protein, 60 aa, Glycine max
  Coding DNA Sequence Number=SeqID_43279
  Subcellular localization annotation: CTP_CleavageSite=45; ConfidenceScore=5.23e-01
MPISPCGSFSWSVSFRHTDSARRQPVDPEKTNRVLGFPALVTGLCQSYRVPVPPSKVTPS

SEQ ID NO: 160058 - protein, 284 aa, Glycine max
  Coding DNA Sequence Number=SeqID_43280
  Pfam annotation: Domain name=DUF1635; Domain location=2-235; Score =100.9; E_value=3.8e-27; Accession=PF07795.2; Description=Protein of unknown function (DUF1635)
MSGEHELRQKLMDVRHELENMKNVKAELLNLLSMAYQERDEARCQLQKLMNPLQNVFDTHQNRLMFPSAKSNSSITESDNNSFSHGSSQVDSFFDTVSSPEFTNINAADPINIMSYLNQHVVLQDFNFSAPHALMVPPEKPMSDDTAGDAVIDCLAKERGLPQKGKLLQAVIDAGPLLKSLLFAGPLPTWRNPPHLQNIKVPPLAIKKCDATCIVPNTFGEIGNSLLKPKLPPLHYSNAPSSCSASMLNFAGQTTGSWNNNAWQLNSTPGVSIQVPSSKRQRHQ

SEQ ID NO: 160059 - protein, 389 aa, Glycine max
  Coding DNA Sequence Number=SeqID_43281
  Homolog annotation: Hit_ID=Q9FN90; Match level="QueryCoverage=33%, HitCoverage=37%, E-value=2e-46, Identity=70%"; Hit description=UDP -galactose transporter related protein-like
  Pfam annotation: Domain name=UAA; Domain location=27-296; Score= -38.7; E_value=1.8e-08; Accession=PF08449.2; Description=UAA transporter family
MAETTSASVSSPTAGDSNWRENKLWKGTFAVAGIMLTLVTYGVLQEKIMRVPYGVNKDYFKYSLFLVFCNRITTSAVSAGALLASKKALDPVAPIYKYCLVSVSNILTTSCQYEALKYVSFPVQTLAKCAKMIPVMVIILYLFFGLQEKGRMSYPASHIFIFFHHPYFLKPRSTKVVSERDIERESEKARESERANQWVRVRSRNERREVRFRKDPRHNHVDSNQSRQPKHSRGNWRDKADISTFYFTRFLDDVTEKDLWVQFKRGVSNVRALERQLDNIIIGSLKLYVNIPRYDRGRRNYAHRIMEHGTQTNVRRQRMTAPPQIHAQHWKATMTYAQALRSNRAKSRPKQYSHDVGAGRYGSLMRILKLAKYRLKAQVEKDEGPSGEG

SEQ ID NO: 160060 - protein, 179 aa, Glycine max
  Coding DNA Sequence Number=SeqID_43282
  Gene Ontology: Mol. function=metal ion binding; Cellular component =integral to membrane; Biological process=ubiquitin cycle
  Homolog annotation: Hit_ID=Q9LSW9; Match level="QueryCoverage=57%, HitCoverage=30%, E-value=4e-20, Identity=42%"; Hit description=RING -H2 finger protein ATL5K
  Pfam annotation: Domain name=zf-C3HC4; Domain location=103-144; Score= 32.9; E_value=1.1e-06; Accession=PF00097.15; Description=Zinc finger, C3HC4 type (RING finger)
MSSDSANDLSKWKLEEVISIIIVCVIFLTLSDCFGIFKRMVCGICLGRNQVQRRLLDESIADDPSLQQLQSRGLEFTVVQSLPTFQFKKNEGEQEKAAISVECAICLGEFEEGEWLKHLPHCSHSFHVSCIDTWFQSHSNCPLCRSVVHHHILQCSVASHTLLQPLRREDFERVQSIHS

SEQ ID NO: 160061 - protein, 101 aa, Glycine max
  Coding DNA Sequence Number=SeqID_43283
MEEQKLMQPSLYFLHLSSSKIFRVTKLHFDYIVSCETNTKDEEKGNSLGYVRLRKEEGIQMVVQVGEQSRQTRRKEKKANLSSPTMRLQHRESDSEVQRHE

SEQ ID NO: 160062 - protein, 106 aa, Glycine max
  Coding DNA Sequence Number=SeqID_43284
  Gene Ontology: Mol. function=transition metal ion binding; Biological process=proteolysis
MCGSVIGTLLNIQGKTKEDLNTHQDLIEMSTQDQLHPSKVIDPLKLNELENKAAIILCQLEIYLPPSFFDIMIHLIVYLMYTIKRYMKNLKGYAKNLHHPEASIVE

SEQ ID NO: 160063 - protein, 271 aa, Glycine max
  Coding DNA Sequence Number=SeqID_43285
  Gene Ontology: Mol. function=transition metal ion binding; Cellular component=cytoplasm; Biological process=proteolysis
  Pfam annotation: Domain name=Transposase_21; Domain location=80-271; Score=199.2; E_value=9.7e-57; Accession=PF02992.5; Description =Transposase family tnp2
MDQTWMNASRMSPAYEEGVEEFLQFASKRSRPNEDEKYFYSCSARYASKGKHVAKKSLSDEEDIVSNGFKRLFVDANNANDLTWHADERNCDEMLCHPTDYSQWKKIDCLYPNFGKEKRNLRLGLVTEGMNPYDSLSTQNSLWPILLRKYMMLSMMISGPRQPGNDIDVYLNPLIEDLTKLWDEGVVVFDGYQNDTFKLRAMLFCTINNFSAYRNLSEYSVKGHRACPICEEDKSYVLERAEDINTVFRKSQKKGKKVKLPFHMEEKVDIV

SEQ ID NO: 160064 - protein, 64 aa, Glycine max
  Coding DNA Sequence Number=SeqID_43286
  Homolog annotation: Hit_ID=Q9AYP0; Match level="QueryCoverage=83%, HitCoverage=93%, E-value=1e-19, Identity=75%"; Hit description =Mitochondrial ATP synthase 6 KD subunit
MRKFDPWPVFFKREWKRNWPFLVGFAVTGALITKLSLGLTEEEAKNSKFVKAHKSNSKWRIENK

SEQ ID NO: 160065 - protein, 55 aa, Glycine max
  Coding DNA Sequence Number=SeqID_43287
MEADMSIEQDQDANIVDQVNSWVNNKLRKSLWMIDWTSNNRHQSTAGGTVGQIWD

SEQ ID NO: 160066 - protein, 211 aa, Glycine max
  Coding DNA Sequence Number=SeqID_43288
  Gene Ontology: Mol. function=protein binding; Cellular component =integral to membrane; Biological process=I-kappaB kinase/NF-kappaB cascade
  Homolog annotation: Hit_ID=Q1S1A4; Match level="QueryCoverage=89%, HitCoverage=87%, E-value=3e-85, Identity=73%"; Hit description =Protein tyrosine phosphatase-like protein, PTPLA
  Pfam annotation: Domain name=PTPLA; Domain location=52-211; Score =111.8; E_value=2e-30; Accession=PF04387.5; Description=Protein tyrosine phosphatase-like protein, PTPLA
MSRISTLYLLAYNSFQAIGWTISLTKILYNLLVTASIKGTYASAASLICFLQCAAFLEVIHGAIGIVPSGVLLPLMQWGGRTHFVLAIVRKLDELQELPSVFITFLAWSMGEVIRYSHYAFGCLGNCPSWMTYLRYTAFIVLYPLGVGPGEIWAMYQALPVIKEKNLYADSFSSLPFSYYDFLKLTSIIYGFFASPIDWAIDFRKQERKNI

SEQ ID NO: 160067 - protein, 261 aa, Glycine max
  Coding DNA Sequence Number=SeqID_43289
  Gene Ontology: Mol. function=DNA binding; Cellular component=nucleus; Biological process=regulation of transcription
  Homolog annotation: Hit_ID=Q0PJI3; Match level="QueryCoverage=99%, HitCoverage=100%, E-value=2e-76, Identity=58%"; Hit description=MYB transcription factor MYB139
  Pfam annotation: Domain name=Myb_DNA-binding; Domain location=56-101; Score=49.6; E_value=1.1e-11; Accession=PF00249.21; Description=Myb -like DNA-binding domain
  Pfam annotation: Domain name=Myb_DNA-binding; Domain location=8-50; Score=48.3; E_value=2.6e-11; Accession=PF00249.21; Description=Myb -like DNA-binding domain
  Pfam module annotation: Pfam domain module=Myb_DNA-binding::Myb_DNA -binding; Domain location=56-101::8-50
MVQQEIRRGPWTEQEDYKLVYFVNMFGDRRWDFIAKVSGKSCRLRWVNYLHPDLKRGKLTPQEEHLVMDLHSKWGNRWSRIARRLPGRTDNEIKNYWRTHMRKKKAQEKKHASAASPVSSSCQSSLSSNNHVVDSHASKEVGEESCYDTGGYDDGMMMGLIGGEKGYSMDDIWKDIMSEEENNIYNNNLQPVYEGHSEEGCNFSCPPPPMIMPSPPSWDQYNISSQPLWVMDEEESNKMLFPTLSDQYFPYYEQGNAFLTG

SEQ ID NO: 160068 - protein, 193 aa, Glycine max
  Coding DNA Sequence Number=SeqID_43290
  Gene Ontology: Mol. function=nucleoside-triphosphatase activity; Biological process=peptide transport
  Homolog annotation: Hit_ID=P0A8L7; Match level="QueryCoverage=43%, HitCoverage=77%, E-value=2e-37, Identity=87%"; Hit description =UPF0263 protein yciU
PLHQSADVGGADPGSGQGEGKADPTAGRGAAFADQPADRLRVPHPLPDRRAGVRQDAPAAGGQFPPCGFVPEGRSAHAGEHVVDRLAVAVRETDHHLGEEVRVQIVIHVLAPVFGGVVQFGAAALFKLQVEQQNIRRIQIVAGQFEEDVVGLFQRFVFGKAQRAEKVEQALDQAMPERPLQPLFGVQQLGTGD

SEQ ID NO: 160069 - protein, 72 aa, Glycine max
  Coding DNA Sequence Number=SeqID_43291
MSSLAIPHHLASLMKVDLALDASHAADLVLDVVKGLNRGSLMKKSKKLMGVEKNAMTRLRHSWPSTLFPKAP

SEQ ID NO: 160070 - protein, 210 aa, Glycine max
  Coding DNA Sequence Number=SeqID_43292
MDNEEGVQEQMKADLSALKDQMASISEVMLKLQKTIEDKATATASNTVREAKPVLQPALNPGRDRNTAVFGRRYSPQAYPYGLPPDFTPRTAPEDLSQAPTFEGQLPPYDDYPGQDDEEVDTHLGPLLHLKDPSPHELPQPNIVRHIPTSPTPVKESVPFAEDKGKIEALEERLRAVEGLGNYPFSDLADLCPVPNIVIGDWESGTVSYM

SEQ ID NO: 160071 - protein, 82 aa, Glycine max
  Coding DNA Sequence Number=SeqID_43293
MSTLAITCFMHLTDICKALLCPLGGDFLFSEVSQPTLSAGGRRETRGMRVPRKEYARSRHQRLFEENVGKTGKDAIYELLSE

SEQ ID NO: 160072 - protein, 252 aa, Glycine max
  Coding DNA Sequence Number=SeqID_43294
  Gene Ontology: Mol. function=nucleic acid binding; Cellular component= intracellular; Biological process=regulation of transcription
  Homolog annotation: Hit_ID=Q6ZD69; Match level="QueryCoverage=99%, HitCoverage=62%, E-value=1e-51, Identity=45%"; Hit description =Putative Shwachman-Bodian-Diamond syndrome protein
MIERLMREIHFAVDPHSTSKKQALELIQELQKHFPIKRCPLRIRATAPDDQVPELLGKLNEWNATVISKEGSSAVSCHTMSKVKQRMTMVGSFKEVLSMSSVGVWIFELEPGLYKDCHDFVMNKMHGRFEVLAHSLYVEGDTQVEQYNDYEDIPEALPKETYDSVLKLNEKLQKQTISSTSRPTEGQQKQNKCSTCNVSFDDTKLYREHHKSEWHKHNIKRKTRQLPPLTEEECMADMELGDSKSDLKDYSF

SEQ ID NO: 160073 - protein, 220 aa, Glycine max
  Coding DNA Sequence Number=SeqID_43295
MYENSNDASKSSAKQLGDISHFYSVESTSIFLLLLLLLLLKIIMRGDHMLAIGSLERHYQCRHIFPEYLAPVGQICVAPGQFAADYMKWFYMISYPFMSLTQPGVTTVMDEALSDVPSDVKQPQHALVCVAPGQFATDYMKWFYMISYPFMSPTQPGVTTVMDEALSDVPSDVKQPQHALETCQTITERLERLINLRVVTEGTHYHRRVPKDHKRCDCGT

SEQ ID NO: 160074 - protein, 57 aa, Glycine max
  Coding DNA Sequence Number=SeqID_43296
MMSTEDVDDGAQRGSTSQAEEARTLGIAETTQRRRKKMSEQAKPAMAVEEPVVPTIS

SEQ ID NO: 160075 - protein, 183 aa, Glycine max
  Coding DNA Sequence Number=SeqID_43297
  Gene Ontology: Mol. function=nucleic acid binding; Biological process= DNA integration
MEETLTHFMQNPKEEWKAVMTRSKRFVEAEDEDSVVSKKKAAEKKERSRSGQAREKKREKAVIEGPEVPYPVVPSKKKKDHHLARFLDIFRKLEITMPFGQMPLYSKFLKDMLKRKHKYIHQENIVVEGNCSVVIQKILPPKHKDPGSVTIPCSIGEVTVGKTLIDLGASINLMPLSMCRRLG

SEQ ID NO: 160076 - protein, 394 aa, Glycine max
  Coding DNA Sequence Number=SeqID_43298
  Homolog annotation: Hit_ID=Q945F5; Match level="QueryCoverage=94%, HitCoverage=88%, E-value=3e-96, Identity=50%"; Hit description=Auxin- regulated protein
  Pfam annotation: Domain name=DUF966; Domain location=45-394; Score =468.4; E_value=9e-138; Accession=PF06136.4; Description=Domain of unknown function (DUF966)
MSVSSSSRGRITTELQVPKKWTDRETSPERTKVWAEPKTKTAKKVSVVYYLSRNGQLEHPHFMEVPLSSPHGLYLKDVINRLNALRGKAMATLYSWSAKRGYKNGFVWHDLSENDFIHPTQGQDYILKGSEIVEHGVAAVAARVNKSEEESNSPVAITRRRNQSWSSIDMNEYRVYKSESFGGSAERIGADAATQTEEKLRRRRAAREEEVVEIQEKNDRRIEAGMEGERVPHVTCDDNDSNNHTTELSRDEISPPPSDSSPETLETLMNADGRLGLRSSESQKDNLTVESCPSGRMRASSVLLQLLSCGAVSFKECGANAVKDRGFSLVGHYKSRMPRGAGNHSGKETGTSMEIPDLSRVRLEDKEYFSGSLIETKKVETPALKRLLAMDNRG

SEQ ID NO: 160077 - protein, 82 aa, Glycine max
  Coding DNA Sequence Number=SeqID_43299
MLILDSGVSVLFHLVVPIWVCLLSLTPCSGSRLQIVEHEEDVVRAKCIPRKSKTLPTKKEEGASMHIVSSSRHGSKRFDPQQ

SEQ ID NO: 160078 - protein, 329 aa, Glycine max
  Coding DNA Sequence Number=SeqID_43300
  Gene Ontology: Mol. function=phosphoribosylaminoimidazolecarboxamide formyltransferase activity; Biological process=purine nucleotide biosynthetic process
  Homolog annotation: Hit_ID=Q7WGB8; Match level="QueryCoverage=39%, HitCoverage=24%, E-value=1e-54, Identity=84%"; Hit description =Bifunctional purine biosynthesis protein
  Subcellular localization annotation: CTP_CleavageSite=47; ConfidenceScore=5.84e-01
MAGPPMSMFSTASAKVQSGLATVSRNGYRLTTSMSMRSIPAALMVSMCSALSRRASRPPWILGCSVLTRPSRISGEPVWAATSVTVRPDSASSLAVPPVDSRRTPRAARARANSTMPVLSDTESRAVSIFMVRDGSGARAPVSLQVGMGNLSCGARQPARPRGNALYLDVVGQQLLAQGVARDAQHFGRPRLVAAGPFQRHFEDRALHAAHHHVPHVVGLGFAQVFEIALQAGAHAFFQDIFLAHRSTDIFMLVLRRSCRQQGFRDRRRVGVAVAGKIEEPIRHRPPLVAGVVDQVHAVAERVRVRQAVQIPPYVLARRAYAGVFAIEA

SEQ ID NO: 160079 - protein, 34 aa, Glycine max
  Coding DNA Sequence Number=SeqID_43301
MVLKWFFKGSIRHAMAVPELEKMQRQDGTNKKQA

SEQ ID NO: 160080 - protein, 116 aa, Glycine max
  Coding DNA Sequence Number=SeqID_43302
MIMRDQDIYNSQDEATTSPFASESEEAKWEESSEEIYTQEEGQLLMVKKECKEVSVSSKRLAKKEIHFAIKTNIKETFHLRQPPHLLLCKKTFVSTTTPLGLEVIPHVKELLDKGL

SEQ ID NO: 160081 - protein, 182 aa, Glycine max
  Coding DNA Sequence Number=SeqID_43303
VVYKSKGETEDIELVEEEQARIGADSSSETSNKSENYKEDARNATHKHKPKRVESVNADAEAFEEEQARIGADSSSETSNKSENYKEDAQNATHKHKPKRVESVNADAEAFGHQSVSLENKTRDSTVLKIGNSAKVVIKQDMKGRRHKYGFNNNKREKAEKKRVVDDETGDKHQLDEVLRMP

SEQ ID NO: 160082 - protein, 209 aa, Glycine max
  Coding DNA Sequence Number=SeqID_43304
  Homolog annotation: Hit_ID=Q1T493; Match level="QueryCoverage=95%, HitCoverage=37%, E-value=3e-22, Identity=30%"; Hit description =Nucleic acid-binding, OB-fold, subgroup
FLKFLDDYEGDGPITVLLTHGRIKEAQGSCLPSVNNSFKASKLIINKPVMEIQEFNERLAELGIEARSGFKSHSEGCTQLSGSIQLSSKESFFGKAEAKTIADINTISKEIVCVTVGTITRIVLDNDSWCYTTCIQCHKKSDAEMAPFTCACGKYNKEAMLRYRLEVMINQGDENTKFLLWDRECSELIGQSADAVNKLKIEVCFWIQE

SEQ ID NO: 160083 - protein, 277 aa, Glycine max
  Coding DNA Sequence Number=SeqID_43305
  Homolog annotation: Hit_ID=Q47522; Match level="QueryCoverage=22%, HitCoverage=83%, E-value=1e-21, Identity=75%"; Hit description=LacZ protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSIPNDLNFFNNWIVGEQYGLMRHGDHIGIGIVASAKKKANRIKMLRREDGTEVKEGEGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160084 - protein, 68 aa, Glycine max
  Coding DNA Sequence Number=SeqID_43306
MSGFTRDSPQISASPHQLDLAPYASGPYNAQWNAPGLLHDKHTLRSSRILGEMEVVFVIGSAVGRLCG

SEQ ID NO: 160085 - protein, 133 aa, Glycine max
  Coding DNA Sequence Number=SeqID_43307
  Subcellular localization annotation: CTP_CleavageSite=26; ConfidenceScore=5.08e-01
MPSRHRDHARKTPSGPREVQQGLRVSSSDYGPLSVLQLVAPNKAIRPLLTGLSSRSTAPPGRRRARHHGSGQQTHRHHLWSSPQLIHKKVRALPATHGRPIGDQVQSQRRPAQDVKEALLGDNLVPFKSLLVI

SEQ ID NO: 160086 - protein, 177 aa, Glycine max
  Coding DNA Sequence Number=SeqID_43308
  Subcellular localization annotation: CTP_CleavageSite=54; ConfidenceScore=5.16e-01
MHYTSSSSPYQPPNHRNDSHHPPQPIKMPKSLFKRKPKPNHKSLQHHFSESATSSSEPKPPILSKPLPSLWKWLVTHQELRKRKSLPKGSKVNAPKFPSIVWTHGSQMKERRLTTIRVQLSQSARISSVNKPSGAILSRRGPITRVMARRLQEDWARDAGEGPRVLTSLKIDFGPMG

SEQ ID NO: 160087 - protein, 118 aa, Glycine max
  Coding DNA Sequence Number=SeqID_43309
  Gene Ontology: Mol. function=hydrolase activity, hydrolyzing O -glycosyl compounds; Biological process=carbohydrate metabolic process
  Homolog annotation: Hit_ID=Q47522; Match level="QueryCoverage=52%, HitCoverage=83%, E-value=3e-22, Identity=75%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLNSIFPECCETLWIMQQCLFSRVPKEANKVQGPTVSTPG

SEQ ID NO: 160088 - protein, 109 aa, Glycine max
  Coding DNA Sequence Number=SeqID_43310
MGKKDKELKGRSNSVIGGYHKWLKSRTKRITWLQKLKGLNGEEEEVPEESEEVQALKAELEKTKVNLAASHGKMLEDKQAKMSALWVEREAREEVIELLHKEGIGLLSL

SEQ ID NO: 160089 - protein, 232 aa, Glycine max
  Coding DNA Sequence Number=SeqID_43311
MEEDRTSIARFLSGLNMEVRDKVELLPYRDLDDLVQLCIMVKQQLKRKPTLKSYGSHSYSKKDQGHGILGAAPSKRKDDKRDEEEKLEKQKKKKDSKALSSKAKEKEKEEKDSSKKIVKKENHFATKVTLQVKELLDEGLVGKSLNPCALLVPKIAPLIELVRNHVPSWEDAQEKGVKRTSPKYQEHRDLRSNPFQGEGMMQSYPPMVLDKRLQEDWARAAKEGPRILMNLR

SEQ ID NO: 160090 - protein, 106 aa, Glycine max
  Coding DNA Sequence Number=SeqID_43312
MAYGFHVLKLCNSSLASGNRLPRLCNRLPEMKSLEAHLLIACSGYGTLCVAIVIAMAAQLIHDRVEMECLEGDWETLEGNARCRFRGTIRFTATSLVHPEEPARTL

SEQ ID NO: 160091 - protein, 104 aa, Glycine max
  Coding DNA Sequence Number=SeqID_43313
MEDTLKMEDLLKRWIEYLDTTRSEVSHPPPVNFNFCGGEHFNNNCHLYSMKNSWWGQELHPYHQYEEKRLSNLDNVFMQFMAYHASSKANQNSIQNLEIQVDKS

SEQ ID NO: 160092 - protein, 81 aa, Glycine max
  Coding DNA Sequence Number=SeqID_43314
MANQEEWVPFMDVLALLIFGVVLFPNVDGFVNLAAIDAFLAYHHSKESPVVAVLADLFDTFDRSARRVAHGSSVACPLSVF

SEQ ID NO: 160093 - protein, 293 aa, Glycine max
  Coding DNA Sequence Number=SeqID_43315
MERHNFHKRFTNLADSSIDLTLVKEFYANLYSPEGPLPKQVIIWVHLIRIDADNLNAFLETLMVLAEGESLPAYSRYCRMPTDIREIEAALCIPDRGFILNAEGHPGKILRKDLTTLAQVWSVLSYSNLALTSHTSDLTVDQARLIFGLVTQLDMNVGVLISGQITSMAQSNSSRLGFPALITALCRTRGVASDSLFFEHLSQIINLAYIRKNCWNPDDPIIIIRGARRPRARPTEAPSTSVAPHLAATSAAPPLAHIAAAPSTLPLVDFQSFEAMLQSIHQGQIILLQSLHL

SEQ ID NO: 160094 - protein, 84 aa, Glycine max
  Coding DNA Sequence Number=SeqID_43316
RKTQGSCMSKHENKGMQFVEQNCPICLHVPSDTIVSGWQKVCGMIIICLCMSSGSPPLDEKRAQNDHNLSLRGIRHNCLRMAKW

SEQ ID NO: 160095 - protein, 236 aa, Glycine max
  Coding DNA Sequence Number=SeqID_43317
DGVPFEGTLNDDWKFDFSAHDARQLVCTNNADMTGCLLAGSLAFESCILHYLIMRILLPRSSNLAQVSEEDLVIMWAFHTGRQLDWAHLVRYRMHKALRLNAPLPYPHLVTLFFRHFQIPLDPKPYVPIKRSFLIGAAVIASFGYRKEHDGSWVKKGVQPADEEGNLPVEDNSTLLRRLMDKFDGLQTSVGDKFDAMELQVDMRFDAMESRITKVEEDVSFIHTCFDPPPPPPSSS

SEQ ID NO: 160096 - protein, 286 aa, Glycine max
  Coding DNA Sequence Number=SeqID_43318
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=70%, HitCoverage=83%, E-value=5e-38, Identity=72%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=22-225; Score=-69.9; E_value=6e-08; Accession=PF00346.9; Description =Respiratory-chain NADH dehydrogenase,
  Pfam annotation: Domain name=NADHdh; Domain location=201-286; Score= -188.1; E_value=0.0069; Accession=PF00146.11; Description=NADH dehydrogenase
  Pfam module annotation: Pfam domain module=Complex1_49kDa::NADHdh; Domain location=22-225::201-286
MGLHHPSMHGVLRLIVTLDDEDVIDCEPILGYLHIGMEKIAENRTIIQYMSYVPRWDYLATMFTEAIIVNGPELLGNIQVPKRASYFQDLHEVDNYECYEEFDWEVQWQKERDLLARYLVRKESIKIIQQALEGIPDGPYENLEIRCFDREKEPEWNEFEYRFISKKPSSALNCQNKNFIDTRYPFFFRLESFKEIYGIIWVFALILILILGITISVLAIVWLEREISAGIQQRIGPEYTGPFGVLQALLDETKLLFKENLIPSRGDICLFSIGLSISVISIIISY

SEQ ID NO: 160097 - protein, 154 aa, Glycine max
  Coding DNA Sequence Number=SeqID_43319
TSNRALGFPVLITGLCQSFGVPVTPSKVIRPPITRAFIEKYCTPRQAQGDAPQAADAAPPPHQADPAGSFGTERYLQHLVRQQAANHRGQVQIHECLYQLSLNQQSQGFTPFACPTLDQFRAEVAWSGDWPEAQAGRRMQRLPAMQRRPAWMRR

SEQ ID NO: 160098 - protein, 119 aa, Glycine max
  Coding DNA Sequence Number=SeqID_43320
MTLLLSNILPSDRSADLPLRKYELLRVSVSPTGCPFPPARPCHHDIGITPARHLVDPKKSNRVLGFPALITGPCQFYGVPVDPNKFIRLLLIGLSLRSTVPPGKRRARHHSSLGMAGSG

SEQ ID NO: 160099 - protein, 248 aa, Glycine max
  Coding DNA Sequence Number=SeqID_43321
  Gene Ontology: Mol. function=nucleic acid binding; Biological process= DNA integration
MVRHRFMIDNYYHWTIVGDKDIKVQINKYHNLVEDLKAENITLPDEFVSKLLIDKLLESCINYKQQLKHRHKQMSLSNLVTHIITKDNNKKEYVDARAKALSAKANMVPDKPIQKRNRQKINDNPYKPEANLAEADGIIVVVISQECEQMGGKGKVLLKLTSWKMLAFSDVLHVPTIKVNLVSIALLEKVGVKVSFESNKIFMTKNNVFVGKGYCDQGLFVLNVSKVINGNVSTSTYMIDSYDIRHAR

SEQ ID NO: 160100 - protein, 357 aa, Glycine max
  Coding DNA Sequence Number=SeqID_43322
  Gene Ontology: Mol. function=RNA-directed DNA polymerase activity; Biological process=RNA-dependent DNA replication
MVTTSPFSVGNFIVRWGMETMALSSLSVFLPIKAKYDVFASTSGHQVHVASGLDSLVHKTKGGIALVDEDPGHHEVSYNDGDNHRVVLVDEVDALEVSLSGLAGLSSIGKDASDGYRSCRCCLVYFGLPLAFCPLPSSYFAPLDVLRGPTVFDVVANTAVKCFLENHDTIGHYGCVMLVPRPFGERLALVWLVPLVRLVRVRFGVCFALVTLLFGLVDFILESGPGCSPWLIRTVRSCYQVVFCTDYLRTFQGGLIVFLLQTGQGGRGHAMRRRRQSCLWTWVPLCQEGTQMLVWICCPIVPLEVEWLPPQRYVYLHNAERCGWIARRPRDVWHEPLVGHGQPLALSTLPRGVALSL

SEQ ID NO: 160101 - protein, 51 aa, Glycine max
  Coding DNA Sequence Number=SeqID_43323
MEITIYKLRVQVNQSNSQLNMGARDKSFMHKAYLEVRMEYPGLVEVSPMQL

SEQ ID NO: 160102 - protein, 194 aa, Glycine max
  Coding DNA Sequence Number=SeqID_43324
MVKVTPATQLHDPATEKSQNHHPHSTNGEKNDCESVMIDAFRWSRCKKPLPQKLMHTIGIPLPIEHIEVVCLLLVAKQVSLAKPPSLCRINKPGLSEWPIERGKLLLPGPGSLMTPPEYDELRRELKRHCWHKALTRVRGKLIKFDAESLNTFLETPMILEPGEHLTTYSRSALKAPEEGPHHFGAYLERPILF

SEQ ID NO: 160103 - protein, 75 aa, Glycine max
  Coding DNA Sequence Number=SeqID_43325
  Subcellular localization annotation: CTP_CleavageSite=30; ConfidenceScore=5.26e-01
MGTMWHAPSLQNTPRPRPSLTTPQSNKNKQQSEDKSLTFLSKHMQFRAPKYINGKLESPRMRGGSPRRAQLAQAS

SEQ ID NO: 160104 - protein, 319 aa, Glycine max
  Coding DNA Sequence Number=SeqID_43326
MASQEKWVPFADILALLIFGVALFPNVDGLVDLATIDAFLAYHHSKESQVVAILANLFDTFDRRCEKNSARIVCCLPALSRVPREGSANGREPLAFPCERFGAQSLKVVQKVHKAWRSPLRKDKELRGIRNGIIGGYHEWLRVHTRGLDWLSKLKVINEENFEAPEEDEEVQALKLELGKARLAKEKFKSAATNIRKECTELREENAATARALEQETKRARNEEHGRDKYRGALWGSNNELKLRREERDQSRVHGMILKEELTACSRSKRSLAQHLEANHASYHRAIKGRVKPVVDPRTKTSRGLRTSVRREGSKREGD

SEQ ID NO: 160105 - protein, 103 aa, Glycine max
  Coding DNA Sequence Number=SeqID_43327
MKQKGKRKKDREGRHVIVKKYKSFVKSKRIFWEQGTDAKSLVFGITEIRMDEFIELMKEHNLETLAMTNFARCFQIIIVTRALWSDMGVRPETDTLTPKCGIL

SEQ ID NO: 160106 - protein, 49 aa, Glycine max
  Coding DNA Sequence Number=SeqID_43328
MVLKFHDDPTVNESEIVVFLRQVRWPTGKRKGFGRREKKRNCEAEEAEN

SEQ ID NO: 160107 - protein, 99 aa, Glycine max
  Coding DNA Sequence Number=SeqID_43329
MQLNIFIDGLRPQSKQLLDASAGGCTIHGGAHESGCCIPNEEKIAHDVNYMGNQPRGNLNTSGFPAFQNNQQYQQQRQWQNHPGNQFNRDQGGSSTRPQ

SEQ ID NO: 160108 - protein, 149 aa, Glycine max
  Coding DNA Sequence Number=SeqID_43330
MATMIEVVMSMKKIVEVNAAAVVATSVVAEVDPTPPSGLNQINHPISDMVGQGGKELGSKGGPHFVQVQNKHAFPPYSLPPNYTPPNVAHTLNENVNNSTPILIKSQQPQFDHARVSQPMEETHEAPRDHNLADLEPYLGYATEGQAVG

SEQ ID NO: 160109 - protein, 91 aa, Glycine max
  Coding DNA Sequence Number=SeqID_43331
  Subcellular localization annotation: CTP_CleavageSite=55; ConfidenceScore=5.37e-01
MSPPPLEPHNHSQTHLMLSGWLPLLAQFSSSGLVGACTLSATLARLVRISEFQLSARLFAQWMDSSGALSGISPHSANMHCSSFFQILPRT

SEQ ID NO: 160110 - protein, 146 aa, Glycine max
  Coding DNA Sequence Number=SeqID_43332
MAIFASSTSTMDRIEATITELTSDQFHFNATQNSMSTKMDEILQRLTLLEIHYQFSNSLEMSRGTCLLCMTKLLVGTLAKPQVVPNPPNTFLDTNHISAFVLTKIKEIAKAYLGKVAEPNELSWNNPWDPRGPRQKWGSIGFFRPR

SEQ ID NO: 160111 - protein, 150 aa, Glycine max
  Coding DNA Sequence Number=SeqID_43333
  Gene Ontology: Mol. function=transmembrane receptor activity; Cellular component=membrane; Biological process=regulation of transcription, DNA-dependent
  Homolog annotation: Hit_ID=Q7XIJ6; Match level="QueryCoverage=88%, HitCoverage=69%, E-value=6e-40, Identity=56%"; Hit description=TIR/P- loop/LRR disease resistance protein-like protein
  Pfam annotation: Domain name=TIR; Domain location=19-140; Score=28.4; E_value=1.1e-07; Accession=PF01582.10; Description=TIR domain
MQRLPAKMIAKIARPACDVFINHRGIDTKRNVSGLLYDNLTRMGVRSFLDSMNMKPGDRLFDHIDRAILGCKVGVAVFSPRYCDSYFCLHELALLMESNKRVVPIFYDVKPSQLVVKDNGTRSPKELQRFSLALEEAKNTVGLTFDSLNG

SEQ ID NO: 160112 - protein, 220 aa, Glycine max
  Coding DNA Sequence Number=SeqID_43334
  Homolog annotation: Hit_ID=Q1S0F5; Match level="QueryCoverage=64%, HitCoverage=30%, E-value=1e-10, Identity=28%"; Hit description=IMP dehydrogenase/GMP reductase
MGSNQTPLLKKRFYQVKIKSLEVTSLQELGQLMGQLQQQAFRKAYGKIWDLATIEVSVEVIASLTQYYDQPLRCFTFEDFQLVPTMEEFEEILGCPLGGRKPYLFSGFYPSIARATKVVKISAQELDRVKQNRNGVVKVPRRCLEEKAKALENQGEWTSFIDILALLIFGFILFPNVEGLVDLALLTLSSPFTIARKARSSPFWPTWMTRLTGGVKRAAQ

SEQ ID NO: 160113 - protein, 176 aa, Glycine max
  Coding DNA Sequence Number=SeqID_43335
MESPTVATYPSAGRRRETHGCVFQGRKMREVATNVYLWKTLEKPIRVGLRIFKYERFESCFYMWGSYGLNDRSKHVKNEEKITESKRDEDEIIQSKNGPLRVHRMNSKPLTPFYSKNKGGGCHPACPDELDLICVTKFRAPSDVALCGACRPWIFFINGALCFLKFNGNGMEKEKR

SEQ ID NO: 160114 - protein, 191 aa, Glycine max
  Coding DNA Sequence Number=SeqID_43336
  Homolog annotation: Hit_ID=Q47522; Match level="QueryCoverage=32%, HitCoverage=82%, E-value=2e-21, Identity=74%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTFPCEESTKSQNEWFDYNKFVNVDFSVERRMLIDDQIKLIDTVDLEGGPVGKPVVPAALMNRPTRGERRFAYWALAECILAYYVGTDEGVSEVLHVAGEKRLH

SEQ ID NO: 160115 - protein, 83 aa, Glycine max
  Coding DNA Sequence Number=SeqID_43337
  Gene Ontology: Mol. function=DNA binding; Biological process=DNA integration
MTRGVEVENQLNRKIKRLRSDRGSDYTLFNEFCEKEGIIHEVTPPYSPESNGVAERKNRTLKEMMNALLVSSSAPSTFGEKPS

SEQ ID NO: 160116 - protein, 298 aa, Glycine max
  Coding DNA Sequence Number=SeqID_43338
  Gene Ontology: Mol. function=transcription regulator activity; Cellular component=intracellular; Biological process=regulation of transcription
  Homolog annotation: Hit_ID=Q10MW4; Match level="QueryCoverage=66%, HitCoverage=34%, E-value=6e-39, Identity=46%"; Hit description=Basic helix-loop-helix, putative, expressed
DTVGNGKAGNKAHCLSSATGALKDGKSVFIDRCNLDREQRSEFIKLGGGPQIDVHAVGGKAAAVVNRMLQHKELPKLSEGFSRITFCQNESDVKNALNTYSTLGPLDSLPHGCFGQKNPDSKIQLGIMMFLKKAEVPVAAASRESGIEDPTSQTLGKNNSCCKDKETLSSIPDNANSEMKEVESQAVGSAGSHANQVSPDDIPTLVFPSISTSDFQFNHEKAADIIFEKVAEFSNKFRNARLVLIDFSHKSKILSLVKAKVAGKNIDTHKFFTHVGDITHLYSRGGLRCNVIANVANW

SEQ ID NO: 160117 - protein, 272 aa, Glycine max
  Coding DNA Sequence Number=SeqID_43339
NEVVGLLLVAKRVSLAKPPCLCSLNKPGLSELAKPSMFQWSIWAKRLLALSLCRAKRALRAKRERYAQNVHSWNILLERNAVLYVTEYDEFQRELERRCWHKALTRQMDGHIDVALVNEFYANLYDLEDKSPRQVRVRGKLIKFDVASLNAFLETPPTWSVLSYSNLALTSHTSDLNMDKARLVYGLVMRMDKDSLSPTINLAYIRKNCWNPNDHMVTFSRTRKAWAQGSEAPSSSAPPAPAPPPAPPAPAPATPVPSGSSAQTAEILVLML

SEQ ID NO: 160118 - protein, 69 aa, Glycine max
  Coding DNA Sequence Number=SeqID_43340
MVLSSLILRWSPSSSSETSTSGVAAGEIWGVASSVTSGVGYASGYGSWAIGASPPPEEKTRLRARPPGP

SEQ ID NO: 160119 - protein, 371 aa, Glycine max
  Coding DNA Sequence Number=SeqID_43341
MPFRGLKNARKRAAFSTFFGKRDELAKRASCAKRAHQYSLYLVPLNAAFKELSANPYGTCQLSGLCLVKRPMSFRKRKCIGARPTAQYDTRRFHSFKAWTRYTDNVLGRHILVERKVEIYYTELDEFKAELERRNFHKHLTNLADNNIDLALVKEFYANLYSPEGPSPKQGESLPAYSRYFRMPTNIREIEAALCIPGRGFVLNAEGHPGKILRKDLTTLAQVWSVLSYSNLASTSHTSDLTLDKARLIFGLVSQLDMNVGALISGQITSMAQSNSFRLGFPALIIALCRSRGVASHSLVFERLSPVINLAYIRKNCWNPADLIITIRGARRVRAMPAEAPSTSAAPPSTPSSADFQCLEAMLQSIHQGQI

SEQ ID NO: 160120 - protein, 255 aa, Glycine max
  Coding DNA Sequence Number=SeqID_43342
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=100%, HitCoverage=19%, E-value=1e-48, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTGSNGNLMGNLPILDGTNWGELRIQMQVVFGFQDVLEVVEYAKKRDCKALFFIHQSVDKANFQKIAHAKTAKEAWCILEKAYSGDAKLKKVKLQTLRRQYEMIQMEPTEKVVDYFTRILSTTNLMKDCGEKLDDHMVVEKILRSLSPRFDYIVCAIEESKNLEDLKIEELQGSLGVHKQRLNDRDTERSTQALQAHSSKGKGRGEWSIDKGKGSHKTHSKNSKETQSETGESSGQHKNGVKSWKKEGKKFDKRK

SEQ ID NO: 160121 - protein, 178 aa, Glycine max
  Coding DNA Sequence Number=SeqID_43343
  Gene Ontology: Mol. function=DNA binding; Cellular component =chromatin; Biological process=DNA integration
  Homolog annotation: Hit_ID=Q1T010; Match level="QueryCoverage=96%, HitCoverage=18%, E-value=1e-28, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEECNLAKSPIEFGLKLGAGLDEKPVDATLFKQMVGSLRYLCHSRLDIAYVVGLSSKKQKDVGLSTCESEYMVAASTACQSGWLESLFAELKIRLDSVVQFNMDNKSAICLANNPIAHGRTKHIGTKYHYLRDQVRKGRISLAYCKSEEQEADILTKALRGEKFYKFREKLGVVNCLN

SEQ ID NO: 160122 - protein, 617 aa, Glycine max
  Coding DNA Sequence Number=SeqID_43344
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=93%, HitCoverage=60%, E-value=1e-79, Identity=37%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=318-452; Score =24.6; E_value=5.2e-05; Accession=PF00665.16; Description=Integrase core domain
  Pfam annotation: Domain name=zf-CCHC; Domain location=152-169; Score =31.9; E_value=2.3e-06; Accession=PF00098.13; Description=Zinc knuckle
  Pfam module annotation: Pfam domain module=RVT_2::rve::zf-CCHC; Domain location=506-617::318-452::152-169
MELIEKVADYFTRILSITNLMKGCGEKLDDQMVVEKILRSLSPRLDYIVCVIEESKNLEDLKIEELQGSLEAHEQRLNDRDKERSTNQTLQAHSSKGKGRGKWSTDKGKGSHKNHSKNFEETQSETGESLGQHKNGVKSWKKEGKKFEKRKVKCFNCNKYGHFASECTHKHKEGRNKAGDEANLAEGAASDSEQVLLMVIEKSDKRGSEFWYLDTGRKVRFADSSSINCEGVGNVVIKRKDGSNVVIENVMYCPTMDSYLLSLGQLLEKGYKTRMEDLMLKVYDKKQRFILKAKMYGHLNFQGLSRLVAKHMVSGMPQIKAPAEVCEGCVARKQPRNSFNVSLPPRAKEPLEAYAKKQSGATLKILRTDRGGEYTSKEFEDFCESKGIIHEVTTPYTPQHNGLAERRNKILLNMKLEEITPEEAWTGNKLRVQSKGMLVLDELGETSGEEATGNSIGGASPAVAQRPQRTNDAIISEGELVHYALLADVEPIGYVEALKEEVWKKAMLEELAAIERNNTWKLARLPKGKKPISLKWVFKREGLNYTEVFALVARIEIVRIVVVLAHSRGWNMWQLDVEYGVYVKEENGDIIILCLYVDDLLIIDSNEVVIQTVKKEL

SEQ ID NO: 160123 - protein, 167 aa, Glycine max
  Coding DNA Sequence Number=SeqID_43345
MGTSEFSHDTWKENERELVFYLKGTNVEQWKHKSISMKSETIKSGKHQQGNNRGEREAKSNKTKSSKQQRGKRRREKCKQQHGVDEKTQKRKKGLPAKGEMEATSSNGGSLAARRRRAETIFVLVVSGDGGGNRHHVAPESYPFVCPMRLRHGTRTSTACPCFIALD

SEQ ID NO: 160124 - protein, 85 aa, Glycine max
  Coding DNA Sequence Number=SeqID_43346
  Gene Ontology: Mol. function=DNA binding; Biological process=DNA integration
MRGSWKKLPNFEQQGNTIQRFNHEPFNLVTSYDESKEKPEKILEWESLAPTGKAHSGSQPVWTTEYTYYRNWMAKQFQEYGTPPT

SEQ ID NO: 160125 - protein, 49 aa, Glycine max
  Coding DNA Sequence Number=SeqID_43347
MGLTWPWTGPVVPATLFPYLVGIVVQFKYEQIARYWKSPSWVAIPFIFH

SEQ ID NO: 160126 - protein, 40 aa, Glycine max
  Coding DNA Sequence Number=SeqID_43348
MHIVVVKIGAGSSRATFWGRDKVKAAENQSRYLGMDANGG

SEQ ID NO: 160127 - protein, 155 aa, Glycine max
  Coding DNA Sequence Number=SeqID_43349
MPFIIQEQQAEWINTHRRILLPLSFRNSKLGGKRAETNSAPFIIQEQQVGWNSKLSDKRAETDFAPFVIRGQFRWQGGSLAKWCFARTKLVSYLHFHFISNKRQVKRGNFHTLISSEDHPLLGCDPHLTTSRYLAPIVRQFVKFRDMPEAKRKAS

SEQ ID NO: 160128 - protein, 129 aa, Glycine max
  Coding DNA Sequence Number=SeqID_43350
  Gene Ontology: Cellular component=chloroplast
  Homolog annotation: Hit_ID=P03938; Match level="QueryCoverage=55%, HitCoverage=75%, E-value=7e-17, Identity=83%"; Hit description =Hypothetical 14 kDa protein ycf68
MSPHGGDMDGGEKRKERDGVSLAFGIAGPGGRPARRAISSVVERAPDNCVVVPGLHISMAYFSCLNRGLKPNLSSGRIDGAIQNSYIPYQYMDSYLSSTGLGLASMEKNGAPNNVSSQTKNYEIAPFIL

SEQ ID NO: 160129 - protein, 153 aa, Glycine max
  Coding DNA Sequence Number=SeqID_43351
MPSRPLSNSKKSASLPCCSCCAVVPHAHTNVGLSLHDIVEVTLALTFTRIECHQSPSSSTSPFSNKDASGSVKLWEITKGVVIEDYQSCGRQLVSFEEKKEELFEICVFSTVLGVTTSNNGKKIMNTLNSDRHQEIMTTSNKVLATSKNAMKK

SEQ ID NO: 160130 - protein, 623 aa, Glycine max
  Coding DNA Sequence Number=SeqID_43352
MDECCPVSCVVTSTSVKEFHVDVACQAPDPGQVLSELLMLSCPEWTCLWHVCSAHAQYSCICVTRGVVVITITSAPCLMLVIPFLLPSLSSILQGIMSSTMSSFLSDSAIGIGGSDSGGSIEQPMMDQDVISIGGSSPENTCWGASDNESSSSERVRASCHIGESTSRHRGKERPSTAFGERCEVGNGQLLKYKSSLTSAASVNAFQRQVKLVLGLILLLTAFQCALLEHLNLIGKIGWVSLNSMSKKLFEFDSNIFHRFFKILSTDVVADDLPLMFNRDGEPCFPFCWQFDPTRFKSFDKDLLTLVERVDKAILEQLSVSLNIQAILSLPSMTDPFTTLDGDFACRPLMKQVRPAGQTMPPSTTVVAVGEGGQPVGEVDLISIVVEVALNAPSSVLTKRKQDDGVGSFGRKMLKAHMSLHALRQAVGLTLGVGRPLIVQNVPSTPPEATSVAVEVSVPATLVGSVVAPLSTIAAPILSAGVATTNTPVMLSSSSFPAMVFLSTILAVASPSLSSRSRISLDHLYTFSDFDSLWGATYKLKQKTPIGFVSALDKKLISLAILEENGQRHQEALHKVVSLEAEVAKWRVTACIVWRAERPKVANATIAFVEAVRLNRQLSSKVG

SEQ ID NO: 160131 - protein, 129 aa, Glycine max
  Coding DNA Sequence Number=SeqID_43353
MVPVLPTVGLGDHCPVRGTGKIRPSGTEMGCKYTPVSFGAGREGKGREMGSGSGINKTRFQSVLLPYLKLAVISLSFVKHNISILKHIGCMHGAYIMGCEEEEESKYIKVVPTNECVCSPFEVDQSVPC

SEQ ID NO: 160132 - protein, 266 aa, Glycine max
  Coding DNA Sequence Number=SeqID_43354
  Homolog annotation: Hit_ID=O04892; Match level="QueryCoverage=46%, HitCoverage=33%, E-value=3e-34, Identity=52%"; Hit description =Cytochrome P450 like_TBP
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 160133 - protein, 116 aa, Glycine max
  Coding DNA Sequence Number=SeqID_43355
TLDGNQHTPFAIQRPESPVACGDTLQLSAPRHLETPSRIDKQRPMWSSAPFPEMSASSDRDYFSLTEARTTRKYLSGYLYKTISVNPNPRSQVAGGDTQLIIRINTLLLSIRLRVR

SEQ ID NO: 160134 - protein, 69 aa, Glycine max
  Coding DNA Sequence Number=SeqID_43356
DSFEEQATQGFFGLHGRQDVVTTTIGRPKHPGRVHAAGDGVTIKQYFGSAPRTSRSSSSLPPEELQQLT

SEQ ID NO: 160135 - protein, 157 aa, Glycine max
  Coding DNA Sequence Number=SeqID_43357
  Gene Ontology: Mol. function=ATPase activity, coupled to transmembrane movement of ions, phosphorylative mechanism; Cellular component=membrane; Biological process=metabolic process
  Homolog annotation: Hit_ID=Q1SL54; Match level="QueryCoverage=40%, HitCoverage=23%, E-value=2e-27, Identity=87%"; Hit description=Major intrinsic protein
  Pfam annotation: Domain name=MIP; Domain location=17-131; Score= -109.3; E_value=0.012; Accession=PF00230.10; Description=Major intrinsic protein
DLWRLQAIKAKFEAALDAYKPSSIIAQEDIGLSMGIQGIEVAKESSDIIILDDNFASIVKVLAGLRLIRVSQCMFTIMNHQYVIWCFWPITGASMNPARSLGPAIVHNEYKGIWIYLVSPTLGVVAGTWAYNFIRYTNKPVHEITKSASFLKGGEAK

SEQ ID NO: 160136 - protein, 83 aa, Glycine max
  Coding DNA Sequence Number=SeqID_43358
MLAIVRDEDGVDASIGDGSRALTSDEDGLASVGGGDNVGATSRGLTGIETEDGDGVDDGRLSQGGNSPTTYRLFFPVVPFPLE

SEQ ID NO: 160137 - protein, 120 aa, Glycine max
  Coding DNA Sequence Number=SeqID_43359
MVSVNVRARARAKEHDDENDDDTMRQRCKLNIDTKLLASCIVIANGAKKIDEPMCRNNRIIYHRPPIIKYESASVGHHVCAGLLPVCHLHGLATGAGGATAASAGVAGPDVVGEVVVVGE

SEQ ID NO: 160138 - protein, 124 aa, Glycine max
  Coding DNA Sequence Number=SeqID_43360
MRLPGKESLLMGSPITINEILDVSISFLNDHLEETLGSTKIEEIHSKCINLAQGKDYGESGFWLKVCRMARHDTCRGLVWLKDKRDASHYFHDTNAKMMIWKLYAKLVMHAPMRTLKCQIFMVM

SEQ ID NO: 160139 - protein, 52 aa, Glycine max
  Coding DNA Sequence Number=SeqID_43361
MLGDKRAETNSAPFVILHTFLPPRLDRVQQNAETNYGSAGRKVHWPKGVLLE

SEQ ID NO: 160140 - protein, 190 aa, Glycine max
  Coding DNA Sequence Number=SeqID_43362
  Gene Ontology: Mol. function=ornithine cyclodeaminase activity; Biological process=arginine metabolic process
  Homolog annotation: Hit_ID=Q2KYV7; Match level="QueryCoverage=86%, HitCoverage=47%, E-value=1e-60, Identity=68%"; Hit description =Ornithine cyclodeaminase
  Pfam annotation: Domain name=OCD_Mu_crystall; Domain location=1-150; Score=-25.3; E_value=1.8e-08; Accession=PF02423.6; Description =Ornithine cyclodeaminasemu-crystalli
MVSKLARNLAGVAGLRLRRFDSIAAAVAGADIVTTVTADKAYATILTADMIEPGMHINAVGGDCPGKTELHADVLRAGPVFVEYEPQTRIEGDLQQMPADFAVTELWRVLTGQCAGRGHARDVTIFDSVGFALEDFSALRWLRDSAVRHGIGTRVEVAPQLADPKDLFGLVLARQTAARAARDTQALLRN

SEQ ID NO: 160141 - protein, 74 aa, Glycine max
  Coding DNA Sequence Number=SeqID_43363
ILPSFLSKAHLGGEAPSSMAYFPSGWRLLSPLLLCLPLHFHGGKSPLKDLIEAQRSSLHRSPTSKLPSIPYGHN

SEQ ID NO: 160142 - protein, 93 aa, Glycine max
  Coding DNA Sequence Number=SeqID_43364
MDAWTKLYRYNKTESNEQLPSLQRHAFVKWWNQFDATKAEPDKVKMWFKAHPEFLKTVDPETSLFLNQKSKLAAFLTGSKLKEHLTKNLKEVL

SEQ ID NO: 160143 - protein, 118 aa, Glycine max
  Coding DNA Sequence Number=SeqID_43365
MTKLGLCVPSDTTVSEWQRGADNRKVSPRIIMTKLGLCVPSDTTVSEWQRGADNRKVSPRIIMTKLGLCVPSDTTVSEWQRGADNRKVSPRIIMTKLGLCVPSDTTVSEWQRGADNRK

SEQ ID NO: 160144 - protein, 86 aa, Glycine max
  Coding DNA Sequence Number=SeqID_43366
MTTTYTSKPYTRVMTGTMHELQPNLGADKKSSPDRLKTQKDGLGKKLNIGQPLRIKTICKEEHSGHQVTNERFLNPMITIQVKRIA

SEQ ID NO: 160145 - protein, 192 aa, Glycine max
  Coding DNA Sequence Number=SeqID_43367
AIFHHEVINTDKDNDSTKLILFGQKVGKGKAIQTTHQNMEVCEDVIGKSRWTYGHSSSSESSNDEEDDDNCFDFFSKDYMTSQSSLSLEPTIKDPPGVQYSQTPLSKKKSNGSQQRRRKLKLPWEMGSSKSFESEKKPNICYSSNHKFVNNFEAKKLPLAGGTPHWGLPPADGALDWGLLFVGGALEWEFSH

SEQ ID NO: 160146 - protein, 57 aa, Glycine max; identical to SEQ ID NO: 155984
  Coding DNA Sequence Number=SeqID_43368

SEQ ID NO: 160147 - protein, 108 aa, Glycine max
  Coding DNA Sequence Number=SeqID_43369
  Subcellular localization annotation: CTP_CleavageSite=55; ConfidenceScore=5.02e-01
MACNMFAPCPNFRDLHGRKLKGPLVIIPKVVISLLMVSRVPSIVANCCNLPFSVKATRDSRVRLPREEDARSRHQCLFEENVRKTGKVWSTNFKCERFGSCIYAQGRC

SEQ ID NO: 160148 - protein, 113 aa, Glycine max
  Coding DNA Sequence Number=SeqID_43370
MCGWRSLASKCLEHLRAIVDVRVNGKVCHEVVATYTWLREGVPMCKDGIAIYGGYGGSHRVSKLGANRKVKHKGQIGVFKMTHYTGYNLNLCKMSYFTLVVIQTNLTCSILVM

SEQ ID NO: 160149 - protein, 60 aa, Glycine max
  Coding DNA Sequence Number=SeqID_43371
MEELRKKMTLSLLKAAINCMISGGRMMAFFLCNHRDIKPNVKRNLSSKGNYEMTGMHNIK

SEQ ID NO: 160150 - protein, 68 aa, Glycine max
  Coding DNA Sequence Number=SeqID_43372
MHHQKRKTLDETLLLSSESETQHDHRSTSTPYGLHRPGINHQGCFNKHSKVKHCFKINTRLLQQTFKG

SEQ ID NO: 160151 - protein, 340 aa, Glycine max
  Coding DNA Sequence Number=SeqID_43373
  Gene Ontology: Mol. function=siderophore-iron transporter activity; Cellular component=membrane; Biological process=siderophore transport
  Homolog annotation: Hit_ID=Q0K283; Match level="QueryCoverage=44%, HitCoverage=20%, E-value=2e-49, Identity=68%"; Hit description=Outer membrane receptor, TonB dependent precursor
  Pfam annotation: Domain name=Plug; Domain location=220-320; Score =64.5; E_value=3.5e-16; Accession=PF07715.5; Description=TonB -dependent Receptor Plug Domain
PPDPAEQRRRRLGRWRRCRLGRGAAHRRPHDLGKALDARQAGLEAAADGVQPGAPMRLVVFQAVGDQGRAQLRIARHQQAVGERDGIRPFGQAADRFGPVGIAGGAVAQAAATVCHQVFRWSLGRLTARGPREFPAFQRSAYPLREMRHGSEAAVIIIPGSIPILMKDPDRGSDDRTLFAPHPCLAPAPDRARAGPETATGPVRGFFAERAVTATKTDAPVMETPQSISVITRDRMELQGAQSVQQATGYSAGVTANNRIDHRRDGVKIRGADSTHYLDGLLNSAWYYNNTRPDPYTLERIEILRGPSGMLYRQGSIGGILNLVSKRPQAEAMRELGVSY

SEQ ID NO: 160152 - protein, 88 aa, Glycine max
  Coding DNA Sequence Number=SeqID_43374
MSCVILFLLLLLLLLLLSTTPCHAAARKARFDTLKGGSSSDDEFKFKPSNNFHGTGLQGNTNAQKDGDQVFGADKRKVYTGPNPLHNR

SEQ ID NO: 160153 - protein, 92 aa, Glycine max
  Coding DNA Sequence Number=SeqID_43375
  Gene Ontology: Mol. function=ATP binding; Cellular component =mitochondrion; Biological process=protein folding
  Homolog annotation: Hit_ID=P34893; Match level="QueryCoverage=93%, HitCoverage=88%, E-value=5e-31, Identity=74%"; Hit description=10 kDa chaperonin
  Pfam annotation: Domain name=Cpn10; Domain location=4-92; Score=89.6; E_value=9.7e-24; Accession=PF00166.12; Description=Chaperonin 10 Kd subunit
MAKRLIPLFNRVLVEKIVPPSKTNAGILLPEKSSKLNSGKVIAVGPGFHSKDGKLIPVAVKEGDTVLLPEYGGTEVKLDNKEYRASRLKLLF

SEQ ID NO: 160154 - protein, 101 aa, Glycine max
  Coding DNA Sequence Number=SeqID_43376
  Gene Ontology: Mol. function=RNA-directed DNA polymerase activity
MDVKTTFLNGDLEEEIYMTQPEGCVVDGQENKVCKLLKSVNSLRYPLPSGLTLKTDSRIHSLSLIRLYPLSSGLKTNRKQSPRCRISKKEKQIKETGRKTL

SEQ ID NO: 160155 - protein, 71 aa, Glycine max
  Coding DNA Sequence Number=SeqID_43377
MDWQFVWLIQITNPPQQWLHNKSDIEEERLTVRKEKTRTTTVAMIGGMNSGGSAKKKKQTMKEKKAQGVRT

SEQ ID NO: 160156 - protein, 129 aa, Glycine max
  Coding DNA Sequence Number=SeqID_43378
MMRGEVVDVEQIDGGDAWNSTKWVCVRSRGCRSKLHDDEPSNFDDAKSPRYILCGTSRGYIYLGYYTENKRGYISCGSVQVEGTSTWLFKENKGGYIPCGSLLVKDFTRLLEISRTVGSWGLDVGTGCG

SEQ ID NO: 160157 - protein, 456 aa, Glycine max
  Coding DNA Sequence Number=SeqID_43379
  Homolog annotation: Hit_ID=Q2P4Z8; Match level="QueryCoverage=35%, HitCoverage=11%, E-value=2e-65, Identity=76%"; Hit description=ATP -dependent RNA helicase
  Subcellular localization annotation: CTP_CleavageSite=45; ConfidenceScore=5.22e-01
LARIWWSHSGASQCPRRAWRSGAGSTAAEGRFNKASRPGTEARFTASSRQDRGLYTSAGAVQGQSPRPPSPGMKTCRYTRGQTQESPVMSPIVPRFRLRLLACAALLLSLSAPALAQRVVEGDLQQQMSPAEFKAAGLEKLSAQELATLNRWLQGKVEAATTQAVAAVRESAREEGRQEVIVKNRGFFDFGSSEPIVGVLQGEFRGFGKGRVYVLDNGQEWEQTDTSTTPGVRKQSPNVSIKPGMLGVWCAVPSNGLPVPWSLADAPLLSDGPPSSIASSRAPARLYRTGFTPGAMRSPAAPASSPRCRCVPPAPARTVTPAALPDPSAAPAIAGARAVPAAPPLPALPGTGAVPACAPGHVADHAWHARYAGSSLSDSADTAPMRRPVYRAGSQDGSARPAAPPCRPGCRAPSPSAALPASASVRPPAPGWSRPASAATSPHRTGPWPHARVAAR

SEQ ID NO: 160158 - protein, 71 aa, Glycine max
  Coding DNA Sequence Number=SeqID_43380
MNPKAVSLLSPVITTKKLYPLLAMNPKEVSLLDPVINQEANPLLAMNPKAVSLFSPVFNQEDLLLKNNHQE

SEQ ID NO: 160159 - protein, 296 aa, Glycine max
  Coding DNA Sequence Number=SeqID_43381
  Gene Ontology: Mol. function=protein binding; Cellular component =outer membrane
  Homolog annotation: Hit_ID=UPI00005F7DD3; Match level="QueryCoverage =59%, HitCoverage=83%, E-value=3e-71, Identity=67%"; Hit description =COG3047: Outer membrane protein W
  Pfam annotation: Domain name=OmpW; Domain location=118-296; Score =264.2; E_value=2.6e-76; Accession=PF03922.4; Description=OmpW family
MANSRHGYTAANFTLQRHAARSTIVGAAHVAHQQAQGFCQFNRHRATAVVGFGPVKRNAKMGAAGATGHTGDFYVRLGKSCAAINLNTLFSGKGVIMKLAKCALLLALAIPQLALAHQAGDFFVRAGSATVRPTEGSDNVLGMGGFSVSNDTQLGLTFTWMATDNIGVELLAATPFRHKVGLGPTGNLATVRQLPPTLMAQYYFFDSQSALRPYVGVGINYTTFYDAKFNQTGQDAQLSDLSVKDSWGVAGQVGLDYQINRDWMLNASLWYMDIDTEVKFKAAGEQQNINTRIDPW

SEQ ID NO: 160160 - protein, 63 aa, Glycine max
  Coding DNA Sequence Number=SeqID_43382
MTESYGIPGASLSAEHVQSPAGHHRADGVADLVYYRDCWPRPDAGRGSVIPAQPDRQQRLIAV

SEQ ID NO: 160161 - protein, 96 aa, Glycine max
  Coding DNA Sequence Number=SeqID_43383
MRVIMEMDGSGIDGASHIGRRNEFLEGLCGFEEVATANADLDQFRVELGVQEVRDHVGDLGDEIRVEGVVGGEGFGGEGLRWNRCVLLRVWKAETE

SEQ ID NO: 160162 - protein, 98 aa, Glycine max
  Coding DNA Sequence Number=SeqID_43384
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=99%, HitCoverage=14%, E-value=1e-14, Identity=42%"; Hit description =Lipoxygenase
  Subcellular localization annotation: CTP_CleavageSite=54; ConfidenceScore=5.10e-01
MALAKELMGFSSFVSASYKVFLHNKHGTFWFNTILLPSDNTRVVRLRKGAKFPMAAISEDLIKTTLTVHAEKPHLDAINDRIGTRNIVLELMSTEIDP

SEQ ID NO: 160163 - protein, 90 aa, Glycine max
  Coding DNA Sequence Number=SeqID_43385
MSQKSDDVKLFGHCHVICHLRSMIPRPFPSREMVLKNRKIIIMSPSKTSEVLNMCEWIRDGIDAHDLATGRESGSEHVNNQEFFRYSNQH

SEQ ID NO: 160164 - protein, 62 aa, Glycine max
  Coding DNA Sequence Number=SeqID_43386
MDTSEPYTGAMRDTVHEPQANLRADQKFSLRETVRKPHYKRNLKESWALSSKGNNARKSSLP

SEQ ID NO: 160165 - protein, 566 aa, Glycine max
  Coding DNA Sequence Number=SeqID_43387
  Gene Ontology: Mol. function=transcription regulator activity; Cellular component=intracellular; Biological process=tetrapyrrole biosynthetic process
  Homolog annotation: Hit_ID=Q1M4Q3; Match level="QueryCoverage=44%, HitCoverage=81%, E-value=1e-117, Identity=78%"; Hit description =Putative erythrulose 4-phosphate dehydrogenase
  Pfam annotation: Domain name=Sugar-bind; Domain location=325-566; Score=238.3; E_value=1.7e-68; Accession=PF04198.3; Description =Putative sugar-binding domain
MQQALRDTGVRVTSGMTGPYGRLNHFGHPDAAVRRYYIDWFKTFADITAELGGVAVGSQFAIFTQRDFNDVARREALIAIAIDCWAEVAEHAKAAGLRYLFWEPMSVGREFGETIPACMALQQRLSAAQFALPMWMMADIDHGDVTSADPRDYDPYAWAEAVPRFSQIIHIKQSMMDKGGHRPFTLQYNAGGRIQPQPLLEALARGGAQDNEICLELSFKEREPTDSNVVAEIAESVAFWADHIDTGVQDLHLATPQPDRDNPMKSAPTSAERDDSLALRAAWLHYVGGLTQAEVAKRLGLPSVKTHRLIARMVAEGAVKVTIDGAIVACVTLEEQLRSRYGLNFCQVAPDLGEEGLPVRALGMAGADYLRNLLASTPAITLGLGHGRTLSAAIHQLARIDAPHLRFVSLLGCLTRNYALNPHDVMHRIAEKTGAQAYMMPVPFFANTEEDRDVLLAQRGVSEVFSMAAHSEVKLVGIGTVEPAAQLVEAGMIDAAEIRALSEAGAVGELLGHFFAADGQMIHNSLTARTLSVPLDLAQRAEIVALTGGPSKVAAIRAVLASGLVT

SEQ ID NO: 160166 - protein, 119 aa, Glycine max
  Coding DNA Sequence Number=SeqID_43388
MAMHRNTDYVLHLPYSSPLSASRQTGCSTYYYRPHVNLLYPMWVYIRAELSYFEDFHVYLELEKPHHDLEFLRTALEYDGWGNVHRYNMELVCPIKVIEDQGDHLDMSSEEIEDYRELL

SEQ ID NO: 160167 - protein, 78 aa, Glycine max
  Coding DNA Sequence Number=SeqID_43389
MSDTMSRTSCPKILELLHNAQCRIHDVGYNVQDILPENTGVAAQCTMQDPRCRIQCPGHPARKYWTHKSVISLTDYYA

SEQ ID NO: 160168 - protein, 102 aa, Glycine max
  Coding DNA Sequence Number=SeqID_43390
MPDESEPTNENLMKNSHRDPPTLKDANPQAKIHPDADHPNLKMLVKRYVHLSHALSHLGPTSPLSPTDDNGLTQILPLSLPGLNGVTQHMDDNWEDMSHAST

SEQ ID NO: 160169 - protein, 125 aa, Glycine max
  Coding DNA Sequence Number=SeqID_43391
  Homolog annotation: Hit_ID=Q1SM20; Match level="QueryCoverage=96%, HitCoverage=31%, E-value=5e-18, Identity=35%"; Hit description =Nucleic acid-binding, OB-fold
MARIPDKINSIDGSKEALKLVVRITDLWFVGTPNKSKQAKMVIVDFEGDQIHVVCKADQLKCWKANLKENSTYVMHNFKVVKNDGQFRVCEHEYKLVFIGVTVVKEADLHQLPFKEFRFVEFGNV

SEQ ID NO: 160170 - protein, 110 aa, Glycine max
  Coding DNA Sequence Number=SeqID_43392
  Pfam annotation: Domain name=Transposase_23; Domain location=37-106; Score=-17.6; E_value=0.096; Accession=PF03017.5; Description =TNP1ENSPM transposase
MQSQGLGLPPQPEVGPFAARVSTKESYVDPLEQDPDTGDSEKCGLHADENHPRLIAFERVYNGLTTVHNVPLSNDKVKVSVKEVRDVEARVPVPSQEVWIIRELRDPRNL

SEQ ID NO: 160171 - protein, 61 aa, Glycine max
  Coding DNA Sequence Number=SeqID_43393
MEFGMHEREREAIRYCFQIESKYMATKNLYPAPCNRQHRKNAVSRIAMVVLSCLSLYKLVL

SEQ ID NO: 160172 - protein, 91 aa, Glycine max
  Coding DNA Sequence Number=SeqID_43394
MKMEALSSSKTQPKAKGKSGIEEDTKMKKKEWKQRKQIETLEKKPRASPTEWPKLNTQRDIKRYTKPSIKDPDLIIPQYTSLSIGESAKHA

SEQ ID NO: 160173 - protein, 175 aa, Glycine max
  Coding DNA Sequence Number=SeqID_43395
MIQKLFKLLEILCNFNSSKLTLSNRSKISIRSPESSDKEIHACETNPKRNANKIHRESKDPRNPNSRSVPCMPIKANLKWPKEAWILGQDVSSGFTPSIRKKPRFFVQQEEAQAWSKLNLLQDHQPLGAKKGQSLRVALLSLLKYRLHSSTSLRHASESSSGKKGETPSDNTFIG

SEQ ID NO: 160174 - protein, 266 aa, Glycine max
  Coding DNA Sequence Number=SeqID_43396
MVAFASSTSTTDHIKAAIAELTFDQTMSTKLDEFLQRLTLLEIYYQFSYVFHSQPPSTPSFEKTVVGIVPQSSTEDGATEFEPSFVCLDKKVPSFMEELLNLISSQGTVVENQTMESEVHGEDGSKFALGSNEKSVFGRGCEFSNYNGTLSRHQVSHVPSSIFNQFGHACAVVSLDNLLSVVVHYGYAAALHDMLLDHRDMTLFERGVESYGSAMVASKRRLAVFVLWTAAKPSELRRDKPWDPGGSGRTRNTLRTRCFWKIQGML

SEQ ID NO: 160175 - protein, 511 aa, Glycine max
  Coding DNA Sequence Number=SeqID_43397
  Gene Ontology: Mol. function=nucleotidyltransferase activity; Cellular component=mitochondrion; Biological process=tRNA processing
  Homolog annotation: Hit_ID=Q6L5J0; Match level="QueryCoverage=99%, HitCoverage=98%, E-value=1e-117, Identity=48%"; Hit description =Putative tRNA His guanylyltransferase
  Pfam annotation: Domain name=Thg1; Domain location=1-246; Score =154.1; E_value=3.7e-43; Accession=PF04446.3; Description=tRNAHis guanylyltransferase
  Pfam annotation: Domain name=Thg1; Domain location=264-507; Score =325.0; E_value=1.3e-94; Accession=PF04446.3; Description=tRNAHis guanylyltransferase
  Pfam module annotation: Pfam domain module=Thg1::Thg1; Domain location=1-246::264-507
MANSKYEYVKCFEVEDEAMFPNIILVWIKASKLHKPHDSNTLKLMNSCAVEVLEEYADVVFAYGFSDEYTFVFKKTSKFHERRASKVLSIITSFFSSVFVRKWDEFFPHKELQCHPSLHGRVIACASIKALQAYLLWRQTICHLSNQHEQCLWRLVERGMNEKEAWDFIKGFEKSDLNNLLFDEFNVNYNTLEPILRQGSCVLKTTGEDTVKYTDNGAPIKRHRRKIVTVHSKKIASKRFWNEHTVLLKDLGGFVEEINNVTPEYVRSFEFDSKLMPCTWIVVRIDGCHFHRFSEIHEFVKPNDDRALNLMNLCAVAVLEKFWEDIVFAYGVSDEYSFILKKTTNLYQRRANTIISAIVSFFTSTYVMRWKDFFPQSELKYPPSFDGRAVCYPSTEILRDYLSWRQVDCHINNQYNSCFWKLVASGKSKREAQNSLKGGQLQKKIEELAIDYNKLPVMYRQGSSIYRDKVDNVLIHQENGESPENYGKVIVGHFDIIGPTFWLEHPNILDE

SEQ ID NO: 160176 - protein, 319 aa, Glycine max
  Coding DNA Sequence Number=SeqID_43398
  Homolog annotation: Hit_ID=Q8GSZ9; Match level="QueryCoverage=81%, HitCoverage=39%, E-value=2e-07, Identity=22%"; Hit description =Armadillo repeat-containing protein-like
  Pfam annotation: Domain name=Arm; Domain location=173-213; Score =11.3; E_value=0.48; Accession=PF00514.13; Description=Armadillobeta -catenin-like repeat
  Pfam annotation: Domain name=Arm; Domain location=48-87; Score=5.4; E_ value=2.6; Accession=PF00514.13; Description=Armadillobeta-catenin -like repeat
  Pfam module annotation: Pfam domain module=Arm::Arm; Domain location =173-213::48-87
MELSETDEENITAAAKFGWYNLLIDRMIQGSESSRMSMAKAIVNLELKDLNLKLLGEQGITLPLLEMLSGSIESKELSLSALVKLARLHANKGIIHYCNIWRMKSFITIKCCEILEKLATDDDRIDFFVDGEGKQLELDNIITNLLAVMQSPNSAHYRKPALRGLLGLCKFETGLVKKAVLAANGVSLILALLDDSDPEIKETAINLLFLFSQHEPEGVVEYLFRPRRLEALVGFLQNEDNDDARAAAFIGDLSMSTPKLTVVSKSTGCTRWWCFRPLKVPLCSAHESVCTVSSTLSVGSKCFARLDKAVTWGGSCKCS

SEQ ID NO: 160177 - protein, 304 aa, Glycine max
  Coding DNA Sequence Number=SeqID_43399
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=93%, HitCoverage=36%, E-value=2e-18, Identity=24%"; Hit description=U box
  Pfam annotation: Domain name=U-box; Domain location=175-229; Score= -15.7; E_value=0.025; Accession=PF04564.6; Description=U-box domain
VVKTANAAIDVVIDKESFKVLSKQLLDIAPVLKELQLQDLNESEAEREPWPLLPAGEVQIHSQVEQVTRDIGRSLAVLSVANTEVLSRISDQVNRLQNEMQTVEFEASQSQLQIIDKLNHGIREKKLDQAFANDMLEEIARAVGMPSRSLSYYLELMLQGIMKKLRNNTLKGFSLCTGTKCERSAIEAWFDDGNGTDPETKEVLEDTTLRSNVQLGESIEEWREVNYCFGIRSIRESLLSNSELLVQESQSQIQDLLRENSINKDWISIGELTDIIISILGESNSRDVKMKILITFKDAVEGHA

SEQ ID NO: 160178 - protein, 459 aa, Glycine max
  Coding DNA Sequence Number=SeqID_43400
  Gene Ontology: Mol. function=binding
  Homolog annotation: Hit_ID=Q9LS90; Match level="QueryCoverage=93%, HitCoverage=99%, E-value=1e-155, Identity=61%"; Hit description =Arabidopsis thaliana genomic DNA, chromosome 3, P1 clone: MXC7
  Subcellular localization annotation: CTP_CleavageSite=66; ConfidenceScore=5.24e-01
MAVGSRRSPTKTLGQIKIASQTRKSLQTERKMQKREQGKSGGSAGGGATPPAKRGRPFGSGNNSSSAAASAADSAAPSTLLGPSLHVHNSFADQNNKRIVLALQSGLKNELTWALNTLTLLSFKEKDDMRKDATPLAKIPGLLDALLQVIDDWRDIALPKEFAKTTRIRTLGANSVVSGFGSEYQALGSTGTPHRPGVGSGSAGIESTQQNGMAKSRFSELWLDEDSLFNLDDEGRAEKQQCAVAASNIIRNFSFMPDNEVIMAQHRHCLETAFQCIEDHLVVGVTYREKRAVQAIMGMLESAVKAWHCAAAELLGRLIINPDNEPFLLPFFPQIHKRLIDLISMPALDAQAAAIGALYNLAEVNMDCRLKIANERWAIDRLLKVIKMPHPVPEVCRKSAMILESLVSEPQNRSLLLAYENAFAEIVFTDGRYSDTFARILYELTSRPSNKVAAARGIW

SEQ ID NO: 160179 - protein, 252 aa, Glycine max
  Coding DNA Sequence Number=SeqID_43401
  Gene Ontology: Mol. function=RNA-directed DNA polymerase activity; Cellular component=chromatin; Biological process=chromatin assembly or disassembly
MTPPIGVINVFLVPDDFKVDSSTGDDDHGMWEVINNLNGRGPKQKMRNGRGRFAIDCLISTEILFEYSIKDFRLPVNFRMISSAHAKLGALEFEKFTPKFANEKWGHNKKLSYRHSVMFANQLKESLSNLKSGKMEWKTINMAGLIKVSGNEVEKENLPHSNWNCALMHKIPDIVRNKPRFGNTHVSRDRSLMEFLQQSGPEMWCMINPYAALEDDKPLMNSVIPIIGGLGIDILKWNSSLEHKLHCSSSKK

SEQ ID NO: 160180 - protein, 132 aa, Glycine max
  Coding DNA Sequence Number=SeqID_43402
MGGDEIRKKLNIEEDGCGIVSNHALHLLARYVQWRFGRVVVDGTLYAESLINGVIRQGLKLICGVKGFGSGSSVDTFSRVKGSSSMINRKKQVMQSYPSRALDRRFQVDWTRDAREDPRILMSLRADFGLMG

SEQ ID NO: 160181 - protein, 82 aa, Glycine max
  Coding DNA Sequence Number=SeqID_43403
MALMNEVLETQINVFNDKTNFLAHNTNNRPVIEPQRGLPRAYMMQSYPARALDKRLQVDWARDPRESPRVLMSLRVDFEPMS

SEQ ID NO: 160182 - protein, 203 aa, Glycine max
  Coding DNA Sequence Number=SeqID_43404
  Homolog annotation: Hit_ID=Q2QTN1; Match level="QueryCoverage=22%, HitCoverage=22%, E-value=1e-12, Identity=64%"; Hit description=Kub3 -prov protein, putative, expressed
MTWTGHKSVFDNVDVGDIYRGLRWVRFFGTGTKASKAAAIVAGQSGAAPIRDGHVCSGAILGRGWSSRYRGGAWQSGAGCGAVFRPATSKHWREDEGFHSDSGFRKMVTEGGGGGHTHGRKERGEETLVEAGKTYLSVTMEAVWVPFIGVNNGGGGVGKECVKRKVMQALSQNPNCSGLAAKDAMEAVWDVCYNDTQPFDRAP

SEQ ID NO: 160183 - protein, 58 aa, Glycine max
  Coding DNA Sequence Number=SeqID_43405
MRIYLLSCSRVREYGLGQQKVLGDHKGWKVTSPDDHGRIFSQGNVDNIGEERSKVKEG

SEQ ID NO: 160184 - protein, 142 aa, Glycine max
  Coding DNA Sequence Number=SeqID_43406
MEREMITLIVDTLLVFYYEKMVGYMPSSFADLVFAGERIEVGLRRGKFDYAASTSSSNRRPGAGGAKKKEGDAYTVTTGTSTWVVVTENKRGYISCGSVQVEGTSTWLFTENKEGYIPCGSLLVKDFTRLKRNLKDCRSLGD

SEQ ID NO: 160185 - protein, 161 aa, Glycine max
  Coding DNA Sequence Number=SeqID_43407
MSYADLLPSLLNNQMVVVSPGKVYQPLFPRWYNPNATCANHGDVLGHSVEQFIAFKHKVQSLIDAGWLTFQEDSPNVRTNPLANHGSSSVNMVGEGKSQELKQIRDVLTPKRFILEVLREVGVIECDDNKGDPCLMHSWVLHDAKRCPIAEELLQGLISRG

SEQ ID NO: 160186 - protein, 156 aa, Glycine max
  Coding DNA Sequence Number=SeqID_43408
MGTRSVLMWRIFISDTIHQFVGIAPLRHPEKSNRALGFLALITGIAVGARPVAIGRRRTTISRVHLSSHVVNHRGQMQLNDSFYQYTLHQHCQDLNPYLWPTPEQFRATFAWPGDKPNFQVEAGPTEAQGAAQVDEGGAEDDGDMADLLDFFIGGD

SEQ ID NO: 160187 - protein, 55 aa, Glycine max
  Coding DNA Sequence Number=SeqID_43409
MHAAVFYHLSVFAKGKMNEEAFWVMVNVTPTWALDDMAKSRLQPHVRLKTLKKRS

SEQ ID NO: 160188 - protein, 100 aa, Glycine max
  Coding DNA Sequence Number=SeqID_43410
NNGNDGDNDDGGTKMMVVEAAKWWRDGADSDSDDNNIGIIVVVTTIVIGWIGGIVVATHNNDDGGSGDNNVVVVVETTTVRCGGGGDCDKIVEVEAIAIV

SEQ ID NO: 160189 - protein, 76 aa, Glycine max
  Coding DNA Sequence Number=SeqID_43411
MAETGQYRSRIGLNKDEFAGKWPESTGPGAIMAERHGRFFANCHSQFVKRGLPWQRPKVQWNFYMVEFQPSTMFRY

SEQ ID NO: 160190 - protein, 105 aa, Glycine max
  Coding DNA Sequence Number=SeqID_43412
  Subcellular localization annotation: CTP_CleavageSite=17; ConfidenceScore=5.17e-01
MGSFSNNLSKGALLDVKCMHAAPKLPVPLASLVSVKESLLAMAICTCKLNKSPVRLAIYVPVEPPVKLASSRCCFVGLLFQAFSGGRLLFSDNRPKGKLQLPLTS

SEQ ID NO: 160191 - protein, 163 aa, Glycine max
  Coding DNA Sequence Number=SeqID_43413
MVIGPLIMSIISSNNEVITLFFGHLRWGPLTVIHRPERVVRQFRYIQTIPPHPVAPSISFEEMNDRWMQLHGLFYMIWHPFMSSAQSGDSPRVLSVQQYDTFVEPNVHQQPVAAATPDEADIDVHHLGHAMDAFEVIADKLERLLNLRILTKGICWIKWPRNN

SEQ ID NO: 160192 - protein, 191 aa, Glycine max
  Coding DNA Sequence Number=SeqID_43414
  Homolog annotation: Hit_ID=Q1SWC9; Match level="QueryCoverage=55%, HitCoverage=48%, E-value=5e-16, Identity=37%"; Hit description=F-box protein interaction domain
  Pfam annotation: Domain name=FBA_1; Domain location=12-149; Score= -52.3; E_value=0.07; Accession=PF07734.3; Description=F-box associated
MPHSCLEQTYSQVYMDGTCLWLSISENQTWEECLVSFDLSNEVFHISILGELGVKASWTKFFIVGPLPCVDLPIGVESKIDIHPIRVGMKGNIFFKRKDDELILFDKSPVAKIVKIDSKCFDDNKDDDKKPKKMTSRLSQEQFKNQVSSFKFQESRIKNNQDQDSRLKIQESRKDSIKISTKKFVKTLSST

SEQ ID NO: 160193 - protein, 159 aa, Glycine max
  Coding DNA Sequence Number=SeqID_43415
  Gene Ontology: Mol. function=helicase activity
  Homolog annotation: Hit_ID=Q9ZQ61; Match level="QueryCoverage=72%, HitCoverage=11%, E-value=4e-28, Identity=48%"; Hit description =Putative helicase
MSWVKFLHTCGLPHTHLLLFLHPSSKYTTLDDIDKIILTEIPCEQHHKELHNLVESHTIHGHWGLANRSSPFMKDGRCSRRRDTGNTIIKNGATDDNWSVAPYNVMLLLKYQAHINIEWCNQITSIKYLFKCINKGYDRITIVIVANEDQGGVVDEIKL

SEQ ID NO: 160194 - protein, 87 aa, Glycine max
  Coding DNA Sequence Number=SeqID_43416
MGLEPAGSAQILTRKTRVDWGRGRVRIFLDNQSQNFISVSRTGRGGENPTPSGVGMGGKSTPLLGFGGGVSKTRPRPALLLCLIGYK

SEQ ID NO: 160195 - protein, 150 aa, Glycine max
  Coding DNA Sequence Number=SeqID_43417
  Gene Ontology: Mol. function=nucleotide binding; Cellular component =membrane; Biological process=small GTPase mediated signal transduction
  Homolog annotation: Hit_ID=Q38922; Match level="QueryCoverage=41%, HitCoverage=29%, E-value=1e-28, Identity=95%"; Hit description=ATGB2
  Pfam annotation: Domain name=Ras; Domain location=64-148; Score= -22.5; E_value=1.4e-07; Accession=PF00071.12; Description=Ras family
  Subcellular localization annotation: CTP_CleavageSite=55; ConfidenceScore=5.47e-01
MCHLLGFGWDSNKPHSHCASLSSFLVLFSNPLQNLLLTLLLSATLPLNNVVSRRTAMSYDYLFKYIIIGDTGVGKSCLLLQFTDKRFQPVHDLTIGVEFGARMVSIDSRPIKLQIWDTLTEVGRVCKDITHISQGHEFEFRHRCEEFDGG

SEQ ID NO: 160196 - protein, 322 aa, Glycine max
  Coding DNA Sequence Number=SeqID_43418
  Gene Ontology: Mol. function=general RNA polymerase II transcription factor activity; Cellular component=transcription factor complex; Biological process=transcription from RNA polymerase II promoter
  Homolog annotation: Hit_ID=Q8H2U2; Match level="QueryCoverage=47%, HitCoverage=59%, E-value=1e-47, Identity=59%"; Hit description=TBP -binding protein-like
  Pfam annotation: Domain name=RRM_1; Domain location=167-250; Score =5.1; E_value=0.049; Accession=PF00076.12; Description=RNA recognition motif. (a.k.a. RRM, R
MEEEDARMQRRRSTDTKKKTYEARTRSRKPKRKWKIKTAQGEGHFSPFIRVVGVPAKTLGAHSNSQNLKTKPVNKAQKPRTMIVAATIEAVSLFSSLYPYSSTFVRSSVSNRPSISLMNASDSEKEDTEIEVIAITPNEENSKLMKKEKKKKKKVSLKDAEKKGGVCYMSRIPPHMDHVKLRHILSQFGDIQRIFLAPQDSSVQVPAKRSRGSRDQAYSEGWVEFGNKSVAKRVANMLNGEQIGGKKRSSFYYDLWNIKYLSKFKWDDLTEELALKKAIREQKLAVELSAAKRERDFYLSKVDQSRALSAIEERLKKSCSEW

SEQ ID NO: 160197 - protein, 172 aa, Glycine max
  Coding DNA Sequence Number=SeqID_43419
MQLKNDDDDVNTMLMCNDQYSCVGPIELLYTIGRTPDGILSLLQVTMTLTHDVLLYYNGRWNMSRQHEFVGYSFIGKHPKRFDIPSRCTIDGLKDVINQVAPQGIPPYDIHESQTVTRLFFEQSGHSEYLDKVIKFEIIELKADDDVLKVLVQYNYWKQFGPIEILAVFSNQ

SEQ ID NO: 160198 - protein, 105 aa, Glycine max
  Coding DNA Sequence Number=SeqID_43420
MASRLIPRFDRSEAYGRITTMQPGGLSRRQYSRNTNQKLCLQDSETEENIEAEMKFEKKFKNQRSGRLIELNQNRGKNIFIRVKCYRTMVTHTDEFEVSSPSYYL

SEQ ID NO: 160199 - protein, 69 aa, Glycine max
  Coding DNA Sequence Number=SeqID_43421
MKTGKYERLKVKNNNQFGEKTNLGGVDDIWGAAVVVRFGLITMLQSVRTPEGLHFSSHKPIHLEDKVKL

SEQ ID NO: 160200 - protein, 288 aa, Glycine max
  Coding DNA Sequence Number=SeqID_43422
  Gene Ontology: Mol. function=transition metal ion binding; Cellular component=chromatin; Biological process=chromatin assembly or disassembly
  Pfam annotation: Domain name=Transposase_21; Domain location=1-81; Score=-137.6; E_value=0.0073; Accession=PF02992.5; Description =Transposase family tnp2
YGNLSGYTVKSHHACPIYEEDTSYVQVKHGRKTIYTRHRRFRKPYHLYWRLKKAFNGSQEHENASILLTGQQILERVEDMNTIFGKTQKKLTSKTCIWKKRSILFDLAYWFDLDVTHCIDVTHMEKNVCDSVIDTLLNIQDKTNDGLNTCQDLAEMDIHEQLHPMSHGLGWNRVRTTRPNLHLGIRVETIQDDLNPKTTRDLGNHHGGWCAFPQRHWPVMLDRHRGGGDVTTTEWMYPVERYMKILKGYKKNLHRPEASIVERYIVEEVIEFCSEYIEKAKPIGLPES

SEQ ID NO: 160201 - protein, 164 aa, Glycine max
  Coding DNA Sequence Number=SeqID_43423
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=98%, HitCoverage=51%, E-value=3e-70, Identity=70%"; Hit description =Glycerol-3-phosphate dehydrogenase [NAD+]
  Pfam annotation: Domain name=NAD_Gly3P_dh_N; Domain location=2-115; Score=83.3; E_value=7.7e-22; Accession=PF01210.13; Description=NAD -dependent glycerol-3-phosphate deh
MNPDEVRMWVYEETLRSGEQLTDVINRTNENVKYLPGIKLGKNVVADPDLESAVKDSNMLVFVTPHQFMEGICKRLVGKIREDSEAISLVKGMEIAVEKFSEATVGYRLNREVAERWVQLFYTHYFIVTAVQDVEGVELCGTLKNVVAIAAGFVDGLEMGNNTK

SEQ ID NO: 160202 - protein, 89 aa, Glycine max
  Coding DNA Sequence Number=SeqID_43424
  Homolog annotation: Hit_ID=Q9SCX9; Match level="QueryCoverage=97%, HitCoverage=19%, E-value=2e-08, Identity=44%"; Hit description =Dihydroxyacetone 3-phosphate reductase
MEGAKPEGVGGNELSSNTAPVATSNNSDFGSVCGIIDNTVQEVVRCHSSFSLLWKNNLFGFQGWSHEETTEREVSNAMQSNNLSSEKEE

SEQ ID NO: 160203 - protein, 87 aa, Glycine max
  Coding DNA Sequence Number=SeqID_43425
MARTKKFGEMTFEALREIADRIPDTVLDVVPDAISPRDSYCLLRLRSVLLLLVSAQREVVLIPRDKKGAEGPAKLVDMLELDDNLLY

SEQ ID NO: 160204 - protein, 94 aa, Glycine max
  Coding DNA Sequence Number=SeqID_43426
MADGGVFRKFRKDLFRKVSGRSVLPEVTKRLPEEHFFRKTPGKGSSGNFPEEVVHPEEFRKTPSSGRTFKFPEDLFGRITSSGMFPEEPLLPEV

SEQ ID NO: 160205 - protein, 128 aa, Glycine max
  Coding DNA Sequence Number=SeqID_43427
MRGEPNSAMILNTKRCREEDRVTKKDATKYLGTVASCHSGYSAKGDIVAKMKLRRKRRELEKNRTHDMTKSKGKDPLEGLGGPMTRARARKAKEALQQVLSILFEYKPKFQGEKSKVVSCIMAQMEED

SEQ ID NO: 160206 - protein, 200 aa, Glycine max
  Coding DNA Sequence Number=SeqID_43428
GAEDDISLCVLSSFSSYRQQKVYTDNHSGISARQRDSKVSMTDLVSAEDDGAEDDISLCVLSGFSSYRQQKVYTDNHLGISARQRDSKVSMTDLVSAEDDVAEDEVSLYVLSGFSSYRQQKVYTDNHSGISARQRDSKVSMTDLVSAEDDGAEEDISLCVLSGFSSYRQQKVYTDNHSGISARQRDSKVSMTDLVSAEDD

SEQ ID NO: 160207 - protein, 428 aa, Glycine max
  Coding DNA Sequence Number=SeqID_43429
  Subcellular localization annotation: CTP_CleavageSite=68; ConfidenceScore=5.53e-01
MPTLPPFISPISPTKLMKSCYGGTSKSGVTYMKYTSLKGSTRMAGDTGSCGSRESRMQKDWRFDRPVRNTELQKKNPIGRKYTDEASKPCGVTIGALRRSYVDVVTKGGCQGDKRTDEAQTPTILINPDEGGEYWCNETWVGMLKKVMEVETLEDRITWELGYNVRTKFLGDDMVLLPGMSDDKAKLLIQSETESDDSLFYSLEKWTPKCRPNNRVVWLQLWGFSIQVWEMKNLRRAVAAIGDVIESDDDTEDRRRLDRARVLVRTPLPPLIRSEVIVRVGELEYRVWIVEETGFEGGSNRKGSSSSDGWSEMITSDDGGEVGDVLDDTNTNFSFSSELPNQKLSPSRTQRAEGGTDVRCCDLRPLGNIQADVTPKEKSKGTVEGMLGSSFGKLNLADNFAGTEEEAANTKEVTCYIPYRMIKGTGIT

SEQ ID NO: 160208 - protein, 295 aa, Glycine max
  Coding DNA Sequence Number=SeqID_43430
  Gene Ontology: Mol. function=nucleic acid binding; Cellular component= intracellular; Biological process=DNA integration
MMAIPSDYVVYLQESYYNIGAKNDPETFSHAISSKELNLWDNAMKDEMDSMACNKVWDIIELHDAIKSIRCRWVFKTKKNSQGKIERHKARLVAKGFTQREGIDLKDVFSPMHKKDSIQVIMALIAQFDFELHQMDVKTKFLNGDLEEEVYMKQPEGFFSNNGEHLVCKLNKYIYGLKQASYQWYLKFHEVISSFGYEENVMNNCIYQKGMLYEVKQFLSKNFDMKDMGNPSGDHWRATKKVVRYLQGTKDYSLMYNRTDDFVVIGYFESDYASCIDTKISTSGYVFLLVSGVVS

SEQ ID NO: 160209 - protein, 211 aa, Glycine max
  Coding DNA Sequence Number=SeqID_43431
MDMNLGYLISHQISLIAQHDTSRLGFPALITALCKARGVQSDSRSLENLSPTINLAYIKKNCWNLDDPTVAFRGPRKARGKRSKAPTTLAPETPAPSSSTTPLPLTQTPVAWPGAQSSPSGGGGASAAQEPAFEEPAVAAAEGEDELTPSEPFYFDVDAHMAQEEGTSTDQIPEPSSAPPPEETQPSTPVTEPKQPIQDSLVAPALDLNED

SEQ ID NO: 160210 - protein, 95 aa, Glycine max
  Coding DNA Sequence Number=SeqID_43432
MPFKGLKSARKRAVFSGKRDELAKRACCTKRVHQYSFRALCQAFLSQAHLVAASAELSELHSLSSQHLVKFLLILVPLSANFKELSANPCGTCSA

SEQ ID NO: 160211 - protein, 674 aa, Glycine max
  Coding DNA Sequence Number=SeqID_43433
  Homolog annotation: Hit_ID=Q6D1B7; Match level="QueryCoverage=48%, HitCoverage=87%, E-value=4e-84, Identity=52%"; Hit description =Putative cell wall degradation lipoprotein
  Pfam annotation: Domain name=LysM; Domain location=444-487; Score =52.4; E_value=1.5e-12; Accession=PF01476.10; Description=LysM domain
  Pfam annotation: Domain name=Methyltransf_11; Domain location=198 -288; Score=-1.7; E_value=0.08; Accession=PF08241.2; Description =Methyltransferase domain
  Pfam annotation: Domain name=PCMT; Domain location=122-325; Score =333.6; E_value=3.4e-97; Accession=PF01135.9; Description=Protein-L -isoaspartate(D-aspartate) O-methyltransferase (PCMT)
  Pfam annotation: Domain name=Peptidase_M23; Domain location=595-674; Score=112.6; E_value=1.2e-30; Accession=PF01551.12; Description =Peptidase family M23
  Pfam module annotation: Pfam domain module=LysM::Methyltransf _11::PCMT::Peptidase_M23; Domain location=444-487::198-288::122 -325::595-674
MLTGSGYRHISYLFFNSWKYTTLPGGIVNGITGASNQVADGIAFDEGYAVTRKDDDWRWAEGWLPHSAWRKTGAAVGGPVNEKGQNQMRIRLSNDDGIQTPGIGVFPGVKTLRQVDPGAGVARKRAGDGLYQAEGIHDEHLLKAIADVPRERFIDEAFEHKAWENVALPIGNGQTISQPYMVARMTALLELNPTSRVLEIGTGSGYQTAILAHLVNHVYSVERIKGLQWQAKRRLKQLDLHNISTRHGDGWQGWAARGPFDAIIVTAAPPEIPTALIAQLGEGGKMVLPVGEDQQVLKRLRRQGGEIIEETIEPVRFVPLTVNHAVNVDTQFYPGLPSRGINEHGKHSCSSGDNTQAPISQIGSNSGDSGMAAAPTTGGGMIAAQNSTVPAMPRGGMLSGGTPSAASAGGMVSGNNNVTTENGRIVYNRNYGNIPKGSYGGETYTVKRGDTLFYIAWITGNDFRDLAQRNNIAAPYSLSAGQTLQVGNGNGQTITGGNAITAADATQGGVPVASNQTQIKSTPVAQQPVITYSDDSGSTGGKMLPSKGANNVATTTAPVTAPPTVSSTTNSTTPVGSWRWPTDGKIIDNFSAAEGGNKGIDIAGSRGQPVVATASGRVVYAGNALRGYGNLIIIKHNDDYLSAYAHNDTMLVREQQEVKAGQKIATMGSTGTSS

SEQ ID NO: 160212 - protein, 105 aa, Glycine max
  Coding DNA Sequence Number=SeqID_43434
  Gene Ontology: Mol. function=transcription factor activity; Cellular component=intracellular; Biological process=regulation of transcription, DNA-dependent
  Homolog annotation: Hit_ID=Q92FS3; Match level="QueryCoverage=71%, HitCoverage=21%, E-value=9e-14, Identity=44%"; Hit description =Transcriptional regulator LacI family
AVDTLWQQAERPQALVAINDRVAMGAIRALRDRGIDVPEQVAVISCERFPGSEYFIPRLTSVDHQNPLLGQNIISMMMAQLDGSLSPHARCSAPLKPVLIPGESA

SEQ ID NO: 160213 - protein, 160 aa, Glycine max
  Coding DNA Sequence Number=SeqID_43435
  Gene Ontology: Mol. function=sugar binding; Cellular component =cytoplasm; Biological process=carbohydrate metabolic process
  Homolog annotation: Hit_ID=Q833J7; Match level="QueryCoverage=96%, HitCoverage=43%, E-value=4e-30, Identity=44%"; Hit description =Phosphosugar-binding protein
  Pfam annotation: Domain name=SIS; Domain location=25-152; Score=48.5; E_value=2.3e-11; Accession=PF01380.12; Description=SIS domain
MMTYIHQQPEVLSHLLACYPQGLPVLGKAKTVLILATGSSINAALSAKYYVEQLTGVRISVQEPFHFQHYEQWDPATDLVIAISQSGESTSTLAAIDALKKQHGVATWGITSKITSPLAQAVDHAVDIMNGEERVGYVTKGYVATILTLMLIGVHSARHS

SEQ ID NO: 160214 - protein, 163 aa, Glycine max
  Coding DNA Sequence Number=SeqID_43436
  Subcellular localization annotation: CTP_CleavageSite=92; ConfidenceScore=5.54e-01
MPISPCGSISWSVPSRHRDRTHKTPSGPRKVQQGPGVSSSGYGPLSVLQGARTPPPGKGSRLQDTQWTRRSSTGSWSCQALITGLCQFYGVLATSSKGIRPPTNRAFIKKYCVSRQAQGETPQQPGDGRQRATDAPPSPLEFTSAHPQKGLSIAYTTWPAVIP

SEQ ID NO: 160215 - protein, 90 aa, Glycine max
  Coding DNA Sequence Number=SeqID_43437
MPQHNASHNHYMQVKGVSLGFSSLVIDYTALVIDYQRPNSNHTASGHENLKKALLVIDYQRPPQSAAFISKPGNRLHPLGNRLPEALIAS

SEQ ID NO: 160216 - protein, 100 aa, Glycine max
  Coding DNA Sequence Number=SeqID_43438
MANNIISTRDSGELTLAISSIKTRVDHLPDRLLSSFGANIERNPKEECKAVMTRSKMVNMNKGEKRIGEEKQQLVTKPKIDPVLEPLSETKEEVEVKDDQ

SEQ ID NO: 160217 - protein, 133 aa, Glycine max
  Coding DNA Sequence Number=SeqID_43439
  Gene Ontology: Mol. function=mRNA (guanine-N7-)-methyltransferase activity; Cellular component=nucleus; Biological process=mRNA processing
  Homolog annotation: Hit_ID=Q6K833; Match level="QueryCoverage=57%, HitCoverage=15%, E-value=3e-09, Identity=69%"; Hit description=mRNA cap guanine-N7 methyltransferase 2 (EC 2.1.1.56) (mRNA (guanine- N(7)-)-methyltransferase 2)
MRTKTTKLMDGATGGTAAILGGRHHRLELLEVDAAISVGRMSQSTQQCLYDFAKMALINIFAHPYAMVCRSFFPFNSLIPFPILILTLIHSRCAACTVEMSTLINGSTLKLATTLELVLPSSSSSSSSTFHSH

SEQ ID NO: 160218 - protein, 254 aa, Glycine max
  Coding DNA Sequence Number=SeqID_43440
  Homolog annotation: Hit_ID=Q1SKD7; Match level="QueryCoverage=81%, HitCoverage=56%, E-value=3e-15, Identity=25%"; Hit description =Ankyrin
MALRKLASKRSRKDKAAEGTSSAPEYDSHRFRSIEHQQRFEAIKGWSFLRERRVQLRDDEYTDFQEEIVCRRWASLVTPHGQVRSRHSPRILCQCLAYRGGRARYEVLDAIGQLLGYPLVLEEGQECEYGQRRNRSDGFDEEAIAQLLCIPGQDFARTAAGRRVRIMRTNMTTLTQIWMTLLLSNIQPSDHNSDLLLPKCQLVYAILTRMSIHVAQLIADAIYIFAGMAPTRHPLDPDKSNRALGFPTLITGLC

SEQ ID NO: 160219 - protein, 203 aa, Glycine max
  Coding DNA Sequence Number=SeqID_43441
VVASTATEVDPTHPFGSINKNSFPPYGLPPNYIPPNVAHVPEEKVDILAPIPIESQQPQSVGGVPLPNTLGGAQFHPQPQPLHFAVGRVPPIMVERGKFEHIKERLRAIKGGGDYAFADMAELCLVPDVVIPLKYKGTTCPKNHLKISSSTPNDGEGDDSNDSGHVTGVLLCIDGGIEVGLRRGKFDYPTSMNRKPRANGENK

SEQ ID NO: 160220 - protein, 70 aa, Glycine max
  Coding DNA Sequence Number=SeqID_43442
MENCRTTLRNNFAGLQTRWSRMHEQRQAMTFKGLRKKVENGELANSALGNDIHGAPKKAENGELANSATQ

SEQ ID NO: 160221 - protein, 146 aa, Glycine max
  Coding DNA Sequence Number=SeqID_43443
MKADMEAMKEQMTTMMEAMMNMRKMMEDNTAIVVDASTSIEMDLIHPTGFNQVNHPVSDVVGQGDEVTKNAYGPHHVQVQSKHSFPPYRLPPNYTSPTVFPKTDHTLAGFGVYPGYTTEGQAFSGIPVLNAPGISQYRPYHNPCIL

SEQ ID NO: 160222 - protein, 107 aa, Glycine max
  Coding DNA Sequence Number=SeqID_43444
MLESFQQQDQMSVLELHIEKDVAGGFMFRSANSLTSCENNLSKNEAQPPRNVSNLHDDEDDDDDDYLVSNSYVEESLEEDDSIDGISDTDDEVTDMIQPVRIVHPTQ

SEQ ID NO: 160223 - protein, 84 aa, Glycine max
  Coding DNA Sequence Number=SeqID_43445
MRTFDLPLCSLEAHARCPSLPQCKALRYQLLSFVMTLYLGTYWVKTSNLPLGSLEVRLRFMHGAFHCPSVGLRGTNCCLVFITS

SEQ ID NO: 160224 - protein, 177 aa, Glycine max
  Coding DNA Sequence Number=SeqID_43446
MVGQGGKEFGSTGNPHFVQVQNEHSFPPYGLPPNYAPPNAIHVFEENVDHSSPIPLESQQPQSGHAHVTQPMGEMHEYCPQPQPFHFAVGRVPPAIVEREKLDHIEEMLRVIEGGGNYAFADMAKLFLVPDVIIPPNFKVSDFDKYKGTTCPKNHLKMYNRKMGAYSKNEKLLMHFF

SEQ ID NO: 160225 - protein, 51 aa, Glycine max
  Coding DNA Sequence Number=SeqID_43447
IEEVKEHHIDEEALIPHNVAPCRACRPWIFFINGILCFSKINGSGIKKEER

SEQ ID NO: 160226 - protein, 50 aa, Glycine max
  Coding DNA Sequence Number=SeqID_43448
MEGYSADKDSVDDTVYEKYGINKEKWAQFCQSLRDPSWEDVRKKAQAIQK

SEQ ID NO: 160227 - protein, 119 aa, Glycine max
  Coding DNA Sequence Number=SeqID_43449
MASRKWARADDIPPSSIPTPPLATIGPNLQSSQTLVPMLQSLFRGQIIIMHSLRELAHHRPIITIEHFLERVARPGGQPPLEGPKEAAPPKPTPARVELVPGDPQSPVVNPPSSPHVIP

SEQ ID NO: 160228 - protein, 128 aa, Glycine max
  Coding DNA Sequence Number=SeqID_43450
MELAWDGAKFGLPNVSNGFFITHADVTENNFRFMNDWSTSIGFSPVYSFLEPQSIRCTKDTREECQKAHWQLLVLCSRENIIVWFCSVRRKPDVHIKFAVNNAMKKICSNLQGKDNAPPPPPQWIEAK

SEQ ID NO: 160229 - protein, 187 aa, Glycine max
  Coding DNA Sequence Number=SeqID_43451
  Gene Ontology: Mol. function=transition metal ion binding; Cellular component=nucleus; Biological process=cytoskeleton organization and biogenesis
  Pfam annotation: Domain name=Transposase_21; Domain location=129-187; Score=-134.7; E_value=0.0041; Accession=PF02992.5; Description =Transposase family tnp2
MQRGSQIEPVDLEIGDRLDDMIRDLGQESFQQAHALMYDTLKSDSKKPLYPGCKKSLTLLSTVLSLVNVKENTLRKCYYEAKKILCPMGMEYQKIYTCPNDCILYRLEYEEMHKCPRFKRLFANVDAAKDLTCHADGKNFDGMLRHLADSSQWKNINRLYPDFDKKARNLQHGLATNGMNPYGSFST

SEQ ID NO: 160230 - protein, 202 aa, Glycine max
  Coding DNA Sequence Number=SeqID_43452
  Gene Ontology: Mol. function=DNA binding
  Homolog annotation: Hit_ID=Q1SFS3; Match level="QueryCoverage=88%, HitCoverage=41%, E-value=4e-17, Identity=28%"; Hit description =Lambda repressor-like, DNA-binding
FQLVPTIEEFEEILGCPLGERKPYLSSGCLPSLSRIATVVMDSARGLDRIKQTRNGIAGLPQKYLEDKARGMANQGNWVPFMDVLALLIFGVVLFPNVDGLVDLAAIDAFLAYHHSKESPVVAVLADLFDTFDRRIDWDQLLAGIGGRTISWFPRWKEGKEGVLFSCGRYPNIPLVGTRGILGAPKFPRLYKESHKAWENPR

SEQ ID NO: 160231 - protein, 1845 aa, Glycine max
  Coding DNA Sequence Number=SeqID_43453
  Gene Ontology: Mol. function=nucleic acid binding; Cellular component= nuclear pore; Biological process=DNA integration
  Homolog annotation: Hit_ID=Q1SRN1; Match level="QueryCoverage=78%, HitCoverage=98%, E-value=0.0, Identity=51%"; Hit description =Integrase, catalytic region
  Pfam annotation: Domain name=Tyrosinase; Domain location=1390-1706; Score=106.7; E_value=6.6e-29; Accession=PF00264.10; Description =Common central domain of tyrosinase
  Pfam annotation: Domain name=rve; Domain location=616-777; Score =172.7; E_value=9.1e-49; Accession=PF00665.16; Description=Integrase core domain
  Pfam module annotation: Pfam domain module=RVT_2::Tyrosinase::rve; Domain location=1029-1285::1390-1706::616-777
MASPFRNDGAFPSSHLSHLISVKLDDKNFKQWKQQIDGVVRGHKLQRFVTVSVIPHRSPSTSDLNLSEVNDAYLDWEQQDALICTWLLSTISDSLLPKLVDCTHAWQVWTEVHRYFATLLTTKARQLRSELRRLSKGPLTIESFMERVREINESLISIGDPVPLRNLIEIVLDALPEEYDPIVATVNSKEDLSSLDELESYLLAHESRLEKHRKMILTEPVSVNLTQAQPSDSSSPMEPSSPATESFPTGTSHVTAHAENNNYNFRGGRSGRGGGRFGRGGGRFGKSQCQICHKSGHDASICYYRYSQSASMPFSPQRAPFNPFLMNARPVYAPSFGYASPRPAAPRPSPPQAFMASSDPTFSNQWWYPDSGASHHVTPDSSNVSDAHSVTGSEQVFMGNGQGLSINSIGSMNFTSPNFPHKPLTLHSLLLVPHITKNLISVSKFAQDNQDSSEVLLRGVVGADGLYKFQSPSSQVSKFKSLSSLNSSVALGSNNCNPSTSCNTLLHSNAQSDCITDCTPSVSMNTSNVSCVNSPLVHATTFTNSQSPQHSIVPNIIPTSKYALWHTRLGHPHYQALAEVLKTCNIPIPPKSLAEFCTACCLGKSHRLPTSLSTTVYAQPFELVVCDLWGPAPIQSLGGYTYFLTCIDAYSRFVWVFPLRLKSDTLTQFVQFKTMVELQFNCKIKVVQSDGGGEFRPFTKYLNNLGITHRFTCPHTHHQNGIVERKHRHIVETGLALLAHSNLPLKMWDHAFVTAAYLINRMPSMSLANQSPYFKLLHKVPDYSHLRVFGCACFPFLRPYNAHKLDFRSQECIFLGYSTIHKGYKCLAATGRIYISRDVLFNETRFPYSILFPSSSSATSTSSPHTSSAWSISAVPVSAIPLTQVSSVPTTPTTSVSLSSPMSAPINTNEVPTTPTANSPIITPSNDASPASENSSLHSPITPSSPTPITSDIAEANTISPSSIPATSSPLSPVPTPQQPSIHPHNTHSMQTRAKSGITKPKIHPTLLLTHMEPTSVGQALSSPHWFQAMKDEYHALLKNQTWTLVSPSVSRKPIGCKWVFRVKENPDGSINKYKAKLVAKGFHQQAGTDFIETFSPVVKPVTVRIVLTLAVTHKWPIQQIDVNNAFLNGTLEEEVFMLQPPGFEAADKTLVCKLNKAIYGLKQAPRAWFDKLKGSLLHHGFLASKCDPSLFLLHTASLTIMVLVYVDDIIITGNSASFITALIKNLNTDFSLKQLGKLDYFLGIEVTHLPNGSLLLSQTKYLTDLLAKINMLNANGMPTPMVSTSKLSKIGSPVVSDPTQFRSVVGALQYATLTRPEISFSVNKPASPHQPLSLLGFCDADWASDPDDRSAEAEYRSMAQLAAEILWVQSLLQELKCRLLTPTILCDNLSTVTLAHNPVLHNRTKHMELDIFFVRDKVLSKNLIVKHVPAQDQWADLLTKPLSAVKFLPLRDKLRVINKLSLLDASSGFPDDKLDVHGSWIFCPWHRWYLYFYEKILGKMIDDPTFALPFWNWDHPAGMRIPPIFTDKSSLLYDEHRNNDHVYALIDLNYDKDSDKDSVQPLQNTRWPPVEKKKSLILTNLNRVYRAVASEECSLPYTFLGPAFEVGCAPQKNYGTLESLHNTVHSWTGELEKPNHDMGLLATAARDPIFFAHQTSIGCGTYGRQNCWMEEDLITKVTTGWNPVSSSTTRTGTMGDLIKPKKESSLLRSKREASTFKKLQLPHTLESIERTTVKRPKPRSRNENEEEEEEGVKEVLVIDVEYDSTDGVRFDVFINDQGDNEIRPLDSEFAGSFVTLPHSPHLKDLGVTKDDDSISVTLAPIYGDKPVAIKGVRIKRVYPEVDDE

SEQ ID NO: 160232 - protein, 80 aa, Glycine max
  Coding DNA Sequence Number=SeqID_43454
MTVLLPPTIVVLTPTTNQGRYLLIANRWSQHRGFKSGACQRLCGTLHHHHQHSSSSSEQQHLPAWLLVQDGGSVKRSPTP

SEQ ID NO: 160233 - protein, 175 aa, Glycine max
  Coding DNA Sequence Number=SeqID_43455
  Subcellular localization annotation: CTP_CleavageSite=19; ConfidenceScore=5.04e-01
MAKLSSRSTHPMHNFHQVHACKNSSKIYTFGPTKEERKSPSPQYSTKDAVPKFVALKPSIEFDQNDAMLFNYKYMYEISNHMCIMQILRPAKIYRFNNWYSKDAMRKSIAIVWARFPTLKEHLLMQAPLELVGLRSSSSMDSFASWKINGNGMEKEEREETPLQGEDESRRSSPP

SEQ ID NO: 160234 - protein, 251 aa, Glycine max
  Coding DNA Sequence Number=SeqID_43456
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-44, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHVLPSRGLQVLTFRGLHVLAFRGLHALTFRGLHVLAFRGLYVLTFRGLHVLPFRGLHVLSFKGLHVLAFKGLHFLTFRGLHVLAFKGLHVLTFKGLHDLAFRGLQVLTFRGLHALTFRGLHVLAFRELHVLAFRGLHVLTFRGLHVLAFKGLHTLTFRGLHVLAFRGLHVLTFRGLHVLPFRGLHVLTFKGLHVLAFKGLHVLAFRGLHVLAFRGLYVLTFKGLHVLPFRGLHVLSFRGTT

SEQ ID NO: 160235 - protein, 63 aa, Glycine max
  Coding DNA Sequence Number=SeqID_43457
  Homolog annotation: Hit_ID=Q1PEB4; Match level="QueryCoverage=84%, HitCoverage=7%, E-value=2e-11, Identity=61%"; Hit description =Hydroxyproline-rich glycoprotein family protein
EKRNAAAKNDEPKKEGASMLWKAFQFVFRVYTFAGGIDDRADKLTRELAQEIESDPNPNLNQL

SEQ ID NO: 160236 - protein, 213 aa, Glycine max
  Coding DNA Sequence Number=SeqID_43458
  Gene Ontology: Mol. function=catechol oxidase activity; Biological process=metabolic process
  Homolog annotation: Hit_ID=Q7Y249; Match level="QueryCoverage=97%, HitCoverage=51%, E-value=1e-21, Identity=50%"; Hit description =Polyphenol oxidase
MNKSLANFLQCIGLLSQVGNSQGSSLEALIVLEMNLNLAGTFENVPHAPVHSWTGERESLTVRTWESSILLRETPFSILTTPTWIGCEAYGKQYRVEKEGISLTLIDVDIPWLKNKPKPKRSKAKKVALLAQDFNFGFKDNKVIRPSNTEFAGSFVSVSHSHVHKNKKIKTCFRVGLTDLLEDLEAENDDSILMTSVPKYGKGLVTIQGIILR

SEQ ID NO: 160237 - protein, 670 aa, Glycine max
  Coding DNA Sequence Number=SeqID_43459
  Homolog annotation: Hit_ID=Q1PEB4; Match level="QueryCoverage=86%, HitCoverage=83%, E-value=1e-46, Identity=41%"; Hit description =Hydroxyproline-rich glycoprotein family protein
  Pfam annotation: Domain name=Extensin_2; Domain location=171-523; Score=-115.7; E_value=0.0083; Accession=PF04554.4; Description =Extensin-like region
MATVGFCGLKPLLFRRKANIFEAMKGSTPKKSSSSKAKNKANGESLELSFVGADQLILMVEIHKKILAFRDIMDLAPCNSSASLREMVMKTLQDLQGLYPGIIPKNEVLKIKDKPIDQSMAYFCKALKSLGESWMMNNDWTNKLNIVLPTCKDNGNMRQLGETMLITLDCLMKLASERFDIELTEEDDHKKEFSPRSSSFGKYNIMRSTSFSDSSFSCCSSPVTPKSVLPDLMKYSARSGDSPRSSCASPLLLSLRVQAVGKLNPIDVKRLSFQMSPTQIHKIEEESPTTELDDNASNHGKDSSEELVFHLDTTEELESIINDHRTNKPQAIREVRLSLSPGQFQPKSPPKPPQTPLEQKEQELVSSPPITQQASPTPCIPQPPPPTTFPTIHVPTPPEMQPNVAPPPPPPPPPPPPSALKLEQNAAPIRMPPPPPPPPPPGSRSLGSATTAAAPPPPPPPIPLIGGSVPAPPPPVPGGVKRGAPPPPPPLGGGRSLCARATTKLKRSTQLGNLYRTLKGKVEGSSLTGKSSAAKKGGIGAASTGGKQGMADALAEMTKRSSYFQQIEEDVQKYTKQILELRSTITNFKTKEMTELSKFHRDVESVLENLTDESQVLSRFEGFPTKKLEALRMAAALYNKLDSILTELQNWKIVPPMGQQLEKIERYFSK

SEQ ID NO: 160238 - protein, 185 aa, Glycine max
  Coding DNA Sequence Number=SeqID_43460
  Gene Ontology: Mol. function=transmembrane receptor activity; Cellular component=membrane; Biological process=defense response
  Homolog annotation: Hit_ID=Q7XIJ6; Match level="QueryCoverage=71%, HitCoverage=69%, E-value=2e-37, Identity=54%"; Hit description=TIR/P- loop/LRR disease resistance protein-like protein
  Pfam annotation: Domain name=TIR; Domain location=19-158; Score=42.9; E_value=1.1e-09; Accession=PF01582.10; Description=TIR domain
MQRLPATLCRKIARPACDVFINHRGIDTKRNIAELLYDRLRRMKVRSFLDSMNMKPGDRLFDHIDKAILGCKVGVAVFSPRYCDSYFCLHELALLMESKKRVVPIFYDVKPSQLVVKDNGTCPSKELQRFSLALEEAKYTVGLTFDSLKGDWSELLRDASDAVIMNLLEVEEEHRRMKRKLNCEY

SEQ ID NO: 160239 - protein, 148 aa, Glycine max
  Coding DNA Sequence Number=SeqID_43461
  Gene Ontology: Mol. function=nucleoside-triphosphatase activity; Cellular component=integral to membrane; Biological process=transport
  Homolog annotation: Hit_ID=Q53PR3; Match level="QueryCoverage=41%, HitCoverage=10%, E-value=7e-14, Identity=48%"; Hit description=ABC transporter protein, putative
MTIYQPSSKLFYMFQKILLLSDGRSLYFGKGENVMNYFSSIGYAPSVATDPTDFLLDLANGFPWWQSGADQMHDRLVLPTLFVTITCWMGGLKVNASIFFQTLAVALLYALVSQGFGLAIGALLINNQKVAVVRKNREKHITEEKRTN

SEQ ID NO: 160240 - protein, 361 aa, Glycine max
  Coding DNA Sequence Number=SeqID_43462
  Gene Ontology: Mol. function=serine carboxypeptidase activity; Cellular component=cellulose and pectin-containing cell wall; Biological process=proteolysis
  Homolog annotation: Hit_ID=UPI000034F551; Match level="QueryCoverage =92%, HitCoverage=66%, E-value=1e-129, Identity=65%"; Hit description= SCPL31; catalytic/ serine carboxypeptidase
  Pfam annotation: Domain name=Peptidase_S10; Domain location=33-361; Score=363.7; E_value=2.9e-106; Accession=PF00450.12; Description =Serine carboxypeptidase
PALSFSSRHRQYWGGGRILSSGDHNGDLVTNLPGQPGVNFQHYAGYVTVNETNGRALFYWFYEAITKPEEKPLVLWLNGGPGCSSVGYGATQEIGPFLVDTDGQGLKFNNFSWNREANMLFLESPVGVGFSYSNTSSDYDQLGDELTDLALTNSVVLFLLFVTANDAYSFLHNWFQKFPSYRIRTFYIAGESYAGKYVPELAELIHDRNKDPSLYIDLKGILLGNPETSDAEDWMGLVDYAWSHAVISDETHQTIKTSCDFNSTDPWRNKDCSQAVDEVLKQYNEIDIYSLYTSVCFASTASSDDQSMQTSMKRSSKMMPRMLGGYDPCLDGYAKAFYNKPDVQKALHASDGHNLKKWSIC

SEQ ID NO: 160241 - protein, 1315 aa, Glycine max
  Coding DNA Sequence Number=SeqID_43463
  Gene Ontology: Mol. function=nucleic acid binding; Cellular component= nucleus; Biological process=RNA processing
  Homolog annotation: Hit_ID=Q5ZCG4; Match level="QueryCoverage=62%, HitCoverage=66%, E-value=0.0, Identity=55%"; Hit description =Putative ATPase
  Pfam annotation: Domain name=DEAD; Domain location=566-834; Score= -33.7; E_value=0.0039; Accession=PF00270.19; Description=DEADDEAH box helicase
  Pfam annotation: Domain name=Helicase_C; Domain location=1179-1257; Score=82.6; E_value=1.2e-21; Accession=PF00271.21; Description =Helicase conserved C-terminal domain
  Pfam annotation: Domain name=SNF2_N; Domain location=568-960; Score =173.4; E_value=5.6e-49; Accession=PF00176.13; Description=SNF2 family N-terminal domain
  Pfam annotation: Domain name=zf-C3HC4; Domain location=998-1038; Score=21.7; E_value=0.00089; Accession=PF00097.15; Description=Zinc finger, C3HC4 type (RING finger)
  Pfam module annotation: Pfam domain module=DEAD::Helicase_C::SNF2 _N::zf-C3HC4; Domain location=566-834::1179-1257::568-960::998-1038
MSARRLSFADWYNSMKDATASCDPCSQPQLQNSPEDSSSKNVSPSESGIHDTFQIQNGSQVLEEPYLSKLGFANSVTSCSPFCSDVSDFGVRGSVGVSDSAANSMLDCERENQGPQSRACSSPNAFPERTQVSKHEIPAYSVETSFPEAQSNNISICGDNLNLSMWIGENESQFKHVREDVESEHASLSSIVDNDDVNIEGYVEDIIAGVSGQQENDSCTSFEASFMDADRSLHVTTSTDSSVGQGSHVSSDFIDYHVSPNCYQGTHDGPFVADSSLGFVPNAINSQLWPYEEMMNNIKAENVELNADIAYMSNGMPSSTTGWMPFQDSQLMLADNGYPSFHSGNFDDMSSLSLSACASYMSYGDHYQNNFHRDDAEFNVGQEVKQTPGIFSSEGCQAYQCFQNEDNYAVISGISNQYQDSIGRTASFQGNFDNLNLKAADNSWLHPQELITSEKQFGCVKREGGIQHNFIDSHLSKGRTENFHVEEDPDVCIIEDISHPAPTSRPAGIGNSLNISQSCRYVGSTVGSTRMKACDERNILRVALQDLSQPKSEVSPPEGLLAVPLLRHQRIALSWMIQKETSSLNCSGGILADDQGLGKTVSTIALILKERPTLLNGCTTARKSELETLDVDDDMLPQNGIVKEESNMCEDKPSGYPMNLLKQAKGRPSAGTLIVCPTSVLRQWAEELRSKVNGQATLSVLVYHGSNRTKDPYEVAKHDVVLTTYSIVSMEVPKQPPADKDDEEKEIFEDHATPSRKRKSPSNSSKSGKKKLDGTNLEAVARPLAKVSWFRVVLDEAQSIKNHKTQVARACWGLRAKRRWCLSGTPIQNAIDDLYSYFRFLRYDPYSDHASFCTRIKNPISRNPANGYRKLQAVLKTIMLRRTKGTLLDGEPIISLPPKYIELKKVDFSMEERDFYSKLEADSRAQFQEYADAGTVKQNYVNILLMLLRLRQACDHPLLVKRYNSNSLWRSSVEMAKKLPQEKQISLLKCLEVSLALCSICNDPPEDAVVSVCGHVFCNQCICEHLSGDDNQCPAANCKSQLSTSMVFSKATLNSCLSDQGCDNSPSCSGPEAEEAEPWSESKPYDSSKIKAALEVLKSLCKPQCYTSKSTSEHSTFREDKNCLGNPSIAKNGKSLKDSPESQNLSDENRSSNASVTVVGEKAIVFSQWTRMLDLLEACLKNSSINYRRLDGTMSVVARDKAVKDFNNCPEVTVIIMSLKAASLGLNLVVACHVLMLDLWWNPTTEDQAIDRAHRIGQTRPVTVLRLTVRDTVEDRILALQQKKRMMVASAFGEDGTGDRQTRLTVDDLKYLFMM

SEQ ID NO: 160242 - protein, 213 aa, Glycine max
  Coding DNA Sequence Number=SeqID_43464
  Gene Ontology: Mol. function=hydrolase activity; Biological process =aromatic compound metabolic process
  Homolog annotation: Hit_ID=O04083; Match level="QueryCoverage=62%, HitCoverage=96%, E-value=3e-15, Identity=62%"; Hit description =Lysophospholipase isolog; 25331-24357
MPNERDQDVFFINVDSENRSSQMSLTGQKKLNPITQTGCLLTPSIQKPQPQFHNHKASIIFTEQWKKSKKSSSSTHTPTTGASLQKRTTTNNKESHPQPPSSPPHLASNSSQDPGSQTLVQLHPAPSSSCSTATPGPFALPRQTQVGDCGGAFEVLHGSRELYREARSEDKTIRVYEGMMHLLLFGETDENVEIVRNDILEWLLARCTQTRVE

SEQ ID NO: 160243 - protein, 88 aa, Glycine max
  Coding DNA Sequence Number=SeqID_43465
WYLEICCGVRRPWGRQGDKALVIDYQLGVIDYTMLPATERKSLEKDILTMRSRYGTHCIVTCVVRFLVKESTLFLLSLVDHDGSAVDP

SEQ ID NO: 160244 - protein, 430 aa, Glycine max
  Coding DNA Sequence Number=SeqID_43466
  Gene Ontology: Mol. function=binding; Cellular component=integral to membrane
  Homolog annotation: Hit_ID=UPI00005F9B8F; Match level="QueryCoverage =91%, HitCoverage=47%, E-value=8e-81, Identity=44%"; Hit description =COG3210: Large exoproteins involved in heme utilization or adhesion
VDSRGSHLTGALVNGNSVTADICRNLSITSLQDSDNYDSKQISVGAGGSFTFGSMTGSGYINASQDKMHSNYDSVLEQSGIYAGQGGFDINVGSHTQLNGAVIASQADADKNRLDTGTLGFTDLHNQADYKTQHQGIGLSSAGNFSGQFKGNMAASMLAGAGSSGHAEGTTQSAVAQGSIVVRDQANQQQDVAALSRDTEHANDSISPIFDKEKEQKRLQTAQLIGEIGSQVADIARTQGQIEATEAGKKELAKNNINQPDADAPAAKKKAYQEALENSSDYKKAMALWGTGSDIQKGIQAATAAIQGLAGGNLAQAASGAAAPYLAEQIHKYTADNQAAKAMAHAVVGAVTSWAAGNSAAAGATGAVSGELMGQLIMHSMYPGKQVSDLQESDKQIISALSTLAAGLAGGVTGGSSASALAGAQAGKNA

SEQ ID NO: 160245 - protein, 64 aa, Glycine max
  Coding DNA Sequence Number=SeqID_43467
  Homolog annotation: Hit_ID=Q6K832; Match level="QueryCoverage=55%, HitCoverage=5%, E-value=5e-08, Identity=75%"; Hit description=Lipase class 3 protein-like
MKLKFTKDWIAYLRLPLPIDVYKEILKPAFTIIADHEMKCLLLLIRGTHSTKDTLTAVTGNLLQ

SEQ ID NO: 160246 - protein, 101 aa, Glycine max
  Coding DNA Sequence Number=SeqID_43468
  Gene Ontology: Mol. function=DNA binding; Biological process=DNA integration
  Homolog annotation: Hit_ID=Q1S1X7; Match level="QueryCoverage=94%, HitCoverage=7%, E-value=1e-20, Identity=51%"; Hit description =Integrase, catalytic region; Zinc finger, CCHC-type; Peptidase aspartic, catalytic
MIEKVSLWAKAITKVVWYRRFDEFIVSHGYIRSPYDSCFYHRKVENGSHIYPLLYMDNMLIDSQIVLAIQKLKLLLSSEFEMKDVGAIEEILGMEIKRDWV

SEQ ID NO: 160247 - protein, 249 aa, Glycine max
  Coding DNA Sequence Number=SeqID_43469
  Gene Ontology: Mol. function=excinuclease ABC activity; Cellular component=excinuclease ABC complex; Biological process=nucleotide -excision repair
  Homolog annotation: Hit_ID=Q1GYJ6; Match level="QueryCoverage=99%, HitCoverage=99%, E-value=1e-116, Identity=61%"; Hit description =Excinuclease ABC, A subunit
MYVLDEPSIGLHQRDNDRLLETLKRLRDLGNSVIVVEHDQDAILLADFIVDIGPGAGEHGGQIVSYGTAAEIQADPNSLTGQYISGKKQIQFKLPRTQPDPARMIKLNGTTGNNLKNVSIEIPVGLLTCVTGVSGSGKSTLINDTLYRAVATHLYGSSTEAAPHESIEGLEFFDKVVDVDQSPIGRTPRSNPATYTGLFTPIRDLFASVPESRARGYGPGRYSFNVKGGRCEACQGDGVLRVEMHFLPD

SEQ ID NO: 160248 - protein, 598 aa, Glycine max
  Coding DNA Sequence Number=SeqID_43470
  Gene Ontology: Mol. function=mannosyl-oligosaccharide glucosidase activity; Cellular component=endoplasmic reticulum; Biological process=oligosaccharide metabolic process
  Homolog annotation: Hit_ID=Q940D4; Match level="QueryCoverage=94%, HitCoverage=67%, E-value=0.0, Identity=55%"; Hit description=Alpha -glucosidase I
  Pfam annotation: Domain name=Glyco_hydro_63; Domain location=50-598; Score=323.9; E_value=2.8e-94; Accession=PF03200.6; Description =Mannosyl oligosaccharide glucosidase
MTGNGRRTTRSGERLSSERLNRHRERSKYGSFIPMFNNGNFKVGFGIVLFLSHYYLANSAAEDRIPRVVTPFPAPKITDLPQFEGEHKESLYWGTYRPQVYLGIRARTPKSLIAGLMWIVVKDGRYHLRHVCKHEDNLSTYGWTKHNGRDFGHQVLVDHGMAITTGFLKSKVEGSGYGGDWAVRINVQIDKSKWNVEFGRGAQLFFYLADEAGNALNLSRKNLNVHTDSLVASGSREDIGDWQLHLKSMDDLELHYSGFHTPHFHNLSNLVEENLASQIRKHARLLLSDSSDDSPNVLVFQIIGGFSFTTDVIFISGTDSESSIVEKRASSLTGTSLSNQLKYKEQAFDEKFEKIFNLAEKVDSESISVGKAAVGNLLGGIGYFYGQSKIAVSRIYNLSEHVDYISYWPAELYTAVPCRPSFPRGFLWDEGFHQLIIWRWDIHISLDIIGHWLDLMNADGWIPREQILGAEALRFFCTCSRVPEEYVPQHPTNGNPPTLFLALNGIINGLKNNEFTATDKTEISLFLERAFVRLEAWFQWFNTTQSGKQMSSYYWHGRNNRTIYELSPKIGQQINLTKTTIGMLQKEANGKATTNEIY

SEQ ID NO: 160249 - protein, 86 aa, Glycine max
  Coding DNA Sequence Number=SeqID_43471
MAALRGVALPTQGVGTLPRRAINERQGQRKTRRVVNDIHGFFTKKNKEYQEKLPLVVLKVVEIIYSKANSEAEYMFQYHLTNILIC

SEQ ID NO: 160250 - protein, 780 aa, Glycine max
  Coding DNA Sequence Number=SeqID_43472
  Gene Ontology: Mol. function=peptidase activity; Cellular component =integral to membrane; Biological process=proteolysis
  Homolog annotation: Hit_ID=UPI000019713B; Match level="QueryCoverage =99%, HitCoverage=84%, E-value=0.0, Identity=57%"; Hit description =peptidase
  Pfam annotation: Domain name=Peptidase_M20; Domain location=16-194; Score=9.3; E_value=0.00042; Accession=PF01546.18; Description =Peptidase family M20M25M40
  Pfam annotation: Domain name=Peptidase_M28; Domain location=13-182; Score=212.6; E_value=9.1e-61; Accession=PF04389.7; Description =Peptidase family M28
  Pfam module annotation: Pfam domain module=Peptidase_M20::Peptidase _M28; Domain location=16-194::13-182
MRISSVDSKETDPSVLVNGHFDSPLGSPGAGDCGSCVASMLEIARLVVDSGWAPYRPVIFLFNGAEELFMLGSHGFMKMHKWHDTIGAFINVEASGTGGPDLVCQSGPSSWPSNVYAEAAIYPMANSAAQDVFPVIPGDTDYRIFSQDYGNIPGLDIIFLLGGYFYHTSSDTVERLLPGSIQARGENLFSIIKTFTNSAKLQNTYKTNSSEITASTFNDERAVFFDYFSWFMIFYPRWVAKILHSIPVFFFLVMPFTHGRTHSWSAALCDFIKGFLFHAVGIIFAVVVPVAFSMLRLLFSSQTMNWFAHPYLAFAMFIPCALVGLLIPRIIWRHFPLSQDISIVKISKEALSDEARFWGAFGFYAVLTLAYLVAGLSGGFVTFFVCASLLPAWISFCLSVKYFGQRSLRSTMFYILPLVPCLAYSVYFGGILAQFLIEKMGMMGSLPLPYGHYVPDVIVAALIGIVTGWCTGPLMPICGHWLARSSILQFLLHLSVFALALSSQFFPYTMSAPKRIVFQHTFHTAGSSQIIESTYDFSVTDSNSLLFLFKHSPSVAKELNITSEFSFESTSLSKRNDWMAIFPVSFLFSNSLKFPAKRDDILKQYEFFPKLSVQNPSLNPEKGPRRVHLELYLGSLEEVWVAVLNITGPLSSWSFADNLLPVVIGGLMRPPVIGSLLDHLQMFNLINFTLLMSNPWHEEACICTGTETYGGGPQSYICRLSGPSDGNWTFWLEANSSEALRVDLAVLDQKLVDPVKRLKNLFPDWVDVVAYSSFMSSYIF

SEQ ID NO: 160251 - protein, 217 aa, Glycine max
  Coding DNA Sequence Number=SeqID_43473
MADAKLSPAGVDCLEVALAKLTLSQLNLATAVDTLATTIDDLLQRLSLRNPTPHFSSSVPAQELIPVTIISTPFMSTLRLMPSLPPMPTPLPMPPPPPMPTPSPMSTLPSMPPLSSMPPPIPRPTTPPCPAPVQPFLPPLSGPLPMPVLHLPNLDLIRTAISFNKLIGIVPLYDHVVVPNDKPWKNKDMALFEMGHVSYGTAMAAQPFAFALCTTAK

SEQ ID NO: 160252 - protein, 104 aa, Glycine max
  Coding DNA Sequence Number=SeqID_43474
MAMMDVRDGTIVVQGSHTHEASDVEVVPWWCCVHLVLWSLGSNLGQRWCISYGFGGGMVMEMSADLGKVGACNNARSGWRWRCAGVLEDRGGWLDENFEGKRRV

SEQ ID NO: 160253 - protein, 226 aa, Glycine max
  Coding DNA Sequence Number=SeqID_43475
MDLVGDLSGWWEESGGLKNERVFLKQGSNDRYLVGEGRWCRRRLWGCNGSMIESRSGLSLNETFNLLGETSSGREGTPAPEENIHTTDGKNMLVESERLLEPLKAEENIHTTDGKNMLVESEREFSHAGLNEVIGTASVDQYCDARLIDVTIYAEGFRCRSAGECVEANLSMIGVRGGNVFKAHLLRLGFGGCSHVGEMEEEGRGGDNNGGGVGVGGGGFTLAWKF

SEQ ID NO: 160254 - protein, 360 aa, Glycine max
  Coding DNA Sequence Number=SeqID_43476
  Gene Ontology: Mol. function=mannosyl-oligosaccharide glucosidase activity; Cellular component=endoplasmic reticulum; Biological process=oligosaccharide metabolic process
  Homolog annotation: Hit_ID=Q940D4; Match level="QueryCoverage=98%, HitCoverage=37%, E-value=1e-129, Identity=62%"; Hit description =Alpha-glucosidase I
  Pfam annotation: Domain name=Glyco_hydro_63; Domain location=1-357; Score=-74.2; E_value=1.6e-17; Accession=PF03200.6; Description =Mannosyl oligosaccharide glucosidase
MDRSEISLFLERAFVRLEAWFHWFNTTQSGKQMGSYYWHGRDDRTMREVNPKDHITQLRCLCWSILTKLSLPLMMTLAPNRHYLWHFQTLSSGLDDYPRASHPSEDERHLDLRCWMLLAADCMHSIQELLDMESKPGMDYGSTVKLLLDFELLNQMHFDDAYGAYFDFGNHTEKVQLKWKELEDGQNYATRQLLRDVMDMPVLRLVPHIGYVSLFPFMGRIIPSGSRILEKQLELISNRSLLWTNYGLRSLAKTSSLYMKHNTEHDPPYWRGPVWINMNYRILSALHHYSKENGPYQEKAKAIYEELRSNLIRNIVRNYQQTGFLWEQYEQTKGKGKGAHPFTGWTSLVVLIMAEAYGNI

SEQ ID NO: 160255 - protein, 264 aa, Glycine max
  Coding DNA Sequence Number=SeqID_43477
  Subcellular localization annotation: CTP_CleavageSite=61; ConfidenceScore=5.06e-01
MRRGGLAGGVGCRGWSWASVRKKKKKSKGSVSIFLIALALFIRYEGFVILLLGLFTSCTSVCTLASGFVNMFSVVAFGSLSLPNSVNGCSIMCLRPKGWELGQYAPFNPAHGCVFEGRKVHGVATNVYWGKMSEKLKSVCGLRTLSVKDLGVVFTHGEGTLDIRPYFFPRLKLPSGAPAPCAPDPPLRVFMYDLPRRFNVGMIDRRSAAEMPVTVEDWPAWPVNWGLKKQHSVEYWMMGSLLNVGGGREVVRVSDPELAQAFFV

SEQ ID NO: 160256 - protein, 209 aa, Glycine max
  Coding DNA Sequence Number=SeqID_43478
  Gene Ontology: Mol. function=structural constituent of ribosome; Cellular component=ribonucleoprotein complex; Biological process =translation
  Homolog annotation: Hit_ID=Q947H2; Match level="QueryCoverage=85%, HitCoverage=86%, E-value=1e-73, Identity=78%"; Hit description =Ribosomal protein
  Pfam annotation: Domain name=Ribosomal_L22; Domain location=45-181; Score=262.3; E_value=9.6e-76; Accession=PF00237.9; Description =Ribosomal protein L22pL17e
MVKYSREPDNPTKCRIDTYSLNDDVYNLSQSEHFFNRLSYAACKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETKLATSKKSQALRSGTSS

SEQ ID NO: 160257 - protein, 135 aa, Glycine max
  Coding DNA Sequence Number=SeqID_43479
  Gene Ontology: Mol. function=signal peptidase activity; Cellular component=signal peptidase complex; Biological process=signal peptide processing
  Homolog annotation: Hit_ID=Q2QS62; Match level="QueryCoverage=60%, HitCoverage=53%, E-value=5e-29, Identity=69%"; Hit description =Microsomal signal peptidase 12 kDa subunit family protein
  Pfam annotation: Domain name=SPC12; Domain location=1-80; Score =142.5; E_value=1.2e-39; Accession=PF06645.4; Description=Microsomal signal peptidase 12 kDa subunit (
MDWQGQKLAEQLMQIMLLAFAVIAFVGGYVMASFQMMILIYAGGVVFTTLLTVPNWPLFNRHPLTWLDPSEVEKHPKPLPSANVTQKKKPVKKKEIVEIEKIGAQNAIKSVLRSEGVPDCDLSREKTPILICLDP

SEQ ID NO: 160258 - protein, 140 aa, Glycine max
  Coding DNA Sequence Number=SeqID_43480
  Gene Ontology: Mol. function=mannosyl-oligosaccharide glucosidase activity; Cellular component=endoplasmic reticulum; Biological process=oligosaccharide metabolic process
  Homolog annotation: Hit_ID=Q940D4; Match level="QueryCoverage=97%, HitCoverage=16%, E-value=9e-57, Identity=70%"; Hit description=Alpha- glucosidase I
VDSEALSVGKAAVGNLLGGIGYFYGQSKIALSRILNLREHVSYMSYWSAELYTAVPSRSFFPRGFLWDEGFHQLIIWRWDIHISLDIIGHWLDLMNVDGWIPREQILGAEALSRVPEEFVPQHPTNGNPPTLFLALNGIC

SEQ ID NO: 160259 - protein, 305 aa, Glycine max
  Coding DNA Sequence Number=SeqID_43481
  Gene Ontology: Mol. function=transferase activity; Cellular component= membrane
  Homolog annotation: Hit_ID=Q5BM99; Match level="QueryCoverage=81%, HitCoverage=48%, E-value=4e-64, Identity=45%"; Hit description =Secondary cell wall-related glycosyltransferase family 47
  Pfam annotation: Domain name=Exostosin; Domain location=18-273; Score= 221.4; E_value=2e-63; Accession=PF03016.6; Description=Exostosin family
YGGASYLMRREKYLQGSTLSESFPEGSGTASVPSCLEFVLRNIKAGVVQCVVVPVDLMELLKKSNYWQRSGGRDHVFPMTHPNAFRFLRDQLNESIQVVVDFGRYPRGMSNLNKDVVSPYVHVVDSFTDDEPQDPYESRSTLLFFRGRTYRKDEGIVRVKLAKILAGYDDVHYERSVATEENIKASSKGMRSSKFCLHPAGDTPSSCRLFDAIVSHCIPVIVSDQIELPFEDEIDYSQFSVFFSFKEALQPGYMIDQLRKFPKEKWTEMWRQLKSISHHYEFRYPPKREDAVDMLWRQVKHKLPG

SEQ ID NO: 160260 - protein, 39 aa, Glycine max
  Coding DNA Sequence Number=SeqID_43482
MSGDLAYKSILQSSALMKLGKVEINTHQIHIYLGHATPQ

SEQ ID NO: 160261 - protein, 70 aa, Glycine max
  Coding DNA Sequence Number=SeqID_43483
MTLRLLMVVVGLVKNRIRRGTIIKKRGSPGNYVGTMMVMVGLGDTEVQTWHTLTRRLGSMDSEFEEGKGE

SEQ ID NO: 160262 - protein, 305 aa, Glycine max
  Coding DNA Sequence Number=SeqID_43484
  Gene Ontology: Mol. function=RNA-directed DNA polymerase activity; Biological process=RNA-dependent DNA replication
  Homolog annotation: Hit_ID=Q1RVK7; Match level="QueryCoverage=85%, HitCoverage=59%, E-value=4e-16, Identity=30%"; Hit description=RNA -directed DNA polymerase
RLGDMDTQFSHAQTLVRRKRNEIHDLFFDDGTWHIDPNDLHHEATRYFHSIFSKDSSPSHSSFEVQNIPQLNEDENLALSAHVTIDEVRIAVMGIKSFKAPGLDDAFLYGTVDPGLLETLPVLIPKVENPNHLKEFLSLAFVMWPISGSNLAVLWNGSKLDNFSPARGRIILAPYFPFQRGTGPPLTHLFFANDVLLFCKATKDQARVVDSTLALFGAASDLKVKLQKSKMICSRGVNVDLRGRIENIMGYSCSNSLGKYLGQHLIEVDSFQDKPWVPVLRHKYIENICLVRALEYLRAGFTGKI

SEQ ID NO: 160263 - protein, 232 aa, Glycine max
  Coding DNA Sequence Number=SeqID_43485
MGSWCGRDLVVEETNLQEEADSGDLMWGVKKECTRVEAMQDKGKFRDKEKGKGVIRAVDLQSFFTNMERGLNMYYHRLIAKNRENSKLGLGSTYPNKTVWIRIEVVKVVCGVEEKRGRRGIHIEENVEVREFNSFLDSLKCIELPLVGKHFTWFSPWGDAVSRLDRCFIGSGWKKVKEEVKCDIEMKFKQEDKEDNALLLETFSEEEINIQCGIVKAISAWSLMGTISTLLS

SEQ ID NO: 160264 - protein, 171 aa, Glycine max
  Coding DNA Sequence Number=SeqID_43486
VLWECETLPDHRHTPEVDKILADNDAAFGGDDDSVFVRREDATDEEVRENAELVERLRSSPVVQFMARAEEILDKMNEMELKENERPYHKEDWEVWKNVPNVIGLDGRPMPRKAQKTREEADDKFWDFARQFFFGLWNFRQRPYPPGKPIDAAQSIGYKNLERRYYDCELQ

SEQ ID NO: 160265 - protein, 284 aa, Glycine max
  Coding DNA Sequence Number=SeqID_43487
  Homolog annotation: Hit_ID=Q3LWF1; Match level="QueryCoverage=21%, HitCoverage=38%, E-value=3e-11, Identity=50%"; Hit description=RNA binding protein
MRSGGWYYKDRLGRTRGPLELITLKTAWGAGIIDKNTFIWGEDMDEWAPIHMIYGMERAIATWEVRLAASATALLHKLQKGIPPWVPLKGFEKKTYKQLQEEAIESKRRDLAVLEANDGLWPGAKIPSHALFLWASGSELTTILEQDHMPNKYIPKYLRKKLAEIIPGLRPWEVLSIEQAMDRLTFNGEWYREPLGSFTTGPPYLEHWNRDVMRLYKIFDDLNTELYEHMENSIAGFDKIMEKIRDDFIARTDKMLEKKDKEKREARKKAGLPEYQWPEKPYVP

SEQ ID NO: 160266 - protein, 816 aa, Glycine max
  Coding DNA Sequence Number=SeqID_43488
  Gene Ontology: Mol. function=RNA-directed DNA polymerase activity; Cellular component=chromatin; Biological process=chromatin assembly or disassembly
  Pfam annotation: Domain name=RnaseH; Domain location=241-367; Score= -28.1; E_value=0.024; Accession=PF00075.14; Description=RNase H
  Pfam annotation: Domain name=rve; Domain location=497-641; Score =48.6; E_value=2.1e-11; Accession=PF00665.16; Description=Integrase core domain
  Pfam annotation: Domain name=zf-H2C2; Domain location=438-479; Score =21.5; E_value=0.0005; Accession=PF09337.1; Description=His(2)-Cys(2) zinc finger
  Pfam module annotation: Pfam domain module=RVT_1::RnaseH::rve::zf -H2C2; Domain location=2-164::241-367::497-641::438-479
MSAHIGIHTIRKPKLRPKALNALTIKDRFPIPTIDELLDELGGASWFSKLDLLQGYHQILLLEEDISKTAFRTHHGHFEFTVMPSGLCNAPSSFQATMNTIFRPFLRQFIIVFFDDILIYSATLEDHVFHLEQAFQVLLQEQFVLKLEKCTFAQPQVEYLGHVVSSRGVEPVLAKVQAIQHFLGLAGFYRRFIRGYATIVAPLTKLLTLESFQWTPDATATFTTLKQMLTSSPVLRLPDFNLPFTVETDASGTGMGVVLSQQGLPVAYFNKKFPLKLLGASTYVRELFAIMAAVKKWRQYLLGRRFNILTDHRSLKELLTQVIQTPEQQKYLARLMGYDYNIQYRSGNSNVVANALSRVPEPTSEIFLLLSVPCFTFLQELKAQLEQCPDYTQLRQSIMDHPDQNPEFSITKDFVLHKGRIWLPSTLPFLNTLLQEYHCTPTGGHMGVAKTLARLTENFYWQGIRKDVKRFVASCLDCQYTKYKARKPAGLLCPLLVPCQSWEDLSLNFITGLPAFRGNTAILVIVDHFSKGIHLGMLPTHHMAYTVAILFMDLVGKLHGMPQSLVSDRNPLFLSKFWQELFFLSGTKLRLSSAYHPQSDRQIEVLNRKPSSWGKLLGWVEWSYNTSWNSSSGLSPYEVTFGKKPFNFPQYLAGDSNIDAVDVMLTNRKAVFTEIKWKLEKAQSRMKYFADKKRCEVEYQVGDMVLVKLRPHRQISVSGQPSAYSKLTKRFYGPFRVVERIGSTAYKLQLLEEARIHPWQGLPPDDTTWENWDQLQADYHLEDKVLSEAVRNDSNIGTRPRRKSRAPTYLKDFTSC

SEQ ID NO: 160267 - protein, 65 aa, Glycine max
  Coding DNA Sequence Number=SeqID_43489
MAEHLASIFETEKDKMNWPFYFKIGVSRHNVENVYIQFKGSNMALISLGTSSKGCVMLEILEVED

SEQ ID NO: 160268 - protein, 270 aa, Glycine max
  Coding DNA Sequence Number=SeqID_43490
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=45%, HitCoverage=8%, E-value=4e-13, Identity=32%"; Hit description=Chromo
MVEELVRVGIERQIWSIKSEFHEVIATTAPLTLCSRHIMVLSITNHDLEGGGVTRGKAQSRKHGILDEVMGTTPHPPRLKPALKPRSLKNVMSLRSSHLKQRPRSLREASSFGVRRFNGTGERGCAERARGEGDTEIGVCVEGAVEVEKEGTRLRKARLVSASFSSCKRARPAAWTSVNGCNAWTSRRMSGFNPDTKQLRRKCGGRPATRLATSLNSERVPVGSSYCEDANRPKGSEPSIWGHQALHGVVVKKRKAMGYGEKRLEKNQRI

SEQ ID NO: 160269 - protein, 66 aa, Glycine max
  Coding DNA Sequence Number=SeqID_43491
  Pfam annotation: Domain name=G-patch; Domain location=2-43; Score =5.5; E_value=0.039; Accession=PF01585.13; Description=G-patch domain
MMVAWVMLGHGYELGMGLGKNNGGSTGLVRVRGNHEKFGLRYNPTHADVRKNISGRKNKGQGPQSG

SEQ ID NO: 160270 - protein, 214 aa, Glycine max
  Coding DNA Sequence Number=SeqID_43492
  Gene Ontology: Mol. function=RNA-directed DNA polymerase activity; Biological process=RNA-dependent DNA replication
  Subcellular localization annotation: CTP_CleavageSite=73; ConfidenceScore=5.19e-01
MGNQQRQGYTQGGFSGFQQGPYNQQGQWRSHPGNQFNKDQGGPSNRPIQQGPNIFQRTTKLEETLTQFMQVTMSNHKSTESALKNLEVQVGQLAKQIDDKSSNSFVANIEKNTKEECKAVMTRSKRFVEAKDEDSVVSKKKATEKKGTDEKKDDNEERSRSEQAREKKREKVVNECAEVPYPVVPSKKEKDRHLAKFLYIFGKLEITMPFGEAL

SEQ ID NO: 160271 - protein, 201 aa, Glycine max
  Coding DNA Sequence Number=SeqID_43493
MGDPISRLSFPGRRIVCHSNHMLSWNICLFAKACLHFSGENTETFSSLTSYPELRRSEFLIGGYVGARASLLSTTPAFVAMTQELVARGDTLRLSAPLCYLDTVVVRWHAEAKFGHSAHMIRGDTLRLSAPLCYSDTVVVRWHAEAKFGHSAHMIRGDTLRLSAPLCYLDTVVVRWHAEAKFGHSAHMIRGDTLWLSAPLC

SEQ ID NO: 160272 - protein, 269 aa, Glycine max
  Coding DNA Sequence Number=SeqID_43494
MGEIEEEQERMKAYIEAMKEQMATMMEAMMSMKKIMEVNATIVAATSAVAEGGKELGITGGPHCVQIQNKHAFLPYDLPPNYTPPNVVPTPDENVNNSTPILIKCQQPQFDHAHISQPMGETHEIPHHNLADFEPHLEYATMGQVVGGVPLPNTLEGPQFRPQPLPLHFAVGRVPPTMVEREKLDHIKERLRVIEGGGDHAFADIAELYLVPDIIIPLKFKVSDFDKFKGTTCPKNHLKLYCRKMGAYAKDEKLLMHFFQESLTRAAVT

SEQ ID NO: 160273 - protein, 508 aa, Glycine max
  Coding DNA Sequence Number=SeqID_43495
  Gene Ontology: Mol. function=oxidoreductase activity; Cellular component=integral to membrane; Biological process=electron transport
  Homolog annotation: Hit_ID=Q2R447; Match level="QueryCoverage=88%, HitCoverage=87%, E-value=1e-140, Identity=54%"; Hit description =Cytochrome P450 family protein, expressed
  Pfam annotation: Domain name=p450; Domain location=61-507; Score =238.4; E_value=1.5e-68; Accession=PF00067.12; Description=Cytochrome P450
MKPTATFFFLLPSTTLVVCLCLGIGTTTLFITLLAISLNYWLVPGGFAWRNYDYYQTKKKLTGPMGWPILGTLPLMGSLAHQKLAALATSLNAKRLMALSLGPTPVVISSHPETAREILLGSSFSDRPIKESARALMFERAIGFAHSGTYWRHLRRIAAFHMFSPRRIHGLEGLRQRVGDDMVKSAWREMGEKGVVEVRRVFQEGSLCNILESVFGSNDKSEELRDMVREGYELIAMFNLEDYFPFKFLDFHGVKRRCHKLAAKVGSVVGQIVEERKRDGGFVGKNDFLSTLLSLPKEERLADSDLVAILWEMVFRGTDTVAILLEWVMARMVLHQDLQKKAREEIDTCVGQNSHVRDSDIANLPYLQAIVKEVLRLHPPGPLLSWARLAVHDVHADKVLVPAGTTAMVNMWAISHDSSIWEDPWAFKPERFLKEDVSIMGSDLRLAPFGAGRRVCPGRALGLATAHLWLAQLLRHFIWLPAQTVDLSECLRLSMEMKTPLRCLVVRR

SEQ ID NO: 160274 - protein, 90 aa, Glycine max
  Coding DNA Sequence Number=SeqID_43496
MASKSGDATPPSPKTARLKVEMTKLERRREVRSFNSSHGEDEGYDDDEGGMRNEMYRKRRNHRRYGGRKREEGIKGVKVKIHTFKGTYDP

SEQ ID NO: 160275 - protein, 97 aa, Glycine max
  Coding DNA Sequence Number=SeqID_43497
MVKVGKAGSEVRNSGVDGFDKFLGCEHGKRSIYRLAKVREKKSKTHQELEGRKCTSLSLELKWEAIPYKSHDFKCLGSMVQREGKIEGDINHRIQTV

SEQ ID NO: 160276 - protein, 840 aa, Glycine max
  Coding DNA Sequence Number=SeqID_43498
  Gene Ontology: Mol. function=RNA-directed DNA polymerase activity; Cellular component=chromatin; Biological process=chromatin assembly or disassembly
  Pfam annotation: Domain name=rve; Domain location=434-590; Score =100.4; E_value=5.3e-27; Accession=PF00665.16; Description=Integrase core domain
  Pfam annotation: Domain name=zf-H2C2; Domain location=389-430; Score =4.8; E_value=0.085; Accession=PF09337.1; Description=His(2)-Cys(2) zinc finger
  Pfam module annotation: Pfam domain module=rve::zf-H2C2; Domain location=434-590::389-430
MNEGDIEKKAFRTHNGHFEYLVMPFGLCNAPSTFQSAMNQLLRPFLRQFATVFFDNILVYSNSLALHLQHLEIIFQTLHHAEFFLKRSKCLFAQDTIEYLGHIVSGKGVSPEPSKIQVMLQWPTPTSVRELRAFLGLTGFYRKFIKHYASIAAPLTSLLCKDAFTWSQDSQQDFDRLKLAMTSAPVLALPDFSEPFMIETDAFETAIGVVLLQNGHPLAYFSKCLGPRMLHASTYIRELHAVVAAVRKWRQYLLGRPFTILTDHKSLRELMTQVIQTPEQHYYLSKLLRYEYSIQYKTGATNVIADALSRAPSPEASLLVLSVPQLDFLSDIKQSFDSNSEFQRLAQAIRDNPNDHPDYTLGHGLILFKGRIWLNQDNPFLHSLITEHHSTPLGGHLGVTKTTHRLESSFFWSGLKQDVKQFIKQSGLLQPLPAPEGVWEDLSMDFITHLPNSNGFTVILVVVDRFSKGVHLGALASGFTAFKVANLFLDMVCKLHGFPKSIVSYRDPIFVSRFWKELFRLSGTRLRLSTSYHPQSDGQTEVMNRVVEQYLRCFIHVQPSTWHQYLALAEWSYNTSLHSSSGLTPFEIVYGKPPPTVLDYVPSATSNEAAQSLLETRHTLHLKLKRKLQKARERMKKYADSKRDDVTFVVGQWVYVKLRPGRQTSITGSIHPKLSKRFFGPFQILERVEAVAYRLLLPPRSQIHPVFHCSLLRPHHGPPPTTTYEWSLQVHDNQPLRRPLCFLASWLDHSTNPPSRMVLTQWKGEPLEDTSWEAWSELCKTYHLEDKVVFGADGSVSISDDDCNISGDCSTDDRHTPNPRPARIKGAPTHLKDYYVNLHT

SEQ ID NO: 160277 - protein, 266 aa, Glycine max
  Coding DNA Sequence Number=SeqID_43499
  Gene Ontology: Mol. function=RNA-directed DNA polymerase activity; Cellular component=chromatin; Biological process=chromatin assembly or disassembly
  Subcellular localization annotation: CTP_CleavageSite=52; ConfidenceScore=5.01e-01
MSTAETFRLYDHIRLHHSRVAKFLNLPTSSTTTLHIIVGNRNRLTSNTTCPQVTIVVEGHQFTLDLFQLPLYGADIVLKVQWLQNLGPIMTDYTSLTMSFTHLGRPITLQADVPLCPDSASAHQLKRYVHIQSLSTLFHLVQIPDPEPQHPLGPLAPLNLLNYSLPFNLLPHPPHTQLQTSGRKALLIPILPKVGTQKVDSFYARGWPHITQSHPFLFIGAPGKEEGVRGTWHCYVDYWALNTITIKARFPVPMIDELLDELGKAS

SEQ ID NO: 160278 - protein, 537 aa, Glycine max
  Coding DNA Sequence Number=SeqID_43500
  Gene Ontology: Mol. function=RNA-directed DNA polymerase activity; Cellular component=chromatin; Biological process=chromatin assembly or disassembly
  Pfam annotation: Domain name=RVP_2; Domain location=259-383; Score= -27.5; E_value=0.00014; Accession=PF08284.2; Description=Retroviral aspartyl protease
  Pfam module annotation: Pfam domain module=RVP_2::Retrotrans_gag; Domain location=259-383::105-235
MANHKTRKTTTDRLEEAIARLTNSQVSINDRYNDLAGKVDSILEHLHLHASDNNTNTTTLSHPNHQRSAVKIDIPRFDGRDPLGWIFKITQLFQYQNTPEDERITVASLYLDGAALSWYQWMYINGLITTWNGFLQALESRFTPTFYEDPKRALFKLTQTSSNPMYDGRFLLSSRYRFCRLLHWPSFRKRSCVIEHSYQLETLSLQDRPSIARLRFRPKLNHHSFNAHLQRWLSEEKKTLAFENDPAPSSDIDSHISLHALAGVPSSETFRIYGMIKNTRLTILVDNGSTHNFLQQRIAQFLKLSTQNTHPLQVMVGNGSMLACDQICPSTNLTIQGHPFVVSFHLLQISGADAMLRIDWLRRLGPVTMNYADSIMSFNHLGHDITLRADVSIGPEPTSAAQLKRLLPTGSTSALYQLHVLPVTEPEQPASPHPIPAMEHLLLRYNNLFQKPSTLPPPRQVVHRITLKPATPPITVRPYRYPHFQKNKIENQVSELLAAGLIRPSTSPYSSLVLLVKKKDDTWRLCIDYRALNSATI

SEQ ID NO: 160279 - protein, 79 aa, Glycine max
  Coding DNA Sequence Number=SeqID_43501
MGCLLGVKLLKRISEVVKREMLSGVPFLLGGFWTGKLFPLIDARLLSKHATRMHFQAHPYGAVTSLTCHARQILKTSTC

SEQ ID NO: 160280 - protein, 176 aa, Glycine max
  Coding DNA Sequence Number=SeqID_43502
  Subcellular localization annotation: CTP_CleavageSite=86; ConfidenceScore=5.66e-01
MMRKQQQQRQMVPPNRGRNNNSSNNVVRVGNVVNGIGLSASAWPPNGSGMRAVFLSGKRERSTGTGVFLPRCVDTRNNNESRKKPVCNTVLVSDRVAQALNLEGVVGGGRGHKQQHKPRFNGENGSPVSRVRSNNNNNNHYGYGYSHHQKRNNLKPQQQPQVVVNHEIQLPLEWTY

SEQ ID NO: 160281 - protein, 132 aa, Glycine max
  Coding DNA Sequence Number=SeqID_43503
MIVADEQDTYNDNFDVDYDHINEEISNVDISCGAPPNFATYLIQESRERFKRSFKFQFFKNQESRIKNNQEQDSRLKIQESREDLIKISMKKFFQKLSSTWIFLKNMFTKEFLLSGNRLPDCCNRLPVAKWI

SEQ ID NO: 160282 - protein, 166 aa, Glycine max
  Coding DNA Sequence Number=SeqID_43504
  Gene Ontology: Mol. function=transition metal ion binding; Cellular component=chloroplast; Biological process=iron ion homeostasis
  Homolog annotation: Hit_ID=Q94IC4; Match level="QueryCoverage=64%, HitCoverage=42%, E-value=3e-56, Identity=99%"; Hit description =Ferritin-2, chloroplast precursor
  Pfam annotation: Domain name=Ferritin; Domain location=1-89; Score =11.2; E_value=0.00018; Accession=PF00210.14; Description=Ferritin -like domain
NIRGGRVVLHPITSPPSEFEHSEKGDALYAMELALSLEKLTNEKLLHVHSVAERNNDPQLADFIESEFLYEQVKSIKKIAEYVAQLRLVGKGHGVWHFDQKLLHDEDHENVLKGCVGTIVYGKSKKLLVELRTMSLSLRRFMTLPNIVQTDYQPRSFQDKTIQITI

SEQ ID NO: 160283 - protein, 102 aa, Glycine max
  Coding DNA Sequence Number=SeqID_43505
MGMQKKEKWKKNSMADIEGEIVCEAKGKGQGEGICSGPLDGETRGGLSFVSGTGVWRARGLSSVKVESVEISVPRHDREMCSLARMCKPEVLALRTFQSINI

SEQ ID NO: 160284 - protein, 126 aa, Glycine max
  Coding DNA Sequence Number=SeqID_43506
MVKPDQILFTIKDQDEKNVTTIKTVYNERQRYRHEQKGLRKEVQHLLKLIEHNPVKGAHARLKRLLCDNMRDLCTCKDKIINVIDHWFNTPFYKRLRGFVSTQAQSFILNELKRSAIVGIDNSAYD

SEQ ID NO: 160285 - protein, 50 aa, Glycine max
  Coding DNA Sequence Number=SeqID_43507
MDQIFNKVGSYWFNQKASSQLNSVGDDINQKYVKGDIEFGCLVREGGEAP

SEQ ID NO: 160286 - protein, 315 aa, Glycine max
  Coding DNA Sequence Number=SeqID_43508
  Gene Ontology: Mol. function=protein binding; Cellular component =integral to membrane; Biological process=defense response to fungus
  Homolog annotation: Hit_ID=Q1T2W9; Match level="QueryCoverage=100%, HitCoverage=71%, E-value=2e-98, Identity=41%"; Hit description =Leucine-rich repeat; Leucine-rich repeat, cysteine-containing type
  Pfam annotation: Domain name=LRRNT_2; Domain location=31-76; Score =38.6; E_value=2.1e-08; Accession=PF08263.3; Description=Leucine rich repeat N-terminal domain
  Pfam annotation: Domain name=LRR_1; Domain location=106-128; Score =14.4; E_value=0.43; Accession=PF00560.23; Description=Leucine Rich Repeat
  Pfam annotation: Domain name=LRR_1; Domain location=130-152; Score =10.8; E_value=2.8; Accession=PF00560.23; Description=Leucine Rich Repeat
  Pfam annotation: Domain name=LRR_1; Domain location=154-181; Score =2.2; E_value=1.1e+02; Accession=PF00560.23; Description=Leucine Rich Repeat
  Pfam annotation: Domain name=LRR_1; Domain location=187-209; Score =1.1; E_value=1.7e+02; Accession=PF00560.23; Description=Leucine Rich Repeat
  Pfam annotation: Domain name=LRR_1; Domain location=214-236; Score =14.7; E_value=0.33; Accession=PF00560.23; Description=Leucine Rich Repeat
  Pfam annotation: Domain name=LRR_1; Domain location=238-260; Score =11.6; E_value=1.9; Accession=PF00560.23; Description=Leucine Rich Repeat
  Pfam annotation: Domain name=LRR_1; Domain location=262-284; Score =6.3; E_value=19; Accession=PF00560.23; Description=Leucine Rich Repeat
  Pfam annotation: Domain name=LRR_1; Domain location=286-308; Score =8.9; E_value=6.3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=31-76::106 -128::130-152::154-181::187-209::214-236::238-260::262-284::286-308
MRIVVFSALMVMPFYWLCLFNHVFVVSGLCLDDQRSLLLQLKNNITFIPWAYRSSSRLKSWNASDDCCRWMGVTCDTEGHVTALDLSGESISGGFDDSSVIFSLQHLQELNLASNNFNSIIPSGFNKLDKLTYLNLSYAGFVGQIPIEISQLTRLVTLDISCLSYLTGQELKLENPNLQKLVQNLTSIRQLYLDGVSIKVPGHEWCSAFLLLRDLQELSMSHCNLSGPLDPSLATLKNLSVIVLDQNNLSSPVPDTFSHLKNLTILSLVYCGLHGTFPQGIFSIGSLSVIDISFNYNLQGVFPDFPRNGSLQILR

SEQ ID NO: 160287 - protein, 104 aa, Glycine max
  Coding DNA Sequence Number=SeqID_43509
LRHNIEIPNGENSRKWVANAVLKFHDDPTVNESEIVIFLRQKDASHVRPQNGGFNPFSFSLTFENPNRATGGGVLESTKNATIDNEERLSDYIEVRDELFTIGD

SEQ ID NO: 160288 - protein, 575 aa, Glycine max
  Coding DNA Sequence Number=SeqID_43510
  Gene Ontology: Mol. function=protein binding; Cellular component =integral to membrane; Biological process=xylan catabolic process
  Homolog annotation: Hit_ID=Q1T2V8; Match level="QueryCoverage=99%, HitCoverage=93%, E-value=1e-180, Identity=38%"; Hit description =Leucine-rich repeat
  Pfam annotation: Domain name=LRR_1; Domain location=109-128; Score =8.0; E_value=9.2; Accession=PF00560.23; Description=Leucine Rich Repeat
  Pfam annotation: Domain name=LRR_1; Domain location=11-27; Score=9.1; E_value=5.8; Accession=PF00560.23; Description=Leucine Rich Repeat
  Pfam annotation: Domain name=LRR_1; Domain location=130-152; Score =7.7; E_value=10; Accession=PF00560.23; Description=Leucine Rich Repeat
  Pfam annotation: Domain name=LRR_1; Domain location=155-177; Score =8.6; E_value=7.2; Accession=PF00560.23; Description=Leucine Rich Repeat
  Pfam annotation: Domain name=LRR_1; Domain location=179-198; Score =17.1; E_value=0.064; Accession=PF00560.23; Description=Leucine Rich Repeat
  Pfam annotation: Domain name=LRR_1; Domain location=204-226; Score =7.1; E_value=13; Accession=PF00560.23; Description=Leucine Rich Repeat
  Pfam annotation: Domain name=LRR_1; Domain location=228-250; Score =8.6; E_value=7.1; Accession=PF00560.23; Description=Leucine Rich Repeat
  Pfam annotation: Domain name=LRR_1; Domain location=252-271; Score =11.5; E_value=2; Accession=PF00560.23; Description=Leucine Rich Repeat
  Pfam annotation: Domain name=LRR_1; Domain location=276-297; Score =7.0; E_value=14; Accession=PF00560.23; Description=Leucine Rich Repeat
  Pfam annotation: Domain name=LRR_1; Domain location=302-325; Score =8.2; E_value=8.2; Accession=PF00560.23; Description=Leucine Rich Repeat
  Pfam annotation: Domain name=LRR_1; Domain location=38-58; Score=4.5; E_value=42; Accession=PF00560.23; Description=Leucine Rich Repeat
  Pfam annotation: Domain name=LRR_1; Domain location=397-419; Score =17.1; E_value=0.062; Accession=PF00560.23; Description=Leucine Rich Repeat
  Pfam annotation: Domain name=LRR_1; Domain location=421-443; Score =19.0; E_value=0.017; Accession=PF00560.23; Description=Leucine Rich Repeat
  Pfam annotation: Domain name=LRR_1; Domain location=445-466; Score =8.2; E_value=8.3; Accession=PF00560.23; Description=Leucine Rich Repeat
  Pfam annotation: Domain name=LRR_1; Domain location=61-83; Score =18.2; E_value=0.031; Accession=PF00560.23; Description=Leucine Rich Repeat
  Pfam annotation: Domain name=LRR_1; Domain location=85-106; Score =9.2; E_value=5.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=109-128::11-27::130-152::155- 177::179-198::...
  Pfam module annotation: Domain location=204-226::228-250::252 -271::276-297::302-325::38-58::397-419::421-443::445-466::61-83::85 -106
  Subcellular localization annotation: CTP_CleavageSite=68; ConfidenceScore=5.49e-01
MHLDNILVLRNLTTLDLSYNNLSVKVNVTNVGSSSFPSISNLILASCNLKTFPGFLRNQSRLTSLDLSDNHIQGTVPNWIWKLQILESLNISHNLLTHLEGPFQNLSSHLLYLDLHQNKLQGPIPFFSRNMLYFDLSSNNFSSIIPRDFGNYLSFTFFLSLSNNTLSGSIPDSLCNAFYLKVLDLSNNNISGTIPSCLMTVSENLGVLNLKNNNLSSPIPNTVKVSCGLWTLNLRGNQLDGPIPKSLAYCSKLEVLDLGSNQITGGFPCFLKEIPTLRVLVLRNNKFQGSPKCLKVNMTWEMLQIVDIAFNNFSGELPREYFTTWKRNIKGNKEEAGLKFIEKQILDFGLYYRDSITVISKGYKMELVKILTIFTSIDFSSNHFDGPIPEELMDWKELHVLNLSNNALSGKIPSSIGNMSQLESLDLSQNSLSGEIPVQLASLSFLSYLNLSFNHLMGKIPTSTQLQSFPASSFEGNDGLYGPPLTKNPDHKEQEVLPQQECGRLACTIDWNFISVELGLIFGHGVIFGPLLIWKQWRLWYWQLVHKILCQIFPQVYLEYVTWRGQTYEALRWRH

SEQ ID NO: 160289 - protein, 62 aa, Glycine max
  Coding DNA Sequence Number=SeqID_43511
MMERIKREKMVSRDRERGQVKDEIGRRRMRVTTVTSLAVRKKTREIETKKGKGEGDEENQRK

SEQ ID NO: 160290 - protein, 138 aa, Glycine max
  Coding DNA Sequence Number=SeqID_43512
  Gene Ontology: Mol. function=microtubule motor activity; Cellular component=microtubule associated complex; Biological process =microtubule-based movement
  Homolog annotation: Hit_ID=Q7Y1U0; Match level="QueryCoverage=62%, HitCoverage=7%, E-value=2e-27, Identity=73%"; Hit description =Kinesin-like calmodulin binding protein
MQVVGVLHIFQFETKQGEEICVALQTHINDVMLRCYSKARYVMDGSLNEDTSNDFKPSSNLELSKKRLQELSKLVEESQMNADQIDGLKVNDNEIEVAEAVTDDGEGHKALSSNGEGHRTLFVENANRVVIAKSMETT

SEQ ID NO: 160291 - protein, 272 aa, Glycine max
  Coding DNA Sequence Number=SeqID_43513
  Gene Ontology: Mol. function=nucleic acid binding; Cellular component= nucleus; Biological process=DNA replication
  Homolog annotation: Hit_ID=Q1STX0; Match level="QueryCoverage=80%, HitCoverage=80%, E-value=5e-77, Identity=66%"; Hit description =Nucleic acid-binding, OB-fold, subgroup
  Pfam annotation: Domain name=tRNA_anti; Domain location=74-148; Score= 45.8; E_value=1.5e-10; Accession=PF01336.15; Description=OB-fold nucleic acid binding domain
  Subcellular localization annotation: CTP_CleavageSite=52; ConfidenceScore=5.39e-01
MYSSASQFDGNAAFSGGGFMPSQTTQGPDSSFVPSKNRDAQSLLPLTVKQIYDASQSSDDKINLIIDGVDVTNVTLVGRVSNKAGRITDVTFVLDDGTGRIECNKWLHEAVDTNEAEAILEGMYARLHGQLKHFQGKRTLNVFSFRPVTDFNEIASHFTDCIYVHLYNSKLRTSVPNQQHSSPIPPTIGYQAQVVPPTNQFSDQHVNGQKGVTVEAMVLDFLHHPANSFTLTPHTSPITVISILYPHSPTIFSPACGWNLCLWLHHLCSACG

SEQ ID NO: 160292 - protein, 456 aa, Glycine max
  Coding DNA Sequence Number=SeqID_43514
  Gene Ontology: Mol. function=oxidoreductase activity; Cellular component=membrane; Biological process=electron transport
  Homolog annotation: Hit_ID=O48928; Match level="QueryCoverage=99%, HitCoverage=99%, E-value=0.0, Identity=83%"; Hit description =Cytochrome P450 77A3
  Pfam annotation: Domain name=p450; Domain location=38-449; Score =329.1; E_value=7.4e-96; Accession=PF00067.12; Description=Cytochrome P450
  Subcellular localization annotation: CTP_CleavageSite=68; ConfidenceScore=5.14e-01
MATLSSYDHFIFTALAFFISGLIFFLKQKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKDARFAVFCILVAMCFGLEMDEETVERIDQVMKSVLITLDPRIDDYLPILSPFFSKQRKKSLGGSQRTVLNGGTDTTATAVEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVK

SEQ ID NO: 160293 - protein, 270 aa, Glycine max
  Coding DNA Sequence Number=SeqID_43515
  Gene Ontology: Mol. function=protein serine/threonine kinase activity; Biological process=protein amino acid phosphorylation
  Homolog annotation: Hit_ID=Q2R441; Match level="QueryCoverage=77%, HitCoverage=71%, E-value=4e-66, Identity=56%"; Hit description =Uncharacterized plant-specific domain TIGR01627 family protein, expressed
  Pfam annotation: Domain name=DUF579; Domain location=39-270; Score =408.3; E_value=1.1e-119; Accession=PF04669.4; Description=Protein of unknown function (DUF579)
GNERMKSRWLVWLLAILGVIGATLFIASMIQTWENNFLCSISRTMQQQQFTHGPTSMQLKAILHYATSQVVPQQSLSEITITFDVLQALHRPANFLVFGLGRDSLMWASLNPHGTTLFLEEDPKWFGIVTKDAPNLLAHTVRYRTQLRDADSLLSSYSSEPACFPATATLRGNERCKVALHNLPDEVYAKEWDLIMIDAPKGYFAEAPGRMAAIFSAAVMARDRKGSGVTHVFLHDVDRKVEKVYAEEFLCRKHLVKSVGRLWHFQIPPM

SEQ ID NO: 160294 - protein, 173 aa, Glycine max
  Coding DNA Sequence Number=SeqID_43516
MSLDALKQVIQSKISLPYVGYGMLKFTTLKIVEDENVKASQSFGLTEDQPHAYWSTLKAKPIPSTQPNEPEFAEFGLPNKELGPFSGDEDKILCNQPHQEHDEEADPTPPSTTILAYYMAVHMQNVDLESNFQDFELVMRWIAKKSNIRWEPSLKEFVLKPKKKYNMLCSSIM

SEQ ID NO: 160295 - protein, 126 aa, Glycine max
  Coding DNA Sequence Number=SeqID_43517
MAMDVLGGAEQYTSLQIVASYVDISSKYGCREGNIVNANQTRLMELGCMESTKENLIVAVAQDENKKILLIAFIVVEAYARTKPAFNYCYNNLRQEQIVNKPLIDLTRFRKKNELLFGMKANEGET

SEQ ID NO: 160296 - protein, 208 aa, Glycine max
  Coding DNA Sequence Number=SeqID_43518
MDFEYQNMSMSKILSRRSSMGSSSRISYYRSSGEGVPFKWEMQPGIAKEQQPREDLPPLSPPPALLSLGLPKPCIPDTKPSTRSRLRFWKKRVKRGKSKKSSSSSHDCFHEDDDVIGLDILDCNSDSESNSMASPRGSSFSSWSSMSFMKSPTTTIRKRASSLLRRGVVFAQRCGGAMTRKSVGVRSWWCLMMVMVDDDDVQCAEANI

SEQ ID NO: 160297 - protein, 78 aa, Glycine max
  Coding DNA Sequence Number=SeqID_43519
MALHFLVYDALKTELQWQRSSWSATRCYAMGSHVIQATYTNKFVDLILSLAHLSISQFDAFESNSGVYLLLLSDQLGV

SEQ ID NO: 160298 - protein, 191 aa, Glycine max
  Coding DNA Sequence Number=SeqID_43520
  Gene Ontology: Mol. function=hydrolase activity; Cellular component =mitochondrion; Biological process=metabolic process
  Homolog annotation: Hit_ID=Q1STY4; Match level="QueryCoverage=98%, HitCoverage=79%, E-value=8e-83, Identity=67%"; Hit description=HAD -superfamily hydrolase subfamily IA, variant 3; Epoxide hydrolase N -terminal domain-like phosphatase
  Pfam annotation: Domain name=Hydrolase; Domain location=14-156; Score= 34.8; E_value=2.9e-07; Accession=PF00702.16; Description=haloacid dehalogenase-like hydrolase
MAHPSAVVSVRRPITHVVFDMDGLLLDTERFYTQVQEIILARYNKTFDWSLKAKMMGKKAIESARIFVEETGISDSLSAEQFLVEREDMLEKLFPTSEPMPEVKQGKPSPDGFLAAAKRFEGGPVDPSNILVFEDAPAGVLAAKNAGMSVVMVPDPRLDKSFLDTADQVLNSLLDFNPSEWGLPPFDDNRD

SEQ ID NO: 160299 - protein, 314 aa, Glycine max
  Coding DNA Sequence Number=SeqID_43521
  Gene Ontology: Mol. function=DNA binding; Cellular component =chromatin; Biological process=DNA integration
  Homolog annotation: Hit_ID=Q1SKN1; Match level="QueryCoverage=95%, HitCoverage=30%, E-value=3e-29, Identity=42%"; Hit description =Integrase, catalytic region
MAEQWHCIQYPEFYVMFGILYQTSCVATPHKNSVAERKHRHILNVARSLLFQANLPKAFWSYAVTHVAHFINRIPSTTLGYRSPFELLHHDSPTLLDLKVFGSLCSVFTLDQGRSKFDPVELEVYLSWIEVCMNTSFHIPLSLEPTSTSFSPEPQCFDFLLDPVSQTVPPSLIFASQPHTVPLSSNNHIPSPYSPLPILCRSSRYRKPPEYLKDFHHHLCNSATPNASSSTAAQGWILVLQQLDVDNAFPHGDLHEEVYMELPPGLFPQFSNQVCHLTKSLYGLKQDSRQWLEKLSSSLVSFDFIQSQYDHSPG

SEQ ID NO: 160300 - protein, 86 aa, Glycine max
  Coding DNA Sequence Number=SeqID_43522
  Homolog annotation: Hit_ID=Q1RZV4; Match level="QueryCoverage=50%, HitCoverage=18%, E-value=3e-16, Identity=90%"; Hit description=Appr -1-p processing
MDAAATVGRVSNGGGVVRFPLSASSALFMQKGDITKWSIDGSTDAIVNPANERMLGGGGADGGNSFLVLVDNNALLRFREEWVKLH

SEQ ID NO: 160301 - protein, 55 aa, Glycine max
  Coding DNA Sequence Number=SeqID_43523
MGRSNKWKTKQVVKTHIVCSEKEGYQDVKLRVVLCTLRKRDEPKTKDYREGLGSR

SEQ ID NO: 160302 - protein, 100 aa, Glycine max
  Coding DNA Sequence Number=SeqID_43524
EEEEEQEKRALDSESPKQESEIEDNCKEEEEEKKIKTLHPDMLWEPAGMLVNTWVHMAWERVGLLPNANLNHTMKMRAVWVVPSDYPCSKRFVTLPIFKF

SEQ ID NO: 160303 - protein, 408 aa, Glycine max
  Coding DNA Sequence Number=SeqID_43525
  Gene Ontology: Mol. function=nucleoside-triphosphatase activity; Cellular component=membrane; Biological process=response to abscisic acid stimulus
  Homolog annotation: Hit_ID=Q9FKM3; Match level="QueryCoverage=99%, HitCoverage=78%, E-value=0.0, Identity=83%"; Hit description =Similarity to AAA-type ATPase
  Pfam annotation: Domain name=AAA; Domain location=239-408; Score =11.2; E_value=3e-05; Accession=PF00004.19; Description=ATPase family associated with various cellular activities (AAA)
MNEYWTSLASLLGVFAFCQTILQAVFPPELRFASVKLFYRIFHCFSSYCYFDITEIDGVNTNELYNAVQLYLSSSVSITGNRLSLTRAVNSSGFTFGLANNDSIVDTFNGVNVLWEHVVTQRQAQTFSWRPLPDEKRGFTLRIKKKDKSFILNSYLDYIMERASDIRRNNQDRLLYTNSRGGSLDSRGHPWESVPFKHPSTFDTLAMDPHKKKEIMEDLLDFANGQSFYHKTGRAWKRGYLLYGPPGTGKSSMIAAMANFLGYDIYDLELTEVHNNSELRKLLMKTSSKSIIVIEDIDCSINLTGRKNNNGSVSVSASRSYYDSEIRAGGGCGEEGGNNITLSGLLNFTDGLWSCCGSERIFVFTTNHIEKLDPALLRSGRMDMHIFMSYCSFPALKILLKNYLGCEA

SEQ ID NO: 160304 - protein, 57 aa, Glycine max
  Coding DNA Sequence Number=SeqID_43526
MGPNPLGLVLDLRASQPMDGWLTMILKCYQNAPFPYLFAIGQSTTKLEREGFTAGLQ

SEQ ID NO: 160305 - protein, 140 aa, Glycine max
  Coding DNA Sequence Number=SeqID_43527
MLRDSIRHPSKKLLSFEFAQRFNIQFRASRYITGLNQTSEGSAFNFERPDMLRDSIRHPKLQHSISSVSIYKGTQSDIRVKSYCRLNWLRGSTFNFERLDMLRDSIRHPSKKLLSFELAESFNIEFRASRYITGLNQTSE

SEQ ID NO: 160306 - protein, 125 aa, Glycine max
  Coding DNA Sequence Number=SeqID_43528
MFRHEYQENGGNVACPITSECTLGLRPSLTTPQFNKNKQQFKDKSLTFLSKYMQLRAPKYINGKLESPRMRCRGAHPGELTYTFFFRETILGCLAEALSICPKLGKGRRPIGHDPSLYLRPSLST

SEQ ID NO: 160307 - protein, 183 aa, Glycine max
  Coding DNA Sequence Number=SeqID_43529
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=77%, HitCoverage=32%, E-value=4e-63, Identity=87%"; Hit description =Putative hydroxymethylglutaryl-CoA lyase
  Pfam annotation: Domain name=HMGL-like; Domain location=22-181; Score= -41.1; E_value=2.7e-05; Accession=PF00682.9; Description=HMGL-like
MAMMQFLNSIPKFVKIVEVGPRDGLQNEKNIVPTSVKIELIHRLASTGLSVIEATSFVSPKWVPQLADANDVMQAVHNLRGIRLPVLTPNLKGFEAAMASGAREVAIFASASESFSKSNINCSIEESLIRFRAVTRAAKQLSIPVRGYAFYFLFNYFKITSNNCASISVLGKQYLSQSAQVKV

SEQ ID NO: 160308 - protein, 157 aa, Glycine max
  Coding DNA Sequence Number=SeqID_43530
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=99%, E-value=1e-20, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSFEFGMISTIDESISCFLIGVDPWVLEPISFRGLHVLAFRGLHVLAFKGLHAFTFRGLHVLAFRGLHALTFRGLHILAFRGLHTLAFKGLHALAFRGLQVLAFRGLHVLTFRRLHALTFRGLHVLAFRGLHALAFRGLHALAFRGLHALAIRGL

SEQ ID NO: 160309 - protein, 287 aa, Glycine max
  Coding DNA Sequence Number=SeqID_43531
  Gene Ontology: Mol. function=nucleic acid binding; Biological process= transport
  Homolog annotation: Hit_ID=Q8H6Q8; Match level="QueryCoverage=72%, HitCoverage=8%, E-value=1e-15, Identity=25%"; Hit description=CTV.20
MDDWNIPEIPQDQLYVPETIKDKHNFDYIIKIVENNIPLGQDIGEEFHLLSKNSIYEHSRKYKYLHIGCVQVAIKPLIDIGIDAAVLMCLRDIRHNKFEDSLIGTVETSLGQALIYRIQYKVMNTCASRVLLKPQKRETTLFITDMTKANVSLPRKIKWDEVTLLERWVMDKATPSVPRPAPTIEHIKQDNSSKVEITFNRRNSFSSRIEASRSEYESARRSFSVRTRSIPVGLTRSESHNQFPTINLQGLDTTSSIPRTTYSQEQEDDQKSIQSPTYSSMEPYDVI

SEQ ID NO: 160310 - protein, 81 aa, Glycine max
  Coding DNA Sequence Number=SeqID_43532
MSSSQSISINTQVLCNIYTKTQSYMQCGTMSVKNHVGRLGVHDKTNHTLASQVTLTRLKGALKPGDPQDLHSKKSIKTSPS

SEQ ID NO: 160311 - protein, 114 aa, Glycine max
  Coding DNA Sequence Number=SeqID_43533
MLWLRGGCPFEFSTHWVRTSNMPLGSLEAHAWCLSLLQCKALSLLVGSFNGDFPPWRCSGRQRKRGERRRHPLRNKPWKKELHHQDEPWIRSLEMMLQWRKRKREGGSKKLNDD

SEQ ID NO: 160312 - protein, 112 aa, Glycine max
  Coding DNA Sequence Number=SeqID_43534
  Homolog annotation: Hit_ID=Q5N967; Match level="QueryCoverage=67%, HitCoverage=27%, E-value=2e-37, Identity=94%"; Hit description =Putative terbinafine resistance locus protein
  Pfam annotation: Domain name=Yip1; Domain location=34-112; Score= -44.3; E_value=0.1; Accession=PF04893.7; Description=Yip1 domain
  Subcellular localization annotation: CTP_CleavageSite=30; ConfidenceScore=5.07e-01
SAVTPSPPPPRPGIATSGFGPAPNTLTEPVWDTVKRDLSRIVSNLKLVVFPNPYREDPGKALRDWDLWGPFFFIVFLGLTLSWSASVKKVLTLLAVSSAEISLVVNNPRLET

SEQ ID NO: 160313 - protein, 100 aa, Glycine max
  Coding DNA Sequence Number=SeqID_43535
  Homolog annotation: Hit_ID=Q5N967; Match level="QueryCoverage=62%, HitCoverage=23%, E-value=6e-30, Identity=93%"; Hit description =Putative terbinafine resistance locus protein
MQNTSHCSSIPSVLLTAALAASGSEKRDGEAEEDNEEEWAPQIPIPEGLTGVLTVRVGEHNELQIAHDSREIALHGVPDGLGERVGGGTEPGGGDAGARR

SEQ ID NO: 160314 - protein, 176 aa, Glycine max
  Coding DNA Sequence Number=SeqID_43536
  Gene Ontology: Mol. function=protein binding; Cellular component =integral to membrane
  Homolog annotation: Hit_ID=Q5N967; Match level="QueryCoverage=48%, HitCoverage=31%, E-value=3e-35, Identity=83%"; Hit description =Putative terbinafine resistance locus protein
  Pfam annotation: Domain name=Yip1; Domain location=18-157; Score =36.8; E_value=7.6e-08; Accession=PF04893.7; Description=Yip1 domain
MVRLLPGDLETIMGLNPLEIDSEIRLCTSTFPKPHQSEVFAVAFALLAAGAVILTLNVLLLGGGPDHSQKYTLMNEAKYLTVFIISSKFQGGHIIFFQSLSLLGYCLFPLDVGALICMLKDNVIVKVVVVCVTLAWSSWAAYPFMSSAVSPRRKALALYPVFLMYVSVGFLIIAID

SEQ ID NO: 160315 - protein, 307 aa, Glycine max
  Coding DNA Sequence Number=SeqID_43537
  Gene Ontology: Mol. function=galactosyltransferase activity; Cellular component=membrane; Biological process=protein amino acid glycosylation
  Homolog annotation: Hit_ID=A0EVG3; Match level="QueryCoverage=82%, HitCoverage=84%, E-value=3e-46, Identity=39%"; Hit description =Hypothetical protein hypro1
  Pfam annotation: Domain name=Galactosyl_T; Domain location=67-248; Score=-68.4; E_value=0.059; Accession=PF01762.12; Description =Galactosyltransferase
MAVKSSKPNRERFMLSCFTFIVFLCVFASINEVRFNGALPNESLPTNSEDDDLRILISVLTLPDQYQRRHFLRLVYGTQTTIEGAKVDVKFVFCNLTKEDQKVLVALEIMRYNDIIVLNCTENMNKGKTSTFFTSLPEIFNNETTTSGIVPYPPYHYVMKADDDTYVRLNSLVRSLRPLPREDLYYGFVIPCGSMDPFKHYMSGMGFVVSWDIVEWIHGSDIPRKHVEGPEDKVFGDWMRWARRGNNRFNAKWSMYNYPDPPSVCSHDLWNDTIAVHLLKNQEKWIRTLTYFNHTHALKPSKLYHIP

SEQ ID NO: 160316 - protein, 47 aa, Glycine max
  Coding DNA Sequence Number=SeqID_43538
MTNYDCWLNFECFKNLIADEAGNKDQSRGGYGGAPASKGCPFVEHSD

SEQ ID NO: 160317 - protein, 308 aa, Glycine max
  Coding DNA Sequence Number=SeqID_43539
  Gene Ontology: Mol. function=prephenate dehydrogenase (NADP+) activity; Biological process=tyrosine biosynthetic process
  Homolog annotation: Hit_ID=Q1RX89; Match level="QueryCoverage=99%, HitCoverage=83%, E-value=1e-94, Identity=56%"; Hit description =Prephenate dehydrogenase; NADP oxidoreductase, coenzyme F420- dependent
  Pfam annotation: Domain name=PDH; Domain location=52-307; Score= -67.8; E_value=6.9e-05; Accession=PF02153.8; Description=Prephenate dehydrogenase
MLGRLCFAFQELRKQLLKGVHAVVREHLFENPVTARVQSLQEDAAPYHRDFLAKTIVRQGHQVLAYSRSDYSSIARELGVTYFHDADDLCAQHPEVILLCTSIPSTEAVLKSFPLQKLERSTLFVDVLSVKEFHRNLFLQHLPPDFDVLCTHPMFGPQSAKDGWSGFLFVFDKVRIGTDEARTSRCDWCLNIFSSEGCQLVETPCAEHDRQAAGSQFITPTVGRILEKLDFLEPTKIDTIGFESLLNLMDNTVRDSFDLYFDLFLFNKNSRQQLERFHLAFESLQNQLFDHVLDNLKQVLKLEEESHD

SEQ ID NO: 160318 - protein, 40 aa, Glycine max
  Coding DNA Sequence Number=SeqID_43540
MARLAHPCSLNAIPPLVGIALSAPFSLRETSKVVIFQIPT

SEQ ID NO: 160319 - protein, 91 aa, Glycine max
  Coding DNA Sequence Number=SeqID_43541
MDPPTTLARVAPSLPSLSRRTSGDLVGDKRVYFHDERGARLATHKDLLSKVSRDIIPFDINIVAVRTTSDNVSSKRKTINEVSLSSSKSET

SEQ ID NO: 160320 - protein, 168 aa, Glycine max
  Coding DNA Sequence Number=SeqID_43542
  Homolog annotation: Hit_ID=Q47522; Match level="QueryCoverage=28%, HitCoverage=59%, E-value=3e-22, Identity=100%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLGNARVFPVTTLKTIYHTDAEHGSKHGNFKTPSSRKFSNKHRVQELERPPYLLMNSQNLEGKMMNVQFSRMELIYLSLMYKWLKNTRNK

SEQ ID NO: 160321 - protein, 198 aa, Glycine max
  Coding DNA Sequence Number=SeqID_43543
  Homolog annotation: Hit_ID=Q40538; Match level="QueryCoverage=18%, HitCoverage=64%, E-value=3e-07, Identity=86%"; Hit description =Nicotiana tabacum (clone 5) activating factor DNA sequence
MSGHNTPISTAHSFLSLNTPRVSVEATINSDLPGLKTLLVEYFSGARLFAKIQRTDTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160322 - protein, 141 aa, Glycine max
  Coding DNA Sequence Number=SeqID_43544
  Gene Ontology: Mol. function=transferase activity, transferring phosphorus-containing groups; Cellular component=integral to membrane; Biological process=two-component signal transduction system (phosphorelay)
  Homolog annotation: Hit_ID=P52101; Match level="QueryCoverage=100%, HitCoverage=28%, E-value=3e-54, Identity=73%"; Hit description =Putative sensor-like histidine kinase yfhK
MTAAGIENGDNFLLLRIERAGNLVGQQFGAFAQAGQRRFEFVRQMAQKLMPLRFQPAKTFAEPDNALSQRANFARPAKADAIAQRFALAQPVNHAFDALNRADNHAGEQQHQHQTDQKQYQRLPAKKLAAIGNFALQLQAA

SEQ ID NO: 160323 - protein, 95 aa, Glycine max
  Coding DNA Sequence Number=SeqID_43545
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8ZN30; Match level="QueryCoverage=99%, HitCoverage=22%, E-value=5e-16, Identity=54%"; Hit description =Putative sensory kinase in regulatory system
MAFLLVLLPLLVLAWQAWESLSALSNQAADTNRNTFTDVRRSEAMARTALELERSYRQYLEPLRPDAQQPCRQPARFANVQNIAERAAAAGKAAV

SEQ ID NO: 160324 - protein, 158 aa, Glycine max
  Coding DNA Sequence Number=SeqID_43546
  Gene Ontology: Mol. function=4-coumarate-CoA ligase activity; Cellular component=peroxisome; Biological process=metabolic process
  Homolog annotation: Hit_ID=Q8S564; Match level="QueryCoverage=99%, HitCoverage=25%, E-value=2e-66, Identity=82%"; Hit description=4 -coumarate:coenzyme A ligase
GYGMTEAGPLAISMAFAKEPSKIKPGACGTVVRNAEMKIVDTETGDSLPRNKSGEICIRGAKVMKAVQHGILKPEGVDIKKFRKQFGYLNDPEATERTIDREGWLHTGDIGFIDDDNELFIVDRLKELIKYKGFQVAPAELEALLIAHPNISDAAVVG

SEQ ID NO: 160325 - protein, 164 aa, Glycine max
  Coding DNA Sequence Number=SeqID_43547
  Homolog annotation: Hit_ID=Q1S9I4; Match level="QueryCoverage=28%, HitCoverage=4%, E-value=1e-13, Identity=72%"; Hit description =Integrase, catalytic region; Zinc finger, CCHC-type
MEEELHDFTKNKICTLVPKPKNKSIIGTRWIFRNKLDEQGKVVRNKAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160326 - protein, 156 aa, Glycine max
  Coding DNA Sequence Number=SeqID_43548
MHERQSIHGAPNKSGEWRIALGNHFAWLQTHWWRMHERQSIHGAPNKSGEWRIALGNHFAWLQTRWWRMHERQSIHGAPNKSGEWRIALGNHFAWLKTHWWRMHERQSIHGTPNKSGEWRIALGNHSPGSTLIGGRCMNNNQFMGLPIKVENGELH

SEQ ID NO: 160327 - protein, 155 aa, Glycine max
  Coding DNA Sequence Number=SeqID_43549
  Gene Ontology: Mol. function=DNA binding; Cellular component=nucleus; Biological process=regulation of transcription
  Homolog annotation: Hit_ID=Q1RUM7; Match level="QueryCoverage=91%, HitCoverage=54%, E-value=1e-30, Identity=50%"; Hit description =Homeodomain-related
MDVKKGGSIVQTEVKLQKHNEKEMGMRKGPWAVDENTILVNYITTHGEVYILIMRFINYKSKEEWEELQILNYLCPDMQHGNITLQEHILILDLRSRWGNMYDCSTTTTKNNQQNKELLKDRVIKQAKQLKCDVNSKQFTDMLHYVWMSRLLERL

SEQ ID NO: 160328 - protein, 96 aa, Glycine max
  Coding DNA Sequence Number=SeqID_43550
MGKLDHLEERLRAIKGGEDYAFANLEELFLVPNIITPPKFEIGAYAKDEELLIHSFQENLTGVAVTWYTNLKPSRVHSWKDLMVAFVRQCQYNGFG

SEQ ID NO: 160329 - protein, 55 aa, Glycine max; identical to SEQ ID NO: 122545
  Coding DNA Sequence Number=SeqID_43551

SEQ ID NO: 160330 - protein, 186 aa, Glycine max
  Coding DNA Sequence Number=SeqID_43552
MSCLAITTPISLCLSASWCMAPTRHPLDPDKSNRALWFLALITGLCQSYGVPFTPSKVIRSLITRAFIEKYCTPRQAQGDAHQAADTPLPPRQADLAGSLGAANHRRQVQIHKCLYRFSLSQQGQGSAPFACPTPEQFGAEVAWPGDWPDAWAGEEPTGSPGEPDESHMDEGMTYLLDFLGGSGAT

SEQ ID NO: 160331 - protein, 88 aa, Glycine max
  Coding DNA Sequence Number=SeqID_43553
MKSADKREYHIVIRTFHQPRANESGDAQRLISSSAPSVILTHEVRFTLVVRRYSSPTTHEILLCWAGMIKFDSAWKRRGYPILSLSRH

SEQ ID NO: 160332 - protein, 193 aa, Glycine max
  Coding DNA Sequence Number=SeqID_43554
  Gene Ontology: Mol. function=sequence-specific DNA binding; Cellular component=nucleus; Biological process=regulation of transcription, DNA-dependent
  Homolog annotation: Hit_ID=Q948K0; Match level="QueryCoverage=92%, HitCoverage=56%, E-value=2e-52, Identity=58%"; Hit description =Homeodomain transcription factor KNAT6
  Pfam annotation: Domain name=KNOX1; Domain location=82-126; Score =94.8; E_value=2.7e-25; Accession=PF03790.4; Description=KNOX1 domain
  Pfam annotation: Domain name=KNOX2; Domain location=133-184; Score =120.2; E_value=5.9e-33; Accession=PF03791.4; Description=KNOX2 domain
  Pfam module annotation: Pfam domain module=KNOX1::KNOX2; Domain location=82-126::133-184
MEDEIYGVSSTAEYTDRALMTPENIFPAEYHSFLMSSAARTPMFGSDEFLSAAIAVTAGNETEPYPNVSVAPEIQRHHDASSLIKAKIASHPHYPRLLQAYIECQKVGAPPELTCLLEEIRRENDVRQRDVVVSTCVGADPELDEFMETYCDMLVKYKSDLTRPFDEATTFLNKIETQLTDLCSRSSLPTLYG

SEQ ID NO: 160333 - protein, 54 aa, Glycine max
  Coding DNA Sequence Number=SeqID_43555
MTCNYASIFISMLQIFDGHGSFPKLLGFWKNCKSDDLWAMGGGIEKMESPVWSG

SEQ ID NO: 160334 - protein, 59 aa, Glycine max
  Coding DNA Sequence Number=SeqID_43556
MPPPGFAFGSGTWWSTVRMVGMTQIWCRECQVRSGKVRSSVYTVLLCGGQILVGLTGYQ

SEQ ID NO: 160335 - protein, 110 aa, Glycine max
  Coding DNA Sequence Number=SeqID_43557
MAKFDPEIVLEFYANAWPIEEGVRDMRSWVRGKIDCNNINEIREERMQTQFYTGSATTRAYVQYSSNPLEISTIFVKSITKSEPHRDNPSLVFRNLLQQETHSLLTNLIE

SEQ ID NO: 160336 - protein, 127 aa, Glycine max
  Coding DNA Sequence Number=SeqID_43558
MLGAPYPLQLPTSVTQCLIHCGDHMTILRRFGPPLPWNVVVLDKGIGDKYVTLPWYKFIQEGDFSHGDKLSFNYRRAEKIWEVVDVSSIGACRPRIFFINGFLCFLEDEWQRNGEGRERGDATSRKR

SEQ ID NO: 160337 - protein, 131 aa, Glycine max
  Coding DNA Sequence Number=SeqID_43559
  Homolog annotation: Hit_ID=Q64EX4; Match level="QueryCoverage=87%, HitCoverage=28%, E-value=2e-29, Identity=50%"; Hit description=MtN19- like protein
  Pfam annotation: Domain name=SURNod19; Domain location=2-131; Score= -218.1; E_value=0.014; Accession=PF07712.3; Description=Stress up -regulated Nod 19
MVSLRYKISWVDWNKHQVPVKVYILDSTNRIRSNGSKIIHDCQAEYTILENGDGDSPHVQKANIPVEKGGYLIYGTAHIHSGIVNVTLYGQDGRTLCTSTPKYGTGNEAGNEKGYLIGVRQVASDILRRGG

SEQ ID NO: 160338 - protein, 52 aa, Glycine max
  Coding DNA Sequence Number=SeqID_43560
  Subcellular localization annotation: CTP_CleavageSite=49; ConfidenceScore=5.04e-01
MSPPPLKTSQSLKNSFKALQDASFGLLNRLWVFYGNPVGGLLLSTNFTLSAH

SEQ ID NO: 160339 - protein, 73 aa, Glycine max
  Coding DNA Sequence Number=SeqID_43561
MPSAVHVSSTYEFGAMRTDCLVQFSVLAFFSEPHKCHCLVLFMHPAPTSLEPREGIAYNCSPILHSPLLFGAP

SEQ ID NO: 160340 - protein, 79 aa, Glycine max
  Coding DNA Sequence Number=SeqID_43562
MVEVSTEAIASLAQYYYQPLRCFTFGDFQLSPMVEEFEEILGCPLGGRKPYLFSGRMGPVHRHSRTVDLWRSPLSECGM

SEQ ID NO: 160341 - protein, 102 aa, Glycine max
  Coding DNA Sequence Number=SeqID_43563
MGAKYLKVVKRKFHATKQWSPDEIRKVAGDHKISSHATDSLSLDDKGTEFVYARLPPNLLLLSDKGKNAGPTGSRMSSARCLWMTKGAEDDVSLCVLSCFES

SEQ ID NO: 160342 - protein, 88 aa, Glycine max
  Coding DNA Sequence Number=SeqID_43564
MGPDGCRETRGTGTREMTRKPRKNSEALLISHVAFLLPFSSTIVAHQSSKLCSPFLLQIAKGSHFRSREAHHYVVGLQISGLGRFLLT

SEQ ID NO: 160343 - protein, 198 aa, Glycine max
  Coding DNA Sequence Number=SeqID_43565
  Subcellular localization annotation: CTP_CleavageSite=38; ConfidenceScore=5.27e-01
MKLCFYRKTKLRVADVPSSFAPIAGILASSTSAPPPALADPSSKSSQTSNAKLQSLFEGQILIMQSLQELAQQKPIMSVEQFIEKAPQPHELEPENDQSSEAIISRAVDFSKRRLETRSNEVAQPEPVPVLAYALVPGVDPSSPQHATDYSTPVLEIPEGQTILVLTLDTSPLAIPVLHLTDEEDVQTQDTQDQSQEL

SEQ ID NO: 160344 - protein, 124 aa, Glycine max
  Coding DNA Sequence Number=SeqID_43566
MASVDISAMVKSKIFPYALRKACILRGDTDPLLLCPREGIKMEPMHDAYAKSGKMPRSVFALCPYLKDLYGRELKGFLVIIPKVVISLLMVSRGIILFEEHTAAVGTTSNNMFSKRKTLDEGSL

SEQ ID NO: 160345 - protein, 67 aa, Glycine max
  Coding DNA Sequence Number=SeqID_43567
MTKLQPPPNNIVAPSPPRCTHFQCVKESRLEQLDEIQVKAINTSNGKNLPKCPALIFEFTGVAFGSS

SEQ ID NO: 160346 - protein, 86 aa, Glycine max
  Coding DNA Sequence Number=SeqID_43568
MSLDLLIEERELLYKDHLSHPDILPSVAFVDFGGVWFMGTHSIACNDFDHQQRHSYMNYPRSTLFHEASPPTPKSTLLHTCSHHCH

SEQ ID NO: 160347 - protein, 86 aa, Glycine max
  Coding DNA Sequence Number=SeqID_43569
  Subcellular localization annotation: CTP_CleavageSite=32; ConfidenceScore=5.37e-01
MTAKILENEFIMSRLLRTFPRISFRSNSSSSSSSMNSPKNNNLLNTHENQTHEVAPKHNLFDEEVRFRDINQNMDDWNISEIPQDT

SEQ ID NO: 160348 - protein, 366 aa, Glycine max
  Coding DNA Sequence Number=SeqID_43570
  Gene Ontology: Mol. function=protein binding; Biological process=Mo -molybdopterin cofactor biosynthetic process
  Homolog annotation: Hit_ID=Q6D7V6; Match level="QueryCoverage=99%, HitCoverage=94%, E-value=1e-132, Identity=66%"; Hit description =Putative molybdopterin binding protein
  Pfam annotation: Domain name=MoCF_biosynth; Domain location=1-166; Score=154.3; E_value=3.1e-43; Accession=PF00994.14; Description =Probable molybdopterin binding domain
MLSTGDEVLHGQIVDTNAAWLADVLFQHGLPMTSRSTVGDAMSSLVEALQSRSQIADVLIVNGGLGPTSDDLSAQAAATASGSELVLQQAWLEKMEAWFASRGRLMAPSNRKQAEIPANAELIDNPVGTACGFALQLNRCWIFFTPGVPSEFKVMVEQQIIPRLKARFTLPEPPLCLRLTTFGRGESDIAAELEPLPLPEGVVMGYRSSMPIIEIKLTGPASQRVAMEQVWQQVKLLLAECTIFEGFEGLPAVLARELHDRGFRLALSEQYTAGLLHWQLAAAQVPLSAAELLPAREESLEAQVTRTRQLAAQQGTVLAFVDCAAHPGSQLGPAGEIYTRAAQSGNPAESGSDDGDEYAAPLAARQ

SEQ ID NO: 160349 - protein, 219 aa, Glycine max
  Coding DNA Sequence Number=SeqID_43571
  Gene Ontology: Mol. function=transferase activity, transferring glycosyl groups; Cellular component=periplasmic space; Biological process=carbohydrate biosynthetic process
  Homolog annotation: Hit_ID=Q8ZPB3; Match level="QueryCoverage=99%, HitCoverage=39%, E-value=1e-86, Identity=69%"; Hit description =Glucans biosynthesis protein D precursor
  Pfam annotation: Domain name=MdoG; Domain location=34-219; Score= -268.3; E_value=0.0065; Accession=PF04349.3; Description=Periplasmic glucan biosynthesis protein, MdoG
MALSAVSGMTGLSSLFAQSAWADDGIADGTAVRFDFDVLKKKAAALAKQPWGGAPGPLPATLANLTPQAYNEIQYDANHSLWNNIADRELDVQFFHVGMGFKRRIRMFSVDAASREAREIHFRPELFNYHNANVDTQQLVGKTDLGFAGFRAFKKPELARRDIVSFLGASYFRAVDETYQYGLSARGVAVNTFSNGQEEFPDFTAFWFETPKAEDTTFV

SEQ ID NO: 160350 - protein, 265 aa, Glycine max
  Coding DNA Sequence Number=SeqID_43572
  Gene Ontology: Mol. function=transferase activity, transferring glycosyl groups; Cellular component=periplasmic space; Biological process=carbohydrate biosynthetic process
  Homolog annotation: Hit_ID=Q8ZPB3; Match level="QueryCoverage=64%, HitCoverage=31%, E-value=2e-74, Identity=74%"; Hit description =Glucans biosynthesis protein D precursor
MEIPTTGETLDNIVCFWQPAEPVKAGSEFNFQYKLYWSQLPPVRSGLARVDATRTGIGGFPEGWAPGEHFPDQWCRRFAIDFIGGDLQAAAPKGIEPVITVSSGTFKQVEILYVEPLKGYRILFDWYPNSDSTKPVDMRLFLRTKDETLSETWLYQYFPPPPDQRNPGDHKNLPDAPARTDTPPAAASAVRSCSAPAPSADNPVSGRAPLPTQSPDQWSPAKKPARASGDAHRPAVCHQESPADGGYQPSNPGHLYPDTDRPVRR

SEQ ID NO: 160351 - protein, 548 aa, Glycine max
  Coding DNA Sequence Number=SeqID_43573
  Gene Ontology: Mol. function=oxidoreductase activity, acting on NADH or NADPH; Cellular component=integral to membrane; Biological process=ATP synthesis coupled electron transport
  Homolog annotation: Hit_ID=Q7CJ84; Match level="QueryCoverage=77%, HitCoverage=87%, E-value=0.0, Identity=77%"; Hit description=NADH -quinone oxidoreductase chain N
  Pfam annotation: Domain name=Oxidored_q1; Domain location=62-342; Score=327.6; E_value=2.1e-95; Accession=PF00361.10; Description=NADH- Ubiquinoneplastoquinone (comple
MDVTPLLRVDGYSMFYTALVMLASLATCTFAYPWLAGFPDNKDEFYLLVLIAALGGIVLASANHLAALFIGIELLSLPLFGLIGYAFRQKRSLEAALKYMILSAAASSFLIFGIALVYADSGSLSFVQLGKSLNDSMIQQPLLLVGLGMMIIGLGFKLSLVPFHLWTPDVYQGAPAPVSTFLATASKIAIFAVIMRLFMYAPVTDSEAVRTVLGVIAFVSILFGNLMAISQSNIKRLLGYSSIAHLGYLLVALIAVKTHQLSLETAGVYLAGYLFSSLGAFGVVSLMSSPYRGPDADTLYSYRGLFWHRPILSAVMTVMMLSLAGIPMTLGFIGKFYVIASGVNAHLWWLTAAVVAGSAIGLYYYLRVTVSLYLSPPELHTRDTPANWAFTAGGVVVLISAILVLLLGVYPQPLITLVQLAQPLIQGSMMDMQWLDCHHSELTAQQLYTVLALRNQVFIVEQACPYQDIDGQDLTADNRHLLGFLDGKLLAYARLLTPALASSPVTIGAEQLRTALAAAGGVSVRAGASGRFLWSPGLPGSHGRLSGR

SEQ ID NO: 160352 - protein, 140 aa, Glycine max
  Coding DNA Sequence Number=SeqID_43574
  Gene Ontology: Mol. function=sequence-specific DNA binding; Cellular component=intracellular; Biological process=regulation of transcription, DNA-dependent
  Homolog annotation: Hit_ID=UPI00006BD227; Match level="QueryCoverage =96%, HitCoverage=48%, E-value=1e-19, Identity=41%"; Hit description =transcriptional regulator
MKVSFERVLPNEKSSFRTLHNNSPISEFKWEYHYHPEIELVCVISGSGTRHVGYHKSNYSNGDLVLIGSNIPHSGFGLNSIDPHEEIVLQFREEILQFPEQEIEARSVKNLLELSKYGIHFSPATKNALLPKLKKMLETE

SEQ ID NO: 160353 - protein, 119 aa, Glycine max
  Coding DNA Sequence Number=SeqID_43575
MERSMINATSGGALGDMTPIEARNLIEKMASNPQQFSERNDVIVLRGVHEVVTDSSSSTENKKLEGKIDALVNLQSGVNEQPEAYAANIHNRPPQQQNQQNNYDLSAIDTIQVGGIIQI

SEQ ID NO: 160354 - protein, 218 aa, Glycine max
  Coding DNA Sequence Number=SeqID_43576
YVGARASLLSTTPPFVAMTQELIRGDTLWLFAPFCHPEAAGPMTSRDQVWSFCTHDTRRYLMVIRTLLSSRGGGPDDKQRPKTKFGHSAPMIRGDTLWLFAPFCHPEAAGPMTSRDQVWSFCTHDTRRYLMVIRTLLSSRGGGPDDKQRPQTKFGHSAPLYHPEAAGPMIRGDTLRLFTPFCHPEAAGPMTSRNQVWSFCTLVSSRGGGPDDTRKYPS

SEQ ID NO: 160355 - protein, 335 aa, Glycine max
  Coding DNA Sequence Number=SeqID_43577
  Gene Ontology: Mol. function=ATPase activity, coupled to transmembrane movement of substances; Cellular component=membrane; Biological process=transport
  Homolog annotation: Hit_ID=Q2Y6D5; Match level="QueryCoverage=73%, HitCoverage=90%, E-value=8e-80, Identity=59%"; Hit description=ABC-2
PAEFRVEPRAELQQGRHAPLDLDRSRGGLQGAADDLQQRRLARPVAADDADRVAAPHFEIDALQRPELVVIWKHLVTPLTRMATSLEGSEDIGKPPAHFLERRETEPRDKRGAYCVLAQPYEVRDMAPQQDLTCLFDDERERVEIDVRLQRLRQCLHRIQHRCHEQHHRGDDAGDLADVTQVDTQCRQQPGHAHGADHQREDHHRQPQCGQRDRAAQEQLGDQQDHHRNHRMEQRGAHRDPRQGLQREHDTLHVAGTVEYQPRGAVDALGEHAVDDDADEQDDGEITMAAGFHAPARLEHHRENEGVDRQHQQWIEEGQRQPEDRTSIPADDLTL

SEQ ID NO: 160356 - protein, 95 aa, Glycine max
  Coding DNA Sequence Number=SeqID_43578
MWHLQSSFFLLHSAAIDLQEAKDSIDEEDPRPTSSTWSYITTTNPLSELDSAKWIIGREDQYGNSKSVERGRKVLSELAFFNMKYAYFARQNLLR

SEQ ID NO: 160357 - protein, 128 aa, Glycine max
  Coding DNA Sequence Number=SeqID_43579
MNGQTSQLEEVLTQFMEASISTNKNIEASIKKLEMQVEQLDRQLEEKSNNEDCKDVVTRGVFKETLPKEIPYPLNPSKVDKQWQYAHFVDTLSRLQLNLPFLEALEQFSSYAKFMKEFDAILPRKGIG

SEQ ID NO: 160358 - protein, 138 aa, Glycine max
  Coding DNA Sequence Number=SeqID_43580
  Gene Ontology: Cellular component=chloroplast
  Homolog annotation: Hit_ID=P03938; Match level="QueryCoverage=43%, HitCoverage=45%, E-value=7e-10, Identity=86%"; Hit description =Hypothetical 14 kDa protein ycf68
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKSGAPNNVSSQTKNYEIAPFILE

SEQ ID NO: 160359 - protein, 142 aa, Glycine max
  Coding DNA Sequence Number=SeqID_43581
  Subcellular localization annotation: CTP_CleavageSite=37; ConfidenceScore=5.17e-01
MHTQSFTIPQFPKIGLTHKNIPQWSRQLSQHALLRAREARLSGALSKGGNMRGVATHVYLWKTSEKPKETGRKEKFQVRKLYLRLRKVNKSGALAPTYPPSKRKSDLRSSFLGVNQAILFTWKVIILRRWTLKMIHLLGKKN

SEQ ID NO: 160360 - protein, 57 aa, Glycine max
  Coding DNA Sequence Number=SeqID_43582
MAKKPVENMPFDITSDEPMKSMSLSSSSNAYNVPWVEKYRPIKVADIVVNEDAISRK

SEQ ID NO: 160361 - protein, 70 aa, Glycine max
  Coding DNA Sequence Number=SeqID_43583
  Subcellular localization annotation: CTP_CleavageSite=47; ConfidenceScore=5.52e-01
MACSLLVSSPLAKMHIPMGPRVSTLCSSTMTKFSIFFMMVLKFLPLLATAMAGIWESSLGRQSMLDGVVK

SEQ ID NO: 160362 - protein, 76 aa, Glycine max
  Coding DNA Sequence Number=SeqID_43584
MFPPGKMPRKGVFRPYCWICPAVTIWSNFSSYKYVQGKSDLPKSAPDCQIPHLRLSFNPASFKFKGNSTFPNAKVT

SEQ ID NO: 160363 - protein, 266 aa, Glycine max
  Coding DNA Sequence Number=SeqID_43585
  Gene Ontology: Mol. function=dopamine beta-monooxygenase activity; Cellular component=integral to membrane; Biological process =histidine catabolic process
  Homolog annotation: Hit_ID=Q1SA84; Match level="QueryCoverage=99%, HitCoverage=100%, E-value=1e-101, Identity=69%"; Hit description =Cytochrome b561 / ferric reductase transmembrane
  Pfam annotation: Domain name=Cytochrom_B561; Domain location=33-218; Score=-68.8; E_value=0.011; Accession=PF03188.6; Description =Cytochrome b561
MPILCKPVYIVVTSFYVYVLQFSDCLAYEEEHHSSSHKSTNNKVYKVNQQKTSDIAVHGLLLWASTGFLMPLGILIIKGSIKAEPGSRRSKVLFYLHVGFQMLSVLLATVGAAMSLKKFENSFDNSHQKLGLALYGAILVQGLIGFFRPHRGKKERSYWYLLHWILGTIVSLVGIINIYTGLKAYHKRTLKSTALWTILFTVEVSFIGLVYLFQDKLEYMKKQGVIIGSESSIVSSNQDIPQSQTQKELLPVACGRKRNALENLFD

SEQ ID NO: 160364 - protein, 96 aa, Glycine max
  Coding DNA Sequence Number=SeqID_43586
MENNFTHIDDEVVVKAKTIRLAPAGLTFRFLIVMLWIHHHCHYHNVDKLIISVAMTLTSSIAPKQSNDVWRQRWLKHSDSTVIRRHGHDYYFHLHH

SEQ ID NO: 160365 - protein, 147 aa, Glycine max
  Coding DNA Sequence Number=SeqID_43587
MASKRERILKATWLKKETGKEERLFHLNIAAPRSVKLWEWNQKFRTAPPRLDYWVTYIMVGPALSPAWVLAWGCQMKRNIFVNLHIGATLPESADFRTSEFKCEEFGRRRSLLKTKREFSGFWDLGKKMATTNSDRKDCWGKVADPV

SEQ ID NO: 160366 - protein, 121 aa, Glycine max
  Coding DNA Sequence Number=SeqID_43588
  Gene Ontology: Mol. function=DNA binding; Cellular component=nucleus; Biological process=regulation of transcription, DNA-dependent
  Homolog annotation: Hit_ID=P40620; Match level="QueryCoverage=56%, HitCoverage=46%, E-value=2e-12, Identity=43%"; Hit description =HMG1/2-like protein
  Pfam annotation: Domain name=HMG_box; Domain location=38-102; Score =43.0; E_value=1e-09; Accession=PF00505.9; Description=HMG (high mobility group) box
MFICSTAAEPCVVAIFNNQLLLSYMESLIFKIVMFTGSSFSFLREDFRKEFQEQNPDVKSMRDIGKACGEKWKTMTYEEKVQYYDIATKKREEFDSAMAEFNKKMENGEFDETDDESEFDE

SEQ ID NO: 160367 - protein, 55 aa, Glycine max
  Coding DNA Sequence Number=SeqID_43589
  Subcellular localization annotation: CTP_CleavageSite=38; ConfidenceScore=5.62e-01
MAKKAKGSHSASSASASSSSEYPFLFTFSFFLNLHSLLCSVSFSLCSPMEPRKGM

SEQ ID NO: 160368 - protein, 130 aa, Glycine max
  Coding DNA Sequence Number=SeqID_43590
  Pfam annotation: Domain name=GnsAB; Domain location=58-117; Score =8.8; E_value=0.056; Accession=PF08178.2; Description=GnsAGnsB family
  Subcellular localization annotation: CTP_CleavageSite=28; ConfidenceScore=5.05e-01
LSECLVLSPKTSLHFNSLELGLARMLVVATYPSAGGRRVTRGMRVPRKEYARSRHQRLFEENVGKTGKDAIYELFSEKVRELYLRTGKERNVKAFGPLTISWGGRQKRGFCSYVSSIAMRKSDLRSSCKS

SEQ ID NO: 160369 - protein, 42 aa, Glycine max
  Coding DNA Sequence Number=SeqID_43591
MKQDSVQNNSCRHQIATISDMYLQPPSSNAKVTKAIVDKLHK

SEQ ID NO: 160370 - protein, 181 aa, Glycine max
  Coding DNA Sequence Number=SeqID_43592
MISEEGQLCEHNQRRRLSCSYYAYRDKILLKPLQGDERGSCTPLQLLSPLAEVSVGLCRHNVGIMPTRHQVDPEKSNRTLGFSISGYRPLSILQGARPPTRSCHRDIGKIAPARHPVDPKKSNRILGFPTLITGLCQFYGVPVAPTRSSDSLLTELLSRSIVSPDRHRVRHHSSQGMADSG

SEQ ID NO: 160371 - protein, 139 aa, Glycine max
  Coding DNA Sequence Number=SeqID_43593
  Gene Ontology: Mol. function=translation initiation factor activity; Biological process=regulation of transcription, DNA-dependent
  Homolog annotation: Hit_ID=Q8RU47; Match level="QueryCoverage=75%, HitCoverage=53%, E-value=4e-19, Identity=42%"; Hit description =Putative Transcription initiation factor IIE, beta subunit
MGKMDIESATHASANGRNVAPTVKFSNDTERLQHINSICKALVGAQMKRVIDLLLESKYGIKDKTELLQLVRKYPEGLAVIDLKDAYPTVMEDLQTLAACLGAFEEPNIIHVDDIVDPVRDLEVITKELRLKFAKHVLF

SEQ ID NO: 160372 - protein, 910 aa, Glycine max
  Coding DNA Sequence Number=SeqID_43594
  Gene Ontology: Mol. function=transmembrane receptor protein serine/threonine kinase activity; Cellular component=integral to membrane; Biological process=protein amino acid phosphorylation
  Homolog annotation: Hit_ID=Q9FL28; Match level="QueryCoverage=96%, HitCoverage=97%, E-value=0.0, Identity=36%"; Hit description =Receptor protein kinase
  Pfam annotation: Domain name=LRRNT_2; Domain location=3-43; Score =54.8; E_value=2.9e-13; Accession=PF08263.3; Description=Leucine rich repeat N-terminal domain
  Pfam annotation: Domain name=LRR_1; Domain location=120-143; Score =14.7; E_value=0.35; Accession=PF00560.23; Description=Leucine Rich Repeat
  Pfam annotation: Domain name=LRR_1; Domain location=144-166; Score =2.4; E_value=1e+02; Accession=PF00560.23; Description=Leucine Rich Repeat
  Pfam annotation: Domain name=LRR_1; Domain location=192-214; Score =12.5; E_value=1.3; Accession=PF00560.23; Description=Leucine Rich Repeat
  Pfam annotation: Domain name=LRR_1; Domain location=216-238; Score =12.3; E_value=1.4; Accession=PF00560.23; Description=Leucine Rich Repeat
  Pfam annotation: Domain name=LRR_1; Domain location=240-262; Score =10.5; E_value=3.1; Accession=PF00560.23; Description=Leucine Rich Repeat
  Pfam annotation: Domain name=LRR_1; Domain location=264-286; Score =11.4; E_value=2.1; Accession=PF00560.23; Description=Leucine Rich Repeat
  Pfam annotation: Domain name=LRR_1; Domain location=330-352; Score =13.7; E_value=0.66; Accession=PF00560.23; Description=Leucine Rich Repeat
  Pfam annotation: Domain name=LRR_1; Domain location=354-376; Score =7.4; E_value=12; Accession=PF00560.23; Description=Leucine Rich Repeat
  Pfam annotation: Domain name=LRR_1; Domain location=396-418; Score =8.5; E_value=7.4; Accession=PF00560.23; Description=Leucine Rich Repeat
  Pfam annotation: Domain name=LRR_1; Domain location=420-442; Score =15.4; E_value=0.2; Accession=PF00560.23; Description=Leucine Rich Repeat
  Pfam annotation: Domain name=LRR_1; Domain location=444-465; Score =4.7; E_value=38; Accession=PF00560.23; Description=Leucine Rich Repeat
  Pfam annotation: Domain name=LRR_1; Domain location=506-529; Score =11.5; E_value=2; Accession=PF00560.23; Description=Leucine Rich Repeat
  Pfam annotation: Domain name=LRR_1; Domain location=531-553; Score =1.1; E_value=1.8e+02; Accession=PF00560.23; Description=Leucine Rich Repeat
  Pfam annotation: Domain name=LRR_1; Domain location=555-576; Score =16.2; E_value=0.12; Accession=PF00560.23; Description=Leucine Rich Repeat
  Pfam annotation: Domain name=LRR_1; Domain location=578-601; Score =10.3; E_value=3.4; Accession=PF00560.23; Description=Leucine Rich Repeat
  Pfam annotation: Domain name=LRR_1; Domain location=72-94; Score =13.7; E_value=0.68; Accession=PF00560.23; Description=Leucine Rich Repeat
  Pfam annotation: Domain name=LRR_1; Domain location=96-118; Score =15.0; E_value=0.27; Accession=PF00560.23; Description=Leucine Rich Repeat
  Pfam annotation: Domain name=Pkinase; Domain location=681-870; Score=- 41.2; E_value=4.1e-06; Accession=PF00069.15; Description=Protein kinase domain
  Pfam annotation: Domain name=Pkinase_Tyr; Domain location=681-870; Score=-119.4; E_value=3.8e-05; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =3-43::...
  Pfam module annotation: Domain location=120-143::144-166::192 -214::216-238::240-262::264-286::330-352::354-376::396-418::420 -442::444-465::506-529::531-553::555-576::578-601::72-94::96-118::681- 870::681-870
MGFDVEIQALKAFKNSITADPNGALADWVDSHHHCNWSGIACDPSSNHVFSVSLVSLQLQGEISPFLGNISGLQVLDLTSNSFTGYIPAQLSLCTHLSQLSLFGNSLSGPIPPELGHLKSLQYLDLGYNFLNGSLPDSIFNYTYLLGIAFTFNNLTGRIPSNIGNLVNATQILGYGNNLVGSIPLSIGQLGALRALNFSQNKLSGVIPREIGNLTNLEYLLLFQNSLSGKIPSEVAKCSKLLNLELYENQFIGSIPPELGNIVQLETLRLYRNNLNSTIPSSIFQMKSSNPAFKCIYWEDPFINNKLDISVNEPESSFGELPSNLGDLHNLKSLILGDNFFHGSIPPSIANCTSLVNVTMSVNALSGKIPEGFSSLSLAMNNFSGLIKSGIQNLSKLIRLQLNVNSFIGSIPPKIGNLNELVTLSLSENKFSGQIPPELSKLSRLQGLSLHENLLEAFSFGLSHNQITGSIPRYVIACFQDMQIYLNLSYNQLVGNVPTELGMLEMIQAIDISDNNLAGPIPAKAFSHMDLLESLNLSRYHLEGKILGTLAELDRLSSLDLSQNDLKGIPEGFANLSGLVHLNLSFNQLEGPVPKTGIFEHINASSMMGNQDLCGANFLWPCKEAKHSLSKKCISIIAALGSLAILLLLVLVILILNRDYNSALTLKRFNPKELEIATGFFSADSIVGTSSLSTVYKGQMEDDGQVVAVLGYAWESGKMKALVQEYMENGNLNRIIHDKGVDQSVISRWILSERGEWEAHLSDFGTARILGLHLQDGSTLSSLAVLQGTVGYMASEFSYMRKVTTKADVFSFGIIVMEFLTKRRPTGLSEEDGLPITLREKCPELIKLSLCCTLPDPEHRPNMNEGLDGLEILGKRTGLLEEVHSCIGRDNSGFHCIEGRWENPKCFHVS

SEQ ID NO: 160373 - protein, 1163 aa, Glycine max
  Coding DNA Sequence Number=SeqID_43595
  Gene Ontology: Mol. function=transmembrane receptor protein serine/threonine kinase activity; Cellular component=integral to membrane; Biological process=protein amino acid phosphorylation
  Homolog annotation: Hit_ID=Q9FL28; Match level="QueryCoverage=97%, HitCoverage=97%, E-value=0.0, Identity=51%"; Hit description =Receptor protein kinase
  Pfam annotation: Domain name=LRRNT_2; Domain location=27-67; Score =56.9; E_value=6.9e-14; Accession=PF08263.3; Description=Leucine rich repeat N-terminal domain
  Pfam annotation: Domain name=LRR_1; Domain location=120-142; Score =15.8; E_value=0.16; Accession=PF00560.23; Description=Leucine Rich Repeat
  Pfam annotation: Domain name=LRR_1; Domain location=144-166; Score =17.1; E_value=0.065; Accession=PF00560.23; Description=Leucine Rich Repeat
  Pfam annotation: Domain name=LRR_1; Domain location=168-190; Score =1.8; E_value=1.3e+02; Accession=PF00560.23; Description=Leucine Rich Repeat
  Pfam annotation: Domain name=LRR_1; Domain location=216-238; Score =13.1; E_value=0.99; Accession=PF00560.23; Description=Leucine Rich Repeat
  Pfam annotation: Domain name=LRR_1; Domain location=240-262; Score =14.9; E_value=0.29; Accession=PF00560.23; Description=Leucine Rich Repeat
  Pfam annotation: Domain name=LRR_1; Domain location=264-286; Score =17.7; E_value=0.042; Accession=PF00560.23; Description=Leucine Rich Repeat
  Pfam annotation: Domain name=LRR_1; Domain location=288-310; Score =5.6; E_value=25; Accession=PF00560.23; Description=Leucine Rich Repeat
  Pfam annotation: Domain name=LRR_1; Domain location=312-334; Score =12.4; E_value=1.4; Accession=PF00560.23; Description=Leucine Rich Repeat
  Pfam annotation: Domain name=LRR_1; Domain location=336-358; Score =13.8; E_value=0.62; Accession=PF00560.23; Description=Leucine Rich Repeat
  Pfam annotation: Domain name=LRR_1; Domain location=360-382; Score =16.1; E_value=0.13; Accession=PF00560.23; Description=Leucine Rich Repeat
  Pfam annotation: Domain name=LRR_1; Domain location=384-406; Score =8.6; E_value=7; Accession=PF00560.23; Description=Leucine Rich Repeat
  Pfam annotation: Domain name=LRR_1; Domain location=408-430; Score =11.2; E_value=2.3; Accession=PF00560.23; Description=Leucine Rich Repeat
  Pfam annotation: Domain name=LRR_1; Domain location=432-454; Score =14.2; E_value=0.46; Accession=PF00560.23; Description=Leucine Rich Repeat
  Pfam annotation: Domain name=LRR_1; Domain location=456-478; Score =7.7; E_value=10; Accession=PF00560.23; Description=Leucine Rich Repeat
  Pfam annotation: Domain name=LRR_1; Domain location=480-502; Score =13.2; E_value=0.94; Accession=PF00560.23; Description=Leucine Rich Repeat
  Pfam annotation: Domain name=LRR_1; Domain location=504-526; Score =15.2; E_value=0.25; Accession=PF00560.23; Description=Leucine Rich Repeat
  Pfam annotation: Domain name=LRR_1; Domain location=528-550; Score =11.3; E_value=2.2; Accession=PF00560.23; Description=Leucine Rich Repeat
  Pfam annotation: Domain name=LRR_1; Domain location=552-574; Score =13.3; E_value=0.86; Accession=PF00560.23; Description=Leucine Rich Repeat
  Pfam annotation: Domain name=LRR_1; Domain location=576-598; Score =12.9; E_value=1.1; Accession=PF00560.23; Description=Leucine Rich Repeat
  Pfam annotation: Domain name=LRR_1; Domain location=600-623; Score =15.5; E_value=0.19; Accession=PF00560.23; Description=Leucine Rich Repeat
  Pfam annotation: Domain name=LRR_1; Domain location=650-672; Score =11.3; E_value=2.2; Accession=PF00560.23; Description=Leucine Rich Repeat
  Pfam annotation: Domain name=LRR_1; Domain location=674-697; Score =17.9; E_value=0.038; Accession=PF00560.23; Description=Leucine Rich Repeat
  Pfam annotation: Domain name=LRR_1; Domain location=699-721; Score =12.4; E_value=1.4; Accession=PF00560.23; Description=Leucine Rich Repeat
  Pfam annotation: Domain name=LRR_1; Domain location=72-93; Score=0.9; E_value=1.9e+02; Accession=PF00560.23; Description=Leucine Rich Repeat
  Pfam annotation: Domain name=LRR_1; Domain location=723-745; Score =16.6; E_value=0.093; Accession=PF00560.23; Description=Leucine Rich Repeat
  Pfam annotation: Domain name=LRR_1; Domain location=747-770; Score =12.9; E_value=1.1; Accession=PF00560.23; Description=Leucine Rich Repeat
  Pfam annotation: Domain name=LRR_1; Domain location=96-118; Score =8.6; E_value=6.9; Accession=PF00560.23; Description=Leucine Rich Repeat
  Pfam annotation: Domain name=Pkinase; Domain location=866-1154; Score= 105.6; E_value=1.5e-28; Accession=PF00069.15; Description=Protein kinase domain
  Pfam annotation: Domain name=Pkinase_Tyr; Domain location=866-1154; Score=25.7; E_value=4.8e-14; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR _1::Pkinase::Pkinase_Tyr; Domain location=27-67::120-142::144 -166::168-190::216-238::240-262::264-286::288-310::312-334::336 -358::360-382::384-406::408-430::...
  Pfam module annotation: Domain location=432-454::456-478::480 -502::504-526::528-550::552-574::576-598::600-623::650-672::674 -697::699-721::72-93::723-745::747-770::96-118::866-1154::866-1154
MLSLKISLTIGIVLSIASIVSHAETSLDVEIQALKAFKNSITADPNGALADWVDSHHHCNWSGIACDPPSNHVISISLVSLQLQGEISPFLGNISGLQVFDVTSNSFSGYIPSQLSLCTQLTQLILVDNSLSGPIPPELGNLKSLQYLDLGNNFLNGSLPDSIFNCTSLLGIAFNFNNLTGRIPANIGNPVNLIQIAGFGNSLVGSIPLSVGQLAALRALDFSQNKLSGVIPREIGNLTNLEYLELFQNSLSGKVPSELGKCSKLLSLELSDNKLVGSIPPELGNLVQLGTLKLHRNNLNSTIPSSIFQLKSLTNLGLSQNNLEGTISSEIGSMNSLQVLTLHLNKFTGKIPSSITNLTNLTYLSMSQNLLSGELPSNLGALHDLKFLVLNSNCFHGSIPSSITNITSLVNVSLSFNALTGKIPEGFSRSPNLTFLSLTSNKMTGEIPNDLYNCSNLSTLSLAMNNFSGLIKSDIQNLSKLIRLQLNGNSFIGPIPPEIGNLNQLVTLSLSENTFSGQIPPELSKLSHLQGISLYDNELQGTIPDKLSELKELTELLLHQNKLVGQIPDSLSKLEMLSYLDLHGNKLNGSIPRSMGKLNHLLALDLSHNQLTGIIPGDVIAHFKDIQMYLNLSYNHLVGNVPTELGMLGMIQAIDISNNNLSGFIPKTLAGCRNLFNLDFSGNNISGPIPAEAFSHMDLLESLNLSRNHLKGEIPEILAELDRLSSLDLSQNDLKGTIPEGFANLSNLVHLNLSFNQLEGHVPKTGIFAHINASSIVGNRDLCGAKFLPPCRETKHSLSKKSISIIASLGSLAMLLLLLILVLNRGTKFCNSKERDASVNHGPDYNSALTLKRFNPNELEIATGFFSADSIIGASSLSTVYKGQMEDGRVVAIKRLNLQQFSAKTDKIFKREANTLSQMRHRNLVKVLGYAWESGKMKALVLEYMENGNLENIIHGKGVDQSVISRWTLSERVRVFISIASALDYLHSGYDFPIVHCDIKPSNILLDREWEAHVSDFGTARILGLHEQAGSTLSSSAALQGTVGYMAPEFAYMRKVTTKADVFSFGIIVMEFLTKRRPTGLSEEEGLPITLREVVAKALANGIEQFVNIVDPLLTWNVTKEHDEVLAELFKLSLCCTLPDPEHRPNTNEVLSALVKLQTTLSC

SEQ ID NO: 160374 - protein, 217 aa, Glycine max
  Coding DNA Sequence Number=SeqID_43596
MDNKIRPLSVSSHSNFFSSLKQVEKRLKLDQTLQPAIESQIQESTLGSPIFLQSSGSQICPSQDSSEPPQAFLSVSQEFPTINQDPSHSQTDHITSANEAEDNDDDDDIEQLMQLLGLSEVKEQRDGDFDEGDSCHCDGGFYAKIVGVEGPKCRKEVLRLDGWINHFMNGGGEEKQEPLRLAHLLLGKSAFVSDGAFGELDFPSTIQEFLHTDPPTD

SEQ ID NO: 160375 - protein, 71 aa, Glycine max
  Coding DNA Sequence Number=SeqID_43597
MARLACISGFWLSASLLAQRGVLQEILLCTQPTMVTLSGLLAQRMNWLSELTISTLYQSCLFHLKLIWKDH

SEQ ID NO: 160376 - protein, 155 aa, Glycine max
  Coding DNA Sequence Number=SeqID_43598
MKIFQSNKEGARKKKPNDLEVNLKNENIITFTKNFMKVRRGMPLNFIFSICLKTRKKDNPIVMTIFVATAIRVNEKAILEIEESFHLAFFGGEKRCIKAAEATRAIAIEFVTMNAFKRLFAPKIGLPLCSPSCMVPPSGVISTTKLTVAIVTTNR

SEQ ID NO: 160377 - protein, 197 aa, Glycine max
  Coding DNA Sequence Number=SeqID_43599
  Gene Ontology: Mol. function=transferase activity, transferring glycosyl groups; Cellular component=chloroplast; Biological process =glucan biosynthetic process
  Homolog annotation: Hit_ID=Q9XGC1; Match level="QueryCoverage=84%, HitCoverage=18%, E-value=4e-84, Identity=91%"; Hit description =Starch synthase, isoform V
MQGGHGLHSTLSAHSKKFIGILNGIDTDAWNPATDAFLPVQYNATDLQGKAENKQALRRNLGLSSTDVRRPLVGCITRLVPQKGVHLIRHAIYLTLELGGQFVLLGSSPVPHIQNEFEGIANHFQNHDHIRLILKYDESLSHVIYAASDMFIIPSIFEPCGLTQVTSNGTRWSTSELRADIRKGLDSDLGTRPGVSE

SEQ ID NO: 160378 - protein, 66 aa, Glycine max
  Coding DNA Sequence Number=SeqID_43600
MVLWYTFHTLPPPLLSPTTPYQHDGEANMLGGKKDSVVALLQLRIVGSRKKKATRNRDDLRQREEW

SEQ ID NO: 160379 - protein, 753 aa, Glycine max
  Coding DNA Sequence Number=SeqID_43601
  Gene Ontology: Mol. function=transferase activity, transferring glycosyl groups; Cellular component=nucleus; Biological process =glucan biosynthetic process
  Homolog annotation: Hit_ID=Q9XGC1; Match level="QueryCoverage=82%, HitCoverage=71%, E-value=0.0, Identity=77%"; Hit description=Starch synthase, isoform V
  Pfam annotation: Domain name=Glyco_transf_5; Domain location=493-734; Score=365.5; E_value=8.4e-107; Accession=PF08323.2; Description =Starch synthase catalytic domain
  Subcellular localization annotation: CTP_CleavageSite=48; ConfidenceScore=5.31e-01
MASKLRTCFVCWNLSGFNCVNHHNANNNWVVRVSFPASCKMRHRATFSSQHKRQQIKPSAEGGLRQNQDEEDDTEVSLNNDDSVENLNDATAPLAININGAEQAEQLSGRQLEDLLVMIKNAEKNILLLNEARIRACEDLEKILVEKEALQGEINVLETRLAETDARITVANQEKIHVEFLEGQLEKLRNELAQKGSTERKYAELHDLQNDDLSDANPLSHNVSIHSLTEELNSLRAENASLKNAIESFKTQLSDVKNNDERLVALEKERSSLESALKDLESKLSISQDGVSQISTLTVECKDLWDKVENLQSLLDKATKQADQAVLVLQQNQDLRRKVDKLEASLEEANIYKLSSDKLQKYNELMQQKIKLLEDRLQKSDEEINSYVWLYQQSVKEFQDTLDTLKKESKKRNLEEPVEDMPWEFWSQLLLLIDGWTLENKISVDDASLLREKVWKRDRRISDTYIACKKQTEQEAISAFLGLLSSATSPGLHVIHIAAEMAPVAKVGGLGDVVSGLGKALQKKGHLVEIVLPKYDCMQYDRVCDLRALDVLIDSYFDRQLYKNKIWVGTIEGLPVYFIEPHHPDKFFWRGKFYGEHDDFRRFSFFSRAALEFLLQAGKKPDIIHCHDWQTAFIAPLYWDIYAPKGLNSARICFTCHNFEYQGTAAASELESCGLESHHLNRPDRMQDNSAHDRVNSVKGGIVFSNIVTTVSPTYAQEVRTSEESWSLTWYLSLYEQVVKKLIFAASVFPIKQ

SEQ ID NO: 160380 - protein, 383 aa, Glycine max
  Coding DNA Sequence Number=SeqID_43602
  Gene Ontology: Mol. function=transferase activity; Cellular component= integral to membrane; Biological process=transport
  Homolog annotation: Hit_ID=Q10MC5; Match level="QueryCoverage=89%, HitCoverage=66%, E-value=1e-164, Identity=73%"; Hit description=O -acetyltransferase, putative, expressed
  Pfam annotation: Domain name=Cas1p; Domain location=1-209; Score =306.7; E_value=4.1e-89; Accession=PF07779.2; Description=Cas1p-like protein
MTHQHFLEKTYFTLIGIKQKSGKDGCSNGSSVQAFVPFVQVLFLMYHYFAATEIYNAIRVFIAAYVWMTGFGNFSYYYVRKDFSLPRFAQMMWRLNFFVAFCCIVLNNDYMLYYICPMHTLFTLMVYGALGIYNKYNEIPSVMAAKILACFLVVILVWEIPGFFDIFWSPFALFLGYTDPAKPDLPRMHEWHFRSGLDRYIWIIGMIYAYFHPNVEKWMEKLEESDTKRRVTIKTGIVSVALFVGYLWYEYIYKLDKVSYNKLHPYTSWIPITWLGKITLETYISQFHIWLRSNMPNGQPKWLLSLIPEYPMLNFMLTTAIYVFVSHRLFELTNTLKTVFIPTKDNRRLLHNFITGVTLCISLYCIALILLLIPHSTVPVTCC

SEQ ID NO: 160381 - protein, 84 aa, Glycine max
  Coding DNA Sequence Number=SeqID_43603
MSNEKIGRIRVVGDGGFGANHAGAASSEIVQSGFGWCVEAKGIRFLSWIESNCVSFLLGVIPVFVSWIYSEYLEYKKLSSPPKV

SEQ ID NO: 160382 - protein, 60 aa, Glycine max
  Coding DNA Sequence Number=SeqID_43604
MSYTLMKIWVIEKRKDHSVDDLLIDGNEGNDNGSVRVQDNDLFVDGDKSNDNIDVTVQGH

SEQ ID NO: 160383 - protein, 63 aa, Glycine max
  Coding DNA Sequence Number=SeqID_43605
MVSYFTLLVPPFLHLATPHAGNNIISPCMTKKGKKEPRSKLKTTDCDGENRSATENNVWPPRK

SEQ ID NO: 160384 - protein, 249 aa, Glycine max
  Coding DNA Sequence Number=SeqID_43606
MAMQNSSYTIILFRELLGAPSNIAGAPSNLLKAFLLSSLFREKAFCLLLFFSARLLRLHLLREACLPFAFEDAGKNGGSLVTVSLPEDPLGVIPELPEEGFFRRCTCSGNIPEEGFSGWPFSGSGSTFRKSLLPELFRKKYFFRKDRAADEDADDVPERRRPTASARRLRVHQMTTEGRDMAEDVADMTDDVPEQPTEAPEMRADAQGADSGEGSDGDDAAEGFPGGPRDPSVLTSFAEHVAHAVWSGQ

SEQ ID NO: 160385 - protein, 79 aa, Glycine max
  Coding DNA Sequence Number=SeqID_43607
MESCKIAILLTIYIMAMLVFAHCCVAENVAEDVAAIPPAPMESAGVHLCASAVFLATAFVVASGLMFVKTELGSGNSSM

SEQ ID NO: 160386 - protein, 111 aa, Glycine max
  Coding DNA Sequence Number=SeqID_43608
MGSEDAKDPFKGVDWKAVGGEMQQNPSAKPALKKRLPKKVREIPEFYFLPRWPLPKAILFCSACIGGGVAAGMLIETWIEKKVKAISDFSNAPKVLPKLSEQLLSWELVTS

SEQ ID NO: 160387 - protein, 354 aa, Glycine max
  Coding DNA Sequence Number=SeqID_43609
  Gene Ontology: Mol. function=transferase activity; Cellular component= chloroplast; Biological process=fatty acid biosynthetic process
  Homolog annotation: Hit_ID=Q9M508; Match level="QueryCoverage=59%, HitCoverage=44%, E-value=1e-106, Identity=91%"; Hit description=Beta- ketoacyl-ACP synthetase I
  Pfam annotation: Domain name=ketoacyl-synt; Domain location=1-139; Score=43.1; E_value=4.1e-10; Accession=PF00109.16; Description=Beta -ketoacyl synthase, N-terminal domain
MGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSTCIQSSLEDAGVSPEEAESGITAYTCGNGYGKVGELSTGGENREKGLEDEGRNGGSQGTKHIHQLPNASAGLSFGIMPTMDDWKLKVQPNKALNIRISIDDIIDVLVMCQKLPDFLLEDKVKMHGGQHGTIANNDPLFPIVPCCKLLGDSLSWQVVIVIEVPVRLFDIALAPRTQMQQELL

SEQ ID NO: 160388 - protein, 314 aa, Glycine max
  Coding DNA Sequence Number=SeqID_43610
  Gene Ontology: Mol. function=transcription regulator activity; Cellular component=nucleus; Biological process=regulation of transcription
  Homolog annotation: Hit_ID=Q1SA72; Match level="QueryCoverage=75%, HitCoverage=100%, E-value=4e-73, Identity=58%"; Hit description =Helix-loop-helix DNA-binding
MYFAITIKRYRAVKEVGQIKMSVGVNQLMLVCQAEYFRQLLKPVTNFLPALVQNNCQLHRLNQHCLLERQSDSTDNIMQTQEYFLPDKMVLPLADEAIDPHMRAPLASAFDAYLPPGVRQITPFERFNVQPSEACPKNFVIFDQTDQRSRIMFHPAMTYKFNSPGLNVHATGSQDFEKNKANQMEREVSSPFEEDPNDIDALLSIGVDELDDFDEEEVSTARTQENYESLSDTCSSYCSKSRKRSSSSSVQKSSGAGGFCHNEGKHWEMKRMVRMLRKIVPGGGNQMDSVAVLDEAVKYLKSLKVEVEQFGVEP

SEQ ID NO: 160389 - protein, 144 aa, Glycine max
  Coding DNA Sequence Number=SeqID_43611
MSKVRAEKPSSEMWKFSQVAGLTIVSVICFTSSSCVELLTDIPMQYNWHQRRLNDVYSSLLLILYYFVGSSIPSAVVLWVMRELPPEEAASIPEESSTIAFVADSSIAIHHPQRWATATSMQNQSEHILLSCLQAELSVSRRIF

SEQ ID NO: 160390 - protein, 85 aa, Glycine max
  Coding DNA Sequence Number=SeqID_43612
MSGFRDTHGFPRPILAVNLALALLHAAVAFLAFFQLLRIHMRNAQLGWTRQKCSSLTVNNNDGVSNATFVRALGYELLVQCVYTV

SEQ ID NO: 160391 - protein, 52 aa, Glycine max
  Coding DNA Sequence Number=SeqID_43613
MVMGSYLLGANYVIGFLDVTIIHQLVTIVRNVFSLEWGHADKHVMGEKPIGK

SEQ ID NO: 160392 - protein, 156 aa, Glycine max
  Coding DNA Sequence Number=SeqID_43614
  Gene Ontology: Mol. function=RNA-directed DNA polymerase activity; Cellular component=signal recognition particle, endoplasmic reticulum targeting; Biological process=RNA-dependent DNA replication
MTFGLTNAPSTFMSSKRISVDEEKVKEIREWPVPKNVNEEIDWVCVHARKARFPAQRKSKLQLRGDRPFQFLEKINDNVYKLDLPRKYGDESNLRTNTYEEGENDEGATSLFNDPLHGIGGTATRFKTKRMKQDLRGLILNIKEKENQCELRAAPN

SEQ ID NO: 160393 - protein, 95 aa, Glycine max
  Coding DNA Sequence Number=SeqID_43615
GSRLQDTQWTRRSPTRSWSCQALITGLCQFYGVLVTSGKGIRPPTNRAFIKKYCVPRQAQGETPQQPGRNTITSRVHLSSSTKRLERCLRPMADQ

SEQ ID NO: 160394 - protein, 213 aa, Glycine max
  Coding DNA Sequence Number=SeqID_43616
  Gene Ontology: Mol. function=pyroglutamyl-peptidase I activity; Biological process=proteolysis
  Homolog annotation: Hit_ID=O73944; Match level="QueryCoverage=90%, HitCoverage=93%, E-value=2e-38, Identity=41%"; Hit description =Pyrrolidone-carboxylate peptidase
  Pfam annotation: Domain name=Peptidase_C15; Domain location=7-209; Score=156.4; E_value=7.3e-44; Accession=PF01470.8; Description =Pyroglutamyl peptidase
MKDKLFVLITGFEKFGGEKINPSENIIKKIRKKKFDNVLIDTIVLPVSYEKSIKILEEYYSKNQVDVAIHLGQAGGRATINLERVAINLMDSIHPDNDNVTLSDKKIIEDGNDAYMTKIKIKELAEFLNKKNIPTSISYTAGQYICNEVYYFSLYNSEKSSNPKFSLFIHVPFLPQQVSEKYPKNDKLPSMPIQLQFKAVMENFAWNTGNFSF

SEQ ID NO: 160395 - protein, 114 aa, Glycine max
  Coding DNA Sequence Number=SeqID_43617
  Gene Ontology: Mol. function=transferase activity, transferring nitrogenous groups; Biological process=biosynthetic process
  Homolog annotation: Hit_ID=Q1H1I3; Match level="QueryCoverage=99%, HitCoverage=28%, E-value=4e-38, Identity=67%"; Hit description =Aminotransferase, class I and II
DDDIVEKFALYRTYHGCAMNPAVQAASIVAWNDEAHVIHNRALYSEKFNAVTPVLQQVWQKTQLPDAAFYLWINTEQDDTVVAKQLYQALNITVLPSSFLAREANGINPDKGFI

SEQ ID NO: 160396 - protein, 166 aa, Glycine max
  Coding DNA Sequence Number=SeqID_43618
  Homolog annotation: Hit_ID=Q1RTB4; Match level="QueryCoverage=33%, HitCoverage=12%, E-value=9e-07, Identity=50%"; Hit description=IMP dehydrogenase/GMP reductase
PSICYKVTARASKKERILSSCEGCPNVPLMGTRGCINYNPVLAIRQLGYPMRGVPSDESIMPFIARGFSDHNARDRELRGSSNGIIGGYHKWLRVRTQGLDWLPNLKTVRDNEVKASEESDQVQALKAKLERARVVKEKFKSIAIKGSNSELKLRRGERNHHGSKA

SEQ ID NO: 160397 - protein, 144 aa, Glycine max
  Coding DNA Sequence Number=SeqID_43619
MAGTFFLLKQQNNLDNYERDATSRLSLYGVSVTSTQGYFKEFTRHGMQCKGRTKSLREVVMGSSTAILRAAREEEAEAPEESEEVQALKAKLEKGQAIKEKFKSTAIKVRRECDELKDINMATAEDLERETKRARKKEHGRNKF

SEQ ID NO: 160398 - protein, 146 aa, Glycine max
  Coding DNA Sequence Number=SeqID_43620
MEMFIHSIDPDAWNSIFKGPFIPTKDLNGELVPKEWDEMKDDEKRKVQDDKKAKDILTFGEKLRRRYGKCLKSLMNVEARLHDECDSKMMTKVMNKKLKDQRTTKVNQRTIQEFKNQEEFKTQGESLESRIKIQDSRSQESRSRFK

SEQ ID NO: 160399 - protein, 82 aa, Glycine max
  Coding DNA Sequence Number=SeqID_43621
SMWDNWQNNWQTDPLSNFGANREKNPKEECKAVMTRSKMVSMNEGEKRIGEEKQQLVTEPKIDLVVEPLSETEEEVEAEDDQ

SEQ ID NO: 160400 - protein, 246 aa, Glycine max
  Coding DNA Sequence Number=SeqID_43622
  Gene Ontology: Mol. function=DNA binding
  Homolog annotation: Hit_ID=Q1RUD8; Match level="QueryCoverage=72%, HitCoverage=43%, E-value=2e-14, Identity=28%"; Hit description=IMP dehydrogenase/GMP reductase
KHLEEKAKALADQGEWTSFIDVLALLVFGFILFPNVDGLVDLATIDVFLAYHYSKESPAIVVLADAYDMFDQRCEKSSARIDCCTPALYVWLVAHIFHHESRPVCHIQGHRMCAEKGKANWEQLLVGFPNVPLMGMRGAPSEESITPFIARGFSDPNARMLQRVRKAWNAVQRKDKELKGSSNGIIGEYHKWLKARMREISWLPKLKISSGEEAKVPEESEEVLALKAELERTRVVKEKFKTIAIR

SEQ ID NO: 160401 - protein, 109 aa, Glycine max
  Coding DNA Sequence Number=SeqID_43623
  Gene Ontology: Cellular component=chloroplast
MNGAKRSAEAVGCKKESVGERSALEGRTRASSAGRSGSENVGLSNANVGENPMPRKPKGSSARVIRGRENASSQSSSTRRYSAEVIHAILPGKARTTFNKWVPVPETDT

SEQ ID NO: 160402 - protein, 147 aa, Glycine max
  Coding DNA Sequence Number=SeqID_43624
MEGLVDLAAIDAFLAFHHGKESLVVVILAMYDTFDRGCEKSGARIEGRIRILSSCEGCPMRGVPSDESIMPFIARGFSDHNARTVRDDEVKASEESDEVQALKAELERAWVVEEKFKAAIVSSSSEEVKGIITGQRHDLEGRAKGLP

SEQ ID NO: 160403 - protein, 231 aa, Glycine max
  Coding DNA Sequence Number=SeqID_43625
  Gene Ontology: Cellular component=integral to membrane
  Homolog annotation: Hit_ID=Q4K822; Match level="QueryCoverage=90%, HitCoverage=71%, E-value=3e-14, Identity=30%"; Hit description =Membrane protein, putative
  Pfam annotation: Domain name=DUF81; Domain location=4-226; Score= -13.1; E_value=6.5e-05; Accession=PF01925.9; Description=Domain of unknown function DUF81
MSHQGAVGGQAMQIAVATSALVMLCTSLLASGRHLRAGTVHWRSLLPILGGIAIGGIAGAALALKVNGEWIRWLFILYLAVTIVDCYARPGFMAPSTACAPSSAGRETILGGGIGLIAAFLGVGGSVMTVPLMRRRGATMAQAAAMANLLTLPLAATASLTWLLMAPMAALPSGFIGNIWWLAAGLLVAGSWLGLRGASRWLAKLPDRWHVRIYPLLLLLVLLAMGFGGVG

SEQ ID NO: 160404 - protein, 331 aa, Glycine max
  Coding DNA Sequence Number=SeqID_43626
  Gene Ontology: Mol. function=oxidoreductase activity; Cellular component=outer membrane-bounded periplasmic space; Biological process=electron transport
  Homolog annotation: Hit_ID=P75804; Match level="QueryCoverage=69%, HitCoverage=61%, E-value=1e-100, Identity=74%"; Hit description =Hypothetical protein yliI precursor
MADRGGKSMTVDRLKRDLLNKLINARIDLAAYLQLRKAKGYMSVSESEHLRDNLFELCNFMREKAPTLKANYGESELIALRRAAEVLSIAGVCLMNGRHDCPNFIAVNAEKLENCLTTLSLCIMVEMLQNRLDHPWSLAFLPDNNGLLVTLKGGQLKHWQAGKGLSDPIVGVPKVWANGQGGLLDVVLAPDFKQSRRIWLSYAEAGKDGKAGTAVGYGRLSDDLTRIEAFQVVFRQTPKLSTGNHFGGRLVFDGKGYLFIGLGENNQRPTAQDLDKLQGKVVRLTEDGNVPPDNPFVRTPGARPEIWSYGIRNPQGMAMNPWSDTLWLNEH

SEQ ID NO: 160405 - protein, 103 aa, Glycine max
  Coding DNA Sequence Number=SeqID_43627
MGDQEETQEQMKADMSALKEQMASMMEVMLGMRQLMEKNVATAVAVSSAAEANPTLLATVHHPPSIFVEPSVSSKWSFRNEMLTSKISFMVMSISHQHTPFPW

SEQ ID NO: 160406 - protein, 213 aa, Glycine max
  Coding DNA Sequence Number=SeqID_43628
  Subcellular localization annotation: CTP_CleavageSite=66; ConfidenceScore=5.40e-01
MQHWKEANIKYHTKGLSSTFFCKSFFIPLSKLYFHAIQKMSTTSSTASTKRKNAIMRPPRIMQFIAAFNNDKNTIQLPAFYHTQWAPNYPEMAHLRYNGAIYEVQVRQHRDKVYLADGLQSFRKDLKIYESTNINFFACDHHSVFDIHFIPPSERQTCGRQRHSSRKKLPHCTKVPLRTCGNHMTVLRRHGPPLQWKVETLNPAIGGKGVVQP

SEQ ID NO: 160407 - protein, 67 aa, Glycine max
  Coding DNA Sequence Number=SeqID_43629
SQGFTSFPCPTPDQFRAEVAWPGDWPEAQAGEAPVGAPAEAPDEVDEAREDEETTDLLDFLRGSGAT

SEQ ID NO: 160408 - protein, 246 aa, Glycine max
  Coding DNA Sequence Number=SeqID_43630
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-36, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAYKGLHALAFKGLYVLTFSGLHALAFRGLHVLAFRGLHALAFRGLHVLAFRGLYVLAFRGLHVLAFRGLYVLTFRGLHILAFRGLHVLAIRGLHVLAIRGLHALTFRGLHVLTFRGLHVLTFRGLHVLTFRGLHVLTFRGLHALAFRGLNVLAVRGLDVLAFRGLQPLAFRGLQPLAFRWLHALSLRGLCVLTFRGLHVLALRGLHVLHFRGLHVLAFRGLHALAFNGLHIRTLREFKVLYP

SEQ ID NO: 160409 - protein, 163 aa, Glycine max
  Coding DNA Sequence Number=SeqID_43631
MRTHLMVIRTFCQLEASEPIDTQRQTSSSAPLSFRDGESDDMRRYLMIIRTFCQLEASEPVDTQRLTTSSAPLSSRDGKSDDMRRYLMLEASEPVDTQRQMSSSAPLSSRDGESNDMRRYLIVIRTFCQLQASEPVDTQRLTSSSAPFSSRDGESDDIQRYLM

SEQ ID NO: 160410 - protein, 76 aa, Glycine max
  Coding DNA Sequence Number=SeqID_43632
MIGNWIAAAEEALFISITYLHLKSLPELPSRIDLQTGAVRAGLYMFNCPELVDRERCIDMAFSWMMQLFQESGNDL

SEQ ID NO: 160411 - protein, 97 aa, Glycine max
  Coding DNA Sequence Number=SeqID_43633
MGAKHLKMTKYKLHATKPRSPDEIRRDSNVSMIDLVSAGDDVNLRVSTGLSAAIDKGRRMTIICLCVPSDTTVSEWQKGVRNDHNLSSHVIGPAASG

SEQ ID NO: 160412 - protein, 372 aa, Glycine max
  Coding DNA Sequence Number=SeqID_43634
  Gene Ontology: Mol. function=cysteine-type endopeptidase activity; Cellular component=flagellum; Biological process=riboflavin biosynthetic process
  Homolog annotation: Hit_ID=Q8KRM9; Match level="QueryCoverage=96%, HitCoverage=30%, E-value=2e-54, Identity=32%"; Hit description=Fjo24
MYLFYFGHGGISGWAQERVLTLDEINNANNFSNVYSRFPFVSTITCEFTLWDEPETFSAGERFLKMKQGGPATMITSSRAIGVDYGRDFTDLYTKDIFKLVNDDFETLGVAHLNAKRQKGPQADHLKVNLLGDPAMKLSRPKRLLVIDAIETPVPGLIRGLDFVKVKGHINNTNGSINTSFNGRVVINIFDKRLNKKTLNNDGNLTPILEYTEEGSAIVKASGTAVNGVFTVEFYVPKDINYAVGEGRILGYADNKATDVFNNQAVQVGDINPNGINDSQPPKVKLYMNNTNFADGGITDQNPMLLACITDDTGNGCLSPSLADYQKGNVTYPFRNLSVGQHQLSFKVWDINNNSTSATLNFEVKDEADQHL

SEQ ID NO: 160413 - protein, 155 aa, Glycine max
  Coding DNA Sequence Number=SeqID_43635
MKQIKLNMCQENPKILESWSLVFVLKETLFSPLWCSLVVPCGISLSDDLLAIAVIIFGVWMSTHHDGCRKSLTVPVIGLGAYHPVLCLGGNFGLHSIGVSIRNTNFKILVLGFSKRLGEDINNIALRTNMSVWEQPWPMREQGVIEDKLPLKSMK

SEQ ID NO: 160414 - protein, 74 aa, Glycine max
  Coding DNA Sequence Number=SeqID_43636
MPLRGRIASGGCAQKGTGHPKTELCPPRIYQYFGLAPWTSRSSSSLPPKELQQLTQHTDTHHRHTHADDTHTPS

SEQ ID NO: 160415 - protein, 100 aa, Glycine max
  Coding DNA Sequence Number=SeqID_43637
  Subcellular localization annotation: CTP_CleavageSite=62; ConfidenceScore=5.87e-01
MKDCRNTSSGDVSSTSRTSQSLTNSSQALRMASSSSSGGFVRARALTTILNRLARISEFQLSAAFVTQRVDQSGALSGMALLPDSSLRLAEDCCGQQIAR

SEQ ID NO: 160416 - protein, 118 aa, Glycine max
  Coding DNA Sequence Number=SeqID_43638
  Homolog annotation: Hit_ID=Q9FI66; Match level="QueryCoverage=93%, HitCoverage=70%, E-value=6e-18, Identity=35%"; Hit description =Similarity to disease resistance response protein
  Pfam annotation: Domain name=Dirigent; Domain location=6-118; Score =25.6; E_value=3.3e-08; Accession=PF03018.5; Description=Dirigent -like protein
  Subcellular localization annotation: CTP_CleavageSite=62; ConfidenceScore=5.06e-01
SEDTGFVGSLDRATLGLEKKNQVSHFRFYFHETFTANNATSVPVVPALPKYNTTTSFGTGLYAATSQTEFNLLVVLNFVLTEGKYNGSTITILGRNRISQNLREIPVIGGSGVFRFAT

SEQ ID NO: 160417 - protein, 83 aa, Glycine max
  Coding DNA Sequence Number=SeqID_43639
MFDVLFEPKFHSKCKSRLKLLKMRLETIHKKKSAMQKFLKKDIAGLLSNALDYNAHGRFLIIQISLIQSQGIAGSSARKYLVD

SEQ ID NO: 160418 - protein, 42 aa, Glycine max
  Coding DNA Sequence Number=SeqID_43640
MPLMLNKLGLSESILLSLRLSEPVLLSQLCSNGQARLSAYWR

SEQ ID NO: 160419 - protein, 100 aa, Glycine max
  Coding DNA Sequence Number=SeqID_43641
MHRSPTGNLVPLDLEIEAALRRNRAERRRKLLQDKTVASILEEETHFSDSTSSDSPSSRESTTYLPKAVIMADEHQQKVTLEDYSSSSVPQFFTSIARPK

SEQ ID NO: 160420 - protein, 266 aa, Glycine max
  Coding DNA Sequence Number=SeqID_43642
  Gene Ontology: Mol. function=aminoacyl-tRNA ligase activity; Biological process=tRNA aminoacylation for protein translation
  Homolog annotation: Hit_ID=P43827; Match level="QueryCoverage=40%, HitCoverage=12%, E-value=1e-34, Identity=71%"; Hit description =Leucyl-tRNA synthetase
VLQWLLFLSAVPPVQLLTGWCVTAKAPPDISAGKCSGHAARRVPFAIQAAQLLGRAIGAGLFAITPAGERGMCCKAIKLGNARVFPVTTLNSIELWKALGNESNIDHAEWVKADEAAMVEDEKLIVVQVNGKVRGKVTVAADADEETVKTVAFADENVKKFTDNTQIVKVIYVPGDQAYRYRRPRGGARYQLLFPLVRVNFELGVIMVIAVSFGKPVVPAALMNRPTRGERRFAYWALAECILAYYVGTDEGVSEVLHVAREKRLH

SEQ ID NO: 160421 - protein, 168 aa, Glycine max
  Coding DNA Sequence Number=SeqID_43643
MGEIEEVQEQMKADMEALKEQMVTMIEGMMSMKKIMEVNMAAVAATNVVAKAKIWEVRAAPIYLQIQNKHAFPPYGLPPNYTPPNVAYTLDEDVNNSAPILIESRQPHPAHVSQPMGETYEIPHHNLVDFKPCLEYATKGKQLVVYPCKTLWRALNFAPNHNPCIPQR

SEQ ID NO: 160422 - protein, 192 aa, Glycine max
  Coding DNA Sequence Number=SeqID_43644
  Gene Ontology: Mol. function=transporter activity; Cellular component= integral to membrane; Biological process=transport
  Homolog annotation: Hit_ID=Q6J1S8; Match level="QueryCoverage=95%, HitCoverage=70%, E-value=8e-49, Identity=47%"; Hit description =Nodulin 26-like protein
  Pfam annotation: Domain name=MIP; Domain location=2-177; Score=16.5; E_value=6.5e-11; Accession=PF00230.10; Description=Major intrinsic protein
MDISLGRKVGAEFLGTFLLMSAAIGAAIEEEKSQGSVVPVYIGAQVLASVSAAFALKLIFHPFMSGGVTVPSVGYGQAFAAEFMVSFTLMFVVTAVAGGTRVVREFPGIIMVQVRLFAGIVVGATVMINILMAGAATGSSMNPARTLGPAIAAHNYKGIWIYLTAPILGSLCGAGAYTVLKLPDRNTTMQEE

SEQ ID NO: 160423 - protein, 67 aa, Glycine max
  Coding DNA Sequence Number=SeqID_43645
MDKKLGEDASMEEKKEGEKERANDFFLALAKETTSFLPTRGEARLVEAEVEVKSEKVKVKGLEKSEG

SEQ ID NO: 160424 - protein, 196 aa, Glycine max
  Coding DNA Sequence Number=SeqID_43646
MAPKKNLVVMILGINDGQNAKKVFLEDSFILDDGLDKLPRKVQFLPLCPYMHCSRTARQDKVIIRGIVQGKEVTISPITNVVASRCLEERFVFDKEWEKEITWEIVDIMLYGGPQPVTNDKVVLRRFLRPTNLSHMCRLIHIFYMCKVLVGEKMKKNLVPYDQAKKTKKQPLFDPKPSDPKPTQKRKAQDSTKSKP

SEQ ID NO: 160425 - protein, 149 aa, Glycine max
  Coding DNA Sequence Number=SeqID_43647
  Pfam annotation: Domain name=zf-CCHC; Domain location=77-94; Score =30.9; E_value=4.5e-06; Accession=PF00098.13; Description=Zinc knuckle
MELQRLNQNEEIDKRKRSIALKASSSIQEEKEEEDSDDEEDFSLFVKKFQKFVKRRRIERRQNFNNGRRSQENSQVLRCYKCNQFGHIKANCPSNEEWPEKSDKKRYDERRTKKAYIAWDDNDSFNGTKKEINLLTKDYESDEKISQEG

SEQ ID NO: 160426 - protein, 67 aa, Glycine max
  Coding DNA Sequence Number=SeqID_43648
MEKVTVQVASHVASDPGKVPTSKKVVVLVTQHFCWNIQQHGGKMAGDNPHTSRNRWNHGNVVTVVTT

SEQ ID NO: 160427 - protein, 67 aa, Glycine max
  Coding DNA Sequence Number=SeqID_43649
MASLLSPVITTKKLYPLLAMNPKTVSLLDPVINQEANPLLAMNPKAVSLLSPVFNQEDLLLKNSHQE

SEQ ID NO: 160428 - protein, 88 aa, Glycine max
  Coding DNA Sequence Number=SeqID_43650
MSDTDSRVSGNHGSHDGSDCDDNDEKEIMVDATVIMTIIVTITIAATIIIMSDSDNHVSGNHGSHGDGHGGGGGWDDNDDCSDDLDVN

SEQ ID NO: 160429 - protein, 400 aa, Glycine max
  Coding DNA Sequence Number=SeqID_43651
  Gene Ontology: Mol. function=transporter activity; Cellular component= integral to membrane; Biological process=transport
  Homolog annotation: Hit_ID=Q2WS26; Match level="QueryCoverage=44%, HitCoverage=40%, E-value=2e-61, Identity=61%"; Hit description =Putative galactonate transporter
  Pfam annotation: Domain name=DUF541; Domain location=243-400; Score =139.9; E_value=7e-39; Accession=PF04402.4; Description=Protein of unknown function (DUF541)
QIPHQRPNHARHAGNQKQPAPAKRSLHVKQQRRHTGEANKLCGRVDANCTGALLLGEPAGNHPIVSRHHRRFESTHAEAQTEQRAEAAGKSVQCGDQRPGKQPRAVYQPRAETIDQESAGNLQRRIDPAERREDQPHLQRREAQFTGHLRGGHRQVGAIHVVNDDVDKHQCQHHKACASGSHADRALAKWLFCHNTTLPRGRMATCKLNPSRRTFVKLKALALAAVMSTGALSGLVQAGEVPNGPHVVTSGQASVDARPDMATLSIVVNVSSKDAADAKKQADDRVAQYFDFLQKNGIEKKDIDAANLSTQPEYDYTKEGKSVLKGYRAVRQVEVTLRQLDKLNELLDGALKSGLNEIRSVELGVANADSYKDQARKAAIANATQQASALAEGFNAKLGP

SEQ ID NO: 160430 - protein, 78 aa, Glycine max
  Coding DNA Sequence Number=SeqID_43652
TTVSEWRKGVWNDHNLSPMSSDPPLWMTKGAKDDVSLCVPSDTTVSEWRKDTTVSEWRKGVRNDHNLSSHVIWPAAFG

SEQ ID NO: 160431 - protein, 254 aa, Glycine max
  Coding DNA Sequence Number=SeqID_43653
  Homolog annotation: Hit_ID=Q27TE8; Match level="QueryCoverage=18%, HitCoverage=78%, E-value=3e-15, Identity=76%"; Hit description=InsA
YDGVFEVLQWLLFLSAVPPVQLLTGWCVTAKAPPDISAGKCSGRVPFAIQAAQLLGRAIGAGLFAITPAGERGMCCKAIKLGIRSSRDNHLIGREGSVFEGVGSKGEEDDARENEGGDNVLEDGIGAEFSQASRLYQHQWLQGLNFKANLQGQAGNEAAQEELRCETDDSVCQDLELRKLLFPLVRVNFELGVIMVIAVSFGKPVVPAALMNRPTRGERRFAYWALAECILAYYVGTDEGVSEVLHVAEKKGCT

SEQ ID NO: 160432 - protein, 104 aa, Glycine max
  Coding DNA Sequence Number=SeqID_43654
  Homolog annotation: Hit_ID=Q6ZAJ4; Match level="QueryCoverage=37%, HitCoverage=7%, E-value=3e-08, Identity=61%"; Hit description =Carboxyl-terminal proteinase-like
MINTLLFVLCLVTSGARHKVHGTQNALQEDLELERQLELLNKPPIKSIHTNFGYIVDCIDINKQPAFDHPLLKYHKLQVCIHDFDDVKEESNKAATNDKHLLQE

SEQ ID NO: 160433 - protein, 61 aa, Glycine max
  Coding DNA Sequence Number=SeqID_43655
  Subcellular localization annotation: CTP_CleavageSite=43; ConfidenceScore=5.02e-01
MAFSIPPPLLPIMTTTGFGLVSKQCSFVASVNGKEDVRKRKTKAEAMWGERRKGYNNRKKK

SEQ ID NO: 160434 - protein, 474 aa, Glycine max
  Coding DNA Sequence Number=SeqID_43656
  Gene Ontology: Mol. function=nucleoside-triphosphatase activity; Cellular component=membrane; Biological process=cobalt ion transport
  Homolog annotation: Hit_ID=UPI00005F8277; Match level="QueryCoverage =99%, HitCoverage=81%, E-value=1e-163, Identity=62%"; Hit description= COG0488: ATPase components of ABC transporters with duplicated ATPase domains
  Pfam annotation: Domain name=ABC_tran; Domain location=302-464; Score= 121.0; E_value=3.4e-33; Accession=PF00005.17; Description=ABC transporter
  Pfam annotation: Domain name=ABC_tran; Domain location=9-177; Score =133.0; E_value=8.3e-37; Accession=PF00005.17; Description=ABC transporter
  Pfam annotation: Domain name=NACHT; Domain location=303-463; Score= -35.4; E_value=0.033; Accession=PF05729.3; Description=NACHT domain
  Pfam module annotation: Pfam domain module=ABC_tran::ABC_tran::NACHT; Domain location=302-464::9-177::303-463
FLDFSLKKGDRIGLIGDNGSGKSTLLKILSGELAASHGSVTPASHCLLARIEQHLPETLLEASLLDGVIARLPAAQRNSERWRAEALLHTLGFSTAQQSQTAATLSGGQHMRLLLARALILQPDLLLLDEPGNHLDLPTLLWLENFLIGWQGSFVLVSHDSALLDRVTNCSAILRDRTLHVFRLPCTAAREALAQQDEADAQRHQAQQQEIARVESSAKRLAIWGRTYDNEGLARKAKQMEKRIDWLKAAQTTLSAGSPWQLQLQGEALQADRVLALPPMSIQPAAGAPTLFSLPALQVKSGDRIAIVGHNGCGKSSLLRQLWHSWQQGDSPLFHPRARVGYYDQSLQQLRDDQTLSAALHGFAALSDEQCKMALISAGFPWLRHQQKVASLSGGERSRLLFVGLTLARYSLLLLDEPTNHLDMTGKEELAQALQQFAGAVLLVSHDRSLIASSCNRFWLIEQQQLSEWHDWPQ

SEQ ID NO: 160435 - protein, 133 aa, Glycine max
  Coding DNA Sequence Number=SeqID_43657
  Subcellular localization annotation: CTP_CleavageSite=19; ConfidenceScore=5.38e-01
MKAIKTLTIAAAAALSLMSAASFAQTVSATSTTLDGAEAKIAAQAQQQGMCQNGSPDGRPFLSCSQARSVSIILAMLLNLQRRLSGRRTQYAEQRGYQPAGAGFCRCITHATPCSRSGDSFCPQAAIYRDGAR

SEQ ID NO: 160436 - protein, 137 aa, Glycine max
  Coding DNA Sequence Number=SeqID_43658
  Pfam annotation: Domain name=DUF1471; Domain location=1-71; Score =2.1; E_value=0.00078; Accession=PF07338.3; Description=Protein of unknown function (DUF1471)
  Subcellular localization annotation: CTP_CleavageSite=19; ConfidenceScore=5.19e-01
MKTIKAMSIAAVAALSLMSAASFAQSVTVTSSTLDGAEAKIAAQAQQQGAQYKITEANTNNRVHMTAELRSPGVYPQDKPASLHAVAATGYLRMVDTRYRQRLMHGIQRADKALLFLKFQYVTAFFMQYPAGVRIVT

SEQ ID NO: 160437 - protein, 225 aa, Glycine max
  Coding DNA Sequence Number=SeqID_43659
  Gene Ontology: Mol. function=nucleoside-triphosphatase activity; Cellular component=integral to membrane; Biological process=response to antibiotic
  Homolog annotation: Hit_ID=Q3L7H3; Match level="QueryCoverage=99%, HitCoverage=34%, E-value=1e-58, Identity=54%"; Hit description=EtsB
  Pfam annotation: Domain name=FtsX; Domain location=45-218; Score =164.4; E_value=2.9e-46; Accession=PF02687.11; Description=Predicted permease
MIVLGSVPVRVIGVANNEDGLSPNRLSVWLPWSTVMYRISGQTALTSISIKLKDDVVSGAAVESLTQLLTARHGTKDFLMFNRDKYRKAIEGAAATLTLLILLVASIALMIGSIGVMNIMLVSVTERTHEIGVRMAVGARRGDIMQQFMIEAVLVCLLGGSLGVALSLVIGPVISLLAGGVLTAIYSWQSAGAAFACSTIIGMIFGYLPARKAARMDPVAALASE

SEQ ID NO: 160438 - protein, 490 aa, Glycine max
  Coding DNA Sequence Number=SeqID_43660
  Gene Ontology: Mol. function=citrate transporter activity; Cellular component=integral to membrane; Biological process=citrate transport
  Homolog annotation: Hit_ID=Q4IV99; Match level="QueryCoverage=43%, HitCoverage=49%, E-value=1e-69, Identity=65%"; Hit description =Sodium/sulphate symporter
  Pfam annotation: Domain name=HTH_1; Domain location=11-70; Score =63.0; E_value=9.6e-16; Accession=PF00126.17; Description=Bacterial regulatory helix-turn-helix protein, lysR family
  Pfam annotation: Domain name=LysR_substrate; Domain location=92-286; Score=3.7; E_value=0.00048; Accession=PF03466.10; Description=LysR substrate binding domain
  Pfam module annotation: Pfam domain module=HTH_1::LysR_substrate; Domain location=11-70::92-286
  Subcellular localization annotation: CTP_CleavageSite=48; ConfidenceScore=5.07e-01
MPAPASRLPKISVIQSFKVAAELGSLAKAAAQLALTPAAVSQQIRQLEAQLGSALFVRTQSGVMLTETGKEYLRYVSEAFDILHLGQQNLRHAASMPKLTLYSLPALASKWLLPNITAWRAHCQGCDLSLHGTHAPVDFSATPADFVICFGEDRYPQLDKQRLFCDEVLPVASPALIQRYPGESLLSQAPLIHLDWGNEGRFLPDWRSWFQAKGSMEPAAQPAFSFNLTSLAIDAAVAGAGGGSAQPAAEQTLFPRLATAFPQSTRQRGADSVADAAGDVLAGAERFCAGRGDPQSGPCPTLGQLAGGAVQPELAADGGGHGAAELSAGAGDAVEHGTHRAADAGGAGAGRAGRYPAGQSRQHWAGAGGGLRHLSTLCQYSARQRTKPGAERRGGKRVPAAFAMAAVVAAAHAGGGAGQRYSAGCLHYAAVPRSAAAGGNAGSIAGAKRARMAADWPTCRHVTVVDDRQPARLICCVGRAGRGVSVFVTA

SEQ ID NO: 160439 - protein, 445 aa, Glycine max
  Coding DNA Sequence Number=SeqID_43661
  Homolog annotation: Hit_ID=UPI0000680584; Match level="QueryCoverage =62%, HitCoverage=75%, E-value=9e-38, Identity=35%"; Hit description =conserved hypothetical protein
  Pfam annotation: Domain name=SBP_bac_3; Domain location=1-162; Score =3.4; E_value=2.7e-08; Accession=PF00497.10; Description=Bacterial extracellular solute-binding proteins, family 3
MSMTEKRREQVAFSDMLYITPSALLTPANSTLTADISTLRGKNIGVAQGTIQETYAKTKWAPQGVNVVSYPNQMEIYPDLVAGRLDASLANAVSAEQGFLNTPEGKGYVNKATLVDKALLGNGVGIGLRKGDTANLTLINNALAALHSNGTYDRLAQKKIMSLLPDYTQQRARFLAAVTRQHGALTAYRHPLTAPDGAALYTDVAVIGDPAAPKRMLILSGTHGVEGYYGSDSQIAWLDSFDVAALPPDCALVLVHLLNPWGAAHLRRVNEDNIDLNRNFIDFSQPAPANPHYALWHDLYHGDRAHADRLLAETLQQSGWPALKRVVEAGQYQAADGLFYGGQQPAWSHRTLHSIVEQHLRQAQVILSFDLHTGAGAWGHPMLLAIAEQRYPAHDWGKSLYDEWLTLLFTGAGRDSDTGVTATATGYVSQFLLTSLPDTQLLPLV

SEQ ID NO: 160440 - protein, 612 aa, Glycine max
  Coding DNA Sequence Number=SeqID_43662
  Homolog annotation: Hit_ID=Q13FB0; Match level="QueryCoverage=31%, HitCoverage=87%, E-value=3e-68, Identity=66%"; Hit description=Two component heavy metal response transcriptional regulator, winged helix family
  Pfam annotation: Domain name=HATPase_c; Domain location=557-612; Score=3.0; E_value=0.044; Accession=PF02518.16; Description =Histidine kinase-, DNA gyrase B-, and HSP90-like ATPase
  Pfam annotation: Domain name=HisKA; Domain location=448-514; Score =58.9; E_value=1.7e-14; Accession=PF00512.15; Description=His Kinase A (phosphoacceptor) domain
  Pfam annotation: Domain name=Response_reg; Domain location=97-208; Score=157.0; E_value=4.8e-44; Accession=PF00072.14; Description =Response regulator receiver domain
  Pfam annotation: Domain name=Trans_reg_C; Domain location=241-304; Score=20.4; E_value=0.00068; Accession=PF00486.18; Description =Transcriptional regulatory protein, C
  Pfam module annotation: Pfam domain module=HATPase_c::HisKA::Response_ reg::Trans_reg_C; Domain location=557-612::448-514::97-208::241-304
  Subcellular localization annotation: CTP_CleavageSite=70; ConfidenceScore=5.41e-01
MALPRSISKPCSEPSLALDSNGGKVGSTPKRSVCCAAASWLRALSDNSKAKDQRFFMMLSGRLSHRGSCRCQPRFSMLTRVILPAISKRPPLPGDRMKILVIEDEAGARDYMRKGLTEAGFIVDVAENGQDGLFYAQEHHYDLILLDVMMPGINGWEVMAQLDKQLQTPVIFLTAKGTVEDRIKGLELGADDYLVKPFSFAELLARVRTQLRRGSQQKLPDILTLADLQLDIARRRVERAGQRIDLTNKEFNLLHLFLLHPGEVLTRTVIASRVWDMNFDSDTNVVDVALKHETPLARRPPFATAQCYGGGHFYTQRNGAVSRTGEADRPEAATVRQHAGQYRIVAGAALSRPAAADRDQSRRASGASHYAGRRRSAVNSAIDPHRLSPPDYPVHRAGGAAGRRDQCAAGAPRPDTAAPAGSGSRGELQPLLAALNQMLSRLEQGYQQLSQVSADMAHDLRTPIGTLLGQTEVALNQPRSVSDYQTLLGSNYAELERLAKMIDNMLFLAKAADASQALDRQRIDLTPLGERLSDYFEGMAEEHGMQLVISLHGELHADPQLLQRALANLIANALHYGTRDGTIHVSSIPQPDAVLLVVENQGPTLSQAQQAR

SEQ ID NO: 160441 - protein, 209 aa, Glycine max
  Coding DNA Sequence Number=SeqID_43663
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q3KAT6; Match level="QueryCoverage=99%, HitCoverage=44%, E-value=8e-48, Identity=51%"; Hit description=Heavy Metal Sensor Signal Transduction Histidine Kinases (STHK) precursor
  Pfam annotation: Domain name=HATPase_c; Domain location=102-209; Score=103.9; E_value=4.6e-28; Accession=PF02518.16; Description =Histidine kinase-, DNA gyrase B-, and HSP90-like ATPase
  Pfam annotation: Domain name=HisKA; Domain location=1-59; Score=32.7; E_value=1.3e-06; Accession=PF00512.15; Description=His Kinase A (phosphoacceptor) domain
  Pfam module annotation: Pfam domain module=HATPase_c::HisKA; Domain location=102-209::1-59
MAHDLRTPIGTLLGQTEVALNQPRSVSEYQTLLGSNYAELERLAKMIDNMLFLAKAADASQALDRQRIDLTPLGERLSDYFEGMAEEHGMQLVISLHGELHADPQLLQRALANLIANALHYGTRDGTIHVSSIPQPDAVLLVVENQGPTLSQAQQARLFDRFWRADASRQQGGSGLGLSIVRRIMQLHQGSCTVSSEHGITRFCLRFPR

SEQ ID NO: 160442 - protein, 185 aa, Glycine max
  Coding DNA Sequence Number=SeqID_43664
  Subcellular localization annotation: CTP_CleavageSite=36; ConfidenceScore=5.07e-01
DSSADAAAAEAPASASAPVENNDSASPFASGPTVINVSHLVTRTDDGSSVYVTVDGQEAGLLQKGESKELRVPAGKHQIGGYVQTLFGFGKVTIPAVDVTTDTNGPKNVGAHLCAPGYPAAINANPALKPAKAKAKAKAKAKAKAKAKRSAISHQCISAYTTSMALMTRKNRIMWVRALTDIALG

SEQ ID NO: 160443 - protein, 310 aa, Glycine max
  Coding DNA Sequence Number=SeqID_43665
  Gene Ontology: Mol. function=transcription factor activity; Biological process=regulation of transcription, DNA-dependent
  Homolog annotation: Hit_ID=UPI00006DBFD1; Match level="QueryCoverage =96%, HitCoverage=96%, E-value=1e-109, Identity=65%"; Hit description= COG0583: Transcriptional regulator
  Pfam annotation: Domain name=HTH_1; Domain location=9-68; Score=58.0; E_value=3e-14; Accession=PF00126.17; Description=Bacterial regulatory helix-turn-helix protein, lysR family
  Pfam annotation: Domain name=LysR_substrate; Domain location=92-300; Score=169.5; E_value=8.3e-48; Accession=PF03466.10; Description=LysR substrate binding domain
  Pfam module annotation: Pfam domain module=HTH_1::LysR_substrate; Domain location=9-68::92-300
MARTSMIRLEDVTLFVRSAALGSFSRAAREANLLPGQVSAAIQRLERDLDRRLFARSTRSLRLTAEGEKYLPFAQEMLALMHAGAESLQSHDDALSGELKIALPSDIGRHIILPLLTEFCRAHPALGLRLSFSDQVSDVFRDPVDIAIRYGKLEDSSYVALPLAEENRRVMVAAPDYLDRHGRPEKLEDLAQHHCLPFVMGGHVYDKWTFPQEGMRRQITVKSRLLCDDAEVARRWAIAGMGIAYKSWLDVCNDIRHGRLERVLPQLPGESTPLHLICPHRKQFSPAIRALHQLLREHLRTLTAQILPAI

SEQ ID NO: 160444 - protein, 538 aa, Glycine max
  Coding DNA Sequence Number=SeqID_43666
  Gene Ontology: Mol. function=oxidoreductase activity; Cellular component=integral to membrane; Biological process=transport
  Homolog annotation: Hit_ID=UPI00006DB441; Match level="QueryCoverage =55%, HitCoverage=90%, E-value=1e-117, Identity=69%"; Hit description= COG0604: NADPH:quinone reductase and related Zn-dependent oxidoreductases
  Pfam annotation: Domain name=ADH_N; Domain location=21-102; Score =53.7; E_value=6.1e-13; Accession=PF08240.2; Description=Alcohol dehydrogenase GroES-like domain
  Pfam annotation: Domain name=ADH_zinc_N; Domain location=135-283; Score=43.7; E_value=6.1e-10; Accession=PF00107.16; Description=Zinc -binding dehydrogenase
  Pfam annotation: Domain name=Nitroreductase; Domain location=328-514; Score=169.8; E_value=6.8e-48; Accession=PF00881.14; Description =Nitroreductase family
  Pfam module annotation: Pfam domain module=ADH_N::ADH_zinc _N::Nitroreductase; Domain location=21-102::135-283::328-514
MSGYAAVNTLKIFTHLEPPGARDLLVKISAIAVNPVDTKVRAGAPTDTPRILGWDAVGVVEAVGSDVTLFQPGDEVYYAGDITRAGSYAEYGLVDERIAGLKPRTLSDADAAALPLTSLTAWELLFDRLEIDAADEGTLLIIGAGGGVGSMLTQLARKLTRLTVIGTASRPETADWVRSLGAHHVIDHQRPLGDQLAAIGHKEVRYVASLTHTDSYYPQLIDVLAPQGKLALIDDPETLDAVPLKRKAISLHWELMFTRSLFHTADMQRQHQILQQVSQLIDDQTLQTTAGEHHGSISAANLRKAHALIESGRARGKIETLMTLNDAVARRHTVKAFSAGKTLPQQEIDTLLNLLRNSPSSVNSQPWHFVVASTAEGREKMAQSTSGAFIYNNPKVLNASHVIALCMRTDLDEAHLQNVLAQEEKDGRFAKPEAKAGQDKSRRSYVDMHRYELRDVPQWMEKQVYLALGGLLLGAAMLGIDATPMEGFDARALDQALGLREQGFTSVVLVSLGYRSEEDFNATLPKSRLSQDEIFTFI

SEQ ID NO: 160445 - protein, 355 aa, Glycine max
  Coding DNA Sequence Number=SeqID_43667
  Gene Ontology: Mol. function=nucleoside-triphosphatase activity; Cellular component=membrane; Biological process=transport
  Homolog annotation: Hit_ID=Q1V7H3; Match level="QueryCoverage=50%, HitCoverage=75%, E-value=8e-44, Identity=53%"; Hit description =Putative ABC transporter, ATP-binding protein
  Pfam annotation: Domain name=ABC_tran; Domain location=30-197; Score =168.2; E_value=2.2e-47; Accession=PF00005.17; Description=ABC transporter
MTQDIRFDQVSFAWGEKQLCDRLNLQLRGGKTTVLLGCSGIGKSTLLRLVAGLVQPQQGSLSGIAQHVAWMGQQDLLYPWLTVLENVMLTARLSGAKPDRVRAHHLLAQVGLEDEAQAAPSQLSGGMRQRVALARTLYAQRELVLMDEPFATLDVMTKHQLQTLTATLLRGKTVLLVTHDPLEACRMADDILLLHGQPLQWYLPDRGGAGRVAAGAPQRRTGISAAGTAGGAGGSVAKAAAARASRNVHAGGNCAGAAAGSRRWRGAGGADGFQPATASGAVSAGDSQPDHPGICAGPAAGAVAGFWHRVKSRGGGADFVFPAVPVAVRRFMPYACQLAGAGANAVSLALANFLA

SEQ ID NO: 160446 - protein, 539 aa, Glycine max
  Coding DNA Sequence Number=SeqID_43668
  Gene Ontology: Mol. function=oxidoreductase activity; Biological process=electron transport
  Homolog annotation: Hit_ID=Q8GEI4; Match level="QueryCoverage=44%, HitCoverage=98%, E-value=1e-109, Identity=80%"; Hit description =Thiazole biosynthesis protein thiG
  Pfam annotation: Domain name=DAO; Domain location=1-278; Score=53.6; E_value=6.5e-13; Accession=PF01266.14; Description=FAD dependent oxidoreductase
  Pfam annotation: Domain name=ThiG; Domain location=298-537; Score =492.5; E_value=4.9e-145; Accession=PF05690.4; Description=Thiazole biosynthesis protein ThiG
  Pfam module annotation: Pfam domain module=DAO::ThiG; Domain location= 1-278::298-537
MLLAERGETVEVIDDEARQPASWFAGGMLAPWCEAESAPAEVITLGQHAAAWWQTRVSSVVHQGTLVLAPSRDNPELNRFARMTTAHQWVDPASLEPALENRFVRGLFFPREAHLDPRRALAELRDKLLQRGVRFDARQPSGRIIDCRGIHARAQLSGLRAVRGEMLILQSHEVSFSRPIRLLHPRFPCYLVPRRDGHFMLGATMIESDDASAISARAMMELLSAAYTLHPALAEARVIESGSGLRPAWPANLPEIHYHNAMNIQLNGRTVSTEATSLSELLIEQQIDAACVATACNGDFVPKSYPSPAILQQAIAASGSEIITVSLRREGTAGAAFRELLTGLNVRVLPNTAGCHTVKEAVTTAHMARELFNTPWIKLEVIGHADTLQPDPFALVEAARILCADGFQVFPYTTEDLIVGEKLLAAGCELLMPWGAPIGSGQGLRNIDGLRAMRAWFSDIPLIIDAGIGAPSQAAQAMEMGFDAILLNTAVAKAGDPVAMARAFSQAIAAGQGAREAGLMEKRDMAVASTPIFGLANLN

SEQ ID NO: 160447 - protein, 151 aa, Glycine max
  Coding DNA Sequence Number=SeqID_43669
  Gene Ontology: Mol. function=riboflavin synthase activity; Cellular component=riboflavin synthase complex; Biological process=riboflavin biosynthetic process
  Homolog annotation: Hit_ID=Q3PGF1; Match level="QueryCoverage=97%, HitCoverage=49%, E-value=9e-30, Identity=50%"; Hit description=6,7 -dimethyl-8-ribityllumazine synthase
  Pfam annotation: Domain name=DMRL_synthase; Domain location=54-151; Score=51.4; E_value=2.9e-12; Accession=PF00885.10; Description=6,7 -dimethyl-8-ribityllumazine synthase
  Subcellular localization annotation: CTP_CleavageSite=45; ConfidenceScore=5.12e-01
MNNVPIQVKGIGASDRARLCARRLCTSNRQSSYASINWVRRWLASSSTLTALPALWIKIATYGWHQAIVNNALVGFEQELAEQGVENTLKSYDVPGAFEMPLLAKRLAETGKFDAIVCAALVVDGGIYRHDFVAQAVVDGLMNVQLATNVP

SEQ ID NO: 160448 - protein, 158 aa, Glycine max
  Coding DNA Sequence Number=SeqID_43670
  Homolog annotation: Hit_ID=Q1RWU1; Match level="QueryCoverage=58%, HitCoverage=26%, E-value=2e-07, Identity=36%"; Hit description =Resistance-like protein HAAS-2-related
MISCYSSLLRWGPVAVYYQPERVMRQFGYTQAIPTPPVDSWVSYDDIHDRWMHYSDHMIQAGEGCIVPGQCASDYIDWFFRISHPFMTPGQASNPLPDGHAPQPRVVPQAPETPSRAGARSTIDICKARYGKVCYGIVERLERHLSLRGSRQAHRHMR

SEQ ID NO: 160449 - protein, 97 aa, Glycine max
  Coding DNA Sequence Number=SeqID_43671
  Subcellular localization annotation: CTP_CleavageSite=40; ConfidenceScore=5.43e-01
MATDPTSPPQSDGQSEATSKRSRTTTRLRTLTLRTVDQPRPAVYVDPATGRASGPMREKFHSYLGVVAREKVPIIHNNWKDVPETLKDIVWNDILLI

SEQ ID NO: 160450 - protein, 82 aa, Glycine max
  Coding DNA Sequence Number=SeqID_43672
RPNKAALPEPTPVQVDLEPTDPQSRVVNPPSFPEREVVPPSPPLIVISDASSDEAAAPPDSPAGETADPLASPVGGIANLSD

SEQ ID NO: 160451 - protein, 172 aa, Glycine max
  Coding DNA Sequence Number=SeqID_43673
MNASMQQKKVKNKGEEPEKINAWFTNQKTEEETKQQGNRKKSKALFGERKIDSNKTNEEVKNSNRNKSKNRQRKRWATTIKNEETKQTSTLSGAAKGNDRKIEDTINGVFKSNIIIIKVGKEDTWTKQENWKCDAEMLKNPPNELDVKQSYPARAFDRKTPSRLGQRCKRRP

SEQ ID NO: 160452 - protein, 266 aa, Glycine max
  Coding DNA Sequence Number=SeqID_43674
  Homolog annotation: Hit_ID=Q1T493; Match level="QueryCoverage=94%, HitCoverage=62%, E-value=2e-16, Identity=22%"; Hit description =Nucleic acid-binding, OB-fold, subgroup
MARAPDNIKSINGSKETLKLAVRIIDLWFLGTPNRSKQAEMVIIDSHGDAIYVVCKQDQLKSWKADLMENFTIVRQSDLEDLPFKKYKFADFTNVIVGLFQPKLLVDIIGVMDEVVYRHVGSKSTRVVFKLKDLRASKLLINEVVFEIQEFRERLSDLGIQVWSILTPGGQGSSQVSGSSQISSKDAFLSKAEAKTISEVNKISEEIVCVTVNTINRIVMDNHSRCYSVCSYSYKKTDVETTAFTCACGKHNDGSLLAGLLWRLDL

SEQ ID NO: 160453 - protein, 158 aa, Glycine max
  Coding DNA Sequence Number=SeqID_43675
MDRPVSNKDPYAHLITFVCIYEIMKIYQMDDEFIFVSLFPFSLEVKAEHWYEVIPPNWSWDELYDKWLSYWSMKHAKWFPRRSKLYGESKFLGNYNNNWYPYFNQGWRTTILARSKRLDPPINLLIKTKTNNINPYTKIEPLSLKRPLTSLCKSPLLT

SEQ ID NO: 160454 - protein, 56 aa, Glycine max
  Coding DNA Sequence Number=SeqID_43676
MVRMRSNSTHRLKSRPGGSHVEDEGKDLEEDTSIMEDLSMDEEDPITELALMKEDS

SEQ ID NO: 160455 - protein, 112 aa, Glycine max
  Coding DNA Sequence Number=SeqID_43677
MKNESLVDGTQNRIIRRCMRSVKLDSPGPAKANDDRRESQRTLVCRVFGVGQEHKLFNLIENDVPNVHGHPRDDDIDELSDVFVEVRNMGVRGDVGIVKGQPSLGERPRIDQ

SEQ ID NO: 160456 - protein, 398 aa, Glycine max
  Coding DNA Sequence Number=SeqID_43678
  Gene Ontology: Mol. function=GTP binding
  Homolog annotation: Hit_ID=Q9FKY6; Match level="QueryCoverage=94%, HitCoverage=90%, E-value=7e-90, Identity=50%"; Hit description =Arabidopsis thaliana genomic DNA, chromosome 5, TAC clone:K2A18
MLSVGLTSVDVDDAFDSASQVNVHGWTINNKYYTADVSLWMAHLHDDFSAANVTLSRRMTALVMVFDMNEPSSLAALREWVSRTDIQNFEILLCIGNKVDLVPSHPAHAEYRRRLLKLEDSAADFYSEEYGISESEGTSLLGDEEPSWDIRRSCLDWCTDHNIEFIEACASNADFDKCLSIDGDLQGVERLYGALSAHMWPGMRKKVSYLFFNFPSLEHADCCFCQHRISADFVLSFSSPPPALAPTPELSSEESDYEQEYEVLSAGSADWDESEQGWISASSLDSGGSAPQNNPGTVGQHEDGIKSDKESHPTTSSTAIQDESEKDMVHNTMDSEGDGKENEGKCLELEDLEHLMSEIGNMRAGLRLMPDFQRRDMAAKLAMKMASIFGGESDEEEI

SEQ ID NO: 160457 - protein, 148 aa, Glycine max
  Coding DNA Sequence Number=SeqID_43679
  Homolog annotation: Hit_ID=UPI00006A2879; Match level="QueryCoverage =61%, HitCoverage=41%, E-value=3e-07, Identity=36%"; Hit description =UPI00006A2879 related cluster
MEKDKAPEWRRMKAQTYQGNPCGVYPDLSSFTGSGVYPDLSSFIGSGVYPDLSSFTGSGVIQTFVACNPCGVYLDLSSFTGSGVYPDLSSFTGSGVYPDLSSFTGSGVIQISVACIKRSAPRNIWLAWTSDILKRRDKLLLFWRTCPS

SEQ ID NO: 160458 - protein, 204 aa, Glycine max
  Coding DNA Sequence Number=SeqID_43680
MTIKYLYDVGKLIAQIFVTNQARTHPPNLPIQRSIDIEFLPNKVCPRLPVLDLGKKKGFKAYGPIEMTRKDKRLHVIAYNTIFDLHKLHEDTFEDQFLVALDIHDEVLVDVEHFANQVPNLIETNEAVGFKLDDVFEEGIPYDKSNKEELIQELPQTEQTQASSSEDPSKALTTHMVVNNNSMSSRGTMPLFKYIEPQGVTQDV

SEQ ID NO: 160459 - protein, 131 aa, Glycine max
  Coding DNA Sequence Number=SeqID_43681
  Homolog annotation: Hit_ID=Q0ZCC2; Match level="QueryCoverage=44%, HitCoverage=17%, E-value=6e-11, Identity=53%"; Hit description=CCHC -type integrase
MVVYQFPRELPELSGLTLKYWIIVGSIPLTMIQTVHELGSTSRLCEHISWILLRINFLDYNPLLNTNEVVFDVNMFSPLMMDLILGVATCPFAGERGEAHGCAFQRRKDTRSRHQRLFVENVGKTKGNRSK

SEQ ID NO: 160460 - protein, 80 aa, Glycine max
  Coding DNA Sequence Number=SeqID_43682
MTTLVSTCYQTLSLMDSEGVFIRITTWVTIAQGGVVDKSSLGQGWAFSPWVKANGELGFWLKRLAEWPDMMYVRVLVWPA

SEQ ID NO: 160461 - protein, 271 aa, Glycine max
  Coding DNA Sequence Number=SeqID_43683
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-40, Identity=31%"; Hit description= UPI00006A17C9 related cluster
RIHVLAFRGLHTLAFRGLHVLSFRGLHALAFEGLHVPTFRGLYALAFKGLHVLPFRGLHVLAIRGLHVLPFRGLHVLHFRGLHVLPFRGLHALAFRGLDALAFRGLHVLAFRGLHALVFRGLHVLNFRGLHALAFRGLHILPFRGLHAPTFRGLYAFAFRGLHVLPFRGLHIIPFRGLHVLHFKGVHVLPFRGLHILAIKGLHVLPIRGLPVLKFRGLHFLPFEGLHALAFRGLQILGFSGLHALTFVGVHALAFIGLHICAFRELKVLRP

SEQ ID NO: 160462 - protein, 101 aa, Glycine max
  Coding DNA Sequence Number=SeqID_43684
  Subcellular localization annotation: CTP_CleavageSite=87; ConfidenceScore=5.57e-01
MFSKKSMLCFSYIIIFPFFSRLLLHSVTLSRSHPLRRRFLSLPLSLSLSTAMLPLALTLRGGASSRSCSWFDSHCRSHSQPSPRRQRAGSDRGPSQSSFSI

SEQ ID NO: 160463 - protein, 537 aa, Glycine max
  Coding DNA Sequence Number=SeqID_43685
  Gene Ontology: Mol. function=sugar porter activity; Cellular component=integral to membrane; Biological process=carbohydrate transport
  Homolog annotation: Hit_ID=Q1SZN1; Match level="QueryCoverage=96%, HitCoverage=74%, E-value=0.0, Identity=66%"; Hit description=Sugar transporter superfamily; Major facilitator superfamily MFS_1
  Pfam annotation: Domain name=MFS_1; Domain location=1-509; Score= -1.8; E_value=0.00038; Accession=PF07690.6; Description=Major Facilitator Superfamily
  Pfam annotation: Domain name=Sugar_tr; Domain location=1-519; Score= -1.5; E_value=8e-07; Accession=PF00083.14; Description=Sugar (and other) transporter
  Pfam module annotation: Pfam domain module=MFS_1::Sugar_tr; Domain location=1-509::1-519
IHAGGLSYIKQEFHLETDPTLEGLIVSTSFLTGTVVTIFSGTVSDMLGRRPMLITSSIMFFLSGLVMLWAPNVLVVLLSRLLDGIAIALTITLTPLYISEIAPPDIRGTLNTLPQFSCSGGMFVAYIMVFWLSLMENPSWRAMLGVVSVPAVAYFFLAVLYLPESPPWLVSKGRITEAKKVLQRIRGTDDVSGELALLAEGMNPGGENTTIEEYIVAPAGDLIANKEAGRDCIKLYGPHQGGVSMVAQPLSGQGSMVSRSMLTLSRQGSIVAQAANLKDPLVNLFGSMHENVTPLEAGAGSRSMLMGEPDQSPYGNSENLHAPLLSAQGSTVERVGSKDMLKVGSNNTDIGGGWKLVYKSTDQGGKREGARQRVYLRADPNAAVLSQQGSFVSGYDLHADGSTEAFPAAALVSHSVISPKDMSIKPEVAAKRTGWGGLLDLGVRRALVVGIGLQVLQQAAGINGFLYYAPQILEQAGVGPLLSNLGISSRSASLLVNVITTFTMLPCIAVSMRLMDIAGRRWVECIAVLQGYYFKVH

SEQ ID NO: 160464 - protein, 243 aa, Glycine max
  Coding DNA Sequence Number=SeqID_43686
  Gene Ontology: Mol. function=DNA binding; Cellular component =chromatin; Biological process=DNA integration
  Homolog annotation: Hit_ID=Q1SDN3; Match level="QueryCoverage=98%, HitCoverage=32%, E-value=1e-65, Identity=68%"; Hit description =Polynucleotidyl transferase, Ribonuclease H fold
MATVRVVLALASINRWHLHQLDVSNAFLHGDLREDVYMEIPPSLLGYTSSQSCKLKKSPYGLKQSSRQLWCPGKGLFFPRTCSPHLLGFSDADWATCIDSRRFITGYCFFIGNSLVSWKTKKQTIVSRSSSETEYRALASTTCELQWLSYLLRDLRIPLSKPSVLYCDNHSALHIVVNPIFHERTKHLDIDCHLVREKSQAGLMLLLPIPFSNQLADIFTKTLPPQSFGTNLSKLLLQNIFAG

SEQ ID NO: 160465 - protein, 548 aa, Glycine max
  Coding DNA Sequence Number=SeqID_43687
  Gene Ontology: Mol. function=protein binding; Cellular component =intracellular; Biological process=small GTPase mediated signal transduction
  Homolog annotation: Hit_ID=Q8RX50; Match level="QueryCoverage=95%, HitCoverage=97%, E-value=1e-163, Identity=59%"; Hit description=PSR9
  Pfam annotation: Domain name=LRR_1; Domain location=242-263; Score =14.7; E_value=0.34; Accession=PF00560.23; Description=Leucine Rich Repeat
  Pfam annotation: Domain name=LRR_1; Domain location=265-286; Score =10.2; E_value=3.5; Accession=PF00560.23; Description=Leucine Rich Repeat
  Pfam annotation: Domain name=LRR_1; Domain location=288-309; Score =16.0; E_value=0.14; Accession=PF00560.23; Description=Leucine Rich Repeat
  Pfam annotation: Domain name=LRR_1; Domain location=311-332; Score =17.8; E_value=0.039; Accession=PF00560.23; Description=Leucine Rich Repeat
  Pfam annotation: Domain name=LRR_1; Domain location=334-355; Score =10.0; E_value=3.8; Accession=PF00560.23; Description=Leucine Rich Repeat
  Pfam annotation: Domain name=LRR_1; Domain location=357-378; Score =3.9; E_value=53; Accession=PF00560.23; Description=Leucine Rich Repeat
  Pfam annotation: Domain name=LRR_1; Domain location=380-401; Score =9.5; E_value=4.7; Accession=PF00560.23; Description=Leucine Rich Repeat
  Pfam annotation: Domain name=LRR_1; Domain location=403-424; Score =11.6; E_value=1.9; Accession=PF00560.23; Description=Leucine Rich Repeat
  Pfam annotation: Domain name=LRR_1; Domain location=451-472; Score =17.0; E_value=0.07; Accession=PF00560.23; Description=Leucine Rich Repeat
  Pfam annotation: Domain name=LRR_1; Domain location=474-492; Score =3.0; E_value=77; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=242 -263::265-286::288-309::311-332::334-355::357-378::380-401::403 -424::451-472::474-492
MNLLPARSVDETVEEIMRLHRSLPARLGIEEVEAARTLVANVEREDQAKLEAVARARERKGPHVPEELFAVLQEMQKSVVLFQSKEQRREALKLLDLENVHVLFDELIQRASNCVSSRSGSKNSVLKRETSSSSSVSVSAFKKEPVKSSEILFTRDDNYMNKIKPNFYPDGYTIGPSVSSKPLILDSSIIPASTSGEDKLSLIKLASLMEVSAKKGTRELILQNKLMDQVDWLPDSIGKLSSLIKLDLSENRITVLPSTIGGLSSLTSLNLHSNKIAELPECVGDLLSLVYLNVGGNQLSSLPASLGRLVHLEELDLSSNQLSVLPDAIGSLVSLKVLNVETNDIEEIPHSIGRCVALRELCADYNRLKALPEAVGKIESLEVLSVRYNNVKQLPTTMSSLSNLKELNVSFNELEYVPESLCFATSLVKMNIGNNFADMRSLPRSIGNLEMLEELDISNNQIRVLPDSFRMLTRLRVLKVEENPLEIPPRHVAEKGAQAVVRYMADLVEKKDAKLQPLIKKKKGWAHHMCFFSKSNKRKRDGVDFVKT

SEQ ID NO: 160466 - protein, 96 aa, Glycine max
  Coding DNA Sequence Number=SeqID_43688
MAPIFQSSQPKAIPRGGHIETQVVVKHPAGTENHTLVNETPQKDNLIAPRTVGNNLSDLDLLPHGLAANAKHQDATASVSTDVSIFANLEKDLPKV

SEQ ID NO: 160467 - protein, 65 aa, Glycine max
  Coding DNA Sequence Number=SeqID_43689
MCLASPLWSLKEVFVDGINLKGEGVFSGIQVAKGGAGSKIRQRIQLILETQWAKIVRGRQRAPKG

SEQ ID NO: 160468 - protein, 343 aa, Glycine max
  Coding DNA Sequence Number=SeqID_43690
  Gene Ontology: Mol. function=translation initiation factor activity; Cellular component=nucleus; Biological process=regulation of transcription, DNA-dependent
  Homolog annotation: Hit_ID=Q1PEV9; Match level="QueryCoverage=70%, HitCoverage=43%, E-value=7e-29, Identity=36%"; Hit description=RNA polymerase I specific transcription initiation factor RRN3 family protein
  Pfam annotation: Domain name=RRN3; Domain location=7-342; Score= -101.3; E_value=5.8e-06; Accession=PF05327.2; Description=RNA polymerase I specific transcription initiation factor RRN3
MGRVQVNNKEEFSQMENDDFSDSQLVRHFRGVLVAVTTGDRENYDELVGYLHPKKNLNPDEVAILVTTLKALSGAVSYIDSVHHESLLFAVSRMSLWNYGIDIMDALLELIISLAASNGKYIDWCLEMLVKHFVPPFYLLDSLRQENGIDRKNKVLSRVHAALKEIADLVPLAPLRLSPIVIQKMPSVFSKETEIVMYVENMLRLESGAIGETVGSIMLPALVDRLLELDVEIGWDGILQEDAKGIFEMELEDVTEFADEDENCDSMVAHAACESETLMHSNEREGGRWRCDGGRKVSGTTVASKCLGNVIMPPCSAAIVGMGMTTAPLKCSTTDFDNIGLHQ

SEQ ID NO: 160469 - protein, 172 aa, Glycine max
  Coding DNA Sequence Number=SeqID_43691
  Gene Ontology: Mol. function=RNA-directed DNA polymerase activity; Biological process=RNA-dependent DNA replication
  Pfam annotation: Domain name=GRP; Domain location=85-162; Score= -28.1; E_value=0.057; Accession=PF07172.2; Description=Glycine rich protein family
MEGIKAEVKMLLKVNFIRTIRYLNAATPKDEYPMPVIDMLVDLTAGNEILILLDDYSRYNQIYLVKNDVSKNDFQCHGALETCELLGFVIHQKGVEVDKSKAKDILETTPPKNMKQLQSLFGDGGGGWEGGGEDGRGGGIGAKVSGGGSRDIGAGGGCGTGACATTTPSIHI

SEQ ID NO: 160470 - protein, 223 aa, Glycine max
  Coding DNA Sequence Number=SeqID_43692
MKDLNETDEEDEGFVQVAFQKRKTVGLVTTAPKRVKKVQPVSEPHKFRRATPREPITDAQRFPLAFIHGNPTPKTSYSKFIYFKPIEKETINVQAPTWTKHDYEHTPSKAFKTLPIDVIKGLFARCGTPKERVLEEGASVWMLITKLLPVHPVDLNLSQEDRSSLGPSRIKLCEWTLKRPPLLVLMEVTVLSTETSFKCYILLGSTTFMMFPSASQKMPTTTC

SEQ ID NO: 160471 - protein, 105 aa, Glycine max
  Coding DNA Sequence Number=SeqID_43693
MSSRPPKPFKFLDMLMWMTPCCLGYNFDGQHNLDSQNLGCYCLLVDKLNMPPKDPLFYMNEWFIVYVDGGDFNGWDNLGSRGVRGGHCKEFESYGLNFREEVEVF

SEQ ID NO: 160472 - protein, 154 aa, Glycine max
  Coding DNA Sequence Number=SeqID_43694
  Homolog annotation: Hit_ID=Q84VH5; Match level="QueryCoverage=65%, HitCoverage=14%, E-value=3e-47, Identity=95%"; Hit description =Envelope-like protein
MAFPTVLCGIMLSQHPNMLNYTDSVMKRESPLSLHYKLFEGTHVPDIVSTSGKAASGAVSKDALIAELKDTCKVLEATIKATTEKKMELERLIERLTDSGIDDGEAAEEEEDPAEQEEAAEEDKEAAEEEEEAAEEEEDAAEETESDDDSEATP

SEQ ID NO: 160473 - protein, 275 aa, Glycine max
  Coding DNA Sequence Number=SeqID_43695
  Gene Ontology: Mol. function=siderophore-iron transporter activity; Cellular component=outer membrane; Biological process=siderophore transport
  Homolog annotation: Hit_ID=Q5PHW8; Match level="QueryCoverage=74%, HitCoverage=28%, E-value=4e-77, Identity=64%"; Hit description =Probable TonB-dependent receptor
  Subcellular localization annotation: CTP_CleavageSite=75; ConfidenceScore=5.82e-01
INGSTSHRPKKKVTSRRGVSAQKSGPTSHRAQIVVPSRNTAYSSSAVARRRNSSQEVASSTSPAMMCFALFKAVRQGGAATPVATRRRLEIAAVAFVDDHRTDVTAIEHIVYPAEDVQRPAVPGKAITGVYAGHGVRGRLRAVGVVSLNVAHVAQLRAGVPAFRRRPGQRGVAHIACDARQAIAGGGTAGFTAHIAAVGGVQQRPGHIQAPVQRKLLIQRQFEAAPPGFAGVGIAGAPAAAFRHHQFVVGLGLEQGGAHQAVAEAQLAAQLDGVA

SEQ ID NO: 160474 - protein, 808 aa, Glycine max
  Coding DNA Sequence Number=SeqID_43696
  Gene Ontology: Mol. function=nucleic acid binding
  Homolog annotation: Hit_ID=Q9FKY7; Match level="QueryCoverage=98%, HitCoverage=67%, E-value=0.0, Identity=56%"; Hit description =Arabidopsis thaliana genomic DNA, chromosome 5, TAC clone:K2A18
  Pfam annotation: Domain name=DUF1683; Domain location=635-789; Score =168.8; E_value=1.4e-47; Accession=PF07919.3; Description=Protein of unknown function (DUF1683)
MSETSDQIDNVADSVVPSVYVGQFAQLLEQGDNVDMLPLTDEEYIHYAISEGKRFRDSLEIIALLKKAYESYSSMKIQRMSSFCAFQMSKEYFGEGDISNAKKTFDSIASLYRKEGWVTLLWDVLGYLRECSRKNGTIKDFVEYSLEMAALPISSDTGVRRDTGPAGPVNLLQREIVQNEVFELVRGASGKATNEHPSNLKITGDESLQLEVDLVSPLRLVMLASVAFHEQTIKPGASTLITVSLLSQLPLTVEIDRLEIQFNQSNCNFFITNAQKPQSVKVSNGIQQHRTETEPSLSLESNKWLRLTYDIQSDQSGKLECLSVIAKIGSHLAICCRAESPASLDSLPLWALEDRVQTVPIKDPILVLSGQKSTQVEEPDSQVDLHLGAAGPALVGEVFLVPVTLVSKGHDVYSGELKINLVDVKGGGLFSPRDSEPYALDSHHVQLLGISGPEGEDDSQLDSDKIKKIQQSFGLISVPILKNGASWSCKLEIKWHRPKPIMLYVSLGYTPFSNELNAQTVHVHKNLQIEGHTAILLNHHYLMPFRRDPLLLSKNKQASESDQPESLPLNQKNVLIVSAKNCTELPLRIKSISIEVEDDAERTCSIQHGTKELSNPSLLVPGEEFKKVFSVSSDMNISKLKLGTMCLSWRRDLGVEEQSASTSTLPWVVTKQKLPDVNVELPPMIVSFECPPYAVVGDPFTYNIRISNQTQLLQEIKYSLADAQSFVLSGYHNDTIYVLPKSEHILSYKLVPLVSGMQQLPKLSMTSVRYSAAYQPSNSSNSVFVFPSKPHFKATVSTNSRVESVANE

SEQ ID NO: 160475 - protein, 223 aa, Glycine max
  Coding DNA Sequence Number=SeqID_43697
  Gene Ontology: Mol. function=nucleic acid binding; Cellular component= nucleus
  Homolog annotation: Hit_ID=Q9FKY7; Match level="QueryCoverage=93%, HitCoverage=15%, E-value=8e-55, Identity=52%"; Hit description =Arabidopsis thaliana genomic DNA, chromosome 5, TAC clone:K2A18
MIALRKRAEVDAKHVVVLNPNDTSDLKQLASTFSELAGTYYREEGRRIKQRVEKKNVSSVELIVRYCFKVAVYAEFRSDWTEAMKFYEEAYHTLREIVGVTTRLPAVQRLVEIKSISEQLHFKISTMLLHSGKVTEAVTWFRQHMNAYKRLVGAPDGIFLHWEWMSRQFLVFGELLETSSKITQGVSPIVLGNPSKPLSEWEYYSAYYYQHCQLGNKLPSHGL

SEQ ID NO: 160476 - protein, 83 aa, Glycine max
  Coding DNA Sequence Number=SeqID_43698
  Subcellular localization annotation: CTP_CleavageSite=27; ConfidenceScore=5.21e-01
MSSFSHPWRKTVLTSSCSNFMPKVAIRASCRACRPWIFFINEVLYFLKINGSEMEKEERRLETPHQGEDESRTSSPSWEGRRR

SEQ ID NO: 160477 - protein, 154 aa, Glycine max
  Coding DNA Sequence Number=SeqID_43699
  Homolog annotation: Hit_ID=Q9FKY7; Match level="QueryCoverage=76%, HitCoverage=10%, E-value=3e-32, Identity=55%"; Hit description =Arabidopsis thaliana genomic DNA, chromosome 5, TAC clone:K2A18
MESRSEQTWSHWAGSPRRWWEGKRAARTEGSLVRCLSSQSRLRMPATMGEGEVAVVESVESVLFLLKRWILEKSGRARVLMGGCADMRWVEIRVWSSGHPTRDASVTGGVRNSSGYSSIGSDRIGSLTHQQQELLCVWVRPCAIHLRIEISTAL

SEQ ID NO: 160478 - protein, 140 aa, Glycine max
  Coding DNA Sequence Number=SeqID_43700
MGPHFEIPPACLIALRQTIEKWIFIINIQKRHAFDGFPRSLKAKYNGLPKSSPTLSGTRFFPSFLRPAKVSKCSNEERLMLKPKDVPQKISARHEFHKHELDNVVAVTEAQPSLRQTPTQAEGETTRMPWEYPFRDSFLS

SEQ ID NO: 160479 - protein, 94 aa, Glycine max
  Coding DNA Sequence Number=SeqID_43701
MGNQLSFCYLGRKCLGSQKHHPKPRTGLVFLDNKSSLASSLATVHRSVSVIIEEWVHDKMNPYVVLQTKDLTGQHMRYACASGQLRLTIVTLNG

SEQ ID NO: 160480 - protein, 157 aa, Glycine max
  Coding DNA Sequence Number=SeqID_43702
AYRVFEISIKKGYDILRGDGVLIAFTSFKWLIAYFLLWKLVLGAHKVRRLSSICFEIAMPLARCGNIYRWIVIQAFSGACGVTFSLKAKLYGIFYGLPKAWEDGTYNGQFLSSILFTKAMHACVHWLAKYGAMYGDSYFTWNVCPVQLTPLMLTDKM

SEQ ID NO: 160481 - protein, 54 aa, Glycine max
  Coding DNA Sequence Number=SeqID_43703
MAKDAVAVARLKASVLLELSDYIQGLKQKLEELNQLLTVATARKIADYDPMPKV

SEQ ID NO: 160482 - protein, 399 aa, Glycine max
  Coding DNA Sequence Number=SeqID_43704
  Gene Ontology: Mol. function=thioredoxin-disulfide reductase activity; Cellular component=cytoplasm; Biological process=removal of superoxide radicals
  Homolog annotation: Hit_ID=Q39242; Match level="QueryCoverage=82%, HitCoverage=86%, E-value=1e-131, Identity=70%"; Hit description =Thioredoxin reductase 2
  Pfam annotation: Domain name=DAO; Domain location=71-377; Score= -62.5; E_value=0.087; Accession=PF01266.14; Description=FAD dependent oxidoreductase
  Pfam annotation: Domain name=GIDA; Domain location=71-387; Score= -247.4; E_value=0.074; Accession=PF01134.12; Description=Glucose inhibited division protein A
  Pfam annotation: Domain name=Pyr_redox; Domain location=222-317; Score=93.7; E_value=5.8e-25; Accession=PF00070.17; Description =Pyridine nucleotide-disulphide oxidor
  Pfam annotation: Domain name=Pyr_redox_2; Domain location=71-362; Score=157.6; E_value=3.2e-44; Accession=PF07992.4; Description =Pyridine nucleotide-disulphide oxidor
  Pfam module annotation: Pfam domain module=DAO::GIDA::Pyr_redox::Pyr _redox_2; Domain location=71-377::71-387::222-317::71-362
  Subcellular localization annotation: CTP_CleavageSite=51; ConfidenceScore=5.72e-01
MRIFPNTFFTKARNLIGLGFASSTAATIAASTSAASSSPSSTSSSDAGDTSSSYSSSSEAQIVHRKILKTKLCIIGSGPAAHTAAIYAARAELKPVLFEGWMANGVAPGGQLTTTTDVENFPGFPAGILGTDLMDRCRQQSQRFGAEVVTETVTAVDLSQRPFRVYSDSTTVEAESVVVATGAVAKRLNFDGAGDTPDGFWNRGISACAVCDGAAPIFRGKPLVVIGGGDSAMEEATFLSKFGSKVYIIHRRDKFRASKVMQGKVMSNPKIEVLWNSVVVGAHGDDKGRILGGVKVKNVVTGAVSDLKVSGLFFAIGHEPATKFLDGQLELDSDGYIVTKPGTTKTSVDGVFAAGDVQDKKYRQAITAAGTGCMAALDAEHYLQGIGLQEETNRLTSFE

SEQ ID NO: 160483 - protein, 146 aa, Glycine max
  Coding DNA Sequence Number=SeqID_43705
  Gene Ontology: Mol. function=transcription regulator activity; Cellular component=nucleus; Biological process=regulation of transcription
  Homolog annotation: Hit_ID=Q652L2; Match level="QueryCoverage=77%, HitCoverage=11%, E-value=9e-36, Identity=62%"; Hit description =Putative HIRA
  Subcellular localization annotation: CTP_CleavageSite=51; ConfidenceScore=5.45e-01
MLALASVSSLWPPTPFVTASSSLGNFVRIFDVNSNATIATLEAPPSEVEVSQMHFDPKREITVQETEIVCSKGPQTLWSARISGKVTVLAGNGNFWRVGCEDGCLQIYTKCGRRAMPTMMMGSAATFVDCDKCWTLLLVTRKGSLY

SEQ ID NO: 160484 - protein, 347 aa, Glycine max
  Coding DNA Sequence Number=SeqID_43706
  Gene Ontology: Mol. function=protein binding; Cellular component =viral envelope; Biological process=chloroplast organization and biogenesis
  Homolog annotation: Hit_ID=Q1T3W0; Match level="QueryCoverage=91%, HitCoverage=60%, E-value=2e-73, Identity=44%"; Hit description=Helix- hairpin-helix motif
MGTKTYYIRLSRGSEALEDLPDVNHFARGGEYDGDRKIEDLKLLYRAYVVNALSSGRMEINKIAELNQLGNIIGLVKREAEAITLDVTSRVYPKKLVQAVSNEIYRENLQHLGDDGELSDKDAAALLRLRIMLCVPQQTIDAAHSDICGSWFEKVVKDTIASGVDGYGADIWKSVRKAAHGLRLTRDTAMSIASKTIRKIFINFIQRARAAGNHKESAKELKKMIAFNTLVVTELSRLLGNKLRETLFRKTVGVIFSPGAREFDEEEVSPLNNMLTCEKAVPYQPQSWGVQEELADLYTTYIKSNETPEKLSSLQYLLGINDSTSASLREMGERLPNNTAEVEEFVF

SEQ ID NO: 160485 - protein, 82 aa, Glycine max
  Coding DNA Sequence Number=SeqID_43707
  Gene Ontology: Mol. function=protein serine/threonine kinase activity; Biological process=protein amino acid phosphorylation
  Homolog annotation: Hit_ID=Q5MJV5; Match level="QueryCoverage=61%, HitCoverage=18%, E-value=6e-10, Identity=54%"; Hit description =Avr9/Cf-9 rapidly elicited protein 256
MKTKGGSKNNVKNKDVEDGKFHDLVENDKEALSDIGRLEKRIKIAIWCIQEHLEMRPTMGKVKQMMDGLVEVPNPPSPNPDV

SEQ ID NO: 160486 - protein, 212 aa, Glycine max
  Coding DNA Sequence Number=SeqID_43708
  Gene Ontology: Mol. function=sequence-specific DNA binding; Cellular component=intracellular; Biological process=regulation of transcription, DNA-dependent
  Homolog annotation: Hit_ID=Q60EQ4; Match level="QueryCoverage=32%, HitCoverage=33%, E-value=5e-23, Identity=82%"; Hit description =Nuclear transcription factor Y subunit B-3
  Pfam annotation: Domain name=CBFD_NFYB_HMF; Domain location=51-123; Score=73.4; E_value=7.3e-19; Accession=PF00808.13; Description =Histone-like transcription factor (CBFNF-Y) and archaeal histone
MRGFFISPISSCFYFSLFPSSDALASPCGGGGGSHESGEHSPHSNFREQDRFLPIANISRIMKKALPPNGKIAKDAKETVQECVFEFISFVTSEYTSLFLAASNKCQREKRKTINDNCNRTITVSEREEGAFIMYDYDTFNMYIKQVVIEGFKSYREQIATKPFSSKVNCVAIHFVLSDLFQNLHGEDRQALLHIEGDSKGSAKRVEMHLRY

SEQ ID NO: 160487 - protein, 375 aa, Glycine max
  Coding DNA Sequence Number=SeqID_43709
  Gene Ontology: Mol. function=RNA-directed DNA polymerase activity; Cellular component=chromatin; Biological process=RNA-dependent DNA replication
MPIIDELLDELGSTSWFSKLDLSQGFHQIRMAEDDIPKIAFRTHYYEYKVMPFGLSNALAMFQSTMNELLKPFLCQFVVVFFDDILVYSLSLVEHLSYLEEIFVVLGQNQFYLRRNKCLFARQSLQYLGHIVSAHGVGPDPSKLSAINEWPTPLSTTDLQRFFELAGFYRRFIHNYASITSPLTSLLRKDQFHWSKEAQVAFDQLKRALTEALVLAPPNFILPFTLETGASVTAMGVVLKQQSHPIAFFSKVFCPRMQRASTYVRELHAITVVVRKWCHYLLGQHFIILTDHKSLKDLMSQVIQAPEQQQYLSKLLGYDYSIQYRPGSGNAAADALSCLFLPTPHCLTLTMPYFTFLDQLRHSLRDIQEFRELMT

SEQ ID NO: 160488 - protein, 121 aa, Glycine max
  Coding DNA Sequence Number=SeqID_43710
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=20%, E-value=1e-13, Identity=48%"; Hit description =Integrase, catalytic region
MELHVGGCDDHKMNDHTPDGVTSMKQSAMKLYVDDHTFDDAVEGDMRRGQCGLKLGMDHKIFWTTLYRKVGGSIDDKDANAQTPNLPLEWKHHGSGSQHVASWHSELWLIYGATPHEVGIV

SEQ ID NO: 160489 - protein, 90 aa, Glycine max
  Coding DNA Sequence Number=SeqID_43711
MAHQPLNGLGGPSRKTLLLKRCNHTPLFPIMTWRGVIGKDISGAGILTISLRLSSGGSSSGDDGRRLWRLCQPRWKRRCRHHHQRSKDGF

SEQ ID NO: 160490 - protein, 76 aa, Glycine max
  Coding DNA Sequence Number=SeqID_43712
MWMCSEAEIYLFGGYITSWKVPSGEGGERGVGIARMDDGEDAKGEGGKYENKEEDEERKVLEGDRSQFIKVCEVKL

SEQ ID NO: 160491 - protein, 82 aa, Glycine max
  Coding DNA Sequence Number=SeqID_43713
MKTHPEGSPPCTLAQSQKHKSLFLPYYEDIEGYSGLLHTIVVVGVCDRWDLVARHREYLFLYLGGLLSSGLSIHQLHSSSLR

SEQ ID NO: 160492 - protein, 71 aa, Glycine max
  Coding DNA Sequence Number=SeqID_43714
MVLFELDHVNQFAEWKGLMSVKRLARIAMRHVHESHSSKSFNVGLYVSLVWIWGGSFNVGFVTAGGPFSGN

SEQ ID NO: 160493 - protein, 65 aa, Glycine max
  Coding DNA Sequence Number=SeqID_43715
MYIGRSLAFLYLFGFHSLHYILARAYRHSSWQVGLQLYKEPWTCMIRENLCSPSAFLASSVAFLA

SEQ ID NO: 160494 - protein, 93 aa, Glycine max
  Coding DNA Sequence Number=SeqID_43716
  Gene Ontology: Cellular component=chloroplast envelope
  Homolog annotation: Hit_ID=O80503; Match level="QueryCoverage=67%, HitCoverage=12%, E-value=1e-12, Identity=57%"; Hit description =Expressed protein
MYEHQSIQKYGEHIDQRKGPNSIAANLWSCGPVVFRADSRIALESFARKNGVSVEDFICSLSYSLKDLESGKIVAWYSPKRKEGMVEFRMYEF

SEQ ID NO: 160495 - protein, 83 aa, Glycine max
  Coding DNA Sequence Number=SeqID_43717
MDLVRTKEEVRTRPKLPSNGSLSAVMDLVQLIDEGSLMQEDQREDEILKEGGGTKLEKRNGRGKWANRWRQECKGKQSKQVAA

SEQ ID NO: 160496 - protein, 126 aa, Glycine max
  Coding DNA Sequence Number=SeqID_43718
  Gene Ontology: Mol. function=oxidoreductase activity; Biological process=metabolic process
  Homolog annotation: Hit_ID=Q1SMR0; Match level="QueryCoverage=55%, HitCoverage=22%, E-value=1e-23, Identity=80%"; Hit description=Short- chain dehydrogenase/reductase SDR
MSRNFTDYATIPSSASGMLQNFTDCAIIFPFDSRHVTKLHGLLNDGCQVPRSSQAKICRQLASHGVTVVLTSRDESVGVESAKVLQEGGLTEVACHQLDILDPSSINQFADWLKENYGGLDILVSF

SEQ ID NO: 160497 - protein, 58 aa, Glycine max
  Coding DNA Sequence Number=SeqID_43719
MEDAPVSPRVALPPKGRLRQQRAEAAERDVLPLQHAPVEPGPQSFPLAYSEQFEATVA

SEQ ID NO: 160498 - protein, 377 aa, Glycine max
  Coding DNA Sequence Number=SeqID_43720
  Homolog annotation: Hit_ID=Q94D97; Match level="QueryCoverage=97%, HitCoverage=70%, E-value=6e-79, Identity=42%"; Hit description =Nodulin-like protein
  Pfam annotation: Domain name=MFS_1; Domain location=17-370; Score= -52.9; E_value=0.083; Accession=PF07690.6; Description=Major Facilitator Superfamily
  Pfam annotation: Domain name=Nodulin-like; Domain location=15-257; Score=299.1; E_value=8.3e-87; Accession=PF06813.4; Description =Nodulin-like
  Pfam module annotation: Pfam domain module=MFS_1::Nodulin-like; Domain location=17-370::15-257
MSLPSFFTIPSAAHQWLSLVGIIWLQAINGTNTNFPAYSCQLKHLSISQVQLNNLAFASDAGKHFGWVFGLVSIYIPLWLVLLIGSTLGLIGYGVQYLFITNHISSLSYWHVFLLTFLAGNSICWINTVCYVVTIRNFPSQGQVAVGLTTSYQWLSAKIYTNIVDVFSPHKKARTFLFLNSLLPFIVSLIAAPLAREIENTGPKNIDFEFALLFVITVATGIYAVMTSLQFVTSKMSSLVIRNGILVSLLLPPLVPVSFKFKELVGSWNTKRERLRVYNFTMENTNNEVSEDEDNSIEGQVIGVREEIGETLMLRRIDFWLYFFIYFFGATIGLVYLNNLGQIAESRGFSGTSSLVSLSSSFGFFGRLIPSLSDYFS

SEQ ID NO: 160499 - protein, 52 aa, Glycine max
  Coding DNA Sequence Number=SeqID_43721
  Homolog annotation: Hit_ID=Q1RX70; Match level="QueryCoverage=77%, HitCoverage=5%, E-value=2e-08, Identity=63%"; Hit description =Ubiquitin
MEYWKLKAIQEINHKNATTIAQQKWRHRVGPISFAHIRDQLGGLQELIENSG

SEQ ID NO: 160500 - protein, 129 aa, Glycine max
  Coding DNA Sequence Number=SeqID_43722
RGYIYLGLIENKRGYISCGSVLVEGTSTRLFKENKGGYIPCGSLLVKGFLQGWKRNLKDRRSFGDWIPKSPLFEFLVPFGLIAHSIQVSTPSFGSLNSMYLLKSMKQFFLEFVLVLLNWGVVRDGLRPM

SEQ ID NO: 160501 - protein, 33 aa, Glycine max
  Coding DNA Sequence Number=SeqID_43723
MKQNLENEVKRQIVDIMEKLSASESPINSSAQV

SEQ ID NO: 160502 - protein, 132 aa, Glycine max
  Coding DNA Sequence Number=SeqID_43724
  Gene Ontology: Mol. function=transporter activity; Cellular component= integral to membrane; Biological process=transport
  Homolog annotation: Hit_ID=P21727; Match level="QueryCoverage=98%, HitCoverage=31%, E-value=3e-41, Identity=67%"; Hit description =Triose phosphate/phosphate translocator, chloroplast precursor
  Subcellular localization annotation: CTP_CleavageSite=37; ConfidenceScore=5.09e-01
MESRVRSCVGTLSSLPHLRKPPREVGAGPSLVTMKVVGSMANGGNLFWGRQLRPELCSQALKKEIVLLQPCLAAASSSVEGNDSGREAKVAPVGFFKKYPALVTGLFFFTWYFLNVIFNILNKKIYNYFPYS

SEQ ID NO: 160503 - protein, 89 aa, Glycine max
  Coding DNA Sequence Number=SeqID_43725
MEVEDEHVKRELMVRRMVVGLRITWYGRLEKGRRYHKWLSEASLMEKYPRLFANSEQNKALVEEDEEHVFKQIWHLPVPCNTQAFVEIV

SEQ ID NO: 160504 - protein, 80 aa, Glycine max
  Coding DNA Sequence Number=SeqID_43726
  Gene Ontology: Mol. function=structural molecule activity; Cellular component=protein complex; Biological process=microtubule-based movement
  Homolog annotation: Hit_ID=P11139; Match level="QueryCoverage=79%, HitCoverage=12%, E-value=7e-09, Identity=53%"; Hit description =Tubulin alpha-1 chain
MMNAHWFQTNMHPLRWVQLKRPRASEVVSDEVVGDVFCVEDEFFGVEELFGCAADFVNDSELEVDKHGADWRHTSPSRTN

SEQ ID NO: 160505 - protein, 67 aa, Glycine max
  Coding DNA Sequence Number=SeqID_43727
MSKLRNENHRNVDKRHKDKFPKWFEHEVKSCQEEYELDENDLDIDDDNGQEEYELDENVEDEDFDIA

SEQ ID NO: 160506 - protein, 92 aa, Glycine max
  Coding DNA Sequence Number=SeqID_43728
MGEGCCTQPYPCICKEAVSGFEPMTNKSPRDILSHDWLKIVMAKRYHDEAGQKKLKPRPTENCSSHVSQKLSWAKDVSWPRLMEKSHDQKMS

SEQ ID NO: 160507 - protein, 92 aa, Glycine max
  Coding DNA Sequence Number=SeqID_43729
MSTTSLRQVSKVTTEVVADCYLLLVHTAQCQEVAGSNRGNVHDKLAASIEGHNKGYWYILHISKRQLEAIEGMSTMSLRQVSKVTTEVVADC

SEQ ID NO: 160508 - protein, 75 aa, Glycine max
  Coding DNA Sequence Number=SeqID_43730
MSKTTKTTKITRTMNNHCRKSFERKTYRESESNNGTYTWFQRRESENETDKGGFVRETSREGETSELLEARKNYK

SEQ ID NO: 160509 - protein, 324 aa, Glycine max
  Coding DNA Sequence Number=SeqID_43731
  Gene Ontology: Mol. function=oxidoreductase activity; Cellular component=vacuole; Biological process=response to oxidative stress
  Homolog annotation: Hit_ID=Q40372; Match level="QueryCoverage=93%, HitCoverage=93%, E-value=1e-129, Identity=75%"; Hit description =Peroxidase precursor
  Pfam annotation: Domain name=peroxidase; Domain location=43-287; Score=459.5; E_value=4.4e-135; Accession=PF00141.13; Description =Peroxidase
MASNIQTLLVLVLATLAIFMIPSNAQLTPNFYKKVCPQALPIIRSVVHREIIRERRIGASLLRLHFHDCFVNGCDGSVLLDDTRNFTGEKTALPNLNSIRGLEVVDEIKEAVDKACKRPVVSCADILATAARDSVAILGGPHLRYSVLLGRRDARTASKDAANANLPPPFFSFSQLLSNFKFHGLDLKDLVALSGGHTLGFARCTTFRDRIYNDTNINPTFAASLRKTCPRVGAGNNLAPLDPTPATVDTSYFKELLCKKGLLHSDQELYKGNGSESDKLVELYSRNPFAFARDFKASMIKMGNMKPLTGNKGEIRRNCRRVNN

SEQ ID NO: 160510 - protein, 177 aa, Glycine max
  Coding DNA Sequence Number=SeqID_43732
MVIDYQRVKTLVKANDNETEIELQLIHSEDQDIGPSASDFTPSPKQVQFAPIAAPMYPYLFDESNQLILTPLSDLIHFNSVEAEEASFIPSWEEVCPWHPSLIENQRRRSPRFILWAFIALGRVLHFLKTKTIWDMGNDDCMRHLQVLWEELQPFGFDLTWLEPHVQSTMSAKTYFE

SEQ ID NO: 160511 - protein, 171 aa, Glycine max
  Coding DNA Sequence Number=SeqID_43733
MVILRPLSFGDNKSRGGRRQIMVIPYTFSPSRGGRVWWHAETNYGHSAPSRPGSIASKDTQRQIMVIMRLVSTRRNEFDNKYRGQLSYPNFVRGPSIVGMRPSFDHFEAHLGLPRSSPEGAFWRKQPSSPGRAGKSKPRRFRDVSVGDFAKIFNRSSSFVVRSSSFFGLQS

SEQ ID NO: 160512 - protein, 62 aa, Glycine max
  Coding DNA Sequence Number=SeqID_43734
MGAMVVVAEASWVFAIDQDNYELLLSRCIKEDLGFKNETHEEVAIKKVGNAFDNRIDAKRTL

SEQ ID NO: 160513 - protein, 231 aa, Glycine max
  Coding DNA Sequence Number=SeqID_43735
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=98%, HitCoverage=15%, E-value=2e-31, Identity=45%"; Hit description=RNase H, putative
MYLTVLDGSIGYVLGQHDSSTRREHAIYYLGKKFIGYETKYSFLEQTYCALTWARRIARWQVLLSEYDIVYVTQKAVKGSALADYIVHQPVENYQSMQCEFPNEGIMALFDNEDSSKERGWIMWFNGNIKELVKQFDEIMFKHIPHEDNQLADALATLSSMLALSKDGDMPLIRIQHHDQPAYCHLVEEESNGKPWCFEIKEYIKSREYPPNASENDQRTLRRLAMSFFPK

SEQ ID NO: 160514 - protein, 268 aa, Glycine max
  Coding DNA Sequence Number=SeqID_43736
  Gene Ontology: Mol. function=RNA-directed DNA polymerase activity; Cellular component=intracellular; Biological process=RNA-dependent DNA replication
  Homolog annotation: Hit_ID=Q1T5N7; Match level="QueryCoverage=77%, HitCoverage=17%, E-value=5e-33, Identity=45%"; Hit description =Peptidase aspartic, active site
  Pfam annotation: Domain name=G-patch; Domain location=165-209; Score =29.0; E_value=1.7e-05; Accession=PF01585.13; Description=G-patch domain
MDHVLARVLVDNGSSLNVMPKTTLAKLLSNESYMKPSTMVVHVLDRFRREVIGEIRLPIHIGPITFEVVFHVMEIASTYSCLLRRPWILGVRAVPSTLHQKLKFIVNDDKLVIIFVEDDLLVSKPSSTPYIKDVEEALETSFQGLEIVNAIDEKEGKEITQPSSASKMVAKVMLENGYQYGHGLGRHGQGPTQSLDLVENKDRFGLGYRPSKDDKKWVMLGKREKRLARLENRVPRIEEVPICDLQESFWSVGFKFPDAITAIKEDIF

SEQ ID NO: 160515 - protein, 42 aa, Glycine max
  Coding DNA Sequence Number=SeqID_43737
MLEERLKAIEGSNYGMAEAANLCLVPDDSLTGAALKWYMQLE

SEQ ID NO: 160516 - protein, 71 aa, Glycine max
  Coding DNA Sequence Number=SeqID_43738
  Gene Ontology: Mol. function=protein serine/threonine kinase activity; Cellular component=nucleus; Biological process=protein amino acid phosphorylation
  Homolog annotation: Hit_ID=Q3C254; Match level="QueryCoverage=84%, HitCoverage=16%, E-value=2e-23, Identity=86%"; Hit description =Mitogen-activated protein kinase
LIGSPDDTSLGFLRSDNACRYVRQLPQYPRQQFAARFPSMSPSAVDLLEKMLVHDPNRRITETLGRNCLML

SEQ ID NO: 160517 - protein, 99 aa, Glycine max
  Coding DNA Sequence Number=SeqID_43739
MAVLEVVSGSEPPMSFELKGVITPWESILTFLMPFSILSPMKTISEKFDKGVPLELPLLAIFRHTSYMFHIPSLSNMSGVKLMLYLYYLVKASPKSFQE

SEQ ID NO: 160518 - protein, 172 aa, Glycine max
  Coding DNA Sequence Number=SeqID_43740
  Gene Ontology: Mol. function=RNA-directed DNA polymerase activity; Cellular component=intracellular; Biological process=RNA-dependent DNA replication
MTCLKLTMPSITSSSFDCLDNQSNEESKDEEGISSELLRLVEQETKKIRPHEEPDDIINLGTEDEKMEVKVGTLICKNEYNKLIKLLHEYTDVFAWLYRDIPGLDVNIVEHKLPLKPECPLVKHKLRQMKPELSLKSIEEVKKQLGTGFIVVAKYPQWVANIVLVPKKDGKV

SEQ ID NO: 160519 - protein, 71 aa, Glycine max
  Coding DNA Sequence Number=SeqID_43741
MNIYGSCEIFHHNNSKDQWPCAYAIGLESYILEGGSMEAKWIWKKDDWRCHFKEKMSQEEAHHHRKPWIRA

SEQ ID NO: 160520 - protein, 86 aa, Glycine max
  Coding DNA Sequence Number=SeqID_43742
MVVPTPHELRLNIILFKTLSRHNLIHHVHMNIIHYNSHFQEARLQEDFDDANSQAYPRPTQEDFDFKKDLSSWIIQVNIKQSKIFK

SEQ ID NO: 160521 - protein, 102 aa, Glycine max
  Coding DNA Sequence Number=SeqID_43743
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SB65; Match level="QueryCoverage=71%, HitCoverage=18%, E-value=4e-20, Identity=64%"; Hit description =Glycoside hydrolase, family 1
MASQKGLIGITLNSDWYVLVSKEKCYRDAACRGLDFMFGWYMGPLIKGEYSKTMRSMLGNRLPEFSKEEARQLKGSLLQHNITTRKMTYTYSQNLSLEVQNP

SEQ ID NO: 160522 - protein, 121 aa, Glycine max
  Coding DNA Sequence Number=SeqID_43744
  Gene Ontology: Mol. function=carbon-sulfur lyase activity; Cellular component=vacuole
  Homolog annotation: Hit_ID=Q1S4J9; Match level="QueryCoverage=84%, HitCoverage=23%, E-value=1e-44, Identity=81%"; Hit description =Alliinase EGF-like; Allinase, C-terminal
  Pfam annotation: Domain name=Alliinase_C; Domain location=4-121; Score=-124.7; E_value=2.6e-07; Accession=PF04864.4; Description =Allinase, C-terminal domain
MLMVCSGDPTIYERFWRQVGDKTTIIIPGWQSLSYFSDGSNICWFLETEFAREVVRLHKVVGNAVTEGRHIVVGTGSSQLILAALYALSSPDAAEPISVVSAAPYYSEFYNVLTNQSNNNI

SEQ ID NO: 160523 - protein, 77 aa, Glycine max
  Coding DNA Sequence Number=SeqID_43745
MGGIEASYVCVRGIVGYGKRERGGDENLRKRKVVTRGEGDEHLGGGLHGKRYMSFDSEESHVLPWKVRSNPFKDFYG

SEQ ID NO: 160524 - protein, 68 aa, Glycine max
  Coding DNA Sequence Number=SeqID_43746
MTVIIVVVNTTIASDDNDEDNGHGSRDGDNNGGDNNDDHTIGDVGTWHGSEWDAWDSSLKTGIRILFN

SEQ ID NO: 160525 - protein, 208 aa, Glycine max
  Coding DNA Sequence Number=SeqID_43747
  Gene Ontology: Mol. function=histone-lysine N-methyltransferase activity; Cellular component=nucleus; Biological process =multicellular organismal development
  Homolog annotation: Hit_ID=Q4VPE8; Match level="QueryCoverage=84%, HitCoverage=99%, E-value=5e-69, Identity=74%"; Hit description =Lateral organ boundaries-like 3
  Pfam annotation: Domain name=DUF260; Domain location=10-110; Score =233.3; E_value=5.1e-67; Accession=PF03195.5; Description=Protein of unknown function DUF260
MASSSSYNSPCAACKFLRRKCMPGCIFAPYFPPEEPQKFANVHKIFGASNVTKLLNELLPHQREDAVNSLAYEAEARVRDPVYGCVGAISFLQRQVQRLQKELDAANADLLRYSYTDITPASLSVPPGLASFHHVPQRQFSARFGNELASGFYRHQSTTATAYSFPYALPWTDTSSEDISEGAGGGALRNCCYPPPTPPPDNTVKQYE

SEQ ID NO: 160526 - protein, 91 aa, Glycine max
  Coding DNA Sequence Number=SeqID_43748
  Homolog annotation: Hit_ID=Q1RV13; Match level="QueryCoverage=90%, HitCoverage=19%, E-value=7e-07, Identity=38%"; Hit description=IMP dehydrogenase/GMP reductase
MALFLFLVVAEGLSDLMTQALAKGMYLGVNVGCNNVEISLLRFTNDTLFFAMLNLKNIMCIKNPHRVQPMEGSNMDANGSKNAKQTKCMEA

SEQ ID NO: 160527 - protein, 112 aa, Glycine max
  Coding DNA Sequence Number=SeqID_43749
MNERKEKEKEQGLDLKHKVPCRFWANVGPGPFLGLNDGVNSALTSLAGVGLDCWSVSSFEDGMLMLDRLVIESEMIVSTGLKRCQVSIGLKRKGKGLGNSITKGTYDTPWNV

SEQ ID NO: 160528 - protein, 183 aa, Glycine max
  Coding DNA Sequence Number=SeqID_43750
  Gene Ontology: Mol. function=ribonuclease H activity; Biological process=RNA-dependent DNA replication
  Homolog annotation: Hit_ID=Q1RYI2; Match level="QueryCoverage=69%, HitCoverage=20%, E-value=2e-17, Identity=35%"; Hit description =Ribonuclease H
MTDDSRNVVECVLELTVKAFILIVSIIVVMSLPRLDAGRDRLVWRGSSDGVFSVKSAYGVISSSQHAPESKLFKLIHRWAGPERIRSFLWKLAHENVLINGKRMRIGISGSDECYSCHNEVESLFHLFPDCRESKQVWHLLVVREQCREFSSCNNWKYWLRTAESEPKWCYPQPGQIVLEMQI

SEQ ID NO: 160529 - protein, 83 aa, Glycine max
  Coding DNA Sequence Number=SeqID_43751
  Homolog annotation: Hit_ID=Q00M75; Match level="QueryCoverage=44%, HitCoverage=6%, E-value=4e-10, Identity=86%"; Hit description=PPR -repeat containing protein
MGEGCCTQPYPCICKEAVSGFEPMTNRSPRHNFTAAPGLALTLNNSINTKNELSKLCSYKYLNMFKYTYLEAIKNYSPIFYVS

SEQ ID NO: 160530 - protein, 319 aa, Glycine max
  Coding DNA Sequence Number=SeqID_43752
  Gene Ontology: Mol. function=RNA-directed DNA polymerase activity; Biological process=RNA-dependent DNA replication
  Pfam annotation: Domain name=zf-CCHC; Domain location=214-231; Score =7.9; E_value=0.048; Accession=PF00098.13; Description=Zinc knuckle
MRMRVSRVVCESKKKSVRVIVRMGVRDDSESENGVGGDVSMDTNISVQKVDVLEEVSKEDVGSTTKQMDGPMIPLSDAELLRWASLRLNTFVVNAFMLAGDYNFALLEGMWMVANHYLILQRWRPLFLMNVEKEKNVAIWIQIQRLPIELYNDVFLNKIGSSLGKFLKVDRLTSIHYRGKFARICVELDLEKPLEMHIYVRGHKLYLEYEGLHSICFWCGLVRHKKDQCREVVEVMSRFPLEKQVEDEVVVVEPLLETSLKERANINAIIANQPNIVTANQDCTKIDNRFGASFVNKGSTNVTTNIEGIEDAFKSQCGV

SEQ ID NO: 160531 - protein, 197 aa, Glycine max
  Coding DNA Sequence Number=SeqID_43753
  Gene Ontology: Mol. function=nucleic acid binding; Cellular component= mitochondrion; Biological process=DNA integration
MDTAANSLLNEEARRKERGMVVQSEANIVENHKRSENRGRSASRSRDKSQGRSKSHFSRITNYYCGKLGHKKFEYIYLKIFLDLSKGGLCIVKIENYVTSKIVGICDITFMTDTWHKLVLKEVRQVPDMYLNLISVGKLDDVGLINQFGACKWKLTKGNMIVARGKKEGFVYVIHGRICKGEANIAHGDSSMELWDR

SEQ ID NO: 160532 - protein, 311 aa, Glycine max
  Coding DNA Sequence Number=SeqID_43754
MAEKTLKEDGVMSSTRKERPRLRKIMLVKSSIRSMLVRKIQQSDREGESIDKANEKCENDESLYFLKMNLPYSDKGCCGSFSGNFISLEARGFESKGSQKFLLIGSYKGEVEMKWEHTEATSNWSKNIENFPNQLRRWNKENVSTLGRNMIKFLLRKRFTGSKILGEDSDGNWVSMLVKLETMVTKFYKDLYSYDSHYHPFVIFHVFPELGDDARKELGSMPTISKIFQTIKYMGSLKALGLDGFQAGVLQNHHAVFEVNKNFITLILNKDESGDNIVAAQEIFHSMSNRKGRKEWMIIKIDLEKTYDRPS

SEQ ID NO: 160533 - protein, 88 aa, Glycine max
  Coding DNA Sequence Number=SeqID_43755
  Gene Ontology: Mol. function=protein domain specific binding; Cellular component=nucleus; Biological process=regulation of progression through cell cycle
  Homolog annotation: Hit_ID=P46077; Match level="QueryCoverage=85%, HitCoverage=28%, E-value=3e-20, Identity=66%"; Hit description=14-3 -3-like protein GF14 phi
MVHVVVLNSTSVLLVASLQSASDLGVARGDKGDEVCVEEFEDSITDVGELSLDLRVVVADGDDMVLVATTFFLLLDRGDDAPRGVACQ

SEQ ID NO: 160534 - protein, 104 aa, Glycine max
  Coding DNA Sequence Number=SeqID_43756
ASEPDDTQRLTSSSAPLSSRDGESDDMRGDGESNDMRGYLMVIRTFCHPETASPMTCGGASEPFDTLTLTSSSAPLSFRGGESDDIRGYLMVIRTFCHQRQRVR

SEQ ID NO: 160535 - protein, 279 aa, Glycine max
  Coding DNA Sequence Number=SeqID_43757
  Gene Ontology: Mol. function=nuclease activity; Cellular component =intracellular; Biological process=DNA repair
FEWAWQHPVESLAVRKAAVEFKSLSGIANKIKLAYTMLTLPSWQSMNITVNFFSTKYMKHCAGCPSLPVHMKTKFGSLDELPCYNKGIDGLSENEDDTIDEVQFDDNNISTSGSVPDVSDDLVTPDSPQNPNDGDKISEAFEWNKESEAREPPLGNSFASQEQSQLFSSTTPLTMKSSSTTSLQRAEIIEEDDFMSVMNKSDADLSQPEPEQSGATTLVANKNRDVGRTFVVPHETEIIDLSTPSPSCRSVLDRKKRRVSSSVGTDFIDLTNSPNFIEL

SEQ ID NO: 160536 - protein, 1011 aa, Glycine max
  Coding DNA Sequence Number=SeqID_43758
  Gene Ontology: Mol. function=RNA-directed DNA polymerase activity; Cellular component=chromatin; Biological process=chromatin assembly or disassembly
  Pfam annotation: Domain name=Chromo; Domain location=919-973; Score =29.9; E_value=9.2e-06; Accession=PF00385.14; Description='chromo' (CHRromatin Organisation MOdifier
  Pfam annotation: Domain name=RVP_2; Domain location=7-130; Score= -22.9; E_value=6.1e-05; Accession=PF08284.2; Description=Retroviral aspartyl protease
  Pfam annotation: Domain name=RnaseH; Domain location=500-617; Score= -19.4; E_value=0.0037; Accession=PF00075.14; Description=RNase H
  Pfam annotation: Domain name=rve; Domain location=687-812; Score=6.5; E_value=0.0017; Accession=PF00665.16; Description=Integrase core domain
  Pfam module annotation: Pfam domain module=Chromo::RVP_2::RVT _1::RnaseH::rve; Domain location=919-973::7-130::240-409::500 -617::687-812
MGEYQTMKIEGKLANVTVEVLIDSGASHSFISPKLTTALGLTVTPTTVRSIKLGDGHRVMSEGVCRGVRIALGTQNFVIDALVLELGGLDVVLGVSWLSTLGKVVMDWKDLSMQFWHNGEMVTLQGQSGRQLQQGFLNSFLEDRKKEFSNEWWWSPNVKIEGGKAQINKGIAEVLGSFPQIFQEQITLPPEREQVHQINLLPNHGPVNVRPYKYPHHQKEEIEKQVTELLQAGVIRPSMSAFSSPVILVKKKDHSWRMCVDYRALNKAIVPDKYPIPIVDELLDELYGATVFSKIDLKSGYHQIRMHEDDVHKTAFRTHNGHYEYLVMPFGLMNAPATFQSTMNHIFRPFLRKFVLVFFDDILVYSNSEQEHLTYLKQVLTVLMKHCFVANRSKCKFGRLQVDYLGHIISGEGVSVDPEKIKCILEWPEPKNVKEVRGFLGLTGYYRKFVKDYGKIARPLTDLTKKDNFLWGETAREAFNQLKKIMTTSPVLVLPNFSIPFEVECDAAGRGIGAVLMQNKQPIAYFSKALSDNNLAKSVYEKELMALVLSIQHWRHYLLGKEFVVYTDHKSLKHFLQQRISSPDQQCWLAKLLGYQFEVKYKPGPENKAADALSRCYDEGDLTALKSGPTWVDSKQLLQEVKQDASVQKIIAEVELNPSAKPGFSVQQGRQKYAATSPGGLLQPLPLPNAIWEDISMDFITGLPKSKGFEAVLVIVDRLSKYSHFILMKHPYNAKTVAELFVKEGTTLKMSSAYHPETDGQSEVINRCLESYLRQPPNLMRFLSNETKVAAVALELQDRDEALNQLKLQLLKAQQQMKYYADLKRKNVQFEVGDWVFLKLRPHRQQSVVRRINQKLAARFYGPFQIIAKVGEVAYKVQLPEQSRIHPVFHVSLLKKAIGDYQVQGELPKELEVIGDDEIYPVKVLGSRVTVQGGVSIPQSLIQWNKKSIDDVTWEDNAVIRGQFPNFSLEDKALSEEGGNDRNVNEELGLDSPKPKVWRVYERKRGKRVTK

SEQ ID NO: 160537 - protein, 102 aa, Glycine max
  Coding DNA Sequence Number=SeqID_43759
  Gene Ontology: Mol. function=nuclease activity; Cellular component =intracellular; Biological process=DNA repair
  Homolog annotation: Hit_ID=UPI00004C0689; Match level="QueryCoverage =65%, HitCoverage=42%, E-value=2e-16, Identity=58%"; Hit description =PREDICTED: similar to GIY-YIG domain containing 2 isoform 2 isoform 2
  Pfam annotation: Domain name=GIY-YIG; Domain location=35-102; Score =9.2; E_value=0.074; Accession=PF01541.14; Description=GIY-YIG catalytic domain
MRKRKVASVIEEEESVQNHGHNNQNENEDCEGNGFFACYLLTSLSPRFKGHTYIGFTVNPRRRIRQHNGEIGCGAWRTKKRRPWEMVLCIYGFPTNVSALQV

SEQ ID NO: 160538 - protein, 185 aa, Glycine max
  Coding DNA Sequence Number=SeqID_43760
  Homolog annotation: Hit_ID=Q75GJ4; Match level="QueryCoverage=25%, HitCoverage=21%, E-value=2e-12, Identity=77%"; Hit description =Expressed protein
MEHVQVVKGKEKQQGEPAQVSEANVHCKGKAIQYAGLGMPRNKKYFLGPVVIDWIRDRLAFKDNIRAGREVGDQVEIGELKGRLTEVISNCDALCKRIATKGPESLVSSIKPFAVTTADQETYLSSSSLRIGMKLPINWDQVIATILSVAISPTILSAGATTLTYYALAAAPVAATGHKATITAL

SEQ ID NO: 160539 - protein, 41 aa, Glycine max
  Coding DNA Sequence Number=SeqID_43761
MTLFHIIKCPQLLNLPSDMDHLTTLTEQNLRYDNPYLLECV

SEQ ID NO: 160540 - protein, 83 aa, Glycine max
  Coding DNA Sequence Number=SeqID_43762
MEKGTSLPMEKDSVEICLHVHIVAQCSHSDDDLDSGDNDDEYRLPMQRVQEKCEEIHEKHGAPSTLEHASFFEDVNYVAAFQP

SEQ ID NO: 160541 - protein, 354 aa, Glycine max
  Coding DNA Sequence Number=SeqID_43763
  Gene Ontology: Mol. function=DNA binding; Cellular component=nuclear pore; Biological process=DNA integration
  Homolog annotation: Hit_ID=Q1T2W1; Match level="QueryCoverage=73%, HitCoverage=35%, E-value=5e-86, Identity=56%"; Hit description =Integrase, catalytic region; Asp/Glu racemase
MSDYEVTGIEDPITHFALFSDCDPTTFESVVKEEKWRKVMDDEIDSIERNDTWELCDLPNGHNTIGVKWACLVAKGYKQQYGVDCTEVFSLVARHDTIRFQMHNCNSVYTPVECGFKLHKDPEGKKINSTLYKQIVGSLMYLTATRPDIMYFVSLISMYMENPTEMHLLAAKRIIRYLQGTREFELFYKRGEKFNLLGFTDSDYAGDSDDRKSTSGYVFMMGSTAISWSSRKQPIITLSTTEAKFIATSTCACQAIWLRNILEEVHFKQQGPTLIYCDNSSTIKLSKNPIMHGRSKHIDVRFHFLRNLSNEEIIDLIYYKSEEHIVDIMTKPLKLSAFQKLRNLLGVCKLNESH

SEQ ID NO: 160542 - protein, 32 aa, Glycine max
  Coding DNA Sequence Number=SeqID_43764
MEGTKIKTTFKCHQQITDEPDYHGYGKSPSKI

SEQ ID NO: 160543 - protein, 517 aa, Glycine max
  Coding DNA Sequence Number=SeqID_43765
  Gene Ontology: Mol. function=extracellular matrix structural constituent; Cellular component=proteinaceous extracellular matrix; Biological process=multicellular organismal development
  Homolog annotation: Hit_ID=Q67YL8; Match level="QueryCoverage=61%, HitCoverage=53%, E-value=3e-12, Identity=25%"; Hit description=MRNA, complete cds, clone: RAFL24-22-E06
MIKRFPSRNNQRSKGIKVKHNHDKQNEFANDSKLSVSTQTDLILKLGRRDLHPGKHEEIQNEKHEEEEEDEHNEEDEENKHGHEEQEDGNKHETEEREEYKHEGREQGDEENKHGAEDQEEAENENEDEGRGGGGDDDIDENDQEKSELDNTDRDDELLDGEQEKEEVDEKENENEDDEKESLVENHNNHEAREEHYKGDDASSAVAHDTHATSTETETLSLENSDVNLEMNIPKPENETTYSDESVGKQNDSDLKVSEGDMIDGISSNTTAVQETGNNTLSNPVDDSSLLNKTTATNSDSHLESSSNLTVVTTEASNNLTGAGNDTSSSSEQNKKVMLSESDQAQSSTMNTTIPGDIKNVQTEGLEQSGNRTSDENLHDTNSTISVKTENGGVDAGESSNLVASNVTENTYRNERSESDISESGKFNGNSETSETDENQNVDATEDEMFKGDTLTGETDETSDSSSANKTMDSAEQDAIDSSDTHIHEDVAEALTDLDTLPDIRNEGDDSDETAAE

SEQ ID NO: 160544 - protein, 772 aa, Glycine max
  Coding DNA Sequence Number=SeqID_43766
  Gene Ontology: Mol. function=histone deacetylase activity; Cellular component=nucleus; Biological process=histone deacetylation
  Homolog annotation: Hit_ID=Q1S4J3; Match level="QueryCoverage=57%, HitCoverage=93%, E-value=0.0, Identity=82%"; Hit description=Histone deacetylase superfamily
  Pfam annotation: Domain name=Hist_deacetyl; Domain location=25-338; Score=579.8; E_value=2.5e-171; Accession=PF00850.10; Description =Histone deacetylase family
  Pfam annotation: Domain name=MTS; Domain location=531-701; Score= -83.5; E_value=0.016; Accession=PF05175.4; Description=Methyltransfera se small domain
  Pfam annotation: Domain name=Methyltransf_11; Domain location=558 -664; Score=1.1; E_value=0.042; Accession=PF08241.2; Description =Methyltransferase domain
  Pfam module annotation: Pfam domain module=Hist_deacetyl::MTS::Methylt ransf_11; Domain location=25-338::531-701::558-664
MEEESSIIEGGASLPSSGSDAKKRRVTYFYEPTIGDYYYGQGHPMKPHRIRMAHNLIVHYSLHRRMEINRPFPASPADIRRFHSDDYVDFLSSVSPETLADSAFSRHLKRFNVGEDCPVFDGLFPFCQASAGGSLGAAVKLNRADADIAINWAGGLHHAKKSEASGFCYVNDIVLGILELLKAHRRVLYVDIDVHHGDGVEEAFYTTDRVMTVSFHKFGDFFPGTGHVKDIGVGSGKNYAVNVPLNDGMDDESFRSLFRSIIQKVMEVYQPEAVVLQCGADSLSGDRLGCFNLSVRGHADCLRFLRSFNVPLMVLGGGGYTIRNVARCWCYETAVAVGVEPDNKLPYNEYYEYFGPDYTLYVDPSNMENLNTSKDLEKLRNTLLEQISRLPHAPSVPFQTTPPTLQLPEEAEENMDRRPKLRKWDGEDYDSDPEEGGKDNSKFSNITAHMRDIADEMEEEKPEEHPSSSKCQQQQKTQEDGIPADEVKILAKFKSRHNYIRVLEVSRKAEHPFRGSRLLLLDTPGNIHSISFLFKSLTNTYFDVFATLPPIVPPGPLALLGFGAGTAARLLLLHHPSALLHCWELDPAVIQVAREYFNLARLERDNQDRLFIYVGDALNATVPNGFSGIVVDLFSKGSLIPELQDPATWRMLRGRLRKGGRIMVNVGGSCVEAENRLRDGKVVMEETLGAMKEVFGKKVFVLSLGNRKDDSSLALTGDLPHLEEWKNRLPDAWSNFKLLVCPSAEEFTWVGDHITKKFLLKSPVETTDATET

SEQ ID NO: 160545 - protein, 94 aa, Glycine max
  Coding DNA Sequence Number=SeqID_43767
MVLAFEEKAQTKGFFLHPYNNQDQGSTTLPIECDFGVSDLRTEIAPLPQTVLLNAEFLGLSGCFLFVITETLFSPHSCNVLAMPLISFMNWDWD

SEQ ID NO: 160546 - protein, 363 aa, Glycine max
  Coding DNA Sequence Number=SeqID_43768
  Gene Ontology: Mol. function=DNA binding; Cellular component=nucleus; Biological process=regulation of transcription
  Homolog annotation: Hit_ID=Q1S4I9; Match level="QueryCoverage=99%, HitCoverage=100%, E-value=5e-88, Identity=52%"; Hit description =Homeodomain-related
  Pfam annotation: Domain name=Myb_DNA-binding; Domain location=14-61; Score=44.2; E_value=4.4e-10; Accession=PF00249.21; Description=Myb -like DNA-binding domain
  Pfam annotation: Domain name=Myb_DNA-binding; Domain location=67-107; Score=16.9; E_value=0.073; Accession=PF00249.21; Description=Myb-like DNA-binding domain
  Pfam module annotation: Pfam domain module=Myb_DNA-binding::Myb_DNA -binding; Domain location=14-61::67-107
MGRHSCCVKQKLRKGLWSPEEDEKLFNYITRFGVGCWSSVPKLAGLQRCGKSCRLRWINYLRPDLKRGMFSQKEEDLIISLHEVLGNSSKLPGRTDNEIKNFWNSCLKKKLLKQGIDPSTHKPLTEAHVKEEKKITETLSPMQTPLSQGSSVPLIFPSSQGSSLLISDSNYYDGGLKEASREIFMTKPALDPLSYYDFPMGVAQSGFNLPMSQYQTSLKASDQNPFGPNSSYVFSTMPSLTNSDHGNVSVTEFSDNNSASKISSLFMSDQVKESSSNSSNMSTIYPISSSMMENAGFSLWEGDNKFDPLFQFQVNATKSEDFKTSSWEEEQLHTQNSIDFTSFPLTSLSEDLTGANFDVFQHI

SEQ ID NO: 160547 - protein, 600 aa, Glycine max
  Coding DNA Sequence Number=SeqID_43769
  Gene Ontology: Mol. function=binding
  Homolog annotation: Hit_ID=Q6YT02; Match level="QueryCoverage=95%, HitCoverage=98%, E-value=2e-83, Identity=33%"; Hit description =Putative armadillo repeat containing protein
  Pfam annotation: Domain name=Arm; Domain location=189-230; Score =26.7; E_value=8.2e-05; Accession=PF00514.13; Description =Armadillobeta-catenin-like repeat
  Pfam annotation: Domain name=Arm; Domain location=232-272; Score=7.7; E_value=1.3; Accession=PF00514.13; Description=Armadillobeta-catenin -like repeat
  Pfam annotation: Domain name=Arm; Domain location=424-460; Score=0.5; E_value=11; Accession=PF00514.13; Description=Armadillobeta-catenin -like repeat
  Pfam annotation: Domain name=Arm; Domain location=461-497; Score=0.1; E_value=12; Accession=PF00514.13; Description=Armadillobeta-catenin -like repeat
  Pfam annotation: Domain name=Arm; Domain location=503-542; Score=7.4; E_value=1.4; Accession=PF00514.13; Description=Armadillobeta-catenin -like repeat
  Pfam annotation: Domain name=HEAT; Domain location=200-232; Score =0.7; E_value=35; Accession=PF02985.12; Description=HEAT repeat
  Pfam annotation: Domain name=HEAT; Domain location=238-274; Score =13.1; E_value=1; Accession=PF02985.12; Description=HEAT repeat
  Pfam annotation: Domain name=HEAT; Domain location=379-410; Score =0.6; E_value=37; Accession=PF02985.12; Description=HEAT repeat
  Pfam annotation: Domain name=HEAT; Domain location=425-462; Score =11.0; E_value=1.9; Accession=PF02985.12; Description=HEAT repeat
  Pfam module annotation: Pfam domain module=Arm::Arm::Arm::Arm::Arm::HE AT::HEAT::HEAT::HEAT; Domain location=189-230::232-272::424-460::461 -497::503-542::200-232::238-274::379-410::425-462
MGKPNPNPAPEEEKSLRDELLGPILLGERVIKLAQEAESPKVDCTELARKVQVVCDNLRSVVRVVSGTQCVNERPIRRIVGEVSKNIERTLALIRKCKKHGGVLRQVFSMTTTADFRKVRSLLESSNGDLVWLLTILDSKDGTNVSLPPIASNDPILAWVWTFTYTLQLGQPKDRAEAATELGSLARDNDRTKFIILDEGGVMPLLKLLKEASSPAAQVAAANALVNITTNQDRVVTFIVESHAVPIIVQVLGDSPMRVRVSVANLVSAMAEQHELAREEFVRANVARPLVSLLSMDMGTVLTDPVADRATSIHSLVLNLSNVGEANSDGSSRGSGQHRRDREVESPELRNEVKVSCAKALWKLSNGCLSSCRKITETKGLLCLAKIIESESGELQLNCLMAVMEIAAVAESNADLRRAAFKRTAPAAKAVLDQLLRVVQEESDPALRIPAIKAIGSLARNFSGKVPQVIGPLVAQLGNRDVDVASEAAIALGKFVCPDNYNCVDHSKAILELDGIPKLMSLLQINDRQQVHGLKLLCYLALNVGNSRVLEQERALNTLERFARPVQAQHPDLKDLFAKALHHLTLYQPGAQLHRQPLGL

SEQ ID NO: 160548 - protein, 135 aa, Glycine max
  Coding DNA Sequence Number=SeqID_43770
  Gene Ontology: Mol. function=copper ion binding
  Homolog annotation: Hit_ID=Q1S4I6; Match level="QueryCoverage=100%, HitCoverage=17%, E-value=2e-56, Identity=80%"; Hit description =Copper amine oxidase
  Pfam annotation: Domain name=Cu_amine_oxidN2; Domain location=8-118; Score=21.9; E_value=8.5e-05; Accession=PF02727.6; Description=Copper amine oxidase, N2 domain
MSRTQSSHPLDPLSAAEISVAVATVRAAGATPELRDSIRFIEVVLLEPDKHVVALADAYFFSPFQPSLLPRTKGGAVIPSNLPPRCARIVVYNKKTNETSIWIVELSQVHAVTRRGHHRGKVISSQVVPDAQPPM

SEQ ID NO: 160549 - protein, 66 aa, Glycine max
  Coding DNA Sequence Number=SeqID_43771
MEAKRSWKGPESHYLIRMEELSKTKMDDYNQEQPHYQFVKKRKEYSIKIKLLLKSTGGEYYTGNLI

SEQ ID NO: 160550 - protein, 55 aa, Glycine max
  Coding DNA Sequence Number=SeqID_43772
MALVLQKATPPPSVLAASTHANKLPTPVISEPSATHALPPKGSLLPKLLFDCKSH

SEQ ID NO: 160551 - protein, 164 aa, Glycine max
  Coding DNA Sequence Number=SeqID_43773
MEDVNRTPREAKDYYSRSIWLSETAQAFGNLKRSDRDNVNGRDSYGYNFQEIVTPEVSGAFDEIKGLIRVNDEVIGEEENGDYGHYSRQSLTTEIVEIVEDGKSISNKDRRVDDLYVAVGKDDLNVVKWALDHAVSPGSRIFLIHVSSPITLIPTPGRLFHQVQ

SEQ ID NO: 160552 - protein, 562 aa, Glycine max
  Coding DNA Sequence Number=SeqID_43774
  Gene Ontology: Mol. function=ATP-dependent helicase activity; Cellular component=nucleus; Biological process=mRNA catabolic process, nonsense-mediated decay
  Homolog annotation: Hit_ID=Q5N7W5; Match level="QueryCoverage=75%, HitCoverage=76%, E-value=1e-134, Identity=56%"; Hit description =Putative DEAD box RNA helicase
  Pfam annotation: Domain name=DEAD; Domain location=202-381; Score =200.9; E_value=3.1e-57; Accession=PF00270.19; Description=DEADDEAH box helicase
  Pfam annotation: Domain name=Helicase_C; Domain location=391-506; Score=59.6; E_value=9.9e-15; Accession=PF00271.21; Description =Helicase conserved C-terminal domain
  Pfam annotation: Domain name=ResIII; Domain location=182-346; Score= -38.4; E_value=0.077; Accession=PF04851.6; Description=Type III restriction enzyme, res subunit
  Pfam module annotation: Pfam domain module=DEAD::Helicase_C::ResIII; Domain location=202-381::391-506::182-346
  Subcellular localization annotation: CTP_CleavageSite=79; ConfidenceScore=5.18e-01
MNPYDNRYSDAASFRGRRSDFVGPIPPPSFVGRGGAVPYGVPGPNGFGSAPVAPVPPFVPPSGGFNVGRGGGRAGNGPVSDRKHDMGRGRGGGGGGRAGAHGFRGSARGGGRHGGGSSRDDLNNIALPKQDFKNLVPFEKNFYVECPAVRAMSEQEVLHYRASREITVQGNDVPKPIMMFHEANFPDYCLEVIANLRFADPTPIQAQGWPMALKGRDLIGIAETGSGKTLAYLLPALVHVNAQPRLAHGDGPIVLVLAPTRELAVQIQEEALKFGSRANKRSTCIYGGAPKGPQIRELKRGVEIVIATPGRLIDMLEAQHTNLRRVTYLVLDEADRMLDMGFEPQIRKIVAQGLKDSPVQQRFPDLPSALLSTISIQKSKADTLPSSTACSKAQIQMEALSIHGDKNQAERDWVLAEFKSGRSPIMTATDVAARGLGPYCQCVGTACNLTKVGRLSAPVNLGTIFFRGVKLYGCLDVKDIKCVINYDFPTSLEDYVHRIGRTGRAGAKGTAYTFFTHANAKFARDLIKILQDAGQTVSPALTALDQGEVFAQEDEEAMEIVV

SEQ ID NO: 160553 - protein, 143 aa, Glycine max
  Coding DNA Sequence Number=SeqID_43775
MLAIITKYQEELNLVVAHEQKVADEYAKCTRKRRLEEGKNTITKHAPRHPYRTRSKSRMMGDQEETQEQMKADMSALKKQMAFMMEAMLGMRQLMEKNVAIAAAVSLAAKADPTLLATAHHPPPNAVGQEKSTQGHNSNPQTQ

SEQ ID NO: 160554 - protein, 35 aa, Glycine max
  Coding DNA Sequence Number=SeqID_43776
MATIALSSRYGSKLAYDTGIWGMAFVDNLVVGKEK

SEQ ID NO: 160555 - protein, 209 aa, Glycine max
  Coding DNA Sequence Number=SeqID_43777
  Gene Ontology: Mol. function=oxidoreductase activity; Cellular component=integral to membrane; Biological process=electron transport
  Homolog annotation: Hit_ID=Q9FGS9; Match level="QueryCoverage=94%, HitCoverage=27%, E-value=7e-67, Identity=62%"; Hit description=FRO1 and FRO2-like protein
  Pfam annotation: Domain name=Ferric_reduct; Domain location=1-115; Score=78.7; E_value=1.8e-20; Accession=PF01794.9; Description=Ferric reductase like transmembrane component
MALLLLPILRGLAVFRILGIQFEASVRYHTWIGTAMILFATIHGASTLLVWGVSHHIEDEIWKWQKTGRIYLAGEIALVVGLVIWVTSLPQIRRRKFEIFYYTHHLYAVFLVLFLFHVGDRHFYTVFPGIFLFSLDKLIRIIQSSPKTCMVSARIFPGRALELILPKDPGMKYNPTSVIFFEDSNHISSSMALFSVSYLVPGLMITFYL

SEQ ID NO: 160556 - protein, 292 aa, Glycine max
  Coding DNA Sequence Number=SeqID_43778
  Gene Ontology: Mol. function=oxidoreductase activity; Cellular component=integral to membrane; Biological process=electron transport
  Homolog annotation: Hit_ID=Q9FGS9; Match level="QueryCoverage=97%, HitCoverage=41%, E-value=9e-37, Identity=36%"; Hit description=FRO1 and FRO2-like protein
  Pfam annotation: Domain name=NAD_binding_6; Domain location=8-266; Score=19.0; E_value=1.1e-06; Accession=PF08030.2; Description=Ferric reductase NAD binding domain
MKTIVCRYDTLLLVAGGSGITPFLSILAEADSATNKSRFPSRIQLVYVIKKAQDFCLLHPISHLLLNQSTEKFHLNLKLFVTQETQAEVGIRELLNEFFKVRTLQVNSMCSNYAAYGPESPSWMAAITGFCSITFLIFVICFNHIIIPSGKRSKMAKEKTPSWVVDLLLIAAFVLALAFSASVAAILRWRRLRKGIPQISHREIQPLDLSSAEARNALEDHEVHFGGRPNFKDIFGKLHDESDGSNIGVLVCGPESMKESVAFACQQESECFKASGKRTESCFTFHTLNFTL

SEQ ID NO: 160557 - protein, 209 aa, Glycine max
  Coding DNA Sequence Number=SeqID_43779
  Homolog annotation: Hit_ID=Q1S4I1; Match level="QueryCoverage=99%, HitCoverage=100%, E-value=3e-40, Identity=49%"; Hit description =Octicosapeptide/Phox/Bem1p
  Pfam annotation: Domain name=PB1; Domain location=24-123; Score=47.2; E_value=5.7e-11; Accession=PF00564.15; Description=PB1 domain
MESKAIDNTIKILYSYGGKILPRHTDAKLRYYGGHTRVLSLHPSTSFSGACVLTLQCFTELILKLTELCASPVTLKCPLPNGDLDTLISVTSDEDLANIIHLYDRASSSLPHRLKIRAILSPPKKLSPSPSSPSSSAAHSPSGGSPHSAADSLPCPAAHQFVRRKCSPVPVAYPISVRSGAAKGCMYTRQLDGSPRFLYRGVHWNNYCH

SEQ ID NO: 160558 - protein, 73 aa, Glycine max
  Coding DNA Sequence Number=SeqID_43780
MMLPYAGTKEDRTGNSYLAAAADQEKNSYVDIIISETFFIQEVPRANQSFSPSSCNTCVLFLSSSANMSLEVL

SEQ ID NO: 160559 - protein, 124 aa, Glycine max
  Coding DNA Sequence Number=SeqID_43781
MTKISIIITLLIAVTASCFVCVLLDRKIEGFYMVVALVTIIASAMVLAFRATMVTFITVLRYIQIREGALGSGLCHLYQLVCHLSMNEEEDLSERLSAELRTNLRFDKVDPCQPAAKDLLQKLG

SEQ ID NO: 160560 - protein, 477 aa, Glycine max
  Coding DNA Sequence Number=SeqID_43782
  Gene Ontology: Mol. function=zinc ion binding; Cellular component =cytoplasm
  Homolog annotation: Hit_ID=Q6ZH84; Match level="QueryCoverage=75%, HitCoverage=49%, E-value=6e-69, Identity=38%"; Hit description =Putative ubiquitin-associated (UBA) protein
  Pfam annotation: Domain name=UBA; Domain location=434-474; Score =19.4; E_value=0.013; Accession=PF00627.21; Description=UBATS-N domain
PHVSTGPFTKNGVPEEPITFEARGQQIPSADLAFNATQQVEAGVAPVDLNVPPFDPFLAQFPDGDGKKGEMLAVNSSASKDDNSGICSSSAGPNNNSTQTTSLTSGAFIDCPGSYYSWPPPLPGNYKMPPFKRSHSHTDAMSGMFHKGVRCDGCGVYPITGPRFKSKPTLPPHILKKGAILKHARPRLDSRFILDVNVIDGTMMAPSTAFTKIWRIRNNGSIVWPKGTQLVWIGGDKFSDFHLVDLQVPEDGVPVEKELDIAVDFTAPPLPGRYISYWRMTTPSGHKFGQRVWVLIQVDASLQDSFYDTSQGLNLNIPLDISGSKGPQIIDINVQPTEEDTVLQTRNPNAPIEPVNQMVDNEPRFELENEFPINEATFVGPAASAPAATPVASSSVSYPIIDLSETTPAVPSNQQSSTVDVPSSSMGTGGINSVEESLLKELEEMGFKQVDLNKEILRNNEYDLYQSLDFLCGVSEW

SEQ ID NO: 160561 - protein, 635 aa, Glycine max
  Coding DNA Sequence Number=SeqID_43783
  Gene Ontology: Mol. function=helicase activity; Cellular component =intracellular; Biological process=protein amino acid phosphorylation
  Homolog annotation: Hit_ID=Q94DI0; Match level="QueryCoverage=87%, HitCoverage=94%, E-value=1e-129, Identity=35%"; Hit description =Pentatricopeptide (PPR) repeat-containing protein-like
  Pfam annotation: Domain name=PPR; Domain location=128-162; Score=6.6; E_value=1.2; Accession=PF01535.11; Description=PPR repeat
  Pfam annotation: Domain name=PPR; Domain location=265-299; Score =19.4; E_value=0.013; Accession=PF01535.11; Description=PPR repeat
  Pfam annotation: Domain name=PPR; Domain location=300-334; Score=9.6; E_value=0.54; Accession=PF01535.11; Description=PPR repeat
  Pfam annotation: Domain name=PPR; Domain location=372-406; Score =13.8; E_value=0.17; Accession=PF01535.11; Description=PPR repeat
  Pfam annotation: Domain name=PPR; Domain location=407-441; Score =39.1; E_value=1.5e-08; Accession=PF01535.11; Description=PPR repeat
  Pfam annotation: Domain name=PPR; Domain location=442-476; Score =42.5; E_value=1.4e-09; Accession=PF01535.11; Description=PPR repeat
  Pfam annotation: Domain name=PPR; Domain location=513-547; Score =15.1; E_value=0.12; Accession=PF01535.11; Description=PPR repeat
  Pfam module annotation: Pfam domain module=PPR::PPR::PPR::PPR::PPR::PP R::PPR; Domain location=128-162::265-299::300-334::372-406::407 -441::442-476::513-547
MNRVKAIASSLRTLESSLATRVLVTRNQVTHFSLHNPLPLFDRSHHLRFPITHHKLYFSTKPKPNSIVELLLTNDWSQALELKLENRFPSMPHETVLYVIKRLDKNPEKASCFFNWVCKKVWFRPSCSVYSLIVRILAAKDTMKQFWVTLRMMKENGFFLDEETYLTISVGFKREKMDSDSVALTHFYNRMLEENAMQSVVSNVVGIISRSEWGDEVVGELAKLEIQLSDNFVIRVLKELRKTPLKAYKFFHWVGKQSGYEHDTVTYNAVARVLPRAESIEEFWSVIEEMKRVGHELDIDTYIKITRQLQRNRMMEDAVKLYELMMDGSCKPLVQDCNMLLKSISANDKPNLDLVFRVAKKYESTGHTLSKAIYDGIHRSLTSAGNFDEAENIVRTMRNAGYEPDNITYSQMVFGLCKMRRFEEACKVLEDMESSRCIPDIKTWTILIQGHCSANEVDKALLCFAKMIEKGCDPDADLLDVLADGFLSQKRIEGAYELVAEISRKCRISPWQATYKKLIEKLLGVMKFEEALELLRLMKSHNYPPYHLPFVPYISKFGSVEDAEAFLKALSVKSYPSHIVYVQVFESLFREGRLSEAKDLLYKTPHHIRTHSKICKLFGSSETKSDTQAQLLPDP

SEQ ID NO: 160562 - protein, 179 aa, Glycine max
  Coding DNA Sequence Number=SeqID_43784
MHSYFPVTRKRRKKLRLLHMSDVRPCLPRNAMKKRPEIQQHQHEPQDLEVLKAVAQAWYSHSGTSKPMSEFYAHRRNFRGSKPSRFKLEALNKPQASSSSRDTTTIYWDFQQSLWDSYELVTVSRRIETGLTLDNPFDELCGSASIQHKRKPESKNSLRNLFNLMSSRRFNAHNTPHQK

SEQ ID NO: 160563 - protein, 65 aa, Glycine max
  Coding DNA Sequence Number=SeqID_43785
  Gene Ontology: Mol. function=protein serine/threonine kinase activity; Biological process=protein amino acid phosphorylation
  Homolog annotation: Hit_ID=Q6ZLP5; Match level="QueryCoverage=79%, HitCoverage=13%, E-value=8e-08, Identity=70%"; Hit description =Putative CBL-interacting protein kinase 23
MDIMLQMGDLKKMKQEVISNNLLILLITAILEPENLLDSNGVLKVLHFGLSTYSQKTLKLPKVKI

SEQ ID NO: 160564 - protein, 73 aa, Glycine max
  Coding DNA Sequence Number=SeqID_43786
  Homolog annotation: Hit_ID=Q9FHN0; Match level="QueryCoverage=91%, HitCoverage=7%, E-value=1e-13, Identity=52%"; Hit description =Similarity to endopeptidase
MDPGTVDIYPSSRIPKNLHYLVKPIYSSKSLITKDLSGSRGTLKEKGFRITTDPQTLTSVLQFSSDDEVVSIQ

SEQ ID NO: 160565 - protein, 33 aa, Glycine max
  Coding DNA Sequence Number=SeqID_43787
MELASVECTNLVGWPRRGWQAWLKNLSISEGML

SEQ ID NO: 160566 - protein, 471 aa, Glycine max
  Coding DNA Sequence Number=SeqID_43788
  Gene Ontology: Mol. function=ammonium transporter activity; Cellular component=membrane; Biological process=transport
  Homolog annotation: Hit_ID=Q1SM09; Match level="QueryCoverage=96%, HitCoverage=97%, E-value=1e-156, Identity=57%"; Hit description =Blood group Rhesus C/E and D polypeptide; Rh-like protein/ammonium transporter
  Pfam annotation: Domain name=Ammonium_transp; Domain location=24-440; Score=247.3; E_value=3.3e-71; Accession=PF00909.11; Description =Ammonium Transporter Family
MSHLPSNLLPVDGSPEWMNRGDNTWQLTSATLVGLQSVPGLVILYGSIVKKKWALNSAFMALYAFAAVLVCWVGWCYKMSFGERILPFLGQPNTALDREFVFRKTFAGEFPNATMVYFQLVFAAITLILIAGALLGRMNFYAWMLFVPLWVTFSYTICAFSIWSTDGWLFKMGLIDYSGGFVIHLSSGVAGFVAACWVGPRAVKDRERFPPNNILLMLAGAGLLWMGWSGFNGGDPYAASIDASLAVLNTHVCTAMSLLTWLFLDILFFGKPSVIGATQGMITGLVCITPAAGVVQGWAAIIMGMMSGSIPWYTMMVLHKESKLLKQVDDTLAVFHTHAVAGSLGGILAGFFADPKLCYLFYGVEDSLHYTGLVYGIFNGRPNAGFRQMMVQLLGIVFVILLNVTTTSIVCLLVRIIVPLRLSEDDLQVGDEAVHGEVAYALWGDGEKLETATEPLTSEKNLEWPTVELRT

SEQ ID NO: 160567 - protein, 340 aa, Glycine max
  Coding DNA Sequence Number=SeqID_43789
  Gene Ontology: Mol. function=pyridoxal phosphate binding; Cellular component=chloroplast; Biological process=amino acid metabolic process
  Homolog annotation: Hit_ID=O31182; Match level="QueryCoverage=52%, HitCoverage=45%, E-value=2e-77, Identity=83%"; Hit description =Cystathionine gamma-lyase-like protein
  Pfam annotation: Domain name=CBS; Domain location=28-145; Score=36.4; E_value=9.9e-08; Accession=PF00571.18; Description=CBS domain
  Pfam annotation: Domain name=Cys_Met_Meta_PP; Domain location=176 -340; Score=49.2; E_value=1.1e-22; Accession=PF01053.10; Description =CysMet metabolism PLP-dependent enzyme
  Pfam module annotation: Pfam domain module=CBS::Cys_Met_Meta_PP; Domain location=28-145::176-340
MYNDYWMLDNGFLERPQHGDLRDLILRPYGQRDTVVIGPNDLLTTAYQRMKLYDVSQLPVMDGDQLVGIVDESDVLLHVYGDEARFRDTVATAMVSKLDRLDVKSPIEALLPVFDRGQVAIVMDGDTSPLNSGLFASKLVKAALIDSRSFDGAARRRHSGNDMSNSSSPDRALALATLAIHGGQSPDPSTGAVMPPIYATSTYAQSSPGEHQGFEYSRTHNPTRFAYERCVASLECGTRGFAFASGMAASSTVIELLDAGSHVVAMDDIYGGSFRLFERVRRRTAGLDFSFVDLTDLAAFEASITPKTKMVWIETPTNPMLKIVDIAAVAAIAKRHGLIV

SEQ ID NO: 160568 - protein, 71 aa, Glycine max
  Coding DNA Sequence Number=SeqID_43790
  Subcellular localization annotation: CTP_CleavageSite=41; ConfidenceScore=5.39e-01
MLPFDFRHVSGTSRIVQQRVPSTSKRSNKGCMPSNNGPRTKLGYDSHLRRWTIKRSFDSVERRENINALDH

SEQ ID NO: 160569 - protein, 134 aa, Glycine max
  Coding DNA Sequence Number=SeqID_43791
MGTNQNGKRFYQVKIKGLDVTSLKELGRLMGPLQRQAFRKVYAKILDLTTAEQDCSCGRRFSKRVGSYEANLKRRKYLEDKTRDMANQEEWVPFVDILALLIFGVVLFPNVDGLVDLAAIDAFLAYHHSKESPV

SEQ ID NO: 160570 - protein, 93 aa, Glycine max
  Coding DNA Sequence Number=SeqID_43792
TSHIEMLEIEQRKVSRNSNGHNFSHGSPILAHNISRRPKLNNGSSREIPTVITFNTKVRFRQIIYQDAQNLTTKALEKFKWSLLFLRRSDSGA

SEQ ID NO: 160571 - protein, 220 aa, Glycine max
  Coding DNA Sequence Number=SeqID_43793
  Gene Ontology: Cellular component=integral to membrane; Biological process=polysaccharide biosynthetic process
  Homolog annotation: Hit_ID=Q46639; Match level="QueryCoverage=80%, HitCoverage=50%, E-value=4e-68, Identity=73%"; Hit description =Amylovoran biosynthesis protein amsL
AAESALSPASKSPASRHPSLYRRSAHRPEYAAGFAVELPRWPPRLLAKVDHAENAREGVDEQPENRCRYRQGGEIEHRHRTQEGKQLGAHLNLRQRHHAFGFDIVRLILRQVTEHEEVEAGQHNQRRQLRQMVEPRHRPGDGQHDQTGTEAQRDVNPVNGALLTTCNLLTMHDIAAHAHVLQHGSYRQNGVDDRQQTQLVRFQLARQHRQLQHLQQRGKA

SEQ ID NO: 160572 - protein, 113 aa, Glycine max
  Coding DNA Sequence Number=SeqID_43794
MWQWGVDRITKGADNYKARLPLVDKGADDDVSHCMLPDPLIRQALENVVFHLLAKPICWLNERPLSATLLGYARGRIQKTMSYTGSLSAPLQVIKRTASAHPLSERSALSQNP

SEQ ID NO: 160573 - protein, 133 aa, Glycine max
  Coding DNA Sequence Number=SeqID_43795
MLKDENLADAVETSAMVAPRGRGGGRNSRGGRGGRGESPHCTYWKRMGYTQENCYSLHGSPEKVAQVSKSEKPESGFSNEKYQEYLRLKSEKSSNQASSSSAPCFSTACVSQFIGSPSPWILDSNASDHISGT

SEQ ID NO: 160574 - protein, 324 aa, Glycine max
  Coding DNA Sequence Number=SeqID_43796
  Gene Ontology: Mol. function=RNA-directed DNA polymerase activity; Cellular component=intracellular; Biological process=RNA-dependent DNA replication
  Pfam annotation: Domain name=rve; Domain location=34-190; Score =126.8; E_value=6e-35; Accession=PF00665.16; Description=Integrase core domain
SMETDCCKHARKCHKCQIYADRMHVPPTTRKVLSSPWPFPMWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKDWHEMLPYALHGYRTSVRTSTGATPFSLVYGMEAVLPVEVEIPSMRVLMEAQLSEAEWCQSRYDQLNLIEEKRMKALCHGQLYQQRMKQAFDKKVRPRVFQEGDLVLKKVLSFQPDSRGKWTPNYEGPYVVKRTFSGGALTLTTMDGDELPRPVNADAVKKYFV

SEQ ID NO: 160575 - protein, 153 aa, Glycine max
  Coding DNA Sequence Number=SeqID_43797
MLEIGLTFGRPLVLGILEVVSNPWRFILVNWFYDADLVNPTRIDRVLTNKDLLADSYPDLEAFNLDEKEFLLLKVISTLPELSCLICSMVGAGLGTDNVALSMTHFPKRVASSHFMVLGRETLAFVISVINKVVSPLCGFKKTLVSQVFMTLY

SEQ ID NO: 160576 - protein, 112 aa, Glycine max
  Coding DNA Sequence Number=SeqID_43798
MEDYYKEMEIAMIRANVEEDHKATIAIFIGGLKKDIADVMNLSSNSFATAKDIESERSSDDEMPPLEDCIDVDVAEPINEDVLVTRCALNMKPKVGGCRNLPFGGRATRDSR

SEQ ID NO: 160577 - protein, 179 aa, Glycine max
  Coding DNA Sequence Number=SeqID_43799
MGLYVQRKDGTLRLVAMGKIMQGDSIIHTVAYADDVARDPESIPHNEDAHVPKPTNVDADDPLRGLIKYSFDIYNKPVEINFDGSCFGIVDAPTSIFIAYSDVSEIIAGDKSLNISVLQLWLMYMHEWSQIFSQGSMYAFLEPQSLVCSKDRCSECQQYLERWLKEYDREVYIGPYFLQ

SEQ ID NO: 160578 - protein, 57 aa, Glycine max
  Coding DNA Sequence Number=SeqID_43800
MTNANCPQESLHSVSNGNLSCLYSILHSVEASFMMMNQEVLIMTKMMTKSPKNDFKI

SEQ ID NO: 160579 - protein, 75 aa, Glycine max
  Coding DNA Sequence Number=SeqID_43801
  Subcellular localization annotation: CTP_CleavageSite=33; ConfidenceScore=5.14e-01
MGMSSPPLITHKLISSSQDNFLFKLHSLQILPRAQLRSVALSGWLVMPKDWLSERVKINTSQTCLINLKLRGNDY

SEQ ID NO: 160580 - protein, 193 aa, Glycine max
  Coding DNA Sequence Number=SeqID_43802
  Gene Ontology: Mol. function=protein binding; Cellular component =integral to membrane; Biological process=xylan catabolic process
  Homolog annotation: Hit_ID=Q1SWI7; Match level="QueryCoverage=98%, HitCoverage=88%, E-value=1e-62, Identity=37%"; Hit description =Leucine-rich repeat
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=128-150; Score =10.0; E_value=3.9; Accession=PF00560.23; Description=Leucine Rich Repeat
  Pfam annotation: Domain name=LRR_1; Domain location=152-174; Score =13.5; E_value=0.76; Accession=PF00560.23; Description=Leucine Rich Repeat
  Pfam annotation: Domain name=LRR_1; Domain location=31-50; Score=0.7; E_value=2.1e+02; Accession=PF00560.23; Description=Leucine Rich Repeat
  Pfam annotation: Domain name=LRR_1; Domain location=52-73; Score=4.0; E_value=51; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-99; Score =11.6; E_value=1.9; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=104-126::128-150::152 -174::31-50::52-73::7-29::80-99
MWEALSQVLYLNLSRNHIHGEIGTTLKNPISIPTIDLSSNHLCGKLPYLSSNVLQLDLSSNSFSESMNDFLCNDQDEPMQLEFLNLASNNLSGEIPDCWMDWTSLVDVNLQSNHFVGNLPQSMGSLAELQSLQIHNNTLSGIFPTSLKKNNQLISLDLGENNLSGSIPTWLRKPLKCENPPPSIKQIWQPHSK

SEQ ID NO: 160581 - protein, 59 aa, Glycine max
  Coding DNA Sequence Number=SeqID_43803
MAVGSKLEWSPPLLLLVMMLVAPQSQAPRLWRPHTLQRKKADRGAGSGICEGVGGITGI

SEQ ID NO: 160582 - protein, 54 aa, Glycine max
  Coding DNA Sequence Number=SeqID_43804
MGKLAAMWGHRKTLLNLGIEHIFLEGDWTVGKNEERGKVRLGDAGAGNVRSDPL

SEQ ID NO: 160583 - protein, 64 aa, Glycine max
  Coding DNA Sequence Number=SeqID_43805
  Gene Ontology: Mol. function=signal transducer activity; Biological process=response to light stimulus
  Homolog annotation: Hit_ID=Q1S6S9; Match level="QueryCoverage=98%, HitCoverage=10%, E-value=1e-15, Identity=81%"; Hit description =BTB/POZ; NPH3
MATPNNRLSLAMERTGQWVFSQDIPTDVIVEVGETIFSLHKGTFSAVHASGKEQLHKKTDIGIK

SEQ ID NO: 160584 - protein, 409 aa, Glycine max
  Coding DNA Sequence Number=SeqID_43806
  Gene Ontology: Mol. function=signal transducer activity; Biological process=response to light stimulus
  Homolog annotation: Hit_ID=Q1S6S9; Match level="QueryCoverage=76%, HitCoverage=54%, E-value=1e-122, Identity=73%"; Hit description =BTB/POZ; NPH3
  Pfam annotation: Domain name=NPH3; Domain location=3-187; Score =168.8; E_value=1.4e-47; Accession=PF03000.5; Description=NPH3 family
TTEASGSNRGSIPLGESRVPIHFLCCLLRCAIYLRASATCKTELEKRISEILEHVTVDNLLVLSFTYDGERLFDLESVRRIISEFVEKEKGNAVFTTAEFKEPCSATMQRVARTVDTYLSKIAAYGDLSISKFNGIAILVPKNARKVDDDLYRAVDIYLKAHPKLDEIEREKVCSVMDPLKLSYEARVHASQNKRLPVQIVLHALYYDQLRLRSGAEERDVEPEKNQLQMDVSLVRENEELRTELMKMKMYISDLQNKNTNNDANPQVHGTTSSATPKKATFFSSVSKTLGKLNPFRNGSKDTTHLEDASVDLTKPRRRRKKLLQSLHTFLMLSVSGACVRGKKERDLMNMVTSSYTRSIPFFICCIPSRLGLMPTDPVRVDALALFQSMSTLRWNCLSGRRSWDNGQL

SEQ ID NO: 160585 - protein, 234 aa, Glycine max
  Coding DNA Sequence Number=SeqID_43807
  Pfam annotation: Domain name=Hin1; Domain location=73-209; Score =52.5; E_value=1.4e-12; Accession=PF07320.4; Description=Harpin -induced protein 1 (Hin1)
MEEGKSKPALAKNPSGSLRRVLRPPHGLHSSIDHLDKGRYLPCCCFACCAWSCLIMFLLIIAILFLGITYLAFLKSGMPKVNVRAFNITKLQVDDGSQKMNAVIGLGLIFSNKNDKLKLLYGPLDVDVTSEDVLLGKKKLGGFYQNPLNDTQLDMTMTLENADVDKYAAEDLISDIKAYEMVFDLYVGGHIGFQVGKLQMNNVPFLASCHQIKREDVDFGRKPECDVKLFAASE

SEQ ID NO: 160586 - protein, 631 aa, Glycine max
  Coding DNA Sequence Number=SeqID_43808
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=99%, HitCoverage=96%, E-value=0.0, Identity=57%"; Hit description =Receptor-like protein kinase
  Pfam annotation: Domain name=LRRNT_2; Domain location=26-64; Score =39.5; E_value=1.2e-08; Accession=PF08263.3; Description=Leucine rich repeat N-terminal domain
  Pfam annotation: Domain name=LRR_1; Domain location=118-137; Score =16.5; E_value=0.097; Accession=PF00560.23; Description=Leucine Rich Repeat
  Pfam annotation: Domain name=LRR_1; Domain location=140-162; Score =18.0; E_value=0.034; Accession=PF00560.23; Description=Leucine Rich Repeat
  Pfam annotation: Domain name=LRR_1; Domain location=164-185; Score =14.2; E_value=0.49; Accession=PF00560.23; Description=Leucine Rich Repeat
  Pfam annotation: Domain name=LRR_1; Domain location=186-208; Score =11.2; E_value=2.3; Accession=PF00560.23; Description=Leucine Rich Repeat
  Pfam annotation: Domain name=LRR_1; Domain location=69-92; Score=2.2; E_value=1.1e+02; Accession=PF00560.23; Description=Leucine Rich Repeat
  Pfam annotation: Domain name=LRR_1; Domain location=94-116; Score =8.5; E_value=7.2; Accession=PF00560.23; Description=Leucine Rich Repeat
  Pfam annotation: Domain name=Pkinase; Domain location=339-607; Score =125.4; E_value=1.6e-34; Accession=PF00069.15; Description=Protein kinase domain
  Pfam annotation: Domain name=Pkinase_Tyr; Domain location=338-607; Score=95.9; E_value=1.2e-25; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=26 -64::118-137::140-162::164-185::186-208::69-92::94-116::339-607::338 -607
MKFHSTSVASFLFVIVILFPLAIADLSSDKQALLDFANAVPHRRNLMWNPSTSVCTSWVGITCNENRTRVVKVRLPGVGLVGTIPSNTLGKLGAVKIISLRSNLLSGNLPADIGSLPSLQYLYLQHNNLSGDIPASLSLQLVVLDLSYNSFTGVIPTTFQNLSELTSLNLQNNSLSGQIPNLNVNLLKLLNLSYNQLNGSIPKALQIFPNSSFEGNSLLCGPPLKPCSVVPPTPSPSSTPPQSTPGRQSSKNKLSKIAIIAIAVGGAVVLFFVALVFFICCLKKEDDRGSNVIKGKGPSGGRGEKPKEEFGSGVQEPEKNKLVFFEGSSYNFDLEDLLRASAEVLGKGSYGTAYKAILEESMTVVVKRLKEVVVGKKDFEQQMEIMGRVGQHTNVVPLRAYYYSKDEKLLVYDYVPGGNLHTLLHGGRTGGRTPLDWDSRIKISLGTAKGLAHVHSVGGPKFTHGNIKSSNVLLNQDNDGCISDFGLAPLMNVPATPSRTAGYRAPEVIEARKHSHKSDVYSFGVLLLEMLTGKAPLQSPGRDDMVDLPRWVQSVVREEWTAEVFDVELMRYQNIEEEMVQMLQIAMACVAKMPDMRPSMDEVVRMIEEIRQSDSENRPSSEENKSKDSNV

SEQ ID NO: 160587 - protein, 207 aa, Glycine max
  Coding DNA Sequence Number=SeqID_43809
  Gene Ontology: Mol. function=small conjugating protein ligase activity; Cellular component=cytosol; Biological process=protein modification process
  Homolog annotation: Hit_ID=Q5YJR0; Match level="QueryCoverage=95%, HitCoverage=100%, E-value=1e-53, Identity=59%"; Hit description =Ubiquitin-conjugating enzyme 9
  Pfam annotation: Domain name=UQ_con; Domain location=5-201; Score =171.0; E_value=3e-48; Accession=PF00179.16; Description=Ubiquitin -conjugating enzyme
MASKRIVKELKDLQKDPPTSCSAGPVAEDMFHWQATIMGPPDSPYTDCIVDQFLVILVYPVFQVQQLVRVSFSIAANAGILHCDSGSIFYEGGRKFALGGGASGYLRCKAKNLPHLSGSNALVVKVAFRTKVFHPNINSNGSICLDILKEQWSPALTISKVLLSICSLLTDPNPDDPLVPEIAHMYKADKAKYEATARSWTQKYAMG

SEQ ID NO: 160588 - protein, 73 aa, Glycine max
  Coding DNA Sequence Number=SeqID_43810
MGGFRVVIARVSEVGGKEEREWREESKEREVGLKGIYGAPRGVSPLEDQGNIFLVKGGDLGNELKERERGRKE

SEQ ID NO: 160589 - protein, 142 aa, Glycine max
  Coding DNA Sequence Number=SeqID_43811
  Gene Ontology: Mol. function=ATP-dependent helicase activity
  Homolog annotation: Hit_ID=Q9LKL6; Match level="QueryCoverage=94%, HitCoverage=21%, E-value=5e-39, Identity=65%"; Hit description=DEAD box protein P68
VATDVASRGLDVTGVSHVINLDLPKLVDCHSVTAMMASHLPGRAGSTGLATSFYTDRDMFLMANIRKAIADAESGNTLTFATGKVARRKEKEAAAAQKEANIALSKQLGLGAASMNIEDKYKFMITATNTKREGAADSAWDD

SEQ ID NO: 160590 - protein, 540 aa, Glycine max
  Coding DNA Sequence Number=SeqID_43812
  Gene Ontology: Mol. function=kinase activity
  Homolog annotation: Hit_ID=Q1SIP3; Match level="QueryCoverage=97%, HitCoverage=92%, E-value=1e-126, Identity=47%"; Hit description=TRNA- binding arm
  Pfam annotation: Domain name=KIP1; Domain location=1-61; Score=83.0; E_value=9.2e-22; Accession=PF07765.3; Description=KIP1-like protein
MTKRSLTSEMERNVRQMQKLMEEDGDSFAQKAEMYYKKRPELISLVEEFYRAYKSMAERFDHINTPCDLQSQASGVSDYGSEPNSYVPSPSPRKMGRRISTNRAAGFDVFLGSGGNVNTFDACQKDGDGSSTLTETDEDYDDASSMNSFSGFFGNGNDHNSIHRRVMELDIEIPHEGKEKHEEERVKNDELKIENNAEDFRVKINAYEQELRIVNEKLRVSEEEIGKLKIELEKYRSMESKNLKGGVGLSSIVEGIKVGGETLELKKLREELRVTKEKLESSEMQIVSLKFGATKTFETIQQLQEQLDLAQKDIASWKTKFNSQKRENSKLQERHARMKTNVADRDHEVRDLKAALSDVERKIFFERANMKSEMSKLLGEQTHLEEKFKEWECQCQSLEEEIRKIYFEKIEMGETLKGEIELLKEEIESKKKNIEDVNVNLDVMKLDRDNLKEEVGSLKEVINSRDDEIEEAHKQVEELTSRAKKQEEEIERQRVEILEGAEEKREAIRQLCFSLEHYRNGYNVLRQAFIGNKRVPLLCT

SEQ ID NO: 160591 - protein, 51 aa, Glycine max
  Coding DNA Sequence Number=SeqID_43813
MVGRMKRECDNVKAPPRKNVAVLVKRPHLHRGAPPRESAAPKSLATVISRD

SEQ ID NO: 160592 - protein, 550 aa, Glycine max
  Coding DNA Sequence Number=SeqID_43814
MMQDIKVSPICSSDYPFNKVRQSSAIVGNDKHFYDHSKRSGFSVIEEFFKTKNRDEDLWNACSGFLDESFDNEMGYDTSCKKTFQMGSKSPELLKSGAYKMENYAFEDLLPKKWSSAIAMKEIDMSEPRSSFSKDELENDFDFYVASSSRLGGNFNAQNLIPEDVRDNSSLLSEESSSRTAERGVSTAHSPSTILTGENRRKHRNAFASPRKHRNVFASTRNKYSTKDEKYRSMPNSSKRMPSHDSNSILQEELDAHNSWQFEEINPSVDKSSVAASFCLDLEADFAVFGSKNKIEDPFSVFITPELSNKASPSFGGFRKAAPLADSPPCSFTSEKFAFDSSIAFPNVGSWPTGPSLSPDFQPKGKSEDACGGFDCETSSTDMSVQGSVSKGERQVKMQKDTNKSFEQEDVFLGDNELSSEKKMSEDAPSSKNHTKECEGTEDTNPKTTTQCFVAADSSGHVEEISSLLKKPDKQESQVDKRKNNCDAETPLKCNKSTKEEVKFWSPEGRTTMSGGKHKNGKISLSGQVMFESYVFKLLRVQKVLKEACT

SEQ ID NO: 160593 - protein, 135 aa, Glycine max
  Coding DNA Sequence Number=SeqID_43815
  Gene Ontology: Mol. function=transferase activity
  Homolog annotation: Hit_ID=Q84VH1; Match level="QueryCoverage=94%, HitCoverage=97%, E-value=5e-24, Identity=57%"; Hit description =Glutathione S-transferase U2
  Pfam annotation: Domain name=GST_C; Domain location=11-115; Score =17.4; E_value=0.004; Accession=PF00043.15; Description=Glutathione S- transferase, C-terminal domain
  Pfam annotation: Domain name=GST_N; Domain location=4-72; Score=10.4; E_value=0.088; Accession=PF02798.10; Description=Glutathione S -transferase, N-terminal domain
  Pfam module annotation: Pfam domain module=GST_C::GST_N; Domain location=11-115::4-72
MAEANVVPLDFWPSSYGMRVKIALAEKGISYECKQEDLEAKSSLILEMNPTMEDELGDKPYFGGEDFGYVDVALVPFTSCFYTVETCGKLSIEEECPKLLAWPRGAWKKSVAKSLPHPHQIYAFAMQYKQRHGLE

SEQ ID NO: 160594 - protein, 63 aa, Glycine max
  Coding DNA Sequence Number=SeqID_43816
MAENLHGITHGNENGGGACHPARPGELSSSRRAKLSPPEVTAFWRNILEGPSGPGCYLHPHVY

SEQ ID NO: 160595 - protein, 115 aa, Glycine max
  Coding DNA Sequence Number=SeqID_43817
MTGRLFADYLALESRILHYLIVRILLPRSSNLAERSFLIGAVVVASFGYHKERDGSWSILDRFDGLQTYVGERFDSLEPQVDTRFEVMNSRIAKVEEDVTIIRNCFDLPPPPPLV

SEQ ID NO: 160596 - protein, 342 aa, Glycine max
  Coding DNA Sequence Number=SeqID_43818
  Gene Ontology: Mol. function=methyltransferase activity; Cellular component=mitochondrion; Biological process=menaquinone biosynthetic process
  Homolog annotation: Hit_ID=Q8YDE4; Match level="QueryCoverage=66%, HitCoverage=84%, E-value=1e-122, Identity=93%"; Hit description =Ubiquinone/menaquinone biosynthesis methyltransferase ubiE
  Pfam annotation: Domain name=MTS; Domain location=166-304; Score= -85.4; E_value=0.022; Accession=PF05175.4; Description=Methyltransfera se small domain
  Pfam annotation: Domain name=Methyltransf_11; Domain location=188 -288; Score=94.2; E_value=4.1e-25; Accession=PF08241.2; Description =Methyltransferase domain
  Pfam annotation: Domain name=Methyltransf_12; Domain location=188 -286; Score=57.9; E_value=3.4e-14; Accession=PF08242.2; Description =Methyltransferase domain
  Pfam annotation: Domain name=Ubie_methyltran; Domain location=132 -341; Score=302.5; E_value=8e-88; Accession=PF01209.9; Description =ubiECOQ5 methyltransferase family
  Pfam module annotation: Pfam domain module=MTS::Methyltransf _11::Methyltransf_12::Ubie_methyltran; Domain location=166-304::188 -288::188-286::132-341
MGDARGGYQIEHAFEKAIACAQDRGEDKLLAFKDRRVHWHQRGFDRHGGQFEIACHFIAEQQRYFLQQPPKAGCGRFLLAHDGELVLDKRMADDCNAHDLSTFLVIFLTLAANGNADRVGAQGGMEHSFGFKAVDESEKQGLVNDVFHKVASKYDVMNDLMSAGMHRVWKDAMIAWLAPSKRPGWTSLDVAGGTGDIAFRIVEASGRQAHVTILDINGSMLGVGRERAIKKGLADNLEFVEANAEELPFQDNSFDAYTIAFGIRNVPHIDKALSEAYRVLKPGGRFLCLEFSEVELPVLDKIYDQWSFHAIPRIGKMITGDADSYSYLVESIRKFPKQHGFM

SEQ ID NO: 160597 - protein, 84 aa, Glycine max
  Coding DNA Sequence Number=SeqID_43819
MVTSILQLDSMNLFVKARAWLNPITQGMAILIANTSSTFHRDERLGNTHAMHGKCNYEIKMPEEHPFLVNHALEENTRITHEQT

SEQ ID NO: 160598 - protein, 84 aa, Glycine max
  Coding DNA Sequence Number=SeqID_43820
MMVRWRTYSFKVDGEQREQESLDGEEDREKDKTTRRRRNIPRYGGEGEEAETCDEARVRRTRCSDAHRDGFARRRLEKEDSAEA

SEQ ID NO: 160599 - protein, 73 aa, Glycine max
  Coding DNA Sequence Number=SeqID_43821
MQLIVNMNGLPNITGMSLSSQMMQSYPTRALDRRLQEDWAKDAREGPRVLMSLRVGYPRNVGFSSPCILGHVD

SEQ ID NO: 160600 - protein, 72 aa, Glycine max
  Coding DNA Sequence Number=SeqID_43822
  Subcellular localization annotation: CTP_CleavageSite=58; ConfidenceScore=5.24e-01
MGVQIATRPTWDFQDVPSQGGCVWRKQPSSPGRAGKSKLRHFCNISVGDFTRILTILRCSSFVIHRSSVFNR

SEQ ID NO: 160601 - protein, 109 aa, Glycine max
  Coding DNA Sequence Number=SeqID_43823
  Gene Ontology: Mol. function=RNA-directed DNA polymerase activity; Cellular component=signal recognition particle, endoplasmic reticulum targeting; Biological process=RNA-dependent DNA replication
MRKERFPAQIKSKLQPRGNRPFQVVENINGNAYKLDLPREYGNRSDSRMNPFEEGGNDRGATSSSNDPLHGIGGLMTRSKTKRMKRALQGLILKIKEKENQFELRVAPN

SEQ ID NO: 160602 - protein, 48 aa, Glycine max
  Coding DNA Sequence Number=SeqID_43824
ERFCDEETELSQGLVPALHELQEGAPVPSQEQIRPDIKGYHEALNHKS

SEQ ID NO: 160603 - protein, 273 aa, Glycine max
  Coding DNA Sequence Number=SeqID_43825
  Homolog annotation: Hit_ID=Q84VH5; Match level="QueryCoverage=99%, HitCoverage=47%, E-value=3e-60, Identity=63%"; Hit description =Envelope-like protein
  Subcellular localization annotation: CTP_CleavageSite=24; ConfidenceScore=5.27e-01
MATSPKETSAPGSPSAPSSPSSTKAPANQERPEFNIQPIQMIPGSAPVPEKLVPKRQQGVKISENPSLATSPREVDTEMDKKIRSIMVPTSSTPDVAVPDAEKDVPTSSTPSKEESTEEDDQATEETPAPRAPEPAPSDLIDLEEVESDEEPIANKLAPGIAERLQSRKGKTPIKRSGRIKTMAQKKSTPITPTTSRRSKVAIPSKKRKEISSSDSDDDVEPDVPDIKRTKTSGKKTCCRKRTRKRCLGLQGDHGPHHDCWTAEDCHRVGRLL

SEQ ID NO: 160604 - protein, 71 aa, Glycine max
  Coding DNA Sequence Number=SeqID_43826
MSLHSSSSVNGEGSTPKDPLYKILDELRSLKLWKEKQERKEKGFAKYIVEEWGKLHVESGLCVDRKLESME

SEQ ID NO: 160605 - protein, 73 aa, Glycine max
  Coding DNA Sequence Number=SeqID_43827
  Homolog annotation: Hit_ID=Q9LE80; Match level="QueryCoverage=52%, HitCoverage=15%, E-value=1e-07, Identity=64%"; Hit description =Arabidopsis thaliana genomic DNA, chromosome 3, P1 clone: MJK13
MFITEAYRTLCDKGPYPADQVLKELEGSLGFMIYENFSSILEWRRRKGDWRCHFKEKMSQEQGHRHRKPWIRA

SEQ ID NO: 160606 - protein, 115 aa, Glycine max
  Coding DNA Sequence Number=SeqID_43828
MKNSRWEKELHHYNQYEEERLKNLEDVLMQFMETSQANFKANQHAIHKIWRFKLEERYGECDKSLSIILFLITNTSVAMTWKTFPGYMSFMESLAKDESARKMCSMRPSCHLEGI

SEQ ID NO: 160607 - protein, 274 aa, Glycine max
  Coding DNA Sequence Number=SeqID_43829
  Gene Ontology: Cellular component=integral to membrane; Biological process=autophagy
  Homolog annotation: Hit_ID=Q1RSF3; Match level="QueryCoverage=96%, HitCoverage=98%, E-value=1e-130, Identity=81%"; Hit description =CD9/CD37/CD63 antigen
  Pfam annotation: Domain name=Tetraspannin; Domain location=4-246; Score=181.2; E_value=2.5e-51; Accession=PF00335.10; Description =Tetraspanin family
MFRISNTVVGALNVLSLLLGIAAVGSSAYIHVRGGSDCQKVLQVPLLVGGIFVVLVSALGIVGSLCRVNGALYAYLLVTFMVIVGLAFFTVFALFVTNRKVGQRVSGKGYGEYRVADFSHWLQRYVVNNKNWDEVKSCLMDAHVCQNLALNGGRNNDSLIFKHFSTTQAGCCKPPVYCGFIMKNATFWEVPKKGPAANNNTDCSTWNNSKEKLCYDCNSCKGGVLANIRNQWRRLTVFNACVLVLVTAIYALGCYAIKNNRSDSHCNHRKPPIP

SEQ ID NO: 160608 - protein, 146 aa, Glycine max
  Coding DNA Sequence Number=SeqID_43830
  Pfam annotation: Domain name=F-box; Domain location=24-74; Score =19.0; E_value=0.017; Accession=PF00646.23; Description=F-box domain
MAIVRLMKTSNKKRHTYNNGSSTSPIKSLPKDLLVEVVARVASDSIVDLRNMKQCCKDFLDASEDNYVWQQVSLDKFPLMRWLPNDKASCFLKCCRESGNIESLYREGLLKFFNYPNGNINGLGDLKTAALKGHIEAKYVYDGIMR

SEQ ID NO: 160609 - protein, 303 aa, Glycine max
  Coding DNA Sequence Number=SeqID_43831
  Gene Ontology: Cellular component=chromosome, pericentric region; Biological process=cell cycle
  Homolog annotation: Hit_ID=Q1RSF8; Match level="QueryCoverage=93%, HitCoverage=97%, E-value=3e-64, Identity=49%"; Hit description=Mis12
  Pfam annotation: Domain name=Mis12; Domain location=8-140; Score =53.4; E_value=7.7e-13; Accession=PF05859.2; Description=Mis12 protein
MEEGDSEAIFGALNLNPQLFCNEVLNIVDDVLDEAFNFFYQDASTKLNIEGTQRSQDLKKGVDCVRLNVQSVLDKQLAAWESYILRHCFALPQGFRMPNTANVSNYYVMLVVEFKAMTSIASTPMLVVDVDLYSICVRDIAIDDDEIPNFQDESNENALDPGAPFDPDIDAQLDSLREKLIEVGKESEMLNQEMQALERKSAVNVAGHINEAVQLYEQNSMHEVFQEIVTTASELGAKMAKLNSSMIEETDQTKTKRIYSTEMDLSAINPAKGLSNMKLDDVEEFWLLNEFMKQNFLLLILNA

SEQ ID NO: 160610 - protein, 196 aa, Glycine max
  Coding DNA Sequence Number=SeqID_43832
  Gene Ontology: Cellular component=integral to membrane; Biological process=autophagy
  Homolog annotation: Hit_ID=Q1RSF3; Match level="QueryCoverage=84%, HitCoverage=61%, E-value=1e-61, Identity=69%"; Hit description =CD9/CD37/CD63 antigen
MVCLSIIILSYLKGNQIRENLGGRKVFENERVVVAAAVEGEVLADVGVHQTTLDLVPVLVVNHVALQPLREVADTVLAVALAGNLPAHLPVGDQERENGEERQPHDYHERHEEVRVECPVYAAQRPHDSQGRDQHHEDAANKERHLQHLLAVGASVDVDVDGGAHGGDAQQQGQHVEGADHGVTYAEHARSEQTRM

SEQ ID NO: 160611 - protein, 212 aa, Glycine max
  Coding DNA Sequence Number=SeqID_43833
  Gene Ontology: Mol. function=phenylalanine-tRNA ligase activity; Cellular component=cytoplasm; Biological process=phenylalanyl-tRNA aminoacylation
  Homolog annotation: Hit_ID=Q1RSG6; Match level="QueryCoverage=84%, HitCoverage=23%, E-value=2e-66, Identity=73%"; Hit description=B3/4
MQLIAVLMHPDFHLEINLTKLTYHLFSLYQTAVRTSLMPGILKTVAHNKDHPKPIKVIYGRWRNITEIPPSKHFIVAYCATLAGLSSQIAYGRGIFEVGDIAVLDEQRDVGAKNLRQLAALYCGANAGFEIIHGLVDRVMEKNGVPFVSPGDKSGYYIERSDEPEFLAGRQARIIYKGKHIGTFGIVHPEVLNNFDIPDPCSFVELNIESFL

SEQ ID NO: 160612 - protein, 71 aa, Glycine max
  Coding DNA Sequence Number=SeqID_43834
MLVLGNDPLKRDDVLTKERNWKRNMWEGVEGRGAQCTSAGCHDGGRLVQSLSLGSRLPPSCEATHSTSSQT

SEQ ID NO: 160613 - protein, 336 aa, Glycine max
  Coding DNA Sequence Number=SeqID_43835
  Gene Ontology: Mol. function=strictosidine synthase activity; Cellular component=vacuole; Biological process=biosynthetic process
  Homolog annotation: Hit_ID=Q1RSG3; Match level="QueryCoverage=97%, HitCoverage=98%, E-value=1e-117, Identity=64%"; Hit description =Strictosidine synthase
  Pfam annotation: Domain name=NHL; Domain location=205-233; Score =13.7; E_value=0.28; Accession=PF01436.11; Description=NHL repeat
  Pfam annotation: Domain name=NHL; Domain location=94-122; Score=7.8; E_value=1.5; Accession=PF01436.11; Description=NHL repeat
  Pfam annotation: Domain name=SGL; Domain location=80-311; Score= -94.6; E_value=0.0024; Accession=PF08450.2; Description=SMP -30GluconolaconaseLRE-like region
  Pfam annotation: Domain name=Str_synth; Domain location=150-238; Score=103.7; E_value=5.3e-28; Accession=PF03088.7; Description =Strictosidine synthase
  Pfam module annotation: Pfam domain module=NHL::NHL::SGL::Str_synth; Domain location=205-233::94-122::80-311::150-238
MMIAISATFMIFFLCSPSVAILITRLPLPSPVTGPESVAFDRNGGGPYVGVSDGRILKYAGPTEGFKEYAFTSPNRNKTICDGLADFSELQATCGRPLGLRFNHQTNELYVADAYSGLIKIGPNGGAPTQCFKDIQPQQENVNTTLGFLDGLDVDVNSGVVYFTQASANYRFKDAQALQSSRDQSGSLFSLDPKTNQTRVLMRGLALASGVAVSRDGSFVLVSEYLANRIQRFWLRGPRANSSELFLQLTGRPDNIRSNQRGQFWVAVNGALGPNPPPRPTILPGGLRISENGVILQILSLVKEFGSEAASEVHEHNGTLYSGSLRASYVPISSMI

SEQ ID NO: 160614 - protein, 108 aa, Glycine max
  Coding DNA Sequence Number=SeqID_43836
MARCGLSWKVDLGSYERKSEVVGSNSGKKIYERWALDRRLQEDCARDVGEGPWVLMSLRASEARLTGVLSKGGKMCGVATNVYLWKASEKPKETGQNENSKFGSCIYV

SEQ ID NO: 160615 - protein, 298 aa, Glycine max
  Coding DNA Sequence Number=SeqID_43837
  Gene Ontology: Mol. function=phenylalanine-tRNA ligase activity; Cellular component=cytoplasm; Biological process=phenylalanyl-tRNA aminoacylation
  Homolog annotation: Hit_ID=Q1RSG6; Match level="QueryCoverage=84%, HitCoverage=41%, E-value=1e-115, Identity=82%"; Hit description=B3/4
  Pfam annotation: Domain name=B3_4; Domain location=160-293; Score= -19.1; E_value=0.00023; Accession=PF03483.7; Description=B34 domain
MDPLRCYGPYKYLRQIVSDSEHLFLRRGFTCTHSLQDQNGAMPTVSVGRDRLYAALGKTYTQEEFEDLCFSFGIELDDVTTEKAIVRKEKHLDEEEADEDEEVIYKIEVPANRYDLLCLEGLAQALRVFCEFQEIPTYRLSNISKDAIQKMHVKPETSLIRPYVVCAVLRGITFDKVRYSSFIDLQDKLHQNICRRRTLVAIGTHDLDKLEGPFTYEALPPSSITFTPLKQERNFRADELMEFYKSDLKLKKFLHIIEDSPVFPVIYDSKRVTPNQLAVSKGHKAVVVLPTANAHPQS

SEQ ID NO: 160616 - protein, 440 aa, Glycine max
  Coding DNA Sequence Number=SeqID_43838
  Gene Ontology: Mol. function=agmatine deiminase activity; Biological process=polyamine biosynthetic process
  Homolog annotation: Hit_ID=Q8GWW7; Match level="QueryCoverage=97%, HitCoverage=97%, E-value=1e-126, Identity=53%"; Hit description =Agmatine deiminase
  Pfam annotation: Domain name=PAD_porph; Domain location=14-421; Score= 569.1; E_value=4.2e-168; Accession=PF04371.5; Description =Porphyromonas-type peptidyl-arginine deiminase
MVMHLNGTPCALGFHMPAEWETHAQCWMGWPERADNWRDGAVHAQRVFARVASAISRFESVTVCVSSAQWENARSQLPEHIRVVEMNMNDSWFRDIGPTFVVRRSTTPESGDAVSRIAGIDWNFNSWGGLEDGCYCDWSLDLLVAKKILGIEKIPRFSHSMVLEGGSIHVDGEVPWMPMVLFSNKNWSFTLIICIVKVCNKDQCRLPRWKFNFDLRTKPTTLKELHHFFLSSGTCLTTEECLLNKNRNPHLSKNQIEDELKTYLGIRKVIWLPRGLYGDDDTNGHIDNMCCFVRPGVVMLSWIDDETDPQYERSVEAYSLLSNETDANGRKFEIIKLHVPSPLYMTEDEAAGVSLDNEAKPRLPGTRLAASYVNFYIANKAIIAPQFGDKKWDDEAVRVLSKAFPHHELQAVRKFRGIFYPENLEEYPVKETTVVGNSKK

SEQ ID NO: 160617 - protein, 447 aa, Glycine max
  Coding DNA Sequence Number=SeqID_43839
  Gene Ontology: Mol. function=adenylate cyclase activity; Biological process=cAMP biosynthetic process
  Homolog annotation: Hit_ID=Q6YV21; Match level="QueryCoverage=87%, HitCoverage=54%, E-value=1e-165, Identity=76%"; Hit description =Uridine kinase-like protein
  Pfam annotation: Domain name=CYTH; Domain location=318-447; Score =17.2; E_value=4.9e-05; Accession=PF01928.11; Description=CYTH domain
  Pfam annotation: Domain name=PRK; Domain location=106-311; Score =22.8; E_value=5.3e-09; Accession=PF00485.8; Description =Phosphoribulokinase  Uridine kinase family
  Pfam module annotation: Pfam domain module=CYTH::PRK; Domain location= 318-447::106-311
MWDFTSHLYSNKKVAEGSNSVASGKEFNGLALIGGGAIGSGAIDTVSGVDSPRRRLLRDQVQVVKRKDSNRYEIVPIQDSLSFEKGFFIFIRACQLLAQKNNGIILVGVAGPSGAGKTVFTEKVLNFMPSIAVITMDNYNDSSRIIDGNFDDPRLTDYDTLLENIQGLKAGKPVQVPIYDFKSSSRIVGHGFKSRNNLFVYASLRLLIMALSIPSHSEGQGTVEVPSSRIVIIEGIYALSEKSRPLLDLRVSVTGGVHFDLVKRVLRDIHRAGQEPEEIIHQISETVYPMYKAFIEPDLKTAHLKIINKFNPFSGFQNPTYILKSARAVTVDQIKAIIAAEHTETKEETYDIFLLPPGEDPEACQSYLRMRNRDGKYNLMFEEWVTDSPFIISPRITFEVSVRLLGGLMALGYTIAAILKRSSHVFHDDKVTIKTDWLEQLNRTYVQ

SEQ ID NO: 160618 - protein, 118 aa, Glycine max
  Coding DNA Sequence Number=SeqID_43840
CNNSCLSQSSRVHTITTQIHLCACATTTTQPPPTIASSYTPPPSPPPCRSAKHDPKQHPTTKKHYHQRLFSHIPIFFNVDGVVVGKNWARRLRKEQGTVSKGKKEKRKKRRRVGFDFF

SEQ ID NO: 160619 - protein, 343 aa, Glycine max
  Coding DNA Sequence Number=SeqID_43841
  Gene Ontology: Mol. function=adenylate cyclase activity; Biological process=cAMP biosynthetic process
  Homolog annotation: Hit_ID=Q6YV21; Match level="QueryCoverage=81%, HitCoverage=41%, E-value=5e-72, Identity=54%"; Hit description =Uridine kinase-like protein
MLFDPPLGLGLPFFVFCSLLTFIMVQGKDRNYCKFVAEKLGLDGSYVPRTYIEQIQLEKLVNDVMALPDDLKTKLSIDDDLVSSPKEALSRASADRRMKYLNRGISQSYSTQRDKILPKLTKLAINNRRFDARALESPAPIANQGVITQLSDQISTLNERMDEFTSRIEELNSKFAISKDSAASQQNLALQAEACNGSGPTSFFVTGLSNGSLTGSLLPNSSSSSQLANKESPLMEEVLVIARGQRQIMHQLDTLSNFLHEYFGERSRLGRPDHTGRMREAESVAIPLVLTLAFGAVGVLLFRDQPFDCFSGELLSVCKKEENFLYRVFSFSSQTNWPVSSLK

SEQ ID NO: 160620 - protein, 442 aa, Glycine max
  Coding DNA Sequence Number=SeqID_43842
  Gene Ontology: Mol. function=protein serine/threonine kinase activity; Cellular component=membrane; Biological process=protein amino acid phosphorylation
  Homolog annotation: Hit_ID=Q45HK2; Match level="QueryCoverage=76%, HitCoverage=98%, E-value=1e-162, Identity=81%"; Hit description =Serine/threonine protein kinase
  Pfam annotation: Domain name=Pkinase; Domain location=28-334; Score =82.5; E_value=1.4e-21; Accession=PF00069.15; Description=Protein kinase domain
  Pfam annotation: Domain name=Pkinase_Tyr; Domain location=28-334; Score=-79.9; E_value=1.4e-07; Accession=PF07714.7; Description =Protein tyrosine kinase
  Pfam module annotation: Pfam domain module=Pkinase::Pkinase_Tyr; Domain location=28-334::28-334
MGCSFSGLNALYDSVNGGGDVWINENRFRIVRQLGEGGFAYVYLVKETPNDSAVAAGLSKKLKGSSHLSDDGTYAMKKVLIQNNEQLELVREEIRVSSLFNHPNLLPLLEHAIISVKPTQETSWNHEAYLLFPVHLDGTLLDNAKIMKAKKEFYSTSDVLQIFRQLCAGLKHMHSFDPPHAHNDVKPGNVLITHRKGQPPLAILMDFGSARPARKQIGSRSEALQLQEWASEHCSAPFRAPELWDCPSQADIDERTDIWSLGCTLYAIMYGVSPFEYALGESGGSLQLAIVNAQVKWPAGPKPPYPEALHQFVSWMLQPTASMRPRIDDIIIHVDKIYQHKWNIIYLLTFFVHISPTFNEQVFDHHFSLTLEWGCQYGYLKGFVHNSPNKIPREDFADIHPSCLLKRACCSAAAAAEEEPIYSFRVKTICIMEPTLSLLLSV

SEQ ID NO: 160621 - protein, 81 aa, Glycine max
  Coding DNA Sequence Number=SeqID_43843
  Gene Ontology: Mol. function=rRNA pseudouridylation guide activity; Cellular component=ribonucleoprotein complex; Biological process =ribosome biogenesis and assembly
  Homolog annotation: Hit_ID=Q6YWS6; Match level="QueryCoverage=65%, HitCoverage=36%, E-value=8e-16, Identity=74%"; Hit description =Putative high mobility group-like nuclear protein 2
MDIFSITVGYCCSCYLIYHVQETPITMQDLAGAGATKRPTCCVLVQTKPAKGEIEQGEQEKLKSDYDQVVAEVTELTTSLF

SEQ ID NO: 160622 - protein, 191 aa, Glycine max
  Coding DNA Sequence Number=SeqID_43844
MSMYYSTVTFLHDLINMNTMESSKHWLPIGSNLTVKSEMPQCLAEQYPNQHAVKKVEKLKAAKFQMKMLRIGLFKLSVTIARQKLVWEILIDGLLKKIEIRWQNISAIRAVIGENLQGMLEIELFFFYMLVLPKLASRYNINVLESRLMFQMSWCLIATRHKIAVDQDDHQETSPLQGLRLRCTLLFLTRR

SEQ ID NO: 160623 - protein, 972 aa, Glycine max
  Coding DNA Sequence Number=SeqID_43845
  Gene Ontology: Mol. function=RNA-directed DNA polymerase activity; Cellular component=chromatin; Biological process=chromatin assembly or disassembly
  Pfam annotation: Domain name=RVP_2; Domain location=8-113; Score= -52.0; E_value=0.011; Accession=PF08284.2; Description=Retroviral aspartyl protease
  Pfam annotation: Domain name=rve; Domain location=702-856; Score =83.3; E_value=7.4e-22; Accession=PF00665.16; Description=Integrase core domain
  Pfam module annotation: Pfam domain module=RVP_2::RVT_1::rve; Domain location=8-113::252-421::702-856
MPGMLAPETFRAYGTVQHHKLTILADGGSTHKSVQLRVAKFLGLPSTSIDPLPIMVGNGGVMQCRFRYPQVSISIQGHQFTVDLFGLSLSGVDIVLGVQWLRDLGPVTTDYTSLSMSFTHLGHPFHLVANMPVNPPSASAHQLKRMLQTQAVLALFHLGPAPSSSQIASPTLVSDNLPTPLALSTLLAKFHQLFSEPSQLPPVRPISHHIHLSPDSKLITVKPYRYSHSQKTELEKQVQSMLNSGLIRLNHSPFSSLMLLVKKKDGSWHYCIDYRALNAITIKHRFPMPTIDELLDELGAASCFSKLDLRQGFHQIRMVEEDIHKTTFRTNIGHYEYYVIPFGLCNAPTTFQATMNKLLKPFLRKFVAVFFDDILVYNPSWVVHLQHLEAIFVVLSQGSFHLCESKCAFAKAKLQYLGHIVSADSVAPDPSKIIAMLNWSTPTNTTDLQGFLGLMGFYRRFIRGYAPMAAPLTALLYKDNFLWSNEAQCAFDNLKQVMTSAPVLTPPNFTIPFCVETDAFGFAMGAVLSQQAHPIAFFSKILCSRLQRSSTYVRELHAITTTHYLAKLLGYDYTIQYCSGSGNVAADALSRIVPPGHYLILSIPNLEYAHSDYSVKKDWIFYRGKLWLPSDNPYIPMLLEEFHSTPLGGHMGKAKTLQRLQDNSFWDSMRRDVHRLVSECRICQQMKYKSKKPIDLLQPIPTPSGLWEDLSLDFITGLPPSHGFTTILIVVDRYSKGTHLGVLPPKYSAHKVVSLFLDIVCKLHGFPHNLVSDRDPIFLSSFWRELFCLSDTKLRYSTTYHPESDGQTEVLNRTLEQYLRSFVHDRPTLWYSFLPLAEWSYNTQYLSGSSPIEVVDSMMATRQALHTKLQHHLLKAHNAMKAYADRHRHDVHFQVRDLVYVCLRPYRQLSVRPHYSKLAKPFYRPFRVTKKIGPVAYRLQLPTGSKIHPVFHVSLLKPHNSPPPTTDETLPL

SEQ ID NO: 160624 - protein, 425 aa, Glycine max
  Coding DNA Sequence Number=SeqID_43846
  Gene Ontology: Mol. function=tetrahydrofolylpolyglutamate synthase activity; Cellular component=extracellular space; Biological process= folic acid and derivative biosynthetic process
  Homolog annotation: Hit_ID=Q8W040; Match level="QueryCoverage=92%, HitCoverage=65%, E-value=1e-114, Identity=56%"; Hit description =Dihydrofolate synthetase /folylpolyglutamate synthetase
  Pfam annotation: Domain name=Mur_ligase_M; Domain location=4-166; Score=-44.7; E_value=0.0081; Accession=PF08245.2; Description=Mur ligase middle domain
PGSVNAVTAEYGGMLGSNCKENTDDNVPMPTFFHFLALLAFKIFAAEQVDVSIMEVGLGGKYDATNVVPTPIVCGITSLGYDHMEILGNTLGEIAGEKAGIFKHRIPAFTVPQPDEAMHVLREKASQLNVPLQVVTPLDAKLLNGSRLALGGEHQYINAGLAIALCSTWLKMNGHLEDSDSSACMKQHTLPEKFIKGLTTASLQGRAQIVPDQFINDEIPNELVFFLDGAHSPESMEACARWFSLAIKDQDQILFHQKLDNSNFSNQVVKMHNGETVQKKSTQILLFNCMSERNPQLLLPHLMKTCADHGVYFKKALFVPGLSVYHKVGSHALPATDSDVDLSWQLTLQRVWENLMQGNKVTWLEGKSNNSAPEELNMEMSASNCEHSAVFSSLPLVLKWLRDTVQQNQSTRFQVTLIHGYTGEL

SEQ ID NO: 160625 - protein, 206 aa, Glycine max
  Coding DNA Sequence Number=SeqID_43847
  Homolog annotation: Hit_ID=Q9ARH4; Match level="QueryCoverage=48%, HitCoverage=46%, E-value=3e-08, Identity=38%"; Hit description =Plastid-targeted protein 2
HLTETSVRAGNSDVYGFLEPQSIQRSGQSQFESESYIKSWIQSSKRDVYLGAYLNRPDNYLKGIINSALKGLDDTPQPKSKAAARWIVVKFNLTWQIDKKIKEYILSQENLDRWHNIHDTCILYEGQMGTLATIESFFALFVEKVETTIDEAQRVVDIVEDVAEGVDKVAEEAVKHLPDGKLRDAVEFVEKVAEDIDKHAERAEDE

SEQ ID NO: 160626 - protein, 189 aa, Glycine max
  Coding DNA Sequence Number=SeqID_43848
MAHSTGSDDSVCQGFALTTQQEIAMANSYQYNSSDNQFLYFSYLRDEDHHQYIDDDDDEQTAYKRALKEFSQLPPLLGLKITMTPEMLQPTKTSQVAANNKVEKLKAVQFPMDMLRIGYFKIEAKYPYELVAKCYYARQKLIWEILHDGLKFKIEIHCQNISAIRAVMEENSPGILEIEVYFSLYIPVF

SEQ ID NO: 160627 - protein, 134 aa, Glycine max
  Coding DNA Sequence Number=SeqID_43849
MELLNIGFRKTDVNYFIFGKNDVNFIELTSVLPESACSTPTLSHIVFSTAGNHSHRTPYRRKLEANPTLLLELWLEENPTYTPPLGTRVVKQFVFVTFLRGTRVLKHSWVLKAQKFLHKKFAKFGRSDVVIARW

SEQ ID NO: 160628 - protein, 108 aa, Glycine max
  Coding DNA Sequence Number=SeqID_43850
MVQWFELRKRNTDFTFEFTKSHKSILRLKEPLKNTEEENYPNCIFRVDSGEWRVETHHMRLRENLTSPHFSTSDYHCPIPIYLKAITYCDVMLPMEKMEITIKRLELR

SEQ ID NO: 160629 - protein, 706 aa, Glycine max
  Coding DNA Sequence Number=SeqID_43851
  Gene Ontology: Mol. function=RNA-directed DNA polymerase activity; Cellular component=mitochondrion; Biological process=RNA-dependent DNA replication
  Homolog annotation: Hit_ID=Q1S0N5; Match level="QueryCoverage=99%, HitCoverage=62%, E-value=0.0, Identity=86%"; Hit description =Peptidase S16, lon protease
  Pfam annotation: Domain name=AAA; Domain location=199-394; Score =184.2; E_value=3.2e-52; Accession=PF00004.19; Description=ATPase family associated with various cellular activities (AAA)
  Pfam annotation: Domain name=AAA_2; Domain location=197-337; Score= -36.2; E_value=0.0051; Accession=PF07724.4; Description=ATPase family associated with various
  Pfam annotation: Domain name=AAA_3; Domain location=200-336; Score= -10.5; E_value=0.0046; Accession=PF07726.2; Description=ATPase family associated with various
  Pfam annotation: Domain name=AAA_5; Domain location=199-342; Score =8.7; E_value=0.00039; Accession=PF07728.4; Description=ATPase family associated with various
  Pfam annotation: Domain name=Lon_C; Domain location=492-699; Score =356.7; E_value=3.7e-104; Accession=PF05362.3; Description=Lon protease (S16) C-terminal proteolytic domain
  Pfam module annotation: Pfam domain module=AAA::AAA_2::AAA_3::AAA _5::Lon_C; Domain location=199-394::197-337::200-336::199-342::492-699
HIGDFTYPRLADFGAAISGANKLQCQQVLEELDVYKRLKLTLELVKKEMEISKIQESIAKAIEEKISGEQRRYLLNEQLKAIKKELGLETDDKTALTGKFRERIEPKREKCPPHILQVIDEELAKLQLLEASSSEFSVTRNYLDWLTALPWGEYSDENFDVTRAQKILDEDHYGLTDVKERILEFIAVGKLRGTSQGKIICLSGPPGVGKTSIGRSIARALNRKFFRFSVGGLADVAEIKGHRRTYIGAMPGKIVQCLKNVGTSNPLVLIDEIDKLGRGHAGDPASALLELLDPEQNANFLDHYLDVTIDLSKVLFVCTANVVEMIPNPLLDRMEVVAIAGYITDEKMHIARDYLEKTTREACGIKPEQVEVTDAALLALIENYCRESGVRNLQKHIEKIYRKIALQLVRQGEMIDATMLPIKDKVDSDELGQNAVQNKNSELVEGIDPEKESETSDEIHKVQSSDQSQCLEVAKESGGDKEIETKTIEQVLVDESNLTDFVGKPVFHAERIYDQTPVGVVMGLAWTAMGGSTLYIETTFVEEGEGKGTLHLTGQLGDVMKESAQIAHTVARRILLEREPENPFFANSKLHLHVPAGATPKDGPSAGSTMTTSLLSLAMKKPVKKDLAMTGEVTLTGKILPIGGVKEKTIAARRSEVKTIIFPSANRRDFDELAPNVKEGLDVHFVDDYMQIFNLAFDDEQSQNIK

SEQ ID NO: 160630 - protein, 161 aa, Glycine max
  Coding DNA Sequence Number=SeqID_43852
MWAIHTGRQIDWAHLVRYHMHKALRLNAPLPYPQLVTLSLQHFNIPLDSEPYVPIKRSFLIGAAMVASFGYRKERDGSWVKKDAQPNDDEGHLPAEGDSSLLQSILYKFDGLQTYVCERFDSLEHQVDTRFEEMNSRISKVEEDVTIIHDCFDLPSPPPSI

SEQ ID NO: 160631 - protein, 81 aa, Glycine max
  Coding DNA Sequence Number=SeqID_43853
  Gene Ontology: Mol. function=1-deoxy-D-xylulose-5-phosphate synthase activity; Biological process=terpenoid biosynthetic process
  Homolog annotation: Hit_ID=Q68IP4; Match level="QueryCoverage=75%, HitCoverage=8%, E-value=6e-27, Identity=87%"; Hit description =Putative 1-deoxy-D-xylulose 5-phosphate synthase 2
MDRAGLVGADGPTHCGAFDITYMACLPHMVVTAPSDEAKLMHMVATVATIDDKPSCFRFPKGLEYASNNSQVEEVYLLAMW

SEQ ID NO: 160632 - protein, 40 aa, Glycine max
  Coding DNA Sequence Number=SeqID_43854
MASTQGYEFTTDICAPWLDALVIKGDFSHPEGKIDEAVEA

SEQ ID NO: 160633 - protein, 149 aa, Glycine max
  Coding DNA Sequence Number=SeqID_43855
  Gene Ontology: Mol. function=nucleic acid binding; Cellular component= chromatin; Biological process=DNA integration
MMAHHRLSYFLGLEVHYGANGIFLSQAKNAHDILERAKLLDVKSISTPLASASSCRLPSLIISKLSSEYCAMSRAPCPLAYPSLGDPFFLFLVTLMPIGLVVLRLVTPPMATRYSWEVILCPGVLKSSPLLLVPAVNLNIGLWQMQQLS

SEQ ID NO: 160634 - protein, 294 aa, Glycine max
  Coding DNA Sequence Number=SeqID_43856
  Gene Ontology: Mol. function=sequence-specific DNA binding; Cellular component=nucleus; Biological process=regulation of transcription, DNA-dependent
  Homolog annotation: Hit_ID=O80411; Match level="QueryCoverage=81%, HitCoverage=68%, E-value=2e-82, Identity=63%"; Hit description =Pharbitis kntted-like gene 3
  Pfam annotation: Domain name=ELK; Domain location=192-213; Score =36.8; E_value=7.5e-08; Accession=PF03789.4; Description=ELK domain
  Pfam annotation: Domain name=Homeobox; Domain location=215-272; Score= -2.0; E_value=0.0081; Accession=PF00046.19; Description=Homeobox domain
  Pfam annotation: Domain name=KNOX1; Domain location=49-93; Score =81.3; E_value=3e-21; Accession=PF03790.4; Description=KNOX1 domain
  Pfam annotation: Domain name=KNOX2; Domain location=96-147; Score =106.5; E_value=7.6e-29; Accession=PF03791.4; Description=KNOX2 domain
  Pfam module annotation: Pfam domain module=ELK::Homeobox::KNOX1::KNOX2 ; Domain location=192-213::215-272::49-93::96-147
MEDIYKMNPLLSCSGGDVVREVNVNSATGASELNLGLVANNFFSDISDRFIKSQIATHPLYPNLVSAYIECRKVGAPPELASLLEEIARESYPTDALREIGDDPELDEFMESYCEVLHRYKQELSKPFNEATLFLCSIESQLSNLCKGTLTMPLDNNHSDEAAGTSEDELSWEKVEAVEGHESSGPRPGDQELKEMLLRKYGGYLSSLKKEFLKKRKKGKLPKDARMVLMDWWNTHYRWPYPTEKVQLSEMTGLDQKQINNWFINQRKRHWKPSEDMRFAIMDGVSGSGFGGPI

SEQ ID NO: 160635 - protein, 50 aa, Glycine max
  Coding DNA Sequence Number=SeqID_43857
MASALNGFDKVKTSVTHFHFDVTFRHVTMFHWRLCLRAHHRSPLPNLTQP

SEQ ID NO: 160636 - protein, 96 aa, Glycine max
  Coding DNA Sequence Number=SeqID_43858
MEFLLVRYHRRLDLDAVDSEGRTASHVVAREGHTRWAKRASIAKRSFSVLSMTEESGRASISRPHTKHEISALSAAGVFCQAQRTTGAKIKSTYLR

SEQ ID NO: 160637 - protein, 153 aa, Glycine max
  Coding DNA Sequence Number=SeqID_43859
  Gene Ontology: Mol. function=transferase activity; Cellular component= chromatin; Biological process=DNA integration
  Homolog annotation: Hit_ID=Q1T2D5; Match level="QueryCoverage=44%, HitCoverage=4%, E-value=2e-18, Identity=55%"; Hit description=Chromo
MEILNKTLEMYLRCFVFDNPKPWYPMLAWAQYWYNSSYHHNLGMRPFKTVFGREPPAIVPYQVHPKDPWESFDASEASWVDLAAIKQSYPRFKLEDKVDCKGKGIVMSNSMGDNYARNFVRNDGHVEDDPQNLARRRSTRARRENMHLRGYAH

SEQ ID NO: 160638 - protein, 150 aa, Glycine max
  Coding DNA Sequence Number=SeqID_43860
MWRQDVGGLVRSREVDKSISGVGMTFPQLKVLSTIMVVVSPLELGLLTVVVVVHKEADLGFSSPWRTETHQGQTLSLTSLVYVAHALCSCIRVTLWSDMYWRRGVILLHTVTRGVTRTGDVESCYCIRVTRGVTRIGDVVSFSCYVSLVE

SEQ ID NO: 160639 - protein, 117 aa, Glycine max
  Coding DNA Sequence Number=SeqID_43861
MGARPSELRLTPEVTGSPRRASSFSLKSFEGPGEPKASLRELGSRKLNKKILLPLVFVNTTVDMTNKALKITVYILNKVPIKVVAKVPNELWTGNKSIIRHMHIWECLAEARPYRSH

SEQ ID NO: 160640 - protein, 289 aa, Glycine max
  Coding DNA Sequence Number=SeqID_43862
  Homolog annotation: Hit_ID=Q53KU9; Match level="QueryCoverage=36%, HitCoverage=15%, E-value=1e-11, Identity=39%"; Hit description =Probable protein kinase [imported]-Arabidopsis thaliana
MAVVLKNSNGTKNSNYVLKWHHRNITSSAVTLEPDMTPRVGSFALAEFLSRNEHGHHVISNRSNLRLWILSKLRSCGFKAVVPKTRQPEVLLVKKVHEFEVRKRPHEALADMGLNGEYNVNELMRLDFVTTKTRTLLYMSACPMDLSYDDLYSSDKKKEPLSWKCRLKICAEAAHDHTTFTQQHGGQTLRLPAFLIRTALCIKAKTIDNINRRQPLDYNSVFVSLGYPILNERKCGSESQFSIASTSGSQVLSIGEAHNGSQVENYIHCSCTTSISLVDPSYSLQSSLV

SEQ ID NO: 160641 - protein, 50 aa, Glycine max
  Coding DNA Sequence Number=SeqID_43863
MTLVSPWTQSWGKLLKIPSWASIGAALYRDLPSYRSVSSFGEAACVFTDS

SEQ ID NO: 160642 - protein, 489 aa, Glycine max
  Coding DNA Sequence Number=SeqID_43864
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=43%, E-value=1e-101, Identity=44%"; Hit description =Chromo
MSLAKLYEEKYQPVNSNRAHNYSYRYFPISAHTVNFNSAPSNAAKNTIKTYLPPLLPTPNTPPLRNNSVKKISLVEMQLWREKGLCYFCDDKFTFNHKCPDRQMLMLQLEDDEGEAEMSFDVVSRDNNSIVETGINNPHHLSLNALKGGLGVGTIRFVAHINTLPVRVLVDGGSSNNFLQPRVAKILKLPIEPSPLFKVMVGNGANWLKTLGSHIADYDSLQIKFLHDGKFITLQGDDDGTPTQAQLHHIRRMISTDSIAETPTSLPPPRSHDHAIPLLEGSKPVKVKPYHYLHSQKDEIEKLLQGMLEEGIIQPSKSPFSSPIILVKKRDGSWRVCTDYRALNSITVKDTFPIPTVDELIDELFGAEFFSKLDLRSGYHQILLKPEDRQIDYLGHVLSSVGVTMETTKLEAITDWPQPTIIKQLKGFLGLTAFVQLKKAMTSAPVLAIPNFRESFVLEIDAFGSGIGAVLSQSQHPIAYFSKKLSPRM

SEQ ID NO: 160643 - protein, 121 aa, Glycine max
  Coding DNA Sequence Number=SeqID_43865
MVPPANGGVETEQSGEKGLQNLTKIRKEVKHIPCIDVRLQRRMLHFAAVTNPNGNHEWQRWVSFMIATSSSFFSRDSTLLNVGAPETFNRRKGSRLIVRANADYYSVLGIIILFVPLSVTR

SEQ ID NO: 160644 - protein, 90 aa, Glycine max
  Coding DNA Sequence Number=SeqID_43866
  Homolog annotation: Hit_ID=O49580; Match level="QueryCoverage=56%, HitCoverage=29%, E-value=1e-12, Identity=66%"; Hit description=AIG2 -like protein
  Pfam annotation: Domain name=AIG2; Domain location=3-90; Score=-23.3; E_value=2.8e-08; Accession=PF06094.2; Description=AIG2-like family
MELSRKSKKSSSFEASQQILGLLLGISGVELDILDEFKDVEYTRTDVEVSLKDKSERLQVCAYVWSNPNDPNLYAEWDFECAKATTWLKS

SEQ ID NO: 160645 - protein, 140 aa, Glycine max
  Coding DNA Sequence Number=SeqID_43867
MTGCLLAGSLAFESRILHYLIVRILLPRSSNLAQVSEEDLIIMWAFHIGRQLDWAHLVKKGAQPANEEGNLPVEDNSTLLRRLMDKFDGLQTFVGDKFDAMELQVDMRFDAMESRITKVEEDVSFIRTCFDPPPPPPSSS

SEQ ID NO: 160646 - protein, 35 aa, Glycine max
  Coding DNA Sequence Number=SeqID_43868
MGDKDVKTSTKASGPEAAMVAASKHFSSAHKIKFN

SEQ ID NO: 160647 - protein, 67 aa, Glycine max
  Coding DNA Sequence Number=SeqID_43869
  Subcellular localization annotation: CTP_CleavageSite=52; ConfidenceScore=5.04e-01
PLDLEDSLNCRSKMVNKGENNSSLCSTVKSLFVSIFGGNVKTGKSAAPGGPVATMVAASKHFSSPHK

SEQ ID NO: 160648 - protein, 122 aa, Glycine max
  Coding DNA Sequence Number=SeqID_43870
  Gene Ontology: Cellular component=nucleus; Biological process =regulation of progression through cell cycle
  Homolog annotation: Hit_ID=Q10MI0; Match level="QueryCoverage=86%, HitCoverage=10%, E-value=4e-31, Identity=62%"; Hit description =Cyclin, putative, expressed
MPSFHVLIYSSQDEPPSERKIIKLCEYAAKNPFRIPKIAKYLEERCYKELRSEHIKLVNIIAESFNKLLSICKVQIAYFAVDVLNVILELLSYSKDETIQTLGCQCLSRFIYCQVNYTIQKP

SEQ ID NO: 160649 - protein, 465 aa, Glycine max
  Coding DNA Sequence Number=SeqID_43871
  Gene Ontology: Mol. function=nucleic acid binding; Cellular component= chromatin; Biological process=DNA integration
  Homolog annotation: Hit_ID=Q1RWN2; Match level="QueryCoverage=98%, HitCoverage=35%, E-value=1e-154, Identity=57%"; Hit description =Peptidase S8 and S53, subtilisin, kexin, sedolisin; Integrase, catalytic region; Zinc finger, CCHC-type
MNAEMKAIEKNKTWELVNIPDGVKPIGVKWIFKTKFNEHGQIEKYKARIVVKGYAQQYGINYTKVFALVARLDTIRVLLAVATQRSCEVFQLDVKSAFLHGELQEEVYVQQPVGFIKKGRENHVYRLRKALYGLMQAPQTWYSKIEAYFAREKFVRCSSEHTLFTKKVHDNVLIVSLYVDDLIFTGNCKDICEEFKSSMQLEFDMIDLGKMRHFLAIEVIQNEAGIFICQRQYAREVLARFNMIECNSVQNPIVPGTTLPKDDEGSSVDATKFKQAVGSLMYLTVTRLDLMFGVSLISIYMTNPKESHWVATKRISRYLKGTIEHDLFYQKGKKTGLSAYSDSNYAGDLDDRRSTSGSIFMMGTAAVSWASKKQPIVSLSTTEAEYIVAASCACQCIWLRRILEHLGLGEKGATEILCDNKSTIQLSKNPVLHGRMANVMTKVVKLDQFEKFRHMLGVVKVTEIS

SEQ ID NO: 160650 - protein, 678 aa, Glycine max
  Coding DNA Sequence Number=SeqID_43872
  Gene Ontology: Mol. function=nucleic acid binding; Cellular component= intracellular; Biological process=DNA integration
  Homolog annotation: Hit_ID=Q1RWN2; Match level="QueryCoverage=97%, HitCoverage=60%, E-value=1e-138, Identity=37%"; Hit description =Peptidase S8 and S53, subtilisin, kexin, sedolisin; Integrase, catalytic region; Zinc finger, CCHC-type
  Pfam annotation: Domain name=Rcd1; Domain location=286-533; Score= -82.5; E_value=0.089; Accession=PF04078.4; Description=Cell differentiation family, Rcd1-like
  Pfam annotation: Domain name=rve; Domain location=347-508; Score =148.2; E_value=2.2e-41; Accession=PF00665.16; Description=Integrase core domain
  Pfam module annotation: Pfam domain module=Rcd1::rve; Domain location= 286-533::347-508
MENFLHSKEMWQLVEDGIPTLGATPTEAQKRSAAEANLKDMKVKNYLFQAIEREILETILDKSTSQAIWRLEHSGQQDTYIFNPKFQLCGVYSIEEANDLSTLSLDELHGSLLVHEQRMQSFQPDEQVLKVTHDDRSGASHGRGRGSRGRGRGRGRQPFDKALVECFQFHKLVHFQYECPGVEKQVHYAKFEDATEAENETLLVAYEEMTQSVQREDWFLDSGCSHHMTGNKQWFTEIHEEGLNKNVKLGNDTTLNVVARGSIQVQINDVTHVISDVYYVPELKTNLLSLGQLQEKGLAILIQNDTSEDDLDKATLLWHKRFGHLNFKGLSTLANKQMVIAKFMESINETPIIHADICGPISLASHSNKRYILSFVDDHSRKMWIYFLHAKSKTFNAFKSFKACVEKEAGTHIVCLRTDRGGEFNSKEFSNFCNQHCISWQLKAAYTPQQNGVAERKNRTIMNAVRAVLHDKQVSKSFWPEVVRWCVHVQNQSPTSAIDQGTPEGVWSGVKPRVDYFCTFGCVAHVHIPDQKRSKLDAKSQQCILLGVSDETKAYKLYDPITKKVIVSRDVVFEEDKSWNWDAHVDGGTTPALDWGDKDVEEIETVESASQQITVSRDQPVTLEPTLNSAPADSPIEGKATRTRRQPLWMSDYETNLSVEEESLLAMMITDFVDPQSF

SEQ ID NO: 160651 - protein, 617 aa, Glycine max
  Coding DNA Sequence Number=SeqID_43873
  Gene Ontology: Mol. function=acyl-CoA binding; Cellular component =membrane; Biological process=translation
  Homolog annotation: Hit_ID=Q94D04; Match level="QueryCoverage=99%, HitCoverage=90%, E-value=1e-124, Identity=42%"; Hit description =Putative p40
  Pfam annotation: Domain name=Kelch_1; Domain location=118-163; Score =23.7; E_value=0.00067; Accession=PF01344.15; Description=Kelch motif
  Pfam annotation: Domain name=Kelch_1; Domain location=15-60; Score =28.8; E_value=2e-05; Accession=PF01344.15; Description=Kelch motif
  Pfam annotation: Domain name=Kelch_1; Domain location=216-261; Score =20.4; E_value=0.0066; Accession=PF01344.15; Description=Kelch motif
  Pfam annotation: Domain name=Kelch_1; Domain location=66-113; Score =11.2; E_value=0.21; Accession=PF01344.15; Description=Kelch motif
  Pfam annotation: Domain name=Kelch_2; Domain location=118-163; Score =21.7; E_value=0.0027; Accession=PF07646.5; Description=Kelch motif
  Pfam annotation: Domain name=Kelch_2; Domain location=15-60; Score =33.1; E_value=9.8e-07; Accession=PF07646.5; Description=Kelch motif
  Pfam annotation: Domain name=Kelch_2; Domain location=216-261; Score =9.5; E_value=2.1; Accession=PF07646.5; Description=Kelch motif
  Pfam annotation: Domain name=Kelch_2; Domain location=65-113; Score =33.6; E_value=7.1e-07; Accession=PF07646.5; Description=Kelch motif
  Pfam module annotation: Pfam domain module=Kelch_1::Kelch_1::Kelch _1::Kelch_1::Kelch_2::Kelch_2::Kelch_2::Kelch_2; Domain location=118 -163::15-60::216-261::66-113::118-163::15-60::216-261::65-113
MDWSKLATTGEKPGPRDSHSAVLVGHKMIVFGGTNGLKKVNDTHILDLVTKEWFRPKCEGTPPSPRESHTATLVGDERLVIFGGSGEGEANYLNDLHVLDLRTMRWTSPTVKGDFPVPRDSHSTLAIGNKLIMYGGDCGDQYQGDVNVLDMDTMSWSRLRIQGSSPGVRAGHAAVNIGTKASSFQMQHFFSFSVMTIFNFFATWFLLNIWYYLKLNLECKFLEVLISKIYIIGGVGDKRYYNDIWVFDICTCSWTQLDIRGQQPQGRFSHTAVVADMDIAIYGGCGEDERPLNELLVLQLGAEHPNGRYNISMCKVFGTCWNHEKRTIPGGADTNSTTPRNGNNNMEVLGKWAYEVVSDKVNPCHFDSGTSQQKRRRIAIAKVWDVESEQEEHSLSLSQHSSPSQSDQEQTPGQKSNVSVMDAQSYHWFKQINKSPSYCQLDNIPSNNTALKNITQRSVHLIENQPKQEHYLHVDEDRKGARHTQHLIGAEVRGKVDGAFDSGLLMTAAVNGRVFRGVLFAPGAGVFSTSVEPKCSVSCSFPSTQPFMNSNHHVRDSQQVANCSRAEPCHGISQPVLAQPTPIMRGTTVSLAKEHKVRSDLQGLVLTLGGPASGNHA

SEQ ID NO: 160652 - protein, 82 aa, Glycine max
  Coding DNA Sequence Number=SeqID_43874
  Subcellular localization annotation: CTP_CleavageSite=27; ConfidenceScore=5.23e-01
MASVNGTYPSRWAPSSKNGIMFTYYTNSTTVNSWHFFFRWKSCKLSFIYKISLLIWEFAELKLLCVYDIDSRVEWQAKTGHS

SEQ ID NO: 160653 - protein, 506 aa, Glycine max
  Coding DNA Sequence Number=SeqID_43875
  Gene Ontology: Mol. function=iron ion transporter activity; Cellular component=flagellum; Biological process=iron ion transport
  Homolog annotation: Hit_ID=Q2QNK6; Match level="QueryCoverage=95%, HitCoverage=75%, E-value=1e-145, Identity=55%"; Hit description =Flagellar biosynthesis protein FLHA, putative, expressed
  Pfam annotation: Domain name=MFS_1; Domain location=23-463; Score= -46.0; E_value=0.04; Accession=PF07690.6; Description=Major Facilitator Superfamily
  Subcellular localization annotation: CTP_CleavageSite=29; ConfidenceScore=5.18e-01
MASSITFFNLKSALTSLALQSTFYASCLTANVVEQLWNFAWPSAIALIHPSLLPVAVMSFFTKVAIIVGGPLVGKLMDHFPRVSAYNCLTIVQASCLIIYTNYKFKQDIALFLKVIILSNFQAAAQLLSAAMIIRAHSVQPTSFSTLLLRPWFVILVSAGAIERLCGVALGVANERDWVVLLAGVNRPIALAQANAVLNRIDLLCEIAGAMLFGFLLSKFHPVICLKVASGLMMGLLPVTIVFNYLTNKLSTGVLDRPKPSQTCCRTFNEDSALDASSIVASTGKPVFKGLEAIKLGWKEYLGQPVLPASLAWVLLCFNIVLTPGSLLTAFLTQRGLHPSIIGGFSGMCALMGVAATFVSSTLVKQFGILKAGAVGLVFQALLLSMAVAVYWSGTISHQSPLLTFLFLIILSRLGHMSYDVVGAQILQTGIPSSKANLIGTTEIAVASLAESIMLGVAIIANDPSHFGCLALLSLLSVVGAAWMFCRWLLNPTDEQKNLFSYDPQF

SEQ ID NO: 160654 - protein, 305 aa, Glycine max
  Coding DNA Sequence Number=SeqID_43876
  Gene Ontology: Mol. function=pectinesterase activity; Cellular component=cell wall; Biological process=cell wall modification
  Homolog annotation: Hit_ID=Q4PSQ5; Match level="QueryCoverage=97%, HitCoverage=94%, E-value=5e-75, Identity=46%"; Hit description =Pectinesterase family protein
  Pfam annotation: Domain name=Pectinesterase; Domain location=11-296; Score=172.7; E_value=9.2e-49; Accession=PF01095.10; Description =Pectinesterase
MDCGGTQVSRTIVVDQSGKSDFHTIQAAIDSIKTSNNKWVKIHIKAGTYTEQIQIPYNMPCIFLEGQGKEVTTVTYNDHQKTDISATFSSFPDNVVASGITFKNSFDTAAILSYDGKRIPALAARIYGDKSAFYNCSFIGFQDTLWDVEGRHYYKNCLIEGAVDFIWGSGQSYFVDCVLNVTSSGSITAQGRSSNSDPSGFVFQRGSVVGSGSAILGRAYDRCSRVIFYDTNLGSVVDPQGWNAWHYTKHEDCIYYAEVGCTGVGANTSKRVPWRKKLTISEFRQQFSTSVFIDHEGWLSKIPLN

SEQ ID NO: 160655 - protein, 207 aa, Glycine max
  Coding DNA Sequence Number=SeqID_43877
MAFTVGIGSGGAIIPCGNRTTAIPYIRGGGGGLLFPDRTRSRNLHLHVACAKKKKKLLEKIELEFWEWFGTFLKYSWIIAIAVATLASSWTASPQSRTNAARSVTSRIRRPTLRAATPRQVDEVDEAGVGDLGEDLNLVFGETGAVAAISAFGGVVFRGAGGDKFGRFDDGEELVSFEGGSVDSAVAASAQEGVGGVVGGGDDVINE

SEQ ID NO: 160656 - protein, 376 aa, Glycine max
  Coding DNA Sequence Number=SeqID_43878
  Gene Ontology: Mol. function=malate transporter activity; Biological process=response to aluminum ion
  Homolog annotation: Hit_ID=Q5FAM2; Match level="QueryCoverage=95%, HitCoverage=59%, E-value=1e-104, Identity=54%"; Hit description =Putative expressed protein
  Pfam annotation: Domain name=UPF0005; Domain location=84-375; Score =457.7; E_value=1.5e-134; Accession=PF01027.11; Description =Uncharacterised protein family UPF0005
MMMGSTARVPKLGSFRHSFAERKERLLSMKGGIGGGYSQIGIPLPESDEEDHSPTRRRCCSYRAVSDGIVGAWKSAKRVAARAWEMGRSDPRKIIFSAKMGLALILLSLLIFLKQPFEDIAKHSVWAILTVVVVFEFSIGATLSKGLNRGLGTLLAGGLALGMGLLSKLSGKWEETIIVVSIFTAGFCATYAKQYPTMKAYEYGFRVFLITYCYIIVSGYHTGEFVETAVDRFLLIALGAAVALGINVCIYPIWAGEDLHKLVAKNFVGVAASLEGVVNNYLNCIEYERVPSKILTYQASEDVVYKGYRSAVESTSTEDSLMGFAVWEPPHGPYKMLRYPWQNYVKVSGALRHCAFMVMAMHGCILSEIQRGDFQG

SEQ ID NO: 160657 - protein, 260 aa, Glycine max
  Coding DNA Sequence Number=SeqID_43879
  Subcellular localization annotation: CTP_CleavageSite=50; ConfidenceScore=5.14e-01
MAFTVASGSGVAIIPCGNTGTAALFPHRTRRNLHVARAKKPLNGDDVSVYAELLKAEVSVLENNKPLDDNDAALKFLEKIDRQFQQPDLWEGPQWDWLGIFIKFSPIIGIAVAKKEVNGNRVSSHKASLAIYGCFTFHEPPKNVREAAERLYSVQSGVESNAESDDVESSAETDVESSAESSSEVFKEPDAYDSDVFDSNPTEISQVSAIEKEAQIVWFLAVVLLEVATARPWRRGSTLHKCCARNKEKEAWCALSYSGA

SEQ ID NO: 160658 - protein, 120 aa, Glycine max
  Coding DNA Sequence Number=SeqID_43880
  Gene Ontology: Mol. function=pepsin A activity; Cellular component =cellulose and pectin-containing cell wall; Biological process =proteolysis
  Homolog annotation: Hit_ID=Q6YWQ0; Match level="QueryCoverage=75%, HitCoverage=15%, E-value=3e-22, Identity=50%"; Hit description =Putative nucellin-like aspartic protease
MEQAVLKSMLHACRSVKDVKDYFKTLTLRFGSKWWILSTLFQISPEGYLIISNKGHVCLGILDGSNVNDGSSIILGDISLRGYSVVYDNVKQKIGWKRADCGMPSRRLRKKNNFIPDSML

SEQ ID NO: 160659 - protein, 753 aa, Glycine max
  Coding DNA Sequence Number=SeqID_43881
  Gene Ontology: Mol. function=oxidoreductase activity; Cellular component=nucleus; Biological process=electron transport
  Homolog annotation: Hit_ID=Q6Z690; Match level="QueryCoverage=83%, HitCoverage=80%, E-value=0.0, Identity=54%"; Hit description =Putative polyamine oxidase
  Pfam annotation: Domain name=Amino_oxidase; Domain location=181-609; Score=315.8; E_value=7.5e-92; Accession=PF01593.14; Description =Flavin containing amine oxidoreductase
  Pfam annotation: Domain name=DAO; Domain location=173-507; Score= -44.7; E_value=0.0052; Accession=PF01266.14; Description=FAD dependent oxidoreductase
  Pfam module annotation: Pfam domain module=Amino_oxidase::DAO; Domain location=181-609::173-507
  Subcellular localization annotation: CTP_CleavageSite=92; ConfidenceScore=5.02e-01
MSDSTNTNPPPPPVAEPPPPPQSGSPENDVAMSPQNSSEDPDSSLPTQTTPEPAVPDSPDSATTRPDPNPPPRKRRRRKKFFTELTTGPSTRRNDVAKDCDVEALIAISVGFPVDSLTEEEIEANGGFHRRRLRAIQLHRRPKPHIGALAFQRFGLEIQTLKLKPFDGSDRGTVIVIGAGFAGLVAARQLVFMGFKVVILEGRTRPGGRVKTKKMSGDGVEAAADFGGSVLTGINGNPLGVLARQLGLPLHKVRDICPLYLPDGRSVDSEVDSRVEVSFNKLLERVCKLRQAMIEEVKSVDVPLGTALEAFRRVYMVAEDKEERMLLNWHLANLEYANATLMSNLSMAYWDQDDPYEMGGDHCFIPGGNEKFVRALAEDLPIFYGRTVECVKYGSDGVLVYAGGQEFRGGMVLCTVPLGVLKKGDIEFVPELPQRKKDAIHRLGFGLLNKVAILFPYNFWGGDIDTFGHLTEDLSMRGEFFLFYSYSSVSGGPLLVALVAGEAAIRFEMMSPVESVKRVLDILKNIFNPKGIVVPDPVQAACTRWGKDHFAYGSYSYVAVGSSGDDYDILAESVGDGTVFFAGEATSKQYPATMHGAFLSGMREAANILRVAKRRSSMPIDTSKSVNQENDDLNKLFVKPDLTFGSFSALFDPNLNDLDSSSLLRVKIGGAVLDSGSLYLYALLPKKWVIELSQLEGDENRMRMLNRNFGVSLVGRKGLSSAAESLIASIKLSRPNLNEAENGLIMTGKENSQ

SEQ ID NO: 160660 - protein, 197 aa, Glycine max
  Coding DNA Sequence Number=SeqID_43882
  Gene Ontology: Mol. function=oxidoreductase activity; Cellular component=membrane; Biological process=electron transport
  Homolog annotation: Hit_ID=Q8W228; Match level="QueryCoverage=82%, HitCoverage=37%, E-value=9e-26, Identity=43%"; Hit description =Cytochrome P450
  Subcellular localization annotation: CTP_CleavageSite=40; ConfidenceScore=5.01e-01
MSPLTLVILIVPLVTLIYILGTTTVSAGTATVSDHQKPPRARRIRNTPTPFPPIPFQTLQSHNPRNCSLRRTTPCSRTGQSSKRPCVCGVRAVLAKREEACTTRPLRASKLASFGALRKREIGAMVESLKEAAMAREIVDVSERVGEVLRNMACKMVLGRNKDRRFDLKGYMSVSVAFILADYVPWLRLFDLQSLIY

SEQ ID NO: 160661 - protein, 160 aa, Glycine max
  Coding DNA Sequence Number=SeqID_43883
  Gene Ontology: Mol. function=oxidoreductase activity; Cellular component=membrane; Biological process=electron transport
  Homolog annotation: Hit_ID=Q75W19; Match level="QueryCoverage=96%, HitCoverage=31%, E-value=6e-53, Identity=61%"; Hit description =Cytochrome P450
MVEENDLAKLCYLDTVVKETLRLHPVVPLLAPHESMEAIVIEGYYMKKKSRVIINAWAIGRHPKVWSENAEVFYPERFMNDNVDFKGQDFPLIPFGSGRTSCPGMVMGLTIVKLVLAQLLYCFHWGLPYGIDPDELDMNEKSGLSMPRARHLLVIQWWQV

SEQ ID NO: 160662 - protein, 251 aa, Glycine max
  Coding DNA Sequence Number=SeqID_43884
  Gene Ontology: Mol. function=peptidase activity; Biological process =proteolysis
  Homolog annotation: Hit_ID=Q6YWQ0; Match level="QueryCoverage=89%, HitCoverage=39%, E-value=3e-24, Identity=32%"; Hit description =Putative nucellin-like aspartic protease
MEDDESPQIKGVVIISLPPPDNPSLGKTITAFTFSNPSPQPSIQPHQHQSQPTHPNAQHNTDPPLQSYPSNPQLSFSFRRLFHSTPVKLFSFFGILLFALFLYGSVSSTTTVELRGRNNDDDDDDKATSFLFPLFPKFGVLGQKDLKLQLGKLSQKEKFLTHRDDGDGSGVVAVDSSSVFPVSGNVYPDGLYFTILRVGNPPKSYFLDVDTGSDLTWMQCDAPCISCGKNCVYSKDKIDTGSTCPIQANKI

SEQ ID NO: 160663 - protein, 478 aa, Glycine max
  Coding DNA Sequence Number=SeqID_43885
  Gene Ontology: Mol. function=oxidoreductase activity; Cellular component=membrane; Biological process=electron transport
  Homolog annotation: Hit_ID=Q8W228; Match level="QueryCoverage=98%, HitCoverage=97%, E-value=1e-157, Identity=55%"; Hit description =Cytochrome P450
  Pfam annotation: Domain name=p450; Domain location=23-469; Score =351.8; E_value=1.2e-102; Accession=PF00067.12; Description =Cytochrome P450
IPTILLVIFIWVVQPKQRHGKIAPGPKALPIIGNLHMLGKLPHRTLQTFARKYGPIMSLKLGQVQAIVVSSPETAELFLKTHDTVFASRPKIQASEYLSHGTKGLVFSEYSAYWRKVRKVCTLQLLSASKVDMFAPLRRQELGVLVKSLRNSAASREVVDLSEVLGELMENIVYKMVLGRARDHRFELKGLVHQVMNLVGAFNLADYMPWLGAFDPQQIIQDHEHNQYDNYKVQKAPHNNKDFVDILLSLMNQPIDLQGHQNVIDRTNIKAIILDMIMAAFDTSSTTVEWAMSELLRHQSVMKRLQDELENVVGMNRHVEEIDLEKLAYLNMVVKETLRLHPVAPLLVPRESREDVTIDGYFIKKKSRIIVNAWAIGRDPKVWHNPLMFDPKRFENCNVDIRGSDFRVIPFGSGRRGCPGIHMGLTTVKLVLAQLVHCFNWVLPLDMSPDELDMNEIFGLTTPRSKHLLATPVYRLVD

SEQ ID NO: 160664 - protein, 511 aa, Glycine max
  Coding DNA Sequence Number=SeqID_43886
  Gene Ontology: Mol. function=oxidoreductase activity; Cellular component=membrane; Biological process=electron transport
  Homolog annotation: Hit_ID=Q8W228; Match level="QueryCoverage=98%, HitCoverage=98%, E-value=1e-171, Identity=59%"; Hit description =Cytochrome P450
  Pfam annotation: Domain name=p450; Domain location=38-500; Score =403.5; E_value=3e-118; Accession=PF00067.12; Description=Cytochrome P450
MLLETFTIPAALLVIFILILSYALFHPNQPQDDDKAHPPGPKPLPIIGNLHMLGKLPHRSLQALAKKYGPIMSIKLGQVPTIVVSSPETAELFLKTHDTVFASRPKTQASEYMSYGTKGLVFSEYGPYWRNMRKFCTTQLLSASKVDMFAPLRREELGLFVKSLEKAASSRDVVNISEQVGELMSNIVYKMILGRNKDDRFDLKGLTHEALHLSGVFNMADYVPWARAFDLQGLKRKFKKSKKAFDQVLEQTIKDHEDPTDSDKKSVHNSEDFVAILLSLMHQPMDQHEQKHVIDRTNVKAIILDMIGGSFDTSTSAIEWAMTELLRHPRVMKTLQDELNSVVGINKKVEESDLAKLPYLNMVVKETLRLYPVVPLLVPRESLENITINGYYIEKKSRILINAWAIGRDPKVWCNNAEMFYPERFMNNNVDIRGHDFQLIPFGSGRRGCPGIQLGLTSVGLILAQLVHCFNWELPLGISPDDLDMTEKFGITIPRCKPLLAIPTYRLLNKA

SEQ ID NO: 160665 - protein, 174 aa, Glycine max
  Coding DNA Sequence Number=SeqID_43887
  Gene Ontology: Mol. function=helicase activity; Biological process =viral genome replication
  Homolog annotation: Hit_ID=Q9LW42; Match level="QueryCoverage=98%, HitCoverage=10%, E-value=2e-43, Identity=53%"; Hit description =Helicase-like protein
MLDEHNVHAKSFRMARDRLTDSQLDNVKLRLIAAREKDGRTYNLPNVSEVAALIVGDFDPDSRRDIIVETQNGELQRIHELHSSYLGLQYPLLFPYGEDGYRPDILHRSISSSRKMKRNRLTMREWFAYRLQSRSNEAQTLLHSRKLFQQFIVEAYTMVESERLSYIRNNKKKT

SEQ ID NO: 160666 - protein, 120 aa, Glycine max
  Coding DNA Sequence Number=SeqID_43888
  Subcellular localization annotation: CTP_CleavageSite=38; ConfidenceScore=5.72e-01
MAELSKKRKGSSASASASRAHRSGATSASTAPIPPSLSSSTLFSSEEQQKRYSNLFSSRSIIDPKFVDMEFFSAETFDCIQAFQNLGLIPFMSLQLPVYPELVKAFYCNLEIQDNTLISE

SEQ ID NO: 160667 - protein, 42 aa, Glycine max
  Coding DNA Sequence Number=SeqID_43889
MSEIGRFGGLGMEERRKEEGAAQGFLENVIFIEQDAWPSVLV

SEQ ID NO: 160668 - protein, 111 aa, Glycine max
  Coding DNA Sequence Number=SeqID_43890
MVVKSDHGRYYGKYDIRVPIKVVIKNPYRCSAETMPYRLHEDKTTLRFSLKHHLKFKLNSLKKCHYRPERVVRQFGCTQTIPAPPVDSWVSYDDIHDRWMHYSDHIVSAGE

SEQ ID NO: 160669 - protein, 240 aa, Glycine max
  Coding DNA Sequence Number=SeqID_43891
  Gene Ontology: Mol. function=4-hydroxybenzoyl-CoA reductase activity; Biological process=electron transport
  Homolog annotation: Hit_ID=Q396F5; Match level="QueryCoverage=64%, HitCoverage=66%, E-value=1e-59, Identity=69%"; Hit description=(2Fe -2S)-binding protein
  Pfam annotation: Domain name=Fer2; Domain location=111-177; Score =10.7; E_value=0.062; Accession=PF00111.17; Description=2Fe-2S iron -sulfur cluster binding domain
  Pfam annotation: Domain name=Fer2_2; Domain location=185-236; Score =2.0; E_value=1.1e-05; Accession=PF01799.10; Description=[2Fe-2S] binding domain
  Pfam module annotation: Pfam domain module=Fer2::Fer2_2; Domain location=111-177::185-236
MECGNLIVPELVSGQLQGGLAMGIGHALHEYLPLYEDGPGNGTWNFNRYHLPRASDVAVWKQSGDILPALSETDPPKGMAEVVMIPIVAALVNAIADATGHRFRDLPPISLTINQKQYGPIEVPEGLMMIDFLHEYLDLTGSRLGCGQGICHACVAIVDHPSGTSEEVRTCITGAHFFNGKKVRTVEGHARVDEQGEVVELSPIQQAFLEHYSFQCGYCTPGFVNAATIFVEKLKREPIA

SEQ ID NO: 160670 - protein, 77 aa, Glycine max
  Coding DNA Sequence Number=SeqID_43892
MTSGELEISVVKQVGNERDKGGNERNTYGDIDAVRRKANTTEEAEGGAVGVVEGFMHAGAVTAVARFNSVVWVGAGL

SEQ ID NO: 160671 - protein, 154 aa, Glycine max
  Coding DNA Sequence Number=SeqID_43893
MPLRGRIASVVVGMAEIGVGFMDDVLACVERTNELGSPLLVATILGSTELSGPLLLSGISDVEVRGGIAKGTPTSKDLLSRSIYTCPVLRGLRNVRSHVGKLLLYASWPSSWVAVGDLHEPSKWSPTSRASKAPRAEQVPSFVSRTVQFFQFLY

SEQ ID NO: 160672 - protein, 188 aa, Glycine max
  Coding DNA Sequence Number=SeqID_43894
  Gene Ontology: Mol. function=RNA-directed DNA polymerase activity; Cellular component=mitochondrion; Biological process=RNA-dependent DNA replication
  Pfam annotation: Domain name=rve; Domain location=1-141; Score=20.4; E_value=0.00012; Accession=PF00665.16; Description=Integrase core domain
MWGIDILGPFPTTKGHVKFLLIAVDFLTKWIKAKPIQRSQLRRYGLPQAIVMDNGRQFTEKDYGEFLKQLDIKHLTSLIGHPQTNRQAKVVNMVILTELCKRLSKVAKGLWVDKLPRVLWGTTKHVQRGQQLRIIGSEARVQEEAYKWRMNWKYNSKLNKCSFKTNKLVWRLRGDAEKDNSEGKLAPN

SEQ ID NO: 160673 - protein, 280 aa, Glycine max
  Coding DNA Sequence Number=SeqID_43895
  Subcellular localization annotation: CTP_CleavageSite=65; ConfidenceScore=5.55e-01
MAHKCLFRANLVLPSPAKPPAMVLMTVFPPLSTVEPITMRLLSSTSIMTSTISTTTLIITSIVVRGVDVVGKGGKDTISVLNASSSKCAQLTFNGQLVTYCTLKRWAKEKIESMDRRGKHLYHVSANPLWEVGKTLHITALSLKCKLNFVMNASKYSLGSENGWEVARGGYRRKVECYFPRYVSRHGWVVGMGSEVEMVVDASSIGACRPRIFFINGFLCFLEDEWQRNGERERERRRHFKEKMSLEEAHHHRRPWIRAWRKKEMNEGRGREEHEILCSK

SEQ ID NO: 160674 - protein, 133 aa, Glycine max
  Coding DNA Sequence Number=SeqID_43896
  Gene Ontology: Mol. function=RNA-directed DNA polymerase activity; Cellular component=mitochondrion; Biological process=RNA-dependent DNA replication
  Pfam annotation: Domain name=RnaseH; Domain location=20-130; Score= -32.1; E_value=0.057; Accession=PF00075.14; Description=RNase H
MKAQCLVVFVIELSTNKEPKFEWWRLCVDGSSSKKGNRFGVILESPDKVILEQSLRIKFQKTNNQAEYEALLAKLRLAKEVRAKYLKCWSNSKLVTGQLNGEYQTKDPQMTRYYHMATRLKDAFVKFKIQHIA

SEQ ID NO: 160675 - protein, 247 aa, Glycine max
  Coding DNA Sequence Number=SeqID_43897
MKDSPKHEKKLVKSMEGQNEVDNAEAEKEKEVEVAKKSIATKKEKMTETDHNMMDYVDPIESLDATEIFLGQSLVVVRHWKETVSQVEEKTKVMVAQLKLMKEVMKKLQDDLDKHVGYLSNKVRENEMLSSRVSDPEEQVKDMGRKMEELSSEKRIMEEELVEMKKAVEKLEGENALMAELKKAKRLIMLNHLEGFKKAQCQVKVLVASFDSARLDVNCNTVDGEIIRDSQLCSESEGEKEKEVESK

SEQ ID NO: 160676 - protein, 136 aa, Glycine max
  Coding DNA Sequence Number=SeqID_43898
  Gene Ontology: Mol. function=RNA-directed DNA polymerase activity; Cellular component=mitochondrion; Biological process=RNA-dependent DNA replication
  Subcellular localization annotation: CTP_CleavageSite=54; ConfidenceScore=5.25e-01
MRSNSSSPSSTYDSNLEAPSKGSVWPISKSSSHQPRKVAKASGHCMWMEPPIIRASNNQVEYEALIAGLKLAIKVGVKKLRSKSDSKLVTEQVNEVFEARLHKCIRTTTWSNNSWSISSINNWSMSTGNKMTELML

SEQ ID NO: 160677 - protein, 186 aa, Glycine max
  Coding DNA Sequence Number=SeqID_43899
  Gene Ontology: Mol. function=RNA-directed DNA polymerase activity; Biological process=RNA-dependent DNA replication
MVIIVGITNWNVRKVLIDGGNLIDILFWSTFHSGTSPHPGVVELVTTFERGELSRTLLVQYVLIDANIFYNILIGRTTLNALGAIMLTPHLTMKFPNQSGNIVTIKVNQVEAHNCSTKSLLVKPYTLASMKHVDAGVLIMWKALHRARPILTQGEMRKTRGQHQPRSCVVSSKEPHQMHQDRGKTW

SEQ ID NO: 160678 - protein, 383 aa, Glycine max
  Coding DNA Sequence Number=SeqID_43900
  Gene Ontology: Mol. function=zinc ion binding; Cellular component =nucleus; Biological process=nucleotide-excision repair
  Homolog annotation: Hit_ID=Q2QNJ3; Match level="QueryCoverage=92%, HitCoverage=53%, E-value=1e-107, Identity=54%"; Hit description =Phospholipase/Carboxylesterase family protein, expressed
  Pfam annotation: Domain name=Rhodanese; Domain location=163-264; Score=9.3; E_value=0.018; Accession=PF00581.10; Description =Rhodanese-like domain
MSEDKYGVLLYYKYAEIPNLDDLLTFYHSNCSSLSLLGRVRLSSHGVNVTVSVPLISSFIPFIPNSLLFTQVGGNLSSLGNHIQALKAYSTLFHHTDFKLATCHHPLNDKVAQECGFTSLSIRIVHELVTLSSHPLLKSPNISNAGKHLSSLHNTSSCCNVIIHSYSESPEKGLVLLDARNLYETRIGKFDVPNVETLDPQVRQFSDLSSWIDDNGERLKGKNILMYCTGGIRCEMASAYIRSKGAGFENVFQLFGGIQRYLEQFPDGGFFKGKNFVFDHRISVGSSDANVIGTCLICQCSFDDYSSRCRCAYCRMLVLVCGSCQNESTQYVCELCQKQGKAVRSTQLIENGESKTSLPGVEFQNFSSDTTMCLPQVPRGDGK

SEQ ID NO: 160679 - protein, 122 aa, Glycine max
  Coding DNA Sequence Number=SeqID_43901
  Gene Ontology: Mol. function=RNA-directed DNA polymerase activity; Cellular component=intracellular; Biological process=RNA-dependent DNA replication
MIAEVEENITQVLEANRDLFSWSRSDMPIINSKFHYHKLAIYLESRPVVQRKIKLDPLEWKIMDEDARKLLSAGFIREVEYTTWPANKVMVKKSNGKWRICTNYTDLNKAVSSLESVPLCFK

SEQ ID NO: 160680 - protein, 592 aa, Glycine max
  Coding DNA Sequence Number=SeqID_43902
  Gene Ontology: Mol. function=methionyl aminopeptidase activity; Cellular component=mitochondrion; Biological process=proteolysis
  Homolog annotation: Hit_ID=Q2QNJ1; Match level="QueryCoverage=57%, HitCoverage=71%, E-value=1e-104, Identity=52%"; Hit description =Metallopeptidase family M24 containing protein, expressed
  Pfam annotation: Domain name=AMP_N; Domain location=265-419; Score =123.2; E_value=7.5e-34; Accession=PF05195.6; Description =Aminopeptidase P, N-terminal domain
  Pfam annotation: Domain name=FSH1; Domain location=4-186; Score= -41.7; E_value=0.0001; Accession=PF03959.4; Description=Serine hydrolase (FSH1)
  Pfam annotation: Domain name=Peptidase_M24; Domain location=454-590; Score=-40.0; E_value=2.6e-05; Accession=PF00557.14; Description =metallopeptidase family M24
  Pfam module annotation: Pfam domain module=AMP_N::FSH1::Peptidase _M24; Domain location=265-419::4-186::454-590
PPPPLDNCKKKFAWFVAPNFDGSSAADWKVADGPFDPLQYQQQTNGYDISVSHLKNVFSQEGPFDGILGFSQGAAMTALISAQQEKLKGEMDFKFVVLCSGFALRMKEMECGPIKCPSLHIFGNEHGKDRQIANQASKELASLYDSDCSAIVEHDCGHIIPTRSPYIDEIKDFLGRFLMLEDEAEGGTRQDKGWWVVGGVVQGEGLMCITRGRRQKKEGVTFLSIQLPLGGFRSYCTDKVVVDIGQPTSASHPQLLKDGELTPGISTEEYILRRKKLLDLLPEKSLAIIAAAPVKMMTDVVPYTFRQDADYLYITGCQQPGGVAILGHDCGLCMFMPEAKPNDVIWQGQIAEVDAALDTFKADRAYPMKKLQEVNHWLEAIVIQALQSKKSIFTSLILPDMIRGSSKLFHNVETATPEYMELEAFKKLAYCNNVKNLAVYTHQLRWIKSPAELKLMKESASIACQALLLAMLHSKTFPFEGMLAAKVEYECKIRGAQRMGFNPVVGGGPNGSVIHYSRNDQRIKHGDLVLMDVGCELHGYVSDLTRTWPPCGSFSSAQKGLKELGILRDVGSSSYHKLNPTSIGSLVLKFAC

SEQ ID NO: 160681 - protein, 83 aa, Glycine max
  Coding DNA Sequence Number=SeqID_43903
MGVGTAAAQLLPSFIGDHLCGATMATAERGRISQNWNSSSHHANLQRLDTKRCCEGGNCLGNLAEKVHQIRWRGLGDWSNILF

SEQ ID NO: 160682 - protein, 146 aa, Glycine max
  Coding DNA Sequence Number=SeqID_43904
  Gene Ontology: Mol. function=endonuclease activity; Biological process=RNA-dependent DNA replication
  Homolog annotation: Hit_ID=Q2HS44; Match level="QueryCoverage=78%, HitCoverage=48%, E-value=2e-19, Identity=44%"; Hit description =Hemopexin
MAFLKETEEGIPGTSSTISLSFFPSSLMKKLECVSILIISCRLFMRLFMTVASMIFLWKEGYKFTWTKSKRKPDEIEEKLDRALANLDWLDMFPDFKLKNFIASKSDHSPIHLLLDANCRKSFRKQFRFENSRFLEPSLDVVVKEG

SEQ ID NO: 160683 - protein, 216 aa, Glycine max
  Coding DNA Sequence Number=SeqID_43905
  Gene Ontology: Mol. function=RNA binding
  Homolog annotation: Hit_ID=Q1RWD7; Match level="QueryCoverage=48%, HitCoverage=24%, E-value=2e-08, Identity=33%"; Hit description =Cyclin-like F-box; Agenet
  Pfam annotation: Domain name=Agenet; Domain location=29-90; Score =61.6; E_value=2.6e-15; Accession=PF05641.3; Description=Agenet domain
MIGEGNGESKRVLLTPKVKSVETVKGNEIGVGAIVEVSSDSGAWFAATVVKVVRKDKFLVEYHGLLADDDSQLREEIDVLHIRPHPPDADVDGQFSLLDELDAFYNDGWWVGVISKALADFKLRLHQDWIGGKWVMPCKSYHQGYCGQGFRGLHNHTVLTIFVSMLDFTPCWKAGQSSPRLLQWAATAADWFNVVVVPNQISAEIVVLCVDSKEVL

SEQ ID NO: 160684 - protein, 195 aa, Glycine max
  Coding DNA Sequence Number=SeqID_43906
  Gene Ontology: Mol. function=RNA-directed DNA polymerase activity; Biological process=RNA-dependent DNA replication
MGQLREASYEDSANCYNVKKDKLNNLIAQEESCWKQREKVYWLREDEMNSRFFHSYASARKKINTIVSLTHDDVKILEIVNHVPLTPPFLLFSIDEFRDALFQMDYNKSPSPDGLNPAFYKNKLEPLCCWHMDTIVNLFNDEDAQEIKKISSRKQAKNGNIVWKFTASGNYSVKTAYHFLMEKLICNDHLKVNES

SEQ ID NO: 160685 - protein, 69 aa, Glycine max
  Coding DNA Sequence Number=SeqID_43907
MVARPLLLYFALLTPAVVSPMQLAKHPPRQLLCNIYPNLGPLSLHMRALSFRHIVSYNVTNYMHQHDLT

SEQ ID NO: 160686 - protein, 87 aa, Glycine max
  Coding DNA Sequence Number=SeqID_43908
  Gene Ontology: Mol. function=transferase activity, transferring hexosyl groups; Biological process=metabolic process
  Homolog annotation: Hit_ID=Q9SGA8; Match level="QueryCoverage=71%, HitCoverage=14%, E-value=2e-10, Identity=53%"; Hit description =Putative UDP-glucosyl transferase
MARPHVMVVPHPVQWCWKVTQEKVKELIECVNRSESEKITCVLAYQSIGWAVKISEKKRIRRAAFCPASAAQLVLGSSIPKMIDTAS

SEQ ID NO: 160687 - protein, 406 aa, Glycine max
  Coding DNA Sequence Number=SeqID_43909
  Gene Ontology: Mol. function=protein binding; Cellular component =clathrin vesicle coat; Biological process=intracellular protein transport
  Homolog annotation: Hit_ID=Q8LPJ0; Match level="QueryCoverage=73%, HitCoverage=99%, E-value=1e-140, Identity=77%"; Hit description =Clathrin-associated protein, putative
  Pfam annotation: Domain name=Adap_comp_sub; Domain location=158-406; Score=312.7; E_value=6.4e-91; Accession=PF00928.11; Description =Adaptor complexes medium subunit family
MSAEVMLEKQLTGHRVDRSICAWFWEQAISLGDSFKQQPVIASPTHYIFQVFRDGITFLGCTQVEMPPLMAIEFLCRVANVLNDYFGALNEDIIKDNFVIVYELLDEMIDNGFPLTTEPSILREMITPPNMVDKALSIVTGSSSNVSDTLPGAAASCVPWRTAEPKYSNNEVYVDLVEEMDAIINRDGGLVKCEIYGEVQVNSRISGFPDLTLSFTNPSILNDVRFHPCVRFRPWESHQILSFVPPDGQFKLMSYRVRKLKSTPIYVKPQLTSDGGICRVSVLAGIRNDPGKTIDSVTVQFQLPPFILSADLTSNHGTVNILAKQTCIWSIGRIPKDKTPSLSGTLVIETGLERLHVFPTFQVGFRIMGVALSGLQIDKLDLKTVPYRFYKGFRALTRAGEFEVRS

SEQ ID NO: 160688 - protein, 79 aa, Glycine max
  Coding DNA Sequence Number=SeqID_43910
MQRDSLESNASNPAIKYMSSMEFMTGRLDSNPCLTTAAFTCLPKIPDPIDAQALAAIEKLKRLNAPSSCLLARNYVVQY

SEQ ID NO: 160689 - protein, 304 aa, Glycine max
  Coding DNA Sequence Number=SeqID_43911
  Homolog annotation: Hit_ID=Q9FXA8; Match level="QueryCoverage=32%, HitCoverage=16%, E-value=4e-41, Identity=79%"; Hit description =Putative invertase
MGRIELAQKAVALAEKRLPVDSWPEYYDTRTGKFIGKQARMYQTWTIAGFLTSKMLLKNPEMASMLFWEEDYELLDICVCGLSKSGRKRCSRGAARSQILEEKGFCEGGMEEEEEAPDDAVLELSEHGIVLIVKNAVASKPRFISNDRSVDSLDASICAEIRTKIPDTIAWDYNFEPAGANPLTFTVKSAALKEAIEDLEWPGSSIQIILEPELPSGAKTHLQGLKKSRARRQLVVVEHPLKATNGWPVAVEGGNLESFVEARNLKVLTWRELCVEPPQGEKGSENVYYRPWEGSMKAPSDGAL

SEQ ID NO: 160690 - protein, 453 aa, Glycine max
  Coding DNA Sequence Number=SeqID_43912
  Gene Ontology: Cellular component=integral to membrane
  Homolog annotation: Hit_ID=Q3JJ92; Match level="QueryCoverage=59%, HitCoverage=25%, E-value=1e-70, Identity=50%"; Hit description=SciS protein
  Pfam annotation: Domain name=OmpA; Domain location=46-128; Score= -7.3; E_value=0.0023; Accession=PF00691.11; Description=OmpA family
MPGRRPTSPQVLIDLHQRLNDVIAARQLEVSDGAFGSKVIIPADKLFAPDGTVVNQVGRALLAHVASAMKTVKGTVLVSVYTDNRPVDGRFASSYEFSFARARAAAATAIRSYPMTAMKTAPAIAGWRSPCLRHRKPSAIIREASDARITPTSVNPSPAVGPDWRHGTELRAVDARSAVELGRYSSTGAGIPAPAGGRPALFLLGAVPVYSRHLARLVQQQAAQSPAGDESRRSVRSPGDRDAADPALHHYLYQLPWYVMIGAPGAGKTTALLNAGLEFPLTDSLGKEAVRGVGGTRHCDWWFTDSAVLIDTAGRYALQESQRARDGAEWHNFIKLLKRYRTRQPINGVIMTISVADLLTDSAEARHAQASALRSRMVELHQQTGIHFPVYVMVTKTDLLKGCMSFYGNLSKPQRDAIWGFTFPWEPGKPHKDDWHRSFSERFQQLEQRLQQQ

SEQ ID NO: 160691 - protein, 46 aa, Glycine max
  Coding DNA Sequence Number=SeqID_43913
MERIQKDIILLSNNIVAVGTTSDNATPKEENSRLGFTVIKRVGDPA

SEQ ID NO: 160692 - protein, 151 aa, Glycine max
  Coding DNA Sequence Number=SeqID_43914
  Gene Ontology: Mol. function=protein binding; Cellular component =microtubule; Biological process=multicellular organismal development
  Homolog annotation: Hit_ID=Q1SXD6; Match level="QueryCoverage=82%, HitCoverage=29%, E-value=3e-50, Identity=81%"; Hit description=WD40 -like
  Pfam annotation: Domain name=NLE; Domain location=14-82; Score=115.6; E_value=1.4e-31; Accession=PF08154.2; Description=NLE (NUC135) domain
MNMNEESGEGSARRVQVRFVTKLGEPYKVPTTAIAIPADLARFGLSSLVNALLQSNDADHQPEPFDFLIDGEFVRMSLEQFLLAKGISAERILEIEYARAVAPRKEEDPSLHDDWVSAVDGSSSRYSLLEVHFCIVVDSSSQRTQPNPLCE

SEQ ID NO: 160693 - protein, 149 aa, Glycine max
  Coding DNA Sequence Number=SeqID_43915
MGCEPNIKTGGEKENGYQDLDIDTWSFLEVVDLIHDLEYFDIGGLKMWWKGVNDYEEVTGDEVTRGEELFNGQQISSKKQKEPRVKNKVSHKGKHKAFGYEDLSIENLGQCDEDPNGMDYDSVIDPHHEEPNPNFREMHDLEIGYETVE

SEQ ID NO: 160694 - protein, 77 aa, Glycine max
  Coding DNA Sequence Number=SeqID_43916
  Subcellular localization annotation: CTP_CleavageSite=28; ConfidenceScore=5.25e-01
MTSHSFVHNTLSNTSAASTSFLKLTYARSGAATGYDRSARHESWNQLQDTITCHFPPSSKRVCDGDGGGECENGGGH

SEQ ID NO: 160695 - protein, 233 aa, Glycine max
  Coding DNA Sequence Number=SeqID_43917
  Homolog annotation: Hit_ID=Q47522; Match level="QueryCoverage=20%, HitCoverage=59%, E-value=1e-21, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVTTLNSMSAIKVIEIGTLIAAPFAARMLAEFGAEVIKIEAMGQGDPLRKWRKLHEGTSHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 160696 - protein, 350 aa, Glycine max
  Coding DNA Sequence Number=SeqID_43918
  Gene Ontology: Mol. function=malate transporter activity; Biological process=response to aluminum ion
  Homolog annotation: Hit_ID=Q5FAM2; Match level="QueryCoverage=82%, HitCoverage=49%, E-value=1e-101, Identity=60%"; Hit description =Putative expressed protein
  Pfam annotation: Domain name=UPF0005; Domain location=64-350; Score =423.6; E_value=2.8e-124; Accession=PF01027.11; Description =Uncharacterised protein family UPF0005
MAPKLAKTGSFRHGLAEKKEKEKLLSAAKSSSSYSEIGIGIGMMQQEEEQSWWNTFKRVAEKALEMGRSDPRKIIFSAKLGLALTILSLLIFLKEPFADLSSYCVWAILTVVVVFEFNIGATLSKGVNGGMGTLLAGGLALGMAELSTLGGKWEELIIIMCTFIVGFCATYTKLYPTFKPYEYGFRMFLITYCFISVSGYQTGEFVDIAINRFVLIALGAAVSLGVNICIYPIWAGEDLHNLVTKNFMGVATSLEGVVNHYLHCVEYKKVPSKILTYQAADDPIYNGYRSAVESTSKEDSLMGFAVWEPPHGHYKMLKYPWKNYVKLSGALRHCAFMVMAMHGCILSEIQ

SEQ ID NO: 160697 - protein, 1080 aa, Glycine max
  Coding DNA Sequence Number=SeqID_43919
  Homolog annotation: Hit_ID=Q8RXA7; Match level="QueryCoverage=94%, HitCoverage=89%, E-value=0.0, Identity=60%"; Hit description =Stomatal cytokinesis defective
  Pfam annotation: Domain name=DENN; Domain location=21-143; Score= -80.4; E_value=0.028; Accession=PF02141.11; Description=DENN (AEX-3) domain
  Pfam annotation: Domain name=WD40; Domain location=698-758; Score =19.6; E_value=0.011; Accession=PF00400.22; Description=WD domain, G -beta repeat
  Pfam annotation: Domain name=WD40; Domain location=764-800; Score =33.1; E_value=9.7e-07; Accession=PF00400.22; Description=WD domain, G-beta repeat
  Pfam annotation: Domain name=WD40; Domain location=804-841; Score =37.8; E_value=3.7e-08; Accession=PF00400.22; Description=WD domain, G-beta repeat
  Pfam annotation: Domain name=WD40; Domain location=845-883; Score =10.7; E_value=2.1; Accession=PF00400.22; Description=WD domain, G -beta repeat
  Pfam annotation: Domain name=WD40; Domain location=887-923; Score =35.2; E_value=2.2e-07; Accession=PF00400.22; Description=WD domain, G-beta repeat
  Pfam annotation: Domain name=WD40; Domain location=927-993; Score =9.0; E_value=3.3; Accession=PF00400.22; Description=WD domain, G -beta repeat
  Pfam annotation: Domain name=dDENN; Domain location=203-271; Score =54.3; E_value=3.9e-13; Accession=PF03455.9; Description=dDENN domain
  Pfam module annotation: Pfam domain module=DENN::WD40::WD40::WD40::WD4 0::WD40::WD40::dDENN; Domain location=21-143::698-758::764-800::804 -841::845-883::887-923::927-993::203-271
  Subcellular localization annotation: CTP_CleavageSite=18; ConfidenceScore=5.05e-01
MDQKFMSAAFLSGIQFVRILQRPTGFRQIHMLTNASVWFHACQLYNNFSKPLWDVIAHMVSSVPLPTPGKERVLFAIESCLLSVEAPPIDWLPHADHVYIPLLFFSGVDYIDAPTPYMMGLYSGVDTSALAIDGVVVVDLEYNRITTSEEIPPIPEPEFSLLRGEIMKLLYPNVIGIDEMNTGIYSVSEHYPKLRAKQWGEEHDLQLRMIFLKFFATVLSGYRNFLENSATQVFNSQAFLKKRSRSTNQPPEPMIAQFLDSHGFLDYLERGVGSDENNNNLLDKLQDAIGRGQNPMSILPSSSVEPEILTVSDSDIGISGSGAKYTYDRFPANIRTEEQEEKRKQILAAVSNAFEYSGRHTPSKDPLADSLSPDERAAERDRMVLDIQVKLQGLWLRLLKLGATDDPLSSFEYGTILVWRACQKVIEVGFAALIESDAEGIGGSGFVECIREHIHSGWDCHLTEEQFIAVKELLKTAINRATSRNDLLTIRDALEVSSDMYKKDNNNVLDYVQRHLISLSIWEELRFWEGYFDYLMEQSSNKSANYASLVTAQLVVLASHMAGLGLPDNDAWYMIETIAERNSIGSNQFIKIRGFLSHIQQLRNGYWGITSMKAQSVLLLALPSPHSKDAKDENQQPTEATGVGRNWVQSMFSRNTTTRSSSFSRVRRWTSDGGNSATNENGTPRKQDLSSGGQKKLQTNVRILRGHNGAITALHCVTKREVWDLVGDREDAVVSLPSGTQNEVICCSCANMQVKIWDPSLRGSELRATLKGHTRTIRAISSDRGKVVSGSDDQSVLVWDKQTTQLLEELKGHDGPVSCVRTLSGERVLTASHDGTVKMWDVRTDRCVATVGRCSSAVLCMEYDDNVGVLAAAGRDVVANIWDIRASRQMHKLSGHTQWIRSIRMVGDTVITGSDDWTARIWSVSRGTMDAVLACHAGPILCVEYSSLDRGIITGGIRCAKNVTIHNAAILSINAGEHWLGIGAADNSLSLFHRPQERLGGFSGTGSKMAGWQLYRTPQKTVAMEKKKEAASPWLIVGLGNPGKKYAATRHNVGFEMVDTIAEAEGISMTTVSFKALFGK

SEQ ID NO: 160698 - protein, 159 aa, Glycine max
  Coding DNA Sequence Number=SeqID_43920
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=100%, HitCoverage=95%, E-value=6e-83, Identity=86%"; Hit description=ADP -ribosylation factor-like protein
  Pfam annotation: Domain name=Arf; Domain location=4-156; Score=333.6; E_value=3.3e-97; Accession=PF00025.11; Description=ADP-ribosylation factor family
  Pfam annotation: Domain name=Ras; Domain location=19-158; Score= -91.3; E_value=0.02; Accession=PF00071.12; Description=Ras family
  Pfam module annotation: Pfam domain module=Arf::Ras; Domain location =4-156::19-158
MGLSFTKLFSRLFAKKEMRILMVGLDAAGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIANK

SEQ ID NO: 160699 - protein, 117 aa, Glycine max
  Coding DNA Sequence Number=SeqID_43921
  Gene Ontology: Mol. function=protein binding; Cellular component =SWI/SNF complex; Biological process=establishment and/or maintenance of chromatin architecture
  Homolog annotation: Hit_ID=Q8LKR2; Match level="QueryCoverage=74%, HitCoverage=18%, E-value=3e-29, Identity=85%"; Hit description=Actin- related protein 4
LTGGTASMHQLKERIEKDLLEESPQAARVKVFVSGNATERRFSVWIGGSILASLGSFQQMWFSKSDYFTVLWIGMKSKVLLISKGSALEFSNGCEYLCLFSYHYWEPGSFRKSNVDH

SEQ ID NO: 160700 - protein, 63 aa, Glycine max
  Coding DNA Sequence Number=SeqID_43922
MEQIEEFDKAKGEDTGQERVFYERCESESNIIYTNVSFRRICEWLQGATLLSLLGLHYPSDFT

SEQ ID NO: 160701 - protein, 353 aa, Glycine max
  Coding DNA Sequence Number=SeqID_43923
  Gene Ontology: Mol. function=molecular_function; Cellular component =membrane; Biological process=auxin mediated signaling pathway
  Homolog annotation: Hit_ID=Q84TV1; Match level="QueryCoverage=85%, HitCoverage=82%, E-value=9e-93, Identity=55%"; Hit description =Nodulin-like protein
  Pfam annotation: Domain name=DUF6; Domain location=171-300; Score =79.1; E_value=1.4e-20; Accession=PF00892.11; Description=Integral membrane protein DUF6
  Pfam annotation: Domain name=DUF6; Domain location=8-125; Score=7.3; E_value=0.025; Accession=PF00892.11; Description=Integral membrane protein DUF6
  Pfam annotation: Domain name=TPT; Domain location=162-300; Score= -5.8; E_value=0.0012; Accession=PF03151.7; Description=Triose -phosphate Transporter family
  Pfam module annotation: Pfam domain module=DUF6::DUF6::TPT; Domain location=171-300::8-125::162-300
MPPDPSHILHPISRPLSTQLPEFYFWDDKLIIMSMNTAPRMTKHIAFQILLSSLTGVTGNQILYFLGLKYSTPTIACALNNLLPAFTFILAVLSRQEYLRIKTRAGVAKALGTVLSVGGAVLLSFYHGKVLGLGESKIHWRYAENMQRESSSSGGGRNHLLGPVAVIVSALVWAVWFIVQKNMSKSYPAPYTSTFYMCLMASIQCVVIALAAEHNVSAWSLHSTIRLTSALYAGTISTALAYVLLAWTIERKGPLYVSVFSPLLLVIIAVASWAFLHEQLYVGTVIGSLLIVLGLYFVLWGKNKEMNKIDVVEVEGTVMEAIKDSEKDEVKDLELQPYEYDPSNVNGYHHDAN

SEQ ID NO: 160702 - protein, 734 aa, Glycine max
  Coding DNA Sequence Number=SeqID_43924
  Gene Ontology: Mol. function=carboxylic ester hydrolase activity; Biological process=lipid metabolic process
  Homolog annotation: Hit_ID=Q1SD04; Match level="QueryCoverage=87%, HitCoverage=100%, E-value=0.0, Identity=73%"; Hit description =Esterase/lipase/thioesterase; AB-hydrolase associated lipase region
  Pfam annotation: Domain name=Abhydro_lipase; Domain location=361-424; Score=75.8; E_value=1.4e-19; Accession=PF04083.6; Description=ab -hydrolase associated lipase region
  Pfam annotation: Domain name=Abhydrolase_1; Domain location=438-733; Score=0.1; E_value=0.0077; Accession=PF00561.10; Description =alphabeta hydrolase fold
  Pfam module annotation: Pfam domain module=Abhydro_lipase::Abhydrolase _1; Domain location=361-424::438-733
MVNSWQLPITQSFLALYSDGIVPSRVLDTVSISDLLRTGGLPCKKVGSDHLALVSEFSFSVTNNEPKDKVAAAAAAAAAASPIVDIEEPNNQQMQRFLDNVLAVTKESVKTFTYESLNNIVRVINGVSALVLTLLPGKATILVGIQGWELRPTLRGTCFPRWMDNGVSSFNHFIHELSVDSDVSSLEYSSEEEEEEDSDYDGYEEYPESPSSQSSRASRANWILVPIHLLLGIPFRLFQLAYSGSGVSKPSLAISANQHPSQSHFPNKVQSLKDQIIHRTTDRRRGIIEDLHMAMEIFIEAVFDVVHRAVHLLLSPSEALGTLSRLFSSHDDVAEDASTSSATLGDNEPTPTDRNTSSRSSLNTDARTCQDVITELGYPYEAIHVITANGYVLLLERIPRRDACKAVYLQHGVFDSSMGWVSNGVVGSPAFAAYDQGYDVFLGNFRGLISREHVNKNISCREYWRYSINEHGTEDIPAMIEKIHQVKTAVSKPDTEEESNDGQLYKFCAICHSLGGASMLMYVVTLRIEAKPHRLSRLVLLSPAGLHHDSNPVLSVAEHTLFLLAPILSRIFPAFYIPTRFFRMIVNKLARDLQNLPAVGGLVQTLVGYVVGGDSSNWVGVLGTLHYNMNDMPGVSFGVSLHLAQIKRARRFRMFDYGNAYGKVYGSPEPLDLGEHYGLVDIPVDLVAGQKDTVIRSSMVKRHYKLMKDAAQFKEPSKSKGSKVEEKGQVSFNG

SEQ ID NO: 160703 - protein, 652 aa, Glycine max
  Coding DNA Sequence Number=SeqID_43925
  Gene Ontology: Mol. function=metal ion binding; Cellular component =nucleus; Biological process=regulation of flower development
  Homolog annotation: Hit_ID=Q2QPD5; Match level="QueryCoverage=98%, HitCoverage=87%, E-value=0.0, Identity=52%"; Hit description =Fibronectin type III domain containing protein, expressed
  Pfam annotation: Domain name=fn3; Domain location=258-347; Score =15.0; E_value=0.005; Accession=PF00041.11; Description=Fibronectin type III domain
  Subcellular localization annotation: CTP_CleavageSite=28; ConfidenceScore=5.04e-01
MTENKSTSKITKKQETKKVSSFSHQPPRKQPRKGENPTRLIPPPDQSSDFGHSNTWICKNAACRAVLSMDDTFCRRCSCCICHLFDDNKDPSLWLVCTSESAQGGDSCGLSCHIECALQHEKVGVIDHGQLMQLDGGYCCASCGKVTGILGCWKKQLTIAKDARRVDVLCYRIYLSYRLLDGTSKFKDLHQTVQEAKAKLETEVGPVNGVSAKMARGIVSRLPIASGIQKLCSLAIEKADRWLATVPYVNPDSTEGSLPAACKFVFEEVTTSSAKIILIEMSNICSEEIKGYKLWYYKSQDESPTKDPISMFPKSQRRILVSNLKPCTEYTFRIISYTDTRDLGHSEAKCFTQSIEIVKNNPSSSVAMNKEKENLLTRGNSSVSKIGPNATTEGYGFKVRDLGKFLRLAWAQEQGYLEEFCCANVKNCCGQSEMVDKPRIPEAQLPSLSRVLDLNVVSVPDLNEELTPPFEYSRDEDNGCSLLQAVEADDDAASHDLEKNGLVRSHGSGDSQTWTHGPTGEVSAVDSRIDMCRKRIASTNEETHDCDSTLINGSPLRISDGSCSLDENFEYCVKVIRWLECEAHIKQEFRLKLLTWFSLRATEQERRVVNTFIQTLIDDPSSLAGQLVDSFSDIISNKRLRSGFCSKAGASN

SEQ ID NO: 160704 - protein, 63 aa, Glycine max
  Coding DNA Sequence Number=SeqID_43926
  Gene Ontology: Mol. function=lyase activity
  Homolog annotation: Hit_ID=Q1S9U9; Match level="QueryCoverage=73%, HitCoverage=16%, E-value=9e-09, Identity=66%"; Hit description =Rhamnogalacturonate lyase
MAISDERQRSMPTMRDKNWQILVYPEAVLLTRLINPAFRGELFHDRYVEELAASVEAAVEEVI

SEQ ID NO: 160705 - protein, 54 aa, Glycine max
  Coding DNA Sequence Number=SeqID_43927
MTRSKIKHSNDILQQMVSAILNKAQVENDEGPEALSRILIVAEGPSAPQIHYMY

SEQ ID NO: 160706 - protein, 166 aa, Glycine max
  Coding DNA Sequence Number=SeqID_43928
  Gene Ontology: Mol. function=pyroglutamyl-peptidase I activity; Biological process=proteolysis
  Homolog annotation: Hit_ID=Q8GVF6; Match level="QueryCoverage=87%, HitCoverage=65%, E-value=3e-48, Identity=65%"; Hit description =Pyrrolidone carboxyl peptidase-like protein
MGSEGPPAAVATVHVTGFRKFHGVSENPTETIVNNLNEYLNKKKGLPKGLVIGSCSILETAGQGALIPLYQTLKSAITSKESESSSSNKIIWLHFGVNSAATRFAIERQAVNEATFRCPDEMGWKPQKVPIVPSDGAITRIRELQLTPCSISFSRLFDCLFWGHSI

SEQ ID NO: 160707 - protein, 287 aa, Glycine max
  Coding DNA Sequence Number=SeqID_43929
  Homolog annotation: Hit_ID=Q47522; Match level="QueryCoverage=21%, HitCoverage=83%, E-value=1e-21, Identity=75%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIKPGRELPFQYSFLYLSLVETVSCEMTSRKPNTGNVKMEPDSVAQAEVQWCDLGSLQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160708 - protein, 391 aa, Glycine max
  Coding DNA Sequence Number=SeqID_43930
  Gene Ontology: Mol. function=nucleic acid binding; Cellular component= intracellular; Biological process=DNA integration
  Homolog annotation: Hit_ID=Q1SB62; Match level="QueryCoverage=98%, HitCoverage=37%, E-value=1e-144, Identity=60%"; Hit description =Integrase, catalytic region; Zinc finger, CCHC-type; Peptidase aspartic, catalytic
MDMVRCMLKAKKMPKEFWAEAVATVVYILNRCLTNSIRDKMLEKAWSGRRPSIKHLKVFGCITYAYVLDQLKKKLDDKGEKCIFIGYNTSQQEPVVIADNHEENDERLSNPTPDEPKSSRRPQRNHQLPARLQDCVMFNHNNPSDEEIINFSLFANYDPVTFEEASSDENWKKAMDDEIRAIEKNDTWELKTKYNLKGEIDRFKARLVAKGYKQKPGINYFEVFVLVASLGIIRMIISLLAQNSWKIYQMDVKFAFRNGVLEEVYVKQLAEYVVEGKEDKVYKLKEGFVWVETSTRAWYKKTDSWFVHNVFERCPCEHILYVKSIDPGDILIVCLYVDDLIFTGINSKLIVEFREAMISCFEMTDSGLVSYFLGIEPVSTPVEEMLKAKGW

SEQ ID NO: 160709 - protein, 108 aa, Glycine max
  Coding DNA Sequence Number=SeqID_43931
MRENVSVRTWILEVLLLSTIQMKDGWRMLLLKVEFNEEDEGFFVLMISLTRELGFMGLACGTNKLESLFLGSTFMGFHSTKNVNGFVIGFQQQGEANGVYGPIHRKHS

SEQ ID NO: 160710 - protein, 89 aa, Glycine max
  Coding DNA Sequence Number=SeqID_43932
MFTINYFIEKHNNNNIETYIVRYKKSFSRLRIDDGDDDRCALLLKEGRTYCQWLFLTLDLKNCYNLIARIYNTIMHCNDHDIAFQLSIL

SEQ ID NO: 160711 - protein, 62 aa, Glycine max
  Coding DNA Sequence Number=SeqID_43933
MDRLARISGFRLSACFSRSVDGLKRFFLALSQRSGALSGWLAKPADWLSEQMKISTSQTCLI

SEQ ID NO: 160712 - protein, 60 aa, Glycine max
  Coding DNA Sequence Number=SeqID_43934
MWFVVVWSLWKGLGGHGGRGLSLATTGQNYVEGIGRSWFVNEVGVQSLYSTDIYGLIVVD

SEQ ID NO: 160713 - protein, 135 aa, Glycine max
  Coding DNA Sequence Number=SeqID_43935
  Gene Ontology: Mol. function=zinc ion binding; Cellular component =endoplasmic reticulum; Biological process=ER to Golgi vesicle -mediated transport
  Homolog annotation: Hit_ID=Q9SFU0; Match level="QueryCoverage=97%, HitCoverage=12%, E-value=1e-40, Identity=58%"; Hit description =Protein transport protein Sec24-like At3g07100
  Pfam annotation: Domain name=Gelsolin; Domain location=6-78; Score =12.5; E_value=0.039; Accession=PF00626.12; Description=Gelsolin repeat
MSNDFRNIDRRLPLTGESLDSRGLYIYDDGLQFIIWFGRLISPDIAKNLLRSDLAEELAKVTLKDNDNEMSRKLKKVLKKFRSTDRAYYQLCHVVRQGEHPREGFLLSNLFEDQMGANIGYADRMLQISRQVHQA

SEQ ID NO: 160714 - protein, 304 aa, Glycine max
  Coding DNA Sequence Number=SeqID_43936
  Gene Ontology: Mol. function=transcription regulator activity; Cellular component=nucleus; Biological process=regulation of transcription
  Homolog annotation: Hit_ID=Q5DM34; Match level="QueryCoverage=45%, HitCoverage=43%, E-value=1e-36, Identity=60%"; Hit description=BHLH transcription factor
  Pfam annotation: Domain name=HLH; Domain location=134-183; Score =51.7; E_value=2.5e-12; Accession=PF00010.16; Description=Helix-loop -helix DNA-binding domain
MEERPWPWGGHPPNGNSIGFPNGVHGSSWGAGEVVRQLGHPEILAPRLASSGALPDVANSAKNDFVHNNFQQQQLPVQMQFDFSRATSRASERSIIAESEISDIKASCKEERMSIADDRRPRKRGRKPANGREEPLNHVEAERQRREKLNQRFYALRAVVPNISKMDKASLLGDAIAYINQLQAKLKTMEFERERFGSTCVDGPVLDVNAEVEKNHHNGAPDMDVQAAQDGVIVKVSCPIDVHPVSKVIQTFKEAEIGVVESRLTVANDTVFHTFVVKSEGPDQVTKDKLIALFSKESNFIQTL

SEQ ID NO: 160715 - protein, 456 aa, Glycine max
  Coding DNA Sequence Number=SeqID_43937
  Gene Ontology: Mol. function=zinc ion binding; Cellular component =endoplasmic reticulum; Biological process=ER to Golgi vesicle -mediated transport
  Homolog annotation: Hit_ID=Q9SFU0; Match level="QueryCoverage=95%, HitCoverage=44%, E-value=4e-97, Identity=44%"; Hit description =Protein transport protein Sec24-like At3g07100
  Pfam annotation: Domain name=zf-Sec23_Sec24; Domain location=337-376; Score=65.4; E_value=1.9e-16; Accession=PF04810.5; Description =Sec23Sec24 zinc finger
  Subcellular localization annotation: CTP_CleavageSite=56; ConfidenceScore=5.30e-01
MGTENPCRPTYPSRPPFAAAAQGVTPFAPTGGAMVGLEPPSFRPTPPAPPLASTPFSSSGPAVRPWVPHFRPVPPGQFNDPSVPPPPSNFPPAGGPFQHFPGQHFSSNAQAPSPHVPPMGQPAIQPSAGQTHPFPPSLQPQPWPQSQTLLFQWGLPLLHFQLSFPGYAQKQAGADIQAPPMHSSHPSNQGNYGPIPPAASLPFQPHQGGYVSQPPMAAPLGIQPMQHPGSGPPIGDVQGLTEDFNSLSIQARPGLVESSIDANELPRPLDGDGEPKSLSEMYPMNCNSRYLRLTTSAIPISQSLCSRWPLPLGAVVCPLAEYPDGEEVPIVNFAASAVVRCRRCCTYVNPYVTFTEGGRKFRCNTCSLLNEVPSEYYAQLDATGRRIDLNQRPELTKGTVEYVAPIDYMVRPPMPPVYFFLIDVSITAFRSGMIEHELNSWSPVSQVHVIYFVRPA

SEQ ID NO: 160716 - protein, 36 aa, Glycine max
  Coding DNA Sequence Number=SeqID_43938
MTKRMGFFSRISGVYKNLKAFLDLFDKSVGLATREK

SEQ ID NO: 160717 - protein, 91 aa, Glycine max
  Coding DNA Sequence Number=SeqID_43939
MQIKWQKINEVRTGVVSSDNTNLDYKVSEGLHSELLFGFAKCFVTCESYAEDSAYIYKLAKKEKKANDIMHRPCLEIEQAQAGYFQATGMT

SEQ ID NO: 160718 - protein, 389 aa, Glycine max
  Coding DNA Sequence Number=SeqID_43940
  Gene Ontology: Mol. function=methionine adenosyltransferase activity; Cellular component=cytosol; Biological process=one-carbon compound metabolic process
  Homolog annotation: Hit_ID=P17562; Match level="QueryCoverage=99%, HitCoverage=98%, E-value=0.0, Identity=86%"; Hit description=S -adenosylmethionine synthetase 2
  Pfam annotation: Domain name=S-AdoMet_synt_C; Domain location=240 -382; Score=281.4; E_value=1.8e-81; Accession=PF02773.6; Description =S-adenosylmethionine synthetase, C-te
  Pfam annotation: Domain name=S-AdoMet_synt_M; Domain location=116 -238; Score=327.8; E_value=1.8e-95; Accession=PF02772.6; Description =S-adenosylmethionine synthetase, cent
  Pfam annotation: Domain name=S-AdoMet_synt_N; Domain location=2-101; Score=210.7; E_value=3.3e-60; Accession=PF00438.10; Description=S -adenosylmethionine synthetase, N-te
  Pfam module annotation: Pfam domain module=S-AdoMet_synt_C::S-AdoMet _synt_M::S-AdoMet_synt_N; Domain location=240-382::116-238::2-101
MDTFLFTSESVNEGHPDKLCDQISDAVLDACLEQDPESKVACETCTKTNLVMVFGEITTKANIDYEKIVRDTCRSIGFVSGDVGLDADKCKVLVYLEQQSPDIAQGVHGHLTKRPEDIGAGDQGHMFGYATDETPELMPLSHVLATKLGMQLTEVRKNEICPWLRPDGKTQVTVEYANDHGAMVPVRVHTVLISTQHDETVTNDEIAADLKEHVIKPVIPEKYLDEETIFHLNPSGRFVIGGPHGDAGLTGRKIIVDTYGGWGAHGGGAFSGKDPTKVDRSGAYIARQAAKSIVANGLARRCIVQISYAIGVPEPLSVFVDTFGTGKIPDKDILKLVKEKFDFRPGIISINLDLKRGASGRFLKTAAYGHFGRDDPDFTWEVVKPLKWE

SEQ ID NO: 160719 - protein, 199 aa, Glycine max
  Coding DNA Sequence Number=SeqID_43941
  Homolog annotation: Hit_ID=Q6CQE5; Match level="QueryCoverage=33%, HitCoverage=77%, E-value=5e-12, Identity=49%"; Hit description =Protein TAR1
MTFHEHITARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHT

SEQ ID NO: 160720 - protein, 116 aa, Glycine max
  Coding DNA Sequence Number=SeqID_43942
VLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 160721 - protein, 71 aa, Glycine max
  Coding DNA Sequence Number=SeqID_43943
MSSSLCWGHHKFVCRILGSSIFVRAGSSYFLVYCAMHNVNNFNIKEMKRLLPCVNLSKGALLGTKRIGLQA

SEQ ID NO: 160722 - protein, 61 aa, Glycine max
  Coding DNA Sequence Number=SeqID_43944
MTIRGGDRGNCFKLRRRRLCSIGTKVSELWTSCHTVTDGGAGVDDEGMSSVLALFLDSFCN

SEQ ID NO: 160723 - protein, 174 aa, Glycine max
  Coding DNA Sequence Number=SeqID_43945
  Homolog annotation: Hit_ID=O21999; Match level="QueryCoverage=37%, HitCoverage=43%, E-value=4e-23, Identity=79%"; Hit description=LacZ -alpha
VLQWLLFLSAVPPVQLLTGWCVTAKAPPDISAGKCSGRVPFAIQAAQLLGRAIGAGLFAITPAGERGMCCKAIKLGNARVFPVTTLNSIGQRRPCGAVAVSGGRINTPVALALLRSAHPRTGRVHGPASLHRGRRAAGPGRLQHPGVVRRRGFPCIGAMPHAVPGRLSQLHGAE

SEQ ID NO: 160724 - protein, 188 aa, Glycine max
  Coding DNA Sequence Number=SeqID_43946
  Gene Ontology: Mol. function=protein serine/threonine kinase activity; Cellular component=membrane; Biological process=protein amino acid phosphorylation
  Homolog annotation: Hit_ID=Q9AWQ0; Match level="QueryCoverage=95%, HitCoverage=32%, E-value=8e-78, Identity=86%"; Hit description =Receptor protein kinase PERK1-like protein
  Pfam annotation: Domain name=Pkinase; Domain location=2-188; Score= -1.9; E_value=1.9e-08; Accession=PF00069.15; Description=Protein kinase domain
  Pfam annotation: Domain name=Pkinase_Tyr; Domain location=4-188; Score=-47.3; E_value=1.4e-09; Accession=PF07714.7; Description =Protein tyrosine kinase
  Pfam module annotation: Pfam domain module=Pkinase::Pkinase_Tyr; Domain location=2-188::4-188
MSDIKTWFDFWVTALRGLTGIPLVNYITVSSLNMMLVYEYVNNGNLEQWLHGAMRHHGYLTWEARIKILLGTAKGLAYLHEAIEPKVVHRDIKSSNILIDDDFNAKVSDFGLAKLLGSGKSHVATRVMGTFGYVAPEYANTGLLNEKSDVYSFGVVLLEAITGRDPVDYGRPAQEVSKLTYMLEENPF

SEQ ID NO: 160725 - protein, 403 aa, Glycine max
  Coding DNA Sequence Number=SeqID_43947
  Gene Ontology: Mol. function=pepsin A activity; Cellular component =cellulose and pectin-containing cell wall; Biological process =proteolysis
  Homolog annotation: Hit_ID=Q8L9B9; Match level="QueryCoverage=99%, HitCoverage=83%, E-value=1e-156, Identity=68%"; Hit description =Chloroplast nucleoid DNA binding protein, putative
  Pfam annotation: Domain name=Asp; Domain location=59-400; Score= -49.8; E_value=1.1e-10; Accession=PF00026.14; Description=Eukaryotic aspartyl protease
  Subcellular localization annotation: CTP_CleavageSite=46; ConfidenceScore=5.59e-01
ALSPNKTPSQLFHLRLLRDGARVKTLNSLAAATNQTRPTNTGSGFSSSVVSGLSQGSGEYFTRLGVGTPPKYLYIVLDTGSDVVWLQCKPCTKCYSQTDQIFDPSKSKTFAGIPCSSPLCRRLDSPGCNTKNNLCQYQVSYGDGSFTVGDFSIETLTFRRAEVPRVALGCGHDNEGLFVGAAGLLGLGRGGLSFPTQTGTRFNNKFSYCLTDRTASAKPSSVVFGDSAVSRTARFTPLVKNPKLDTFYYVELLGFSVGGAPVRGISASLFRLDSTGNGGVIIDSGTSVTRLTRPGYVALRDAFRVGASHLKRASEFSLFDTCYDLSGLSEVKVPTVVLHFRGADVSLPASNYLIPVDNDGTFCFAFAGTMSGLSIVGNIQQQGFRVVFDLAGSRVGFAPRGCA

SEQ ID NO: 160726 - protein, 268 aa, Glycine max
  Coding DNA Sequence Number=SeqID_43948
  Gene Ontology: Mol. function=ribonuclease H activity; Cellular component=nucleus; Biological process=RNA-dependent DNA replication
  Homolog annotation: Hit_ID=Q1SZM6; Match level="QueryCoverage=83%, HitCoverage=73%, E-value=3e-45, Identity=40%"; Hit description =Ribonuclease H
  Pfam annotation: Domain name=RnaseH; Domain location=107-236; Score =0.7; E_value=5e-05; Accession=PF00075.14; Description=RNase H
MIPLEFLGPDSDIYPWMSIAAGSNASHQNNSKDCIQNNIKGDKGILFSITCWFIWRSRNEEIFNDKVQPVWHIANQIHTLNDIIYKDVTQSLQQPSPMLVLWIAPPGNVMKLNTDGSAFGNLGQAGFGGIIRDNLGNWHTGFMGSCGFTTSVHAELLAIYHGLKIARDIGIGRLICESDLKVALDLITGEINMFHQYFPTIMLIHSLKHMDWEVTFVHVYREGNKCADWFAKTGNSSQQGMIILDHRPSPIYQAYLGDAMGVTTQRMI

SEQ ID NO: 160727 - protein, 1308 aa, Glycine max
  Coding DNA Sequence Number=SeqID_43949
  Homolog annotation: Hit_ID=Q17Q32; Match level="QueryCoverage=38%, HitCoverage=45%, E-value=2e-09, Identity=19%"; Hit description =Enolase-phosphatase e-1
  Subcellular localization annotation: CTP_CleavageSite=94; ConfidenceScore=5.69e-01
MEILNISNPTNFSIPTFCHPKTLTSKFTSNNIKPTSPFRRTSFSLYLSRSAAIKFQTWAHSGRPSNRRNSLRKKLLRDHKVNPNQIPNDPFSVSGNGVEESGVGVQGVSVVNNVVEAEKPKSKILRESVLWNKLENWVDQYKKDVEYWGVGSGPIFTVYEDSLGAVERVVVDEDQILKRSKVRRDAVENLAEVRSKILNAKNIAREMESGNNVIARNSSVAKFVVEGKEEGGGFVKAVQGFVAKPRLLPRLSWVGRKVLYVLVVVWVVKKLFVAFGERDKEVEYTATEKEMMRRKIKAREEKEKLTKRAVEVVVESSEAPVVDIKKPKLDKEQLRNSILKVTGSADKLVVHDSSDKVKTRSTEMDYKVQEIREMARQARKIEGSNGVVGNRDMETDDPVIEISSDDSEQYDGLSNHQNEVSKETTDSNTIMQSVSVDVPESIDNSVLHEEVPTHKGNLYALDAIVPGDREIKKQEIEFSENDVHLKDSENGKPSDTPINGSSMTNESSVKKKPRIIRSVKEARDYLSKKHDKQDPGTSTECKIELAKENIADMKSSSVIDLNGQKYQNLEKNTIVSKSDTLNGILDSKPLINSSDDSDQKDKEVSPRKNEYIKGSGIEPGLEELQKDETTLDQEVSGISTETRLPVKPENWLEIKLHKVEPIIEQIRSDALDGVSDSKAATSPSEDSNQKDKEFSPTKDDYFKDSGVEPGLGNLQESDTTLDHEINGIGTETRLPVKPENWPDKSLIEVEHSRSDALNGLSDSKSATNAREDSNQKNKKFGTTKDDYLKDAGVEPGIRNHQKSGTTLDSEVNGISTETRGSGKTENWLEKNFHEVEPIVKQIRAGFRNNYMAAKERVNQTLDIPTEMESLGGVEDDGELDWMQDDHLRDIVFRVRENELSGRDPFYLMNDEDKDTFFRGLEKKVEKENKKLSDIHEWLHSNIENLDYGADGISIYDPPEKIIPRWKGPPVEKIPEFLNEFLDEKKTSSTRNMNPVKKDESGFAITSADSSLQEKVDGSTAPIKKSKNPKTIIEGSDGSIKVGKKSGKEYWQHTKKWSQGFLDCYNDETDPEVKSIMKDMGKGLDRWITEKEIEEAAELMDKLPDRNRSFMEKKLNKIKREMELFGPQAVVSKYREYADDKEEDYLWWLDLSHVLCIELYTVENGEQKVGLYSLEMASDLELEPKPYHVIAFQDPNDCKNLCYIIQAHMEMLGNGHAFVVARPPKDAFREAKANGFGVTVIKKGELQLNIDQPLEEVEEQISEIGSKMYHDMMMKERSVDINTLMKGVFGFSDRSIKRLKRKLKKPRKG

SEQ ID NO: 160728 - protein, 592 aa, Glycine max
  Coding DNA Sequence Number=SeqID_43950
  Gene Ontology: Mol. function=GTPase activity; Cellular component =microtubule; Biological process=cell division
  Homolog annotation: Hit_ID=Q9SMB6; Match level="QueryCoverage=99%, HitCoverage=92%, E-value=0.0, Identity=76%"; Hit description =Phragmoplastin
  Pfam annotation: Domain name=Dynamin_M; Domain location=206-493; Score=278.8; E_value=1.1e-80; Accession=PF01031.10; Description =Dynamin central region
  Pfam annotation: Domain name=Dynamin_N; Domain location=3-197; Score =218.6; E_value=1.4e-62; Accession=PF00350.13; Description=Dynamin family
  Pfam annotation: Domain name=GED; Domain location=498-591; Score =120.1; E_value=6.2e-33; Accession=PF02212.8; Description=Dynamin GTPase effector domain
  Pfam module annotation: Pfam domain module=Dynamin_M::Dynamin_N::GED; Domain location=206-493::3-197::498-591
MEGVESSGKSSVLESVVGKDFLPRGSGIVTWRPLVLQLHKIDEGREYAEFMHLPRKKFLDFAAVRQEIADETDRETGHNKGISSVPIHLSIYSPHVVNLTLVDLPGLTKVAVDGQPDSFVQDIENMVRAFIEKPNCIILAISPANQDLATSDAIKISREADPKAEAESKEDAENTEPRSFLFRNVSRERTFGVLTKIDLMDKGTDAAEILEGKSYKLSFPWIGVVNRSQADINKQVDMIAARKRETEYFSNTPEYRHLASRMGSVHPGKVLSKHLESVIKSWIPGLQSLINKTIIELETELKRIGKPIAADTGGKLYMIMEICQTFDQLFKDHLDGIRPGGEKIYQVFDNQFPASIKRLQFDKHLSIGKVRKLITEADGYQPHVIAPEQGYGRLIESCLVSIRGPAEAAVDAVHGILKDLILKSMSETMARIKAVSHLECRTWSAAVDSLERMREESKKSTLLLVDMEYGYLTIDFFRKLPQDAEKGGNPTHSLFDRYDDSYLRRIATTVLSYVNMVCGTLRHTIPKSVVYCQVREAKRSLQDHFFTELGKKEGKQLASLLNEDPAIMQPRTSLAKRLKLYRSAQSEIEAVA

SEQ ID NO: 160729 - protein, 590 aa, Glycine max
  Coding DNA Sequence Number=SeqID_43951
  Gene Ontology: Mol. function=phosphotransferase activity, alcohol group as acceptor; Biological process=protein modification process
  Homolog annotation: Hit_ID=Q9ZPY9; Match level="QueryCoverage=99%, HitCoverage=99%, E-value=0.0, Identity=59%"; Hit description =Expressed protein
  Pfam annotation: Domain name=PI3_PI4_kinase; Domain location=292-549; Score=289.2; E_value=7.8e-84; Accession=PF00454.17; Description =Phosphatidylinositol 3- and 4-kinase
  Pfam annotation: Domain name=ubiquitin; Domain location=119-190; Score=21.3; E_value=0.0018; Accession=PF00240.13; Description =Ubiquitin family
  Pfam annotation: Domain name=ubiquitin; Domain location=38-111; Score= 49.4; E_value=1.2e-11; Accession=PF00240.13; Description=Ubiquitin family
  Pfam module annotation: Pfam domain module=PI3_PI4_kinase::ubiquitin:: ubiquitin; Domain location=292-549::119-190::38-111
MSSAGVTTLSPVPRELLLSPDGYYTPLHLSLDQEFIFIYLSYYGSLTPMRVLPCDTIESVKLKIQKSEGLPSLTNKQKLVCDGRELARSNSLLKEYGVTEGNVLHLVIRLSDLQTISVRTSSGKDFTFQVERCRDVGYVKQQIAKKEKRFADPEQQEVVCNGELLEDQTLIDGICSKYNDAVIHLFVRVKYAEVRTGQDELSVVAKELKDTKDYDVSETNCRKKYDVSKEDTGREYGVVEPIVPRKAIDRDLLLEPVIVNKKIELASEVWNMINSTYEGLDSGNYPIRSAEGTGGAYFMLDSTGQKYISVFKPIDEEPMAVNNPRGLPFSEDGEGLKKGTTVGQGAFREVAAYILDHPMSGRRSLFGDEKGFAGVPPTVMVKCLHKGFNHPGDLTAKIGSLQMFMENNGSCEDIGPGAFPVKEVHKISVLDMRLANADRHAGNILIGKEKENDQAVLIPIDHGYCLPTSFEDCTFEWLYWPQARQPYSPEIIDYIKSLDADEDIALLKFHGWNLPVECARTLQISTMLLKKGVERGMTPFAIGSLMCRESLNKESVIEGIVKAALDSVLPGTSEATFLDAVSEIMDQHLD

SEQ ID NO: 160730 - protein, 610 aa, Glycine max
  Coding DNA Sequence Number=SeqID_43952
  Gene Ontology: Mol. function=RNA-directed DNA polymerase activity; Cellular component=chromatin; Biological process=chromatin assembly or disassembly
MAEKDIPKIVFRTHQGYYEYRVMPFGLCNMPSTFQVAMNALLSPFLWKFTTIFFYDILVYNATLPDHLHHLECVFSSLSQAQYFLKRSKCLFEQRQLDYLGHIVSGKGVQPDLSKIQAIIDWPTLRSSKDLRAFLDLTGFYRKFVKGYAAIATPLTKLLSTLWALSYINEHASAYVCELQAIVVAVRKWRQYLLGHRFITFTNHRSLHELMSQTIKTPKQQFYLAKLLGFDYDIQYKARTSNVVADSLSRIDSSTQGQYFVLSIPHHEFMIQLRETLSASSEFQKQCEAIQAKPEDHHDFFILGDFILFKGAIWIDTQNPFILVLLHEYHAAPIGGHFGVKRRYIASVPTSNGPACSRTSRHSSVTAVHVNKLNISRAKVLDCSNLFRYPPASGKTSPWISSHTFRVPTGSQLFSWSLIGSPREFTLVPYLLTLRRSSTGFTPYKVTYDKPPPSVPDYLKGSSPNDAVDTMLLTREAIHATLKRKLLKTHHQISLLSAISGHFASWNALVVLRIDYKSLTSPRYTPSFIVPCYALTMESTWEKWEDICKSHHLEDKVIFPGRDNDSTNSRENREDILLVPEEARAIVVAMQSQKVQNLDVAVEITVVDYL

SEQ ID NO: 160731 - protein, 58 aa, Glycine max
  Coding DNA Sequence Number=SeqID_43953
LFGMASMFDMPFRGLKSEEKELRFLHFSGKCDELAKRACCAKQVHQYSLNIRVLGRTR

SEQ ID NO: 160732 - protein, 1202 aa, Glycine max
  Coding DNA Sequence Number=SeqID_43954
  Gene Ontology: Mol. function=binding
  Homolog annotation: Hit_ID=Q7EY18; Match level="QueryCoverage=98%, HitCoverage=63%, E-value=0.0, Identity=51%"; Hit description =Putative tetratricopeptide repeat(TPR)-containing protein
  Pfam annotation: Domain name=TPR_1; Domain location=271-304; Score =17.6; E_value=0.043; Accession=PF00515.18; Description =Tetratricopeptide repeat
  Pfam annotation: Domain name=TPR_1; Domain location=313-346; Score =3.1; E_value=2.3; Accession=PF00515.18; Description=Tetratricopeptide repeat
  Pfam annotation: Domain name=TPR_1; Domain location=355-388; Score =8.4; E_value=0.53; Accession=PF00515.18; Description=Tetratricopeptid e repeat
  Pfam annotation: Domain name=TPR_2; Domain location=271-304; Score =23.8; E_value=0.00062; Accession=PF07719.7; Description =Tetratricopeptide repeat
  Pfam annotation: Domain name=TPR_2; Domain location=313-346; Score =8.4; E_value=3.4; Accession=PF07719.7; Description=Tetratricopeptide repeat
  Pfam annotation: Domain name=TPR_2; Domain location=355-388; Score =15.5; E_value=0.2; Accession=PF07719.7; Description=Tetratricopeptide repeat
  Pfam module annotation: Pfam domain module=TPR_1::TPR_1::TPR_1::TPR _2::TPR_2::TPR_2; Domain location=271-304::313-346::355-388::271 -304::313-346::355-388
AENELVLKGMLSDEAFTRLKESGTGLHCKSMHDLIELSRKYYTDVALPKLVADFGSLELSPVDGRTLTDFMHTRGLRMHSLGHVVKLSEKLSHVQSLCIHEMIVRAFKHILRAVISAVDKEKMASSIAGALNLLLGVPENRESDKSREVHPLVWKWLELFLKKRFDWDLNKLNYKDVKKFAILRGLCHKVGIELVPRDFDMDSPIPFQKSDIVSLVPVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRAKLGSDDLRTQDAAAWLEYFESKAFEQQEAARNGTRKPDASIASKGHLSVSDLLDYINPNTKGRDAAAKRRSQITKVRATSYQNTGMSSSDESSKEIPKEASDEEVQISEPVGSADSEQESNSGPDLEQAILKQISDEKLQIYDEIFSEAHAEGEDGWQSVQRPRSAGSYGRRLKQRRAALGKVYSYHKNVEVGTESPFVRSPNPNSRYYFLKKRTISHGSYTDDHTTNITQGNKFGRKVVKAVTYRVKSMPSTSKPCANETLENGDKLLSSLPEPDPIDANPVKNSKVSLGKSPSYKEVALAPPGTISKFQVYNPQSEISVSSEHDSGKHEEEVEANRNVDVDPTLIEVNDTVKEKNNDSLSDSVDDSLDDTGVAIEGKEETELIVAVQDNCMSAEGQSGDVKAQGAVDSSILIHAVDDHVDSYKQELDTSNSSGSLEPSANTNPISQGGEDLRVNVSPSSQIRTGGIPYKKLSASAAPFNPSPAIARAAPIAMNMTLPSGPRAVPAIGPWPVNMNVHPGPTTVLPAVAPMCSSPHHAYPSPPTTPNMMQPLPFMYPPFTQPQSVSPSNFPVTNSAFHANHFTYLNPTISKFGPSAVWPGCHPVEFPLPVPIVEPIPDPISESQALCHGLESPSSASVLPEDIDNIGDSNQVVKTLSSEISEDEAVRSGSESIKENGNMNFHGSENAGNKQHQNIASNGNSSSSGTNMDGEKTFSILFRGRRNRKQTLRMPISLLTRPNGSQSFKVIYNRVVRGSHAPKSMNLSSSKDCTATS

SEQ ID NO: 160733 - protein, 226 aa, Glycine max
  Coding DNA Sequence Number=SeqID_43955
  Pfam annotation: Domain name=DUF1442; Domain location=1-218; Score =17.3; E_value=9.4e-09; Accession=PF07279.2; Description=Protein of unknown function (DUF1442)
MKCNNHKRQYGTWRIQNPGSNEFLSALAAGMKAKLIVEVTSCVSLTTLALAAAARPTGGRVVCILPESILNDSQQVINNSGLKDQVEFRTEDPSKLLPFYENIDFFLVDCKDNENYARLLNLVDVNLTRSIVVAKNMVGGDGDKKGIRWCLRGKDEKLEVRSLKHPLGNGMEVTRISKSDNTNNMRFGVKGDYSKKRRKSSWIAKFDEESGEEHIYRVPQVDWFWS

SEQ ID NO: 160734 - protein, 80 aa, Glycine max
  Coding DNA Sequence Number=SeqID_43956
MENQSLCRPTRRLLGRRPTKNTNCGREKTAGKNNNEEEGARKGGRRLLGAQKKKERGRRNGIFGSSLNCWVHLATPKSGY

SEQ ID NO: 160735 - protein, 80 aa, Glycine max
  Coding DNA Sequence Number=SeqID_43957
  Subcellular localization annotation: CTP_CleavageSite=63; ConfidenceScore=5.53e-01
MKDGRNTSSGDVSSPSRTSQTHLKLSGRLPLQSLVSADLHTTKSLKLYRTWTFLSVELSRHVEASRKGQTRFQNLISGLN

SEQ ID NO: 160736 - protein, 38 aa, Glycine max
  Coding DNA Sequence Number=SeqID_43958
MHPAEEVWQVIPRAENALCGRRCSSASVKGRKWSQRKK

SEQ ID NO: 160737 - protein, 611 aa, Glycine max
  Coding DNA Sequence Number=SeqID_43959
  Homolog annotation: Hit_ID=Q10B16; Match level="QueryCoverage=12%, HitCoverage=13%, E-value=2e-26, Identity=69%"; Hit description =Expressed protein
  Pfam annotation: Domain name=Extensin_2; Domain location=258-580; Score=-141.6; E_value=0.091; Accession=PF04554.4; Description =Extensin-like region
  Pfam annotation: Domain name=X8; Domain location=408-492; Score =169.6; E_value=8e-48; Accession=PF07983.3; Description=X8 domain
  Pfam module annotation: Pfam domain module=Extensin_2::X8; Domain location=258-580::408-492
  Subcellular localization annotation: CTP_CleavageSite=46; ConfidenceScore=5.50e-01
MAKEASLCLLFLFSFLSTSCSGSLVGFSYRERGDTSTSARTISFLQQSNVSPTQIRIFVTDHRILSTLSNSKVLTDVYLNKSQVENFIISKPSELKAHLLNILSHSNIKSIIASCGSECLAQNEMPLFLHALKSIGSVLRELHLGREVKISVAYPLSFLEKLNASHENSIRRILSFIKETKSFVMVEDSIGGELSMGDHFVHAIIKRATLAASILPCKDVPIVLTIKSTVILPSMELAQFSEKISKYLESETHIRKRIAALYIEVHSAKDFASKKLKRRSLDDTTNPTNTVFPTNPASSTPIITPPDTPTIITVPATNPVTISPSNPAAMPVTVPSTTPVPNPITPTNPANSPVPVSNPATTPIATPPPVTNPVTSYPPPSGNVPPVVNPQPQPPPANTNAPAIQGQSWCVAKQGAPEASLQSALDYACGMGGADCSQIQQGGNCYSPVTLQNHASVAFNSYYQKNPAPTSCDFGGTATLVNTNPSTGSCIFPSSSSSSSTTTMPKSSPPTPPTQSSPIALPPPSPLTPEPSIPTAPPTSSSSGTGPFGYGAPPSELNSSNPASGIMPGFASDSPPVVNTTSVSRSVGLRPFVGFTILMVSFGTTRLSMHP

SEQ ID NO: 160738 - protein, 113 aa, Glycine max
  Coding DNA Sequence Number=SeqID_43960
  Subcellular localization annotation: CTP_CleavageSite=49; ConfidenceScore=5.09e-01
MDGGGIKEDLLGTPNSIAGAPSKFPKWQKCPSAFCELSSVDTRGRNVPRASAKEPSSAVDGRRFFRGCPWNISSASVNGRRTAEEPSSVELRGRTSSARVNGRRFFRELPRKK

SEQ ID NO: 160739 - protein, 1411 aa, Glycine max
  Coding DNA Sequence Number=SeqID_43961
  Gene Ontology: Mol. function=ATPase activity, coupled to transmembrane movement of substances; Cellular component=integral to membrane; Biological process=transport
  Homolog annotation: Hit_ID=Q7FMW1; Match level="QueryCoverage=94%, HitCoverage=95%, E-value=0.0, Identity=56%"; Hit description=MRP -like ABC transporter
  Pfam annotation: Domain name=ABC_membrane; Domain location=228-497; Score=70.4; E_value=5.7e-18; Accession=PF00664.13; Description=ABC transporter transmembrane region
  Pfam annotation: Domain name=ABC_membrane; Domain location=843-1113; Score=68.9; E_value=1.6e-17; Accession=PF00664.13; Description=ABC transporter transmembrane region
  Pfam annotation: Domain name=ABC_tran; Domain location=1185-1368; Score=160.0; E_value=5.9e-45; Accession=PF00005.17; Description=ABC transporter
  Pfam annotation: Domain name=ABC_tran; Domain location=574-746; Score= 136.7; E_value=6.2e-38; Accession=PF00005.17; Description=ABC transporter
  Pfam annotation: Domain name=Dynamin_N; Domain location=577-730; Score=-45.8; E_value=0.088; Accession=PF00350.13; Description =Dynamin family
  Pfam annotation: Domain name=MMR_HSR1; Domain location=1186-1272; Score=-17.3; E_value=0.039; Accession=PF01926.13; Description=GTPase of unknown function
  Pfam module annotation: Pfam domain module=ABC_membrane::ABC _membrane::ABC_tran::ABC_tran::Dynamin_N::MMR_HSR1; Domain location =228-497::843-1113::1185-1368::574-746::577-730::1186-1272
  Subcellular localization annotation: CTP_CleavageSite=59; ConfidenceScore=5.33e-01
MVFAVSTVLSCAVISVMNMALAFYQYSSRKIIGFNSVSLALTWVLATIVSFYSMRTKVRENKRFGFPLVLILWWVFACSIDAILLSLKLVKGFESIDLWFFLSEDNVVDSVSLPLLVLLCFNVCARENSDVEQEQQLLLEKEEESSMEEEDEEAFTNASMWSKLAFRWLNPIFKAGRIKKLELGHIPPVPPSETAENASSVLEESLRKQKLEGGSLTKAIAYSLWKSLALNAVLAGVNTGASYIGPLLITNFVNFLLGDDGDSSIQYGLLLAFIFFLAKTVESLSQRQWYFGAQRIGIRVRAALISLIYGKSLLMKCAGPTQGRIINLINVDVERIGDFCWYIHGVWLLPVQIILALVILYINLGGTPSFAAFGVTILVMVCNTPLANKQEGLHSKIMEAKDSRIKVTSETMKNIRILKLHSWETSFLQKLLQLREIERGWLQKYLYTCSAVATLFWTSPTLVSVVTFGACILVKTELTTATVLSALATFRILQEPIYNLPELISMIIQTKVSVDRIHEFIKEDDQNQFINKLTSKISEVAIEIKPGEYAWETNDQTHTKPAIQITGKLVIKKGQKVAVCGSVGSGKSSLLCCLLGEIPLVSGAVTKVYGTRSYVPQSPWIQSGTVRENILFGKQMKKEFYEDVLDGCALHQDINMWGDGDLNLVEERGINLSGGQKQRIQLARAVYNDSDIYFLDDPFSAVDAHTGTHLFKKCLMKLLYDKTVVYATHQLEFLEAADLILVMKDGKIVESGSYKELIACPNSELVQQMAAHEETVHEINPCQEDDSVSCRPCQKNQMEVAEENIQEIMEDWGRSKEEEAETGRVKWSVYSTFVTSAYKGALVPVILLCQILFQVMQMGSNYWISWATEQKGRVNNKQLMRTFVLLSLTGTIFILGRTVLMAAVAVETAQRLFLGMITSVFRAPVSFFVTTPSSRIMSRSSTDQSIVDTDIPYRLAGLVFALIQLLSIIVLMSQVAWQVILLFFAVLPISIWYQAYYITTARELARMVGIRKAPILHHFSESIAGAATIRCFNQEKLFFTKVKALIDDYSRVAFHNFGTMEWLSVRINFLFNLVFYFVLVILVTLPRSTIDPSLAGLVATYGLNLNVLQAWVIWNLCNVENKMISVERILQFSSIPSEAPLIIQDCRPEPEWPKEGKVELRNLHIRYDPAAPMVLKCVTCVFPAQKKIGVVGRTGSGKSTLVQALFRVVEPLEGSILIDGVDISKIGLQDLRSKLGIIPQDPTLFLGTVRTNLDPLEQHEDQELWEVLSKCHLAEIVRRDQRLLDAPVAENGENWSVGQRQLVCLARLLLKKRRILVLDEATASIDTATDNLIQKTIREETSGCTVITVAHRIPTVIDNDRVLVLDEGTIVEYDEPAQLLQNNSSSFSKGDITWVGWLTKETKGCGFDPPS

SEQ ID NO: 160740 - protein, 380 aa, Glycine max
  Coding DNA Sequence Number=SeqID_43962
  Gene Ontology: Mol. function=nucleic acid binding; Cellular component= cytoplasm; Biological process=intracellular protein transport
  Homolog annotation: Hit_ID=Q9ZRC5; Match level="QueryCoverage=83%, HitCoverage=92%, E-value=4e-95, Identity=59%"; Hit description=Plant IF-like protein
  Pfam annotation: Domain name=Tropomyosin; Domain location=144-334; Score=-109.6; E_value=0.022; Accession=PF00261.10; Description =Tropomyosin
MSEKPSSSLTSTVAAREVDPLLQDLNEKKQSFRRNVVSLAVELKELRSRLASQEQSYAKETQTRQARDFLEAETNAKNMELQIGRLQKNLEERNEQLQASASSAEKYLKELDDLRTQLVTTRATADASAASAQSAQLQCLELVKELNEKNGSLREHEDRVLRLGEQLDNLQKDLQARESSQKQLKDEVLRIEHDIMEALAKAGENKNCELRKILDEVSPKNFEKMNKILGVKDDEIAKLKDEIKIMSAHWKLKTKELESQLEKQRRADQELKKKVLKLEFCLQEARSQTRKLQRMGERRDKAIKELRDQLAAKQQREVAAADKLNQNFWDTSGFKMVVSMSMLILVVLPCWQMSYVYSGLDIIKVAHMRRIKVNAFGGFA

SEQ ID NO: 160741 - protein, 86 aa, Glycine max
  Coding DNA Sequence Number=SeqID_43963
  Gene Ontology: Mol. function=ribonuclease H activity
MHTDGSARGCSGHRGAGGIFCDHSRGVLGCFSSYVGTQFMLYAEVVAVILALDIVKEKAWSHAWLECESTLIIQHFKNPSHIPWSI

SEQ ID NO: 160742 - protein, 155 aa, Glycine max
  Coding DNA Sequence Number=SeqID_43964
MAQALVSDTYNKPSTTLLGARELKFYPNGDNTFWLDPRALIGGAGGPSNAGDGAGTVCFLLFFDLGAGAGTSALGAITGVGVVGANIRGELTGTGAGVTAGDVATGGVVTGAGAATLDEGDATVGDKTGGVIVAALGDEAGEDEVGEAIGQLILV

SEQ ID NO: 160743 - protein, 116 aa, Glycine max
  Coding DNA Sequence Number=SeqID_43965
  Gene Ontology: Mol. function=RNA-directed DNA polymerase activity; Cellular component=chromatin; Biological process=RNA-dependent DNA replication
MAPEDMEKTTLVTLWGTFYYKVMFFGLKNVGATYQRAMVSLFNDMMHKEIEVYVDDMIAKSRTEEEHLVNLQKLFERLHKVKSGKLLGFIVSQKGIQVDPYKVKAILEMPEPRTEK

SEQ ID NO: 160744 - protein, 56 aa, Glycine max
  Coding DNA Sequence Number=SeqID_43966
MSMQDIIKMKEVLLRTILSTITFLEHKNTIGAKMDKPPKSDGEDIEQGKDTENILL

SEQ ID NO: 160745 - protein, 39 aa, Glycine max
  Coding DNA Sequence Number=SeqID_43967
MALKFIYLAWQILHAKACQTLTKGLASHSHKGPYTRKGA

SEQ ID NO: 160746 - protein, 123 aa, Glycine max
  Coding DNA Sequence Number=SeqID_43968
  Gene Ontology: Mol. function=peroxidase activity
  Homolog annotation: Hit_ID=Q2HT09; Match level="QueryCoverage=75%, HitCoverage=56%, E-value=1e-25, Identity=61%"; Hit description=Acid phosphatase/vanadium-dependent haloperoxidase related
  Pfam annotation: Domain name=DUF212; Domain location=6-114; Score =36.5; E_value=1.3e-08; Accession=PF02681.5; Description=Divergent PAP2 family
  Subcellular localization annotation: CTP_CleavageSite=99; ConfidenceScore=5.05e-01
MHSKTSSISSNYPIISAIVAFAIAQSIKFFTTWLICKFKERRWNLKQLVGSGGMPSSHSATVTALAAAIGLQEGFGGPLFATALVMYDATGLRLQAGPQAEVIVGGILGLLTPIGLLRPVTKN

SEQ ID NO: 160747 - protein, 219 aa, Glycine max
  Coding DNA Sequence Number=SeqID_43969
  Gene Ontology: Cellular component=plastid; Biological process =peroxisome organization and biogenesis
  Homolog annotation: Hit_ID=Q9LRB5; Match level="QueryCoverage=96%, HitCoverage=70%, E-value=3e-50, Identity=73%"; Hit description=Amino acid transporter-like protein 2
  Pfam annotation: Domain name=Aa_trans; Domain location=26-219; Score=- 69.7; E_value=5.7e-05; Accession=PF01490.8; Description=Transmembrane amino acid transporter protein
MVATETEIANADRKAINDWLPVTASRNAKWWYSAFHNITAMVGAGVLTLPYAMSMMGWYGPGTVILLLSWVITLFTLWQMVEMHEMIPACYSTIAWVASIGKGKLPDVDYSYKAHSTADGVFNFMLAMGEVAFSYAGHNVVLEIQATIPSTPEKPSKKAMWKGVIVAYLGVAFCYLPVAFIGYYIFGNSVDDNILITLDTPAWLIAAANMFVVVHVIGG

SEQ ID NO: 160748 - protein, 227 aa, Glycine max
  Coding DNA Sequence Number=SeqID_43970
  Homolog annotation: Hit_ID=UPI000019713A; Match level="QueryCoverage =33%, HitCoverage=7%, E-value=2e-24, Identity=68%"; Hit description =nucleic acid binding / zinc ion binding
MTAQGCYSRIGVARITESMIIKKQRNLSQSGACEKKKRWIQTGGDMVEGDAGAGEGMLDDGSDASGVAVGGDGNGAAVVRANEGGAYVLRDGVGIASFRHVTVLYVPPHRRLRRRVLRLCLRRRRSASSAHLIYNLIKSKRFLTYRYGYYNSNRVCGCLGLIKKERKGTVCDLTCLPLGFGIWNEGRDWKNGNRLDFLCSGLAPDGKALFNGHVLWEATQVVDLLDK

SEQ ID NO: 160749 - protein, 228 aa, Glycine max
  Coding DNA Sequence Number=SeqID_43971
  Gene Ontology: Mol. function=ATP-dependent helicase activity; Biological process=DNA recombination
  Homolog annotation: Hit_ID=Q8W028; Match level="QueryCoverage=98%, HitCoverage=25%, E-value=7e-49, Identity=44%"; Hit description =Helicase
MSPPPLLAQKVSAIAVILKRSENKHGQYIFDIPTVANDMGVTAVELTNQLYDLKLMGEITYEMKDLAYCYRIIEVPTDLLSLSADNTRWLSEVENCKVRKMDAMFNAAYFALNLCDNMQGCGGANHTPCLQRKILDYFSGVDNADFCKKIGQSSPFLRADLKVFLQSNSHARFTPRAVARVLYHSLEQSAKPEHLIMDCRGRYTHIDFKEVMEAAKEELKNFVGKDTL

SEQ ID NO: 160750 - protein, 1166 aa, Glycine max
  Coding DNA Sequence Number=SeqID_43972
MGYPFGRYWQRHNWDLLLANVLGFQVEGQGVMKPEEKVYGEGKVLKVFVFGLYGELEVTLLVGHCIGLDSGLPLREKDDDLALFSEMQSREEESFLLQPSDDLEDSFSSKLRDFPDIKLGISIPGRGETSELLNTDGNKNDYDWLLTPPDTPLFPSLDDEPPEINVVSRGRPRSKPISISRSSTTERSYKSSRVSASPSRLSSSPHSGNNTLQSRGRSSSTPNSSPTQVLRHATPTRRPSPPPTKPTTPAPSPSTPTPRRIRTGSSSPAFSSGIRRTSPVKTSHGNSASPKIRTWQTNIPGFSSEAPLNLRTSLADQPASYVRDQFSSCSKGSIVSSSDDDLDSLQSIPVGSLDRFGSRRDGSFSNSKSHSISKKSARMVSPSSAPKRSFDSAIRQMDRKSPQNMFRPLLSSVPSTTLYVGKANSVQRSLVSRNSSVTTSSNVSSDHGTSFAPDTEGSDHNQDDVARATEKILYTDICEVCSSDKIDGLNTSIGHEINDESADILHTKTRGPVIALDPIECEASFNHGIDKEFNESLETFHVIGDISETGGFENTICSNCGCPLEATDQTEKNLRLCPECSRKTTLLRHVIPEANLQFSSDNSVNSTNIPAEEKPSAETDQLTLLSELRQETDVGNTRFPLGEPDAVESQTFPSEFIQDRSQQNSLSSSLMERSRQMPANQLEVDQSGVDYKKPDNHSGDQQFYLSNDHSNLKVDLLEGTGISLLLKRSSSSKEHVIQGRTFTAMTLSYNDLSFARRSINSIRSSTGRSSYSTSSSADFSSARHSDFHVQRQSSGRKLDVDYGYDVRIRPPSPGSSFSGMLNYSYHGLGFATQQTSSGNTECSILKEIPQDLLEMQASENAVTDAIDSSSMGSIVLREDNLGYHDWCRTTDAWSSELVSQATGVQHGNNSVSSFPNHGSSISNDSISVSSVLNTETSVKDPESSFDEKLDMENSNVDGLNALVTINTSTIEESEIKVENCCQKDTGVVDVDPSLVSKSPIDDFQEHYVPNSSSDYLAASVSELHASKYSLGIDKGNTRSLTLEEATNTILFCSTIILDLAYQAATIAMEKEHSEQLEGSEPTVTILAKPNSNTKDSRSRTAGKRAMKPQKAARSKMVETDVKSPSKIENDENIDESSTRNVGLPNKVDNMKPLPDKLEAKCNCIIM

SEQ ID NO: 160751 - protein, 112 aa, Glycine max
  Coding DNA Sequence Number=SeqID_43973
  Gene Ontology: Mol. function=protein serine/threonine kinase activity; Cellular component=plasmodesma; Biological process=protein amino acid phosphorylation
  Homolog annotation: Hit_ID=Q8LPJ1; Match level="QueryCoverage=93%, HitCoverage=23%, E-value=5e-29, Identity=58%"; Hit description =Protein kinase ADK1-like protein
MLRFEDKLDYSYLKRLFRNLFIREGYQFDYIFYWTIWKYPQIGGSSSKGRWKAMHARPSVRKPEKVSVGKEIREKFSGAVEAFSRRNPTSPSPRGDHSKHRSFEEVAVHKDV

SEQ ID NO: 160752 - protein, 165 aa, Glycine max
  Coding DNA Sequence Number=SeqID_43974
VVLPETFRKRGFFRKGLPELWKFFRKCASSGILPDEPLLPESSRKTFFESLPEEVFFRKTFGYFRKNTSSGNFPEKVLPELPEEPLTGSTAESILDSKSNGELGRLTSKAVRGEDGEEEEAWLVVSGRRRKLGSRCPEEDESLEDQQEWKKKRSSSGLPRRGARF

SEQ ID NO: 160753 - protein, 834 aa, Glycine max
  Coding DNA Sequence Number=SeqID_43975
  Gene Ontology: Mol. function=hydrolase activity; Cellular component =cytosol; Biological process=nitrogen compound metabolic process
  Homolog annotation: Hit_ID=Q7XAC5; Match level="QueryCoverage=99%, HitCoverage=100%, E-value=0.0, Identity=88%"; Hit description=Embryo- specific urease
  Pfam annotation: Domain name=Amidohydro_1; Domain location=397-706; Score=283.9; E_value=3e-82; Accession=PF01979.10; Description =Amidohydrolase family
  Pfam annotation: Domain name=Urease_alpha; Domain location=271-391; Score=293.5; E_value=3.9e-85; Accession=PF00449.10; Description =Urease alpha-subunit, N-terminal domain
  Pfam annotation: Domain name=Urease_beta; Domain location=133-234; Score=234.7; E_value=2e-67; Accession=PF00699.10; Description=Urease beta subunit
  Pfam annotation: Domain name=Urease_gamma; Domain location=1-100; Score=265.2; E_value=1.3e-76; Accession=PF00547.9; Description =Urease, gamma subunit
  Pfam module annotation: Pfam domain module=Amidohydro_1::Urease _alpha::Urease_beta::Urease_gamma; Domain location=397-706::271 -391::133-234::1-100
MKLSPREVEKLGLHNAGYLAQKRLARGLRLNYTEAVALIATQIMEFARDGEKTVAQLMCIGKHLLGRRQVLPEVQHLLNAVQVEATFPDGTKLVTVHDPISCEHGDLGQALFGSFLPVPSLDKFAENKEDNRIPGEIIYGDGSLVLNPGKNAVILKVVSNGDRPIQVGSHYHFIEVNPYLTFDRRKAYGMRLNIAAGTAVRFEPGDSKSVKLVRIGGNKVIRGGNGIADGQVNETNLREAMEAVCKRGFGHKEEEDASEGITGDPDSPFTTIIPREEYANKYGPTTGDKIRLGDTDLFAKIEKDFALYGDECVFGGGKVLRDGMGQSCGDPPAISLDTVITNAVIIDYSGIIKADIGIKDGLIVSIGKAGNPDIMDDVFFNMIIGANTEVIAGEGLIVTAGAIDCHVHYICPQLVDEAISSGITTLVGGGTGPTAGTRATTCTPAPSQMKLMLQSTDDLPLNFGFTGKGSSSKPDELHDIIKAGAMGLKLHEDWGSTPAAIDSCLTINIHTDTLNEAGFVEHSIAAFKGRTIHTYHSEGAGGGHAPDIIKVCGMKNVLPSSTNPTRPLTLNTIDEHLDMLTFCGMQMVCHHLNREIPEDLAFACSRIREGTIAAEDILHDIGAISIISSDSQAMGRVGEVISRTWQTANKMKVQRGPLQPGESDNDNFRIKRYIAKYTINPAIANGFSQYVGSVEVGKLADLVMWKPSFFGAKPEMVIKGGVVAWADMGDPNASIPTPEPVKMRPMFGTLGKAGGALSIAFAAVDQRVHALYGLNKRVEAVGNVRKLTKLDMKLNDSLPQITVDPDNYTVTADGEVLTSFATTFVPLSRNYFLF

SEQ ID NO: 160754 - protein, 124 aa, Glycine max
  Coding DNA Sequence Number=SeqID_43976
  Homolog annotation: Hit_ID=Q942M1; Match level="QueryCoverage=62%, HitCoverage=14%, E-value=6e-07, Identity=39%"; Hit description=STAM binding protein(Associated molecule with the SH3 domain of STAM)- like
MSGYFWVLAILGDKSVSLPPPNKESLTKHAFLRPNGLWGQWLGPSAEIKVQYRRPGPAKSSHDSGLDATTYQHLHIPVKMMEDFRRLALENTRKNSETCGVLAGSLERDVVICVLPSSRKSLGW

SEQ ID NO: 160755 - protein, 521 aa, Glycine max
  Coding DNA Sequence Number=SeqID_43977
  Gene Ontology: Mol. function=extracellular ligand-gated ion channel activity; Cellular component=membrane; Biological process=transport
MTNLQIQTEEPPLSQTPLLISIQQQLENENEGNHHHNNNYNENKKDQDVQVDGEIVEESLVRLERFLTLLGFNQDSPLSLVVSWSVFAAVGVVTPLVALSMCECPECDRYEIQSFEMAIVAFQASLAAVSLLCLSHNLRKYGLRRFLFVDRYSGKLHCFHRDYVAQISGSMRMLFLWVLPCFILKTVREIIRIFYVQHGSWWLSLAILSALIISWTYMSTISLSACILFHLVCSLQVIHFDDYGKLLQRESDVLVFMEEHIRLRYHLSKISHRFRIYLLLEFLVVTASQVVTLLQVTGYGQMLTFINGGDFAVSTLVQVVGIIICLHAATRISHRAQNIVSLASRWHAMLTCTSSDAPSQLRSSASAGSLEAANHLNAIQVDYSESDLESMDYAGMFTNTQWTSNVSSHHKRQAFVMYLQTNPGGITIFGWTVDRSLVFLVTTINLIESPPHAEPECRMHTVAMQRSRETVCIVHPGTGPGTLLLNARPLPQSPATQMSPKFYSSFSFLSQHTYLRGSCDF

SEQ ID NO: 160756 - protein, 476 aa, Glycine max
  Coding DNA Sequence Number=SeqID_43978
  Gene Ontology: Mol. function=nucleoside-triphosphatase activity; Cellular component=membrane; Biological process=mRNA processing
  Homolog annotation: Hit_ID=Q9C7G2; Match level="QueryCoverage=99%, HitCoverage=71%, E-value=0.0, Identity=66%"; Hit description=ATP -dependent RNA helicase, putative
  Pfam annotation: Domain name=DUF1605; Domain location=303-418; Score =88.5; E_value=2.1e-23; Accession=PF07717.6; Description=Domain of unknown function (DUF1605)
  Pfam annotation: Domain name=HA2; Domain location=176-269; Score =91.0; E_value=3.6e-24; Accession=PF04408.13; Description=Helicase associated domain (HA2)
  Pfam annotation: Domain name=Helicase_C; Domain location=22-113; Score=32.9; E_value=1.2e-06; Accession=PF00271.21; Description =Helicase conserved C-terminal domain
  Pfam module annotation: Pfam domain module=DUF1605::HA2::Helicase_C; Domain location=303-418::176-269::22-113
MAMVKIVAYIHIREPEGDILIFMTGQDDIEKLVSKLEDKVRVFSPPPPNCRRIIVATNIAETSLTVDGVVYVIDSGYVKQRQYNPSSGMYSLDVVQISKVQANQRAGRAGRTRPGKCYRLYPSRIYNDEFLDVTVPEIQRSSLAGSVLYLKSLDLPDIDILKFDFLDPPSSESLQDALKQLFLIDAIDENGAITSIGQKMAELPLEPSLAKTLMEANNYGCLYEALTVAAMLSAETTLLPGQRKTEKKRKHTISNLPDGSGLGDHIQLLQIYECWDQTDFDIGWCKDNGLQVRGMLFVRDVRKQLSQIMQKISKGPLDVRANGKREEFRQDYRNLRKALCMGYANQLAERKMHHNGYRTLGFQAQVVQVHPSSVLSLDDLGKFPDYVVYHELIATPRPYMRNVCAVEMRWVIPIINKLKSLDVYKLSGGVHHVEEEPEKKLPDFPKKDVEVASTADDRESRIQAARERFLARKGKK

SEQ ID NO: 160757 - protein, 150 aa, Glycine max
  Coding DNA Sequence Number=SeqID_43979
  Homolog annotation: Hit_ID=Q42051; Match level="QueryCoverage=37%, HitCoverage=47%, E-value=2e-14, Identity=64%"; Hit description=DNA -binding protein
MWEGGAHPSAGGLGGTEVGCGGGEGGVRDCTRRKLEVEGEGGVALERETCGFTGLVDLHHGVGMGVEEDEENGDHGNEKEEEGNLKLKEKEEGTCPVLLIYSTLSVVLKALSFSFTCALARFSSAILLVEASLFANLSCAKAFILSAFTL

SEQ ID NO: 160758 - protein, 746 aa, Glycine max
  Coding DNA Sequence Number=SeqID_43980
  Gene Ontology: Mol. function=protein serine/threonine kinase activity; Biological process=protein amino acid phosphorylation
  Homolog annotation: Hit_ID=Q6K5F8; Match level="QueryCoverage=99%, HitCoverage=100%, E-value=0.0, Identity=50%"; Hit description =Putative PITSLRE alpha 2-1
  Pfam annotation: Domain name=Pkinase; Domain location=400-691; Score =345.8; E_value=7e-101; Accession=PF00069.15; Description=Protein kinase domain
  Pfam annotation: Domain name=Pkinase_Tyr; Domain location=400-691; Score=49.0; E_value=1.8e-15; Accession=PF07714.7; Description =Protein tyrosine kinase
  Pfam module annotation: Pfam domain module=Pkinase::Pkinase_Tyr; Domain location=400-691::400-691
MAAGRHGGYRENEFRERESKLEVSRRGGFANSKEDYDRVSNGGGDVVRGGSRDRVRVRQKDIKEREDVNGGGYRSSSSRSDSGSSGLGPRQCGFSVKSVDREPGELSSESGSDDATESEPGAKDTEVAMLEETRTQSPPAPERKRKFSPIVWDQDDKEVNESSRVRGSTSAVKGALPPPPPLPKVFCQLQSPNVPNGGVEIHLVKNRETEELQLNAASKVTLPSPSGLHSLPPKGRWDNDQEAEHPEGEDYIPTRNISSSRWAAGDNSPVDEGEILNDEEMPKRRRRVSPELLDGRLRNKLLSPEESKVEGIERARARSSESEERGVRGRTSSGDDFPGIESEKDDYMEIDAQGGESETSVSHSDTDSEDEDDGQETPEPPAQPQRAVNMLQGCRSVDEFERLNKIDEGTYGVVYRARDKKTGEIVALKKVKMEKEKEGFPLTSLREINILLSFHHPSIVDVKEVVVGSSLDSIFMVMEYMEHDLKGLMEAMKQPFSQSEVKCLMIQLLEGVKYLHDNWVLHRDLKTSNLLLNNRGDLKICDFGLARQYGSPLKPYTHLVVTLWYRAPELLLGAKQYSTAIDMWSLGCIMAELLSKEPLFNGKTEFDQLDKIFRILGTPNETIWPGFSKLPGVKVNFVKHQYNLLRKKFPATSFTGSPVLSDSGFDLLNKLLTYDPEKRITAEAALNHEWFREVPLPKSKEFMPTFPAQHAQDRRVRRIYKSPDPLEEQRRKELQQGETGTGGIFG

SEQ ID NO: 160759 - protein, 245 aa, Glycine max
  Coding DNA Sequence Number=SeqID_43981
  Gene Ontology: Mol. function=ribonuclease H activity; Biological process=RNA-dependent DNA replication
  Homolog annotation: Hit_ID=Q1RYI2; Match level="QueryCoverage=99%, HitCoverage=45%, E-value=9e-18, Identity=25%"; Hit description =Ribonuclease H
MAWNGSGDGRFSMKSAYAKVSNTDQIPDQPSCKIIFRHCAACKNIEETLFHVFRDCHGVVLVWQFFIRMNDGSDFYSCNNWHLWLLTNLSRDYGVHASFGGDETLWLSKMKCGLLWKLFINLLICPMLAVKVERSLRLFIRVNRRLQVKGVYPQQGEVVLNCDGAVTNAACSGVIRDHMGAYLCGFGAYIGSASVLKAELMAILFGFKLAWSRGFRKIRVESDSLNAIRLIPGQGSNLRPCYDII

SEQ ID NO: 160760 - protein, 303 aa, Glycine max
  Coding DNA Sequence Number=SeqID_43982
MDMPPANFLSHKPKAKTRHRPLHACGVSILAIIDIVIGKTQHINGPLGSTLKRVTKLAKFATPLIYAMRFQLLAILSIIDQAILAIEKIVERLFPPSTRVFDKVDEIVLMIVSLPEKFDGAMNKFPTIVHEVPFLDWALTLVISRLNSLVSTLNHWGQENSRVDEKTIGVDRSCNEGYLPMDNSSNDINNENLENFPPIISDCEHEGAHEIAVSSDVKGSSYQEALLEKGKEENPDEKMEKECEIEKKINGDCDCEEGREKNDGNNEKSKDGIMKSQDGGNERVKDGLLELFESAWLMKAGSY

SEQ ID NO: 160761 - protein, 238 aa, Glycine max
  Coding DNA Sequence Number=SeqID_43983
  Gene Ontology: Mol. function=transcription factor activity; Cellular component=membrane; Biological process=regulation of transcription, DNA-dependent
  Homolog annotation: Hit_ID=P71318; Match level="QueryCoverage=99%, HitCoverage=85%, E-value=1e-121, Identity=87%"; Hit description =Hydrogen peroxide-inducible genes activator
MPCKPTHAERADPQAGRRVGRHAARAHQPQGAVHPGGSAAGGAGAYRAARSESIEGDGQPAGRSHVRAAAHRPDPDRGALSAAADHPDAAQNFPETGNVPARSANPATAGATRQRQIGLRHSGIGEGNRGVYRTRARGDAGFGGREAADAGGWALPARSGDGLLLPGGRGRRYPLPRHQSGNAAQYGRGRQRHYPAAVTGGAAAARTRRRLLSGLLQAGTEAHHRVGVSPRFPTAQPL

SEQ ID NO: 160762 - protein, 567 aa, Glycine max
  Coding DNA Sequence Number=SeqID_43984
  Gene Ontology: Mol. function=aspartic-type endopeptidase activity; Cellular component=lysosome; Biological process=sphingolipid metabolic process
  Homolog annotation: Hit_ID=Q948P0; Match level="QueryCoverage=99%, HitCoverage=99%, E-value=0.0, Identity=62%"; Hit description =Aspartic proteinase 2
  Pfam annotation: Domain name=Asp; Domain location=84-566; Score =515.3; E_value=6.7e-152; Accession=PF00026.14; Description =Eukaryotic aspartyl protease
  Pfam annotation: Domain name=SapB_1; Domain location=438-476; Score =57.6; E_value=4e-14; Accession=PF05184.5; Description=Saposin-like type B, region 1
  Pfam annotation: Domain name=SapB_2; Domain location=317-351; Score =56.1; E_value=1.2e-13; Accession=PF03489.7; Description=Saposin-like type B, region 2
  Pfam module annotation: Pfam domain module=Asp::SapB_1::SapB_2; Domain location=84-566::438-476::317-351
MGHKYLWLVFCLWALTCSLLPSFSFGLMRIGLKKRDLDLDSIRAARMVREKPRLGRPVLGAYDHDLGKPIDEGIVPLKNYLDAQYYGEIGIGTPPQKFNVIFDTGSSNLWVPSSKCYFSIACYTHHWYKSKKSKTYTKNGTSCKIGYGSGSISGFFSKDHVKVGDVVVKNQDFIEATREGSLSFVLAKFDGLLGLGFQEISVENAVPVWYNMVKQNLVSEQVFSFWLNGDPKAKDGGELIFGGIDPKHFKGDHIYVPVTKKGYWQIEMGDFFIGGLSTGVCEGGCAAIVDSGTSLLAGPTTVVTEINHAIGAEGVLSVECKEVVSEYGELLWDLLVSGVRPDDVCSQVGLCFKRAKSESILRLSNDLKMFDGCLIILAVSLKSSSEYNQVYNMQKFSAKIIVKEPLLPTNFSGLDTLRSNGIEMVTEKGQRELSAKDTALCTSCQMLVVWIQNQLKQKKTKEIVFNYVNQLCESLPSPNGESVVDCNSIYGLPNITFTVGDKPFTLTPEQYILKTGEGIAEVCLSGFIAFDIPPPRGPLWILGDVFMRVYHTVFDYGNLRVGFAKAA

SEQ ID NO: 160763 - protein, 346 aa, Glycine max
  Coding DNA Sequence Number=SeqID_43985
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=98%, HitCoverage=43%, E-value=6e-57, Identity=35%"; Hit description=Bg55 protein
  Pfam annotation: Domain name=U-box; Domain location=280-344; Score =45.2; E_value=2.2e-10; Accession=PF04564.6; Description=U-box domain
MDVAEVEENLFAASDAKLHGQMCKTLSIIYCKVLSVFPSLEAARPRSKSGIQALCSLHVALEKVKNVLQHCSECSKLYLAITGDSVLLKFEKAKCALEDSLRRVEDIVPQSIGCQVQEIVNEFATIEFALDPSEKQVGDDLIALLQQGRKFNDSNDSNELESFHQAATRLGITSSRAALAERRALKKLIERAQSEEDKRKELIIAYLLHLMRKYSKLFRNEFSDDNDSQGSAPCSPVQGSIEDSVPGSHCQAFDRQLSKFSCFNFKPNISRTSGQMPLPPEELRCPISLQLMYDPVIIASGQTYERVCIEKWFSDGHNNCPKTQQKLSHLCLTPNYCVKGLVSKLV

SEQ ID NO: 160764 - protein, 61 aa, Glycine max
  Coding DNA Sequence Number=SeqID_43986
  Homolog annotation: Hit_ID=Q9XIM7; Match level="QueryCoverage=46%, HitCoverage=14%, E-value=5e-07, Identity=82%"; Hit description =Similar to cold acclimation protein WCOR413
MTLLHSPKQIQIQVELSSTSYRNNNHLMMRKIKEGRLKKMNGMSSDVRMSVFQFARSNISK

SEQ ID NO: 160765 - protein, 87 aa, Glycine max
  Coding DNA Sequence Number=SeqID_43987
MGGHRQKKSSSGFFSIFNIFSSRKPRGGYYDASDSGRKVWPSDYDKGNWGVAEPNIDMKAEAFIAKYKKRVSESALYQLDPAAAENA

SEQ ID NO: 160766 - protein, 101 aa, Glycine max
  Coding DNA Sequence Number=SeqID_43988
MGGNRQRKSSTFKSVFNIFKSSNRQRGGGHYDANYDDAPKQWTKVWPSDEDRGRWGVADPVIDLRATAFIAQYKKRVSESEIHCQAQNFNEDKTFFKLDSG

SEQ ID NO: 160767 - protein, 105 aa, Glycine max
  Coding DNA Sequence Number=SeqID_43989
MFKEVDMNEKNEDQAGVNEEHVDCSYGFNTSKWARSVAYEIGFVTMIMRLDTNTGTRENTSFVLSACERSGQYRCRKKDFVRRDTGSRKCGCPFKIRGKPLVGGQ

SEQ ID NO: 160768 - protein, 88 aa, Glycine max
  Coding DNA Sequence Number=SeqID_43990
LGATVDGAFSCDGEKTDSCNIFSSRKSKGGYSDAPDSWRRVYPSDYDKGNWGVAEPNIDMKAEAFIAKYKKRVSESALYQLDPAAENA

SEQ ID NO: 160769 - protein, 181 aa, Glycine max
  Coding DNA Sequence Number=SeqID_43991
  Gene Ontology: Mol. function=sequence-specific DNA binding; Cellular component=nucleus; Biological process=regulation of transcription, DNA-dependent
  Homolog annotation: Hit_ID=Q7XJK7; Match level="QueryCoverage=68%, HitCoverage=57%, E-value=9e-25, Identity=46%"; Hit description=MADS -box protein AGL35
  Pfam annotation: Domain name=SRF-TF; Domain location=9-60; Score =36.4; E_value=9.7e-08; Accession=PF00319.9; Description=SRF-type transcription factor (DNA-binding and dimerisation domain)
MTRKKVKLAYITDVTARKSTYKKRKKGIIKKVSELTILCGIPACAIISSPFDSKPEVWPDPERAKQVIQKYLDASVLDESKNVNQESFIMQRIAKAQEQLKKHRQENHEKEMALSMFQYMQGEDLPNNVEELKELNKLIEKNLKEIENKLAVNVSSQGDVVIPVATIRILLLQDVAHNLNS

SEQ ID NO: 160770 - protein, 499 aa, Glycine max
  Coding DNA Sequence Number=SeqID_43992
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SWW1; Match level="QueryCoverage=99%, HitCoverage=99%, E-value=0.0, Identity=65%"; Hit description =Glycoside hydrolase, family 1
  Pfam annotation: Domain name=Glyco_hydro_1; Domain location=39-497; Score=642.9; E_value=2.7e-190; Accession=PF00232.9; Description =Glycosyl hydrolase family 1
MKAISPSFLCLITLVALLAGSIESAPASVKPSHYAAPFNRSVFPSGFLFGIGSAAYQIEGAAAIDGRGPRKIWDHSDGSLAIDFYHRYKSDIKMVKEVGLDSYRFSISWSRIFPKGKGAVNTLGVKFYNDLINEIIANGLKPFVTLFHWDLPQALEDEYGGFLKPEIVEDFRNYADFCFKTFGDRVKHWVTLNEPYGYSVNGYSGGSFAPGRCSNYVGKCPTGDSSTEPYIVNHHLILAHGAAVNCYKNKYQAHQKGQIGVTIVTFFFEPKSNSDADRKAARRALDFMFGWFANPITFGDYPESMRSLVGSRLPTFTKAQSESLKGSYDFLGINYYTSNFAEYAPPTATNKTYFTDMLAKLSSTRKGVPIGTPTPLSWLFIYPEGLYKLMTYIRDNYNNPPVYITENGVAESKNDSLAINEARKDGIRIRYHDGHLKSLLHAIKDRVNVKGYYIWSFSDSFEWDAGYTARFGIIYVDYKNNLSRYPKSSAFWLKKFLLK

SEQ ID NO: 160771 - protein, 243 aa, Glycine max
  Coding DNA Sequence Number=SeqID_43993
MSKKDIEKRKPKYASTEFWGGEKKKYGSNEIEVVEGWEDDMFLKTVKRAAFGSIPIDSEKIDENLLRIIESQSDQVKSDVQNQIAQNANLETIGFSSVEEAEVIQEVDFNQPEPEKGFNFSDMDYPFTKGNWTVQGHSVVSDTDDITGFEERTGHIDRDYYKGILICESIWKHADALLISKAPEMLEMLEDVCENLELQLAMRGVCGQGNGKSSGCDADGYGGTHLLEKAKTLIKQATGINEP

SEQ ID NO: 160772 - protein, 234 aa, Glycine max
  Coding DNA Sequence Number=SeqID_43994
  Homolog annotation: Hit_ID=Q6F974; Match level="QueryCoverage=46%, HitCoverage=27%, E-value=2e-48, Identity=89%"; Hit description =Putative permease
MALRVAQSGLNFIQLGGIVILIPIIAFYFLLDWERMLDSLSRLIPRPYEASTLTIVRECHSVLGAFVKGQFLVMLLLGIVYAVGLQLIGLEVGLIIGMVAGLASIIPYLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 160773 - protein, 289 aa, Glycine max
  Coding DNA Sequence Number=SeqID_43995
  Gene Ontology: Mol. function=RNA-directed DNA polymerase activity; Cellular component=intracellular; Biological process=RNA-dependent DNA replication
GSKSSLLELLLSSEPHRVLLVKVLNKAHVAQDISVEGFESIVNNITANNYLTFVEEEIPVEGRGHNRALHVSVKCMNHIVAKVLINNGSSLNVMLKSTLDKLPFNAAHLRPSSMITFQVMDINPTYSCLLGRPWIHLVGVVPLTLHQKLKFVVEGRLVTVLGEEDILVSCPSSMPYVEATEESLETAFQSYEVVSNASVESLPVRLHMSDALMMVARNHRRFGLGYKPMRADVRKRALERKSKSMGQQQGSQVKTTPSCHISGNFVSAGWRYGGQVTMIHDEAPQEHSD

SEQ ID NO: 160774 - protein, 121 aa, Glycine max
  Coding DNA Sequence Number=SeqID_43996
MTMSSVKTITVFFMLSKAKLSCLTPVAMQSERFFDVSVIQRCFDDNNDDDKGDDKKLKDQSKNKSSESRTIQEFKNQEEFKTQEESLESRIKIQGSRSQESRSRFKTQDSRMKKRLNQDKY

SEQ ID NO: 160775 - protein, 78 aa, Glycine max
  Coding DNA Sequence Number=SeqID_43997
MTLSLRKTRQQVSRSPCHAQVTPPHGDQPESQGSSKPSDMPPSTSIFPHEKLRVLTDKACTISMQYEVWNMSIINALK

SEQ ID NO: 160776 - protein, 60 aa, Glycine max
  Coding DNA Sequence Number=SeqID_43998
MEYESQQREKRLVCLEEIMGLREHKGLVFVKAKLSKFILMMPKTQVKNQESNKFQESRFK

SEQ ID NO: 160777 - protein, 40 aa, Glycine max
  Coding DNA Sequence Number=SeqID_43999
PYRALFNLQTRDLSEDSNPGIIGTAAGWSIRGEAKGDIQE

SEQ ID NO: 160778 - protein, 81 aa, Glycine max
  Coding DNA Sequence Number=SeqID_44000
METQSKPPVELESLLCRDGLAIPIGDFAMHGELPVKLASSKHKRVGFRWYIMNSVITVLYFNGRVYEENDGVIFEGSKKAI

SEQ ID NO: 160779 - protein, 200 aa, Glycine max
  Coding DNA Sequence Number=SeqID_44001
  Subcellular localization annotation: CTP_CleavageSite=17; ConfidenceScore=5.41e-01
MAPLSLLFFLAFSLFLLSSTIMAQITISPSPLAPVIPPSPSSSQISLPPSPLAAVIPPSPSPSQISLPPSPLATVIPPSPSPSQISLPTPPLAPVIPPPLPSQYSPPPPHLPTSPFAPPPLVVETPVTPPPPSLPTRPASRFAPPPPVGEAGRETPVGGSGTKGGSGSGGVQGGGGQGSHIDSYSGGGRRGGEHFVGVGY

SEQ ID NO: 160780 - protein, 85 aa, Glycine max
  Coding DNA Sequence Number=SeqID_44002
MHGGPKPPEPVASLVTGHGSAAEGRVRAGETAITIGGLPCTGIASMAGGLLQFEFFLALFHYKSRSFESALRFLPLLPLLCYSSS

SEQ ID NO: 160781 - protein, 98 aa, Glycine max
  Coding DNA Sequence Number=SeqID_44003
MSPFQVAIWSLHACIAIDAGDLLKDTKLATGSGGLGPPCMVFTWENLSVWKEENLGLYSVNTAYGILLEFHGWIFELQWGPLMVIFHHGDAAEDKGKE

SEQ ID NO: 160782 - protein, 54 aa, Glycine max
  Coding DNA Sequence Number=SeqID_44004
MEVEEWKVVTFVAKAEAYNVAPYRACRPWIFFITIVFHYLKINGSRKEKEERAP

SEQ ID NO: 160783 - protein, 101 aa, Glycine max
  Coding DNA Sequence Number=SeqID_44005
  Gene Ontology: Mol. function=RNA-directed DNA polymerase activity; Biological process=DNA integration
MHPTTHLGLEEESTKVDVTQYKAMNGSLLYLTASRPNVLFNVCLCARFQKEPREVHLTTVKQFVNKKTITSKVLGVKDVLSSDTIAKATRCHCKGSTYQEW

SEQ ID NO: 160784 - protein, 80 aa, Glycine max
  Coding DNA Sequence Number=SeqID_44006
MHPTDIQSLTDDLSSVSKLHEQMYLHDQALAYPSSLHISRAIDIKMVVDRVYPRLPVWDVSKKKGFEMYYKEQMPSWQMK

SEQ ID NO: 160785 - protein, 89 aa, Glycine max
  Coding DNA Sequence Number=SeqID_44007
  Homolog annotation: Hit_ID=Q00M75; Match level="QueryCoverage=41%, HitCoverage=6%, E-value=1e-09, Identity=83%"; Hit description=PPR -repeat containing protein
MGEGCCTQPYPCICKEAVSGFEPMTNKSPRHNFTATPGLALMRVVIIKERDRKNSQESEILFLPSSKESKCTREKSHYGEKYALFIHYL

SEQ ID NO: 160786 - protein, 192 aa, Glycine max
  Coding DNA Sequence Number=SeqID_44008
  Gene Ontology: Mol. function=calcium ion binding; Cellular component =oxygen evolving complex; Biological process=DNA integration
MGQNNLDGDESWDKKLSQVDLHLKYRSDGTIDQYKVRLVAKGYTKFLGYRQSQGDDETKKLVLKEKLATRFEIKELGKLKYILGIEVAYSKQSIFISQRKYILDLLRETEKSGYEQSKVPIKQNHKISRSEEESLAVEKSRYQRLRDTLHMEVYTEADYVRSVVNGRSTSGYYMFLRGNLVKWWSKKQTIVA

SEQ ID NO: 160787 - protein, 439 aa, Glycine max
  Coding DNA Sequence Number=SeqID_44009
  Subcellular localization annotation: CTP_CleavageSite=44; ConfidenceScore=5.19e-01
MDQSQNQRPATSTTTPSRSFQFHPLRVPIFDLFNLYLGLGRNSRQKPDDSLRDPPNKTQKRVHALNRELPPPNEQFILDFEQLQSQCADQDQLRSVTEAILISLVVQCSGHGPRADFLLFVLRSLCGIGCINWDSLLPSLLSSVSSAELPVGQLSQAVPTVSSSSLSQTGMLPPPSTIANSSNFQSSNPASPLTSVHTIGSPAQSTMEPLSCAAMSPVKSSDISSAGQQSKLRGSPSVRTNDISNSSLRQLCCKIILTGLEFSLKPVTYAEIFNYMLNWLVNWDQRQQGIDESDVIKSWRPDKAVIAWLHSCLDVIWLLVDEGKCRVPFYELLRSDLQFIENIPDDEALFTLILEIHRRRDMMAMHMQMLDQHLHCPTFGTHRILNQTIPNVSGEAVAHLRLSPITYLSVLGEPLHGEVMNLISVSRYSLLMYEHAFKY

SEQ ID NO: 160788 - protein, 302 aa, Glycine max
  Coding DNA Sequence Number=SeqID_44010
MDERSIGMFWVVTYTMAQPACETVMNWLNSAGVADLLPGANLQQAERLMATREVSPLPMSLLSGFSINLCVKLSYQMEDSLFSGQVIPSIAMVETYTRLLLLAPHSLFRSHFNHLVQRNPSLLSKPGVTLLVLEILNYRLLPLYRYQGKSKALMYDVTKIISAIKGKRGDHRVFRLAENLCLNLIFSLRDFFLVKREGKGPTEFTETLNRVTVITLAILIKTRGIADAEHLLYLQNMLEQIMATSHHTWSEKTLHHFPSVLREALSGQTDKRSLAIQTWQQGKGIGGCRKVGLKMRNSNVTK

SEQ ID NO: 160789 - protein, 87 aa, Glycine max
  Coding DNA Sequence Number=SeqID_44011
MWWYYGRRDETGKHLSSFAKLLLKCDICAQYTMPELPKGCKRVGYKWVFKTKRDSHGNLERYKAMLADKGFTQKDDIAYKETFSPVS

SEQ ID NO: 160790 - protein, 586 aa, Glycine max
  Coding DNA Sequence Number=SeqID_44012
MTYISHSFPQHRQYLCAGALILMHGHAENINSGNLGRVLREFSPEEVTSNIYTMVDVLLHHMQIELQQGHSSQDLMLKACASIAFFVWTNELLPLDILLLALIDRDDDPHALRMVISLLDRPELQQRVKHFCMTRGHPEHWLYSGIFKRVELQKALGNHLAWKDRYPVFFDDIAARLLPVIPLIIYRLIENDAMDTAERLLAMYSPLLAYYPLRFTFVRDILAYFYGHLPGKLIVRILNVLDISKIPFSESFPQQISLTNPVMCPPLDYFTTLLLGIVNNVIPPLHNNSKSGSMGDASSNTLRTAQSKPPAVSQSGSANASEGQKAFYQIQDPGTYTQLVLETAVIEILSLPISASQIVQSLVQIVVNIQPTLIQSSNALHGGSNSVGQGSVLPTSPSGGSTDSLGASRSTPSVSGINTSNFASRSGYTCQQLSCLLIQACGLLLAQLPSDFHSQLYLETTRIIKENWWLKDGTRSLGEIDSAVGYALLDPTWAAQDNTSTAIVLPERNSDLCNHTGNVVALLHSFFSNLPQEWLEGTNVIIKQLRPVTSVAMLRIAFRVMGPLLPKLANAHALFNKVQRITNSQS

SEQ ID NO: 160791 - protein, 49 aa, Glycine max
  Coding DNA Sequence Number=SeqID_44013
MSHEGGINGGCGKGIEGFEQRGFWGTLCCTKKIEIERHHNNSAILANSR

SEQ ID NO: 160792 - protein, 40 aa, Glycine max
  Coding DNA Sequence Number=SeqID_44014
MGKLCLADGKLAKNYIPLFVQELEESKFAALQNMREKPSS

SEQ ID NO: 160793 - protein, 156 aa, Glycine max
  Coding DNA Sequence Number=SeqID_44015
  Gene Ontology: Mol. function=catalytic activity; Cellular component =intracellular; Biological process=metabolic process
  Homolog annotation: Hit_ID=Q9C522; Match level="QueryCoverage=91%, HitCoverage=26%, E-value=3e-49, Identity=62%"; Hit description=ATP citrate lyase, putative; 3734-7120
MESAQAKNQALKEVGVVVPTSFKAFEDEIMETFHKLVEEGNITPIKEFVPPPILEDLNTTIRSGKVHAPTHIISTISDDRGEEPCYVGVPMSTIIENGYGVGDICIMLCSDHVPCVSGAHNSIVKARVGTCLLSCFSSYMERVGLGSSSSMEFFAS

SEQ ID NO: 160794 - protein, 129 aa, Glycine max
  Coding DNA Sequence Number=SeqID_44016
MSIVGHSQKPRQCRVVHVEGHNGQADMVWRGVILKNLGNLKYPTQWVCPIKMRHFKLHAMRVIGRGTGVRLEGKPVCGNFLEEFNEFYYIKFWVVVVGENWLEVSFAMTSSIRSILDLEWVESAMKETQ

SEQ ID NO: 160795 - protein, 89 aa, Glycine max
  Coding DNA Sequence Number=SeqID_44017
  Subcellular localization annotation: CTP_CleavageSite=30; ConfidenceScore=5.10e-01
MTPILVLDASVSKTKGREKFDKNSTGVIVMASSNSQRQVELLKSTQSGLLSTMRTKLIDGGNRKMILDSDNIEGAIVDAKPPRAIPFLD

SEQ ID NO: 160796 - protein, 51 aa, Glycine max
  Coding DNA Sequence Number=SeqID_44018
MATLRDGKEFTKVVGIGNEVLILVVALFVLALLNFSALVLVDGFLSLQRLC

SEQ ID NO: 160797 - protein, 185 aa, Glycine max
  Coding DNA Sequence Number=SeqID_44019
  Homolog annotation: Hit_ID=Q1SAV4; Match level="QueryCoverage=40%, HitCoverage=19%, E-value=2e-08, Identity=39%"; Hit description =Integrase, catalytic region
MGPKSTLRLMRTLEPSPASLVQSSWSLLAMALVIGPLIGRIASPPVIQRHLASGASPYEITYGKNPFNIPQHITGTSKNDPVDNILSNREASFAELKKKLLKAREVMKQFADSKQREINFKSGDWWKGLPPDDTTWEDWDSLKTPLHLVDKVFLDGIGDDRKQQQGSIGRQKRKINPPKHLRDFM

SEQ ID NO: 160798 - protein, 130 aa, Glycine max
  Coding DNA Sequence Number=SeqID_44020
MAFTSIVKLISTGIVLTSQLSNTDVVFCKDALAIQMGSIKKKARVLAVVIPGLTSQLSPTKPFLETALGGDDGDAGSGAGELGLAIPLEEGKDGRMGAEEECGVRGGGGTGKKGEEKVKDDEEEAQWLSE

SEQ ID NO: 160799 - protein, 133 aa, Glycine max
  Coding DNA Sequence Number=SeqID_44021
MYWTLTYHISLDGAAEAYDFLESHEMMSWATAYSSIVVKPHLAPDMETEQHSPQQSPLVVANMHDEGLTSHAQSYEFMPQPHHHQEDYRYNLQFFSASREDFMRNLMGTNLRTLESPYAYLQNMLVSLFASFH

SEQ ID NO: 160800 - protein, 149 aa, Glycine max
  Coding DNA Sequence Number=SeqID_44022
  Gene Ontology: Mol. function=nucleic acid binding
MILGPRDNKLEREVCPAEDFTIKLDERWYHSGKFQKLHMSCSYVVAACKHAHYEYTNYISLVYMLESVFNVYTRLFRELHNEAYLPPCHAPMICPDPEKKRSTKVRPVSSCIHTEMDIQELGQPKLCSMCIPGHSKKNCLHYVGSSQQH

SEQ ID NO: 160801 - protein, 83 aa, Glycine max
  Coding DNA Sequence Number=SeqID_44023
MVLIQWQGFPPEEATWEKWFTVSNVLHLEDKVHLSGEGIDSNQGRNPSPPGELEAEFHQEEIPAQEGRPKRINIRPGYLKDFV

SEQ ID NO: 160802 - protein, 134 aa, Glycine max
  Coding DNA Sequence Number=SeqID_44024
  Gene Ontology: Mol. function=RNA-directed DNA polymerase activity; Cellular component=chromatin; Biological process=RNA-dependent DNA replication
  Homolog annotation: Hit_ID=Q1SAV4; Match level="QueryCoverage=34%, HitCoverage=11%, E-value=8e-10, Identity=58%"; Hit description =Integrase, catalytic region
MACLVTKRESTATFGEWMKVLYDHSANARNLYQSEGRAWTNDHRYYSRMRFMTFVWQSNWGCDKSFQMAEGMSNGLFNKQLDIGKQSIPSEIGFNTMSYFCDPEMAAERCTMKLMRNGLNERVVTVKPYAPFIE

SEQ ID NO: 160803 - protein, 157 aa, Glycine max
  Coding DNA Sequence Number=SeqID_44025
  Subcellular localization annotation: CTP_CleavageSite=29; ConfidenceScore=5.12e-01
MTNLDPLLGAHLPKRTPLPMAPPKSSTCRGATRVAYEATLDGDTMVVFVKGSNLQPHKISNPTRIRCHFELQSFRKDNAFLLTTRIFSMAQEVVRCMLPQSIRNNPNKAQGILVTVSYLGGNVRHPFRVLVPSMARVSSPSGGGRVQKRNRKDLLNV

SEQ ID NO: 160804 - protein, 146 aa, Glycine max
  Coding DNA Sequence Number=SeqID_44026
MADHTTRKTTTDRLKEAISQLTVHHDFFVSQHSNLASKGTPDEEHIIVALFYMDGPALSWFQWMSYNGFITSWPDLLQALESCFAPTFYDDPKGALFKLSQCGSVIDYLKKFERLANRIVGLPPPFLPNCFVSGLSQEICREVQAL

SEQ ID NO: 160805 - protein, 365 aa, Glycine max
  Coding DNA Sequence Number=SeqID_44027
MNAGKNAPTPRQARPQEGSTMHSNAPILHTWTIKSHSTFGATLECVKVKHFGSWDKTLKVHGWDCEDMDEGEREEEAKVSVGPCFADSGKRRYGAGVKRLATVVYCSSFDGLENFWERDQKGGFSHGVVEGWGKAKELKQTIAPLNYNQSSWRSTLRKLKEKNGEMDEKISDCLLSKSLAQQLGLGLRVEDNLNDVVLQMGESHLHHPLHAAGHYLNPQYFYGNPSLENDPEVMEGLYKCVQRQRSKLHPSKRVLDQQLVYIKYNQSLKEHFDCKNVRDSIVLTEADESNEWLLGEMTNKDEEAAQEDELEFDDLTWGHVEAATGVGEPIGDEIGSEEEEDQIYNGASDEDKEAILDLAAEDDDI

SEQ ID NO: 160806 - protein, 135 aa, Glycine max
  Coding DNA Sequence Number=SeqID_44028
  Subcellular localization annotation: CTP_CleavageSite=7; ConfidenceScore=5.20e-01
MNYSTLMLQNVMRFKCSVNYPYKALYPIFQFYRSLFFPVYVNNQRSKQNAFLFLHRSPTKTTSSHCASRWTIVRKMSRRRSPSSQIKAVVVGTVEGGADGGGRCYDCGSLGISPKIARLVLVKFAVRAFYVLQLL

SEQ ID NO: 160807 - protein, 57 aa, Glycine max
  Coding DNA Sequence Number=SeqID_44029
MKILMLSRRICLRKGENVNHASFADVEKISHVCHYQKGGECKCFTNWASGRSGGEVA

SEQ ID NO: 160808 - protein, 67 aa, Glycine max
  Coding DNA Sequence Number=SeqID_44030
  Subcellular localization annotation: CTP_CleavageSite=38; ConfidenceScore=5.10e-01
MCFKDFWASQLMKACSVSLAEHDVRRDNVLARRADCVQSAMLSGSTFSRVLFSLSESGSLAKRMSLA

SEQ ID NO: 160809 - protein, 78 aa, Glycine max
  Coding DNA Sequence Number=SeqID_44031
  Subcellular localization annotation: CTP_CleavageSite=25; ConfidenceScore=5.02e-01
MKKIQGQQAPFIFVTFRSEMCKMFKRGAKWAFFGHFPALGPTRRLKGEAISLSRLSFIVSDAWGANTFPMHKRLPNLD

SEQ ID NO: 160810 - protein, 104 aa, Glycine max
  Coding DNA Sequence Number=SeqID_44032
MSRLLEMNANGNLCSSHRGAFIFWLILNFSRLRGNGGGHCLDVEDGHLHNGDKGASSVVSLLDDEGGEGGAHSFSTILGLALVALVLFWLPWLSQEQGMLAFEH

SEQ ID NO: 160811 - protein, 143 aa, Glycine max
  Coding DNA Sequence Number=SeqID_44033
MENMFMQLMEISQASFKVNQNSIQNLEIQVGKSHSMENCRWEQELQPYNQYEEKIISNLENLLMQLMETTEATQHAIKNLEIQFGKLAKEVDKFFVTREENFVEVEAHEESLLEEHDSREKDEEKSEKRIQQPWEKCSQVEIQ

SEQ ID NO: 160812 - protein, 184 aa, Glycine max
  Coding DNA Sequence Number=SeqID_44034
  Gene Ontology: Mol. function=DNA binding; Biological process=DNA integration
  Homolog annotation: Hit_ID=Q1SJY5; Match level="QueryCoverage=46%, HitCoverage=8%, E-value=2e-23, Identity=58%"; Hit description =Integrase, catalytic region
MGSKSTLRLMRTLGPSLGSLANLLGVFYPMPLRGRIASPTYRPDIMFSVYLCARFQKEPRKVLLSVIKCIFRYLIGTYNLGLCFKRRKDFGLTSYCDVDYAGDKLERKSNSGSCHFIGGNLRNSEFLDNKAIVSKVLGVIVTLSSNSIAKAIGCLHEGNAYHEGWEKTFELSTRKMQKKLLTRK

SEQ ID NO: 160813 - protein, 124 aa, Glycine max
  Coding DNA Sequence Number=SeqID_44035
MAIALLIELLGEDNEDAFLETKQCRGRHVLLSWLQVIYADRCFENTNQLNGYVTLLQTFSYYRVEEGEWKIYRGITMSHSLDSWQKIIMVLMAKMIVEDEVAEEFRVAREDVDGLRVYCKNLLT

SEQ ID NO: 160814 - protein, 87 aa, Glycine max
  Coding DNA Sequence Number=SeqID_44036
ERRVVVDEKQEIYKGPEDVAPEDVVFSGGPKDKLVLTEYVKHMACQLWDDLDLGLPPLTECGYEITDKELLSTFSKRWHRETNTPFI

SEQ ID NO: 160815 - protein, 62 aa, Glycine max
  Coding DNA Sequence Number=SeqID_44037
  Subcellular localization annotation: CTP_CleavageSite=23; ConfidenceScore=5.35e-01
MIGRISFGSYLQVSSPGRATPVRKYKRGGGGTFSSPETLPPHFKNPPSSRELREQQPLSFHC

SEQ ID NO: 160816 - protein, 98 aa, Glycine max
  Coding DNA Sequence Number=SeqID_44038
MLNGTPRGFSMTSTRCVRVVSSKKWRLRKPSKGYGYHCIIEWIWEQVSIGHRNLGEFYRWVLWFDLGMAFMDNWVVGKEMGCCWVGGKLGHIGMAATA

SEQ ID NO: 160817 - protein, 160 aa, Glycine max
  Coding DNA Sequence Number=SeqID_44039
MTITPLPYSLRVDNLVMYMSLNPWGRHMKILHHNLVDFEPCLGYATEGQAVGEMGKLDHLEKRLRAIKGGEDYAFDNLEELFLVPNIITPPKFKVLDFDKYRGTTCPENHLKMYCRKMGAYAKDKKLLIHSFQGSLTGGSCYLVGTFPSLCLEGPNGCLR

SEQ ID NO: 160818 - protein, 364 aa, Glycine max
  Coding DNA Sequence Number=SeqID_44040
  Gene Ontology: Mol. function=hydrolase activity, acting on ester bonds; Cellular component=membrane; Biological process=lipid catabolic process
  Homolog annotation: Hit_ID=Q4KC01; Match level="QueryCoverage=100%, HitCoverage=52%, E-value=1e-156, Identity=73%"; Hit description =Phospholipase C
MKAVGAEQPQMVLILRQPVVADRLTRLDGKTARDLRQIPPIVDVKHRSLLAGIEQVQRHAALLGRDGGFNVQLVGQRAGRACQAALMGQTLVGGGWQRHLRQLFLAQAQAVGGVAAGGGQARQRFAVRIDKVERRGEIAAHRAAPGADVGFMHLKALFQKLQHRGVIEDLRVDPAAAAPGRQHQHRHPWAGAVDAAVRRRLILRTGRGHVLEDLGVERHGRFTGEAAVFAQRRRGRRRHMVKKAVVFVVVDQQDGFTPHLRVVGQRVEDLLGEPAALHRAGGIGVFRIGRRRDDPADLRQFALLHVGAESGQHGVQIVAVGGRQGVAVALVQRRGLVERIAVGHEGVEVFRRPRRIAHLNAGGA

SEQ ID NO: 160819 - protein, 84 aa, Glycine max
  Coding DNA Sequence Number=SeqID_44041
  Subcellular localization annotation: CTP_CleavageSite=12; ConfidenceScore=5.30e-01
MVLNASYSPKLASSSPWSPNYFRVKEPASLGEPVTSGVSISSLGRVAIDPSAHFPINRRAREAEERIQGSEVEGIERTKKEEEE

SEQ ID NO: 160820 - protein, 322 aa, Glycine max
  Coding DNA Sequence Number=SeqID_44042
  Homolog annotation: Hit_ID=Q1SN43; Match level="QueryCoverage=51%, HitCoverage=34%, E-value=2e-27, Identity=39%"; Hit description =Nucleic acid-binding, OB-fold, subgroup
MANKYNFVAEITAKKGLLEDIGRQSLFDPFFKVAENGGIYRTFHHKYKISFQYSTKVTLVQNVDVPDKPYDFVPISDIVGGGYDSDYLLGKVHSIHFFGVAENGGIYRAFHHKYKIAFQYSTKVTLVQNVDVPDKPYDFVPISDIVGGGYDSGIHHKYKIAFQYSTKVTLVQNVDVPDKPYDFVHTSDMVDGGYDSDYLLDVMAMLTGVGIQHENESNGRKSKMNIIQLEADGSFVGELNAFLASGEVDNVVAIVKFAKVKSYQVVYNADFVATKVLAKRMLQNMDSPCVSLSQLSDGLVSAKVDFLDVTQMKKIEWIKDCE

SEQ ID NO: 160821 - protein, 104 aa, Glycine max
  Coding DNA Sequence Number=SeqID_44043
MVRGIVKILIINMNYYPPFPNPELTVGVGHHSDFETITLCIYTVKKIGIVYKMGKCENDEQEATCSHTKGSANDNITTGTHNRVGLITTLEKLREIVISKEVVL

SEQ ID NO: 160822 - protein, 312 aa, Glycine max
  Coding DNA Sequence Number=SeqID_44044
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=7e-35, Identity=30%"; Hit description= UPI00006A17C9 related cluster
MRGTINESISCFLIGVDPWVLEPISFRGLHALTFRGLHVLAIRGLHVLTFRGLHAFTFRVLHVLAFKGLQVLAFRGLHTLALEDYISSPSEGYTSSPSKGYMPSPSEGCTPSPSKGCTPSPSKGYTSSPLEDYTGLHILTFRGLHVLAIRGLHALAIRGLHVLAIRGLHALTFRGLHVLAFRGLHILAFRGLHVLAFRGLHVLTFRRLHVLAFRGLHALAFRGLHVLAFRGLHVLAFRGLHALTFRRLQILTLKGLRILAFKWLHVLAFRELHVLAFRGLYVLAFSGVHVLAFRGLHVLAFRGLHICAFRGL

SEQ ID NO: 160823 - protein, 171 aa, Glycine max
  Coding DNA Sequence Number=SeqID_44045
MKNGGIEVGLKRGKFNHPALMNKKTGANEEGEDEGETHAVTTIPIRPSFPPTQQCHYLANNNPSPYPPPIYPQRSSLNQSQNPPSTQSTTKHHLKHKPKHQPRNEFCSEKPVEFTPIPVSNADLLPYLLDTAMVAITPARFPQPLHFSEGTTRTQCVLIMEEPRGIPLSIV

SEQ ID NO: 160824 - protein, 90 aa, Glycine max
  Coding DNA Sequence Number=SeqID_44046
MGANNHKGISAYHGCRMTKLGLCLSSGPPPLDDKRVRITVRMTKLGLCLSSGPPPLDDKRVRITIRYLRVSWVQNDQTWSLLVIGPAASG

SEQ ID NO: 160825 - protein, 98 aa, Glycine max
  Coding DNA Sequence Number=SeqID_44047
MEWFFRILHPFVTRTEETAAPRHPPPLHHKEFVKPPIPEVSVATDLPTHSVVHCEGCQGMAQDLGAIVEDLERVINLRMVTEGTDLHDIMTRCLRRAR

SEQ ID NO: 160826 - protein, 103 aa, Glycine max
  Coding DNA Sequence Number=SeqID_44048
  Gene Ontology: Mol. function=DNA-directed DNA polymerase activity; Biological process=nucleobase, nucleoside, nucleotide and nucleic acid metabolic process
  Homolog annotation: Hit_ID=Q1SH99; Match level="QueryCoverage=95%, HitCoverage=24%, E-value=2e-14, Identity=70%"; Hit description=DNA -directed DNA polymerase B
MIFADFFKKLQDAVSDVKNEIAQHLVNLEVSNFSMAPVKVSWCKFEVTVDSPKQIIVWRRPERLTRFTIVRKLDGIIFPMGFSKEVTDRNLQAGSNILCAESR

SEQ ID NO: 160827 - protein, 299 aa, Glycine max
  Coding DNA Sequence Number=SeqID_44049
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=1e-43, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RVAYPHLQRTACPLLQRTTRVALRGPHALIFRGLPVLAFRGLHTPTIRELHVLAFRGLHVLTFRGLHALAFRGLHVLAFRGLHVLAFRGLHALAFRGLHALAFKGLHILAFRGLHALAFRGLHVLTFRGLHVLTFRGLHALALRGLHAPAFRGLHVLPFRGLHVLAFRGLHALTFRGLHVLAFRGLHVLALRGLNALAFRGIHAHTFKGLHALVFRGLHALSVRGLHVLTFRGLHILAFRGLRIPTVRGLHVLALIGLHVSPSEGHTPSTLEDYPSSPSEDNTSSPSEDYTPPPFRGIH

SEQ ID NO: 160828 - protein, 139 aa, Glycine max
  Coding DNA Sequence Number=SeqID_44050
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-11, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
NVFTIRGLHVLAFIGLDVVAFRGLHVLAFRGLDVLAFKELHALAFRELHALARLHLKRTTEDYTSSPSKDCSSSPSEDYTFSPSDDYLSSPSKDYTSSPLEDYTSSPSEGYMASPSEDYTSSPSEDYMSLPSEGDMPSP

SEQ ID NO: 160829 - protein, 97 aa, Glycine max
  Coding DNA Sequence Number=SeqID_44051
MVAISLTKVHHLHFAENTTRMQRVLVTEKPRGIPIEHCKALKCKVQGLIDAGWLKFEENCVIFNFHRNWVQAIGLFAQATCDHSIRDYSSCTLVGLP

SEQ ID NO: 160830 - protein, 148 aa, Glycine max
  Coding DNA Sequence Number=SeqID_44052
  Gene Ontology: Mol. function=transition metal ion binding; Cellular component=cytoplasm; Biological process=electron transport
MVWSIARHPKSLQTKHVDVDMGDRLEDMIPNFGLESFQQVHAPLYDTLQNDLKNPLYPGCTKFARLSVVLDLVLQRMLPNQNTFSINHYKAKNILCPLGIEYRKMHACPNDCILYKNEFAEMHKCPKCVVSQYRVKDGDAILPRKGIG

SEQ ID NO: 160831 - protein, 251 aa, Glycine max
  Coding DNA Sequence Number=SeqID_44053
  Homolog annotation: Hit_ID=Q5XM22; Match level="QueryCoverage=38%, HitCoverage=84%, E-value=1e-35, Identity=54%"; Hit description =Resistance-like protein HAAS-2
  Pfam annotation: Domain name=DUF1723; Domain location=1-38; Score =29.4; E_value=1.3e-05; Accession=PF08330.1; Description=Protein of unknown function (DUF1723)
RWHGETSTFHLPVGELTITLDDVSSLLHLPITGALHSFHALSMEEARFLLTGLFEVSAEEARAEEARAEEARAETALTRRAYVRLGWVRDIYETRCQVRQWIVAAHAYLLQLVGCTLFANKSATYVHLVHLDAFRDLAQSGGYAWGVAALCWIYEHFPTVHQCVIDDTYQETSPRASRWLTSKTHMNGITGAPYRARCDALTVTDVSWLPYTEHRGVRAFEVISSFQGQLRWGPMVVTALPERVVRQFGYI

SEQ ID NO: 160832 - protein, 178 aa, Glycine max
  Coding DNA Sequence Number=SeqID_44054
  Gene Ontology: Biological process=response to DNA damage stimulus
  Homolog annotation: Hit_ID=UPI00005F78ED; Match level="QueryCoverage =98%, HitCoverage=56%, E-value=1e-54, Identity=61%"; Hit description =COG2307: Uncharacterized protein conserved in bacteria
MVQPRLQAVARQALPGAEAHLRQQDRTEIARAILAAAANLLQLAGDLFNAGVQRARTFAAQDQHFVDQRRHQLLLKDGVVGLARRHRAQQAVEAVIFPYRVGMLLQQLLVNAQQPRGAVAALHQRAKPDKTQRIAAQQRAGHRAAKQMRTLFHPVEEAVGTGRRDTAAARVAHLNPRR

SEQ ID NO: 160833 - protein, 48 aa, Glycine max
  Coding DNA Sequence Number=SeqID_44055
MSDMPFRGLKSARKRTAFSAFYGKRDELAKRSLKNSLSAPTALSEFIF

SEQ ID NO: 160834 - protein, 55 aa, Glycine max
  Coding DNA Sequence Number=SeqID_44056
MAKRSSRKKGYAQQRRSYRRYKSVATVWLQRPAIPNNKKLWDQLPLPRRRTSSIL

SEQ ID NO: 160835 - protein, 114 aa, Glycine max
  Coding DNA Sequence Number=SeqID_44057
MSQVDQHLSTQPQPSAQELMPNNKFTTNEMELKTLKRKASNIDLDLNLSLKLNSRVSAENQGSMVVDHEVVDSNLSLSLCSQSSSFSSSRLKKAQDHSKEQGEIIRASTLDLTI

SEQ ID NO: 160836 - protein, 83 aa, Glycine max
  Coding DNA Sequence Number=SeqID_44058
MSEIEEVQEQKKADMKAMNAMKEKMTMMIEAKMSIRKMMEVNTAIVVAASTATEMDPIHLSDFTQVGHPISDVVGQGGEAAKN

SEQ ID NO: 160837 - protein, 212 aa, Glycine max
  Coding DNA Sequence Number=SeqID_44059
  Homolog annotation: Hit_ID=P76206; Match level="QueryCoverage=99%, HitCoverage=83%, E-value=4e-69, Identity=62%"; Hit description =Hypothetical protein ydiY precursor
  Pfam annotation: Domain name=DUF481; Domain location=23-212; Score =171.3; E_value=2.4e-48; Accession=PF04338.3; Description=Protein of unknown function, DUF481
  Subcellular localization annotation: CTP_CleavageSite=14; ConfidenceScore=5.06e-01
MKAFNKLSAVLLLSAGAFCHQAFADNAVFTSMDDPSTAKKPFEGTASAGYLAQTGNTTSSSLTASTSMTWYQTSTAYSLWGNAANTSSNDERSSETYNIGGRSRYNLNSADYLFGQASWLSDRLNGYDSRDVLTAGYGRQILNGPVHSLRAEFGPGVRYDDFHDGGHETKALGYGALSYQWQLTDTTKFIQGVSVLSSFGEDTTLNSETALQ

SEQ ID NO: 160838 - protein, 186 aa, Glycine max
  Coding DNA Sequence Number=SeqID_44060
MEVMMSMKKIMEANAVVVAATSVVAKVNPTPPFVLNQMNPPTPGMVGKDLGSTGGPHDVQIQNEHAFPPYGLPPNYTPPNVAYTPGEDVNNSAPILIVSRQPHHAHISQPMGETYEIPHHNLADFEPCLGYATEEQAVGGILLQNTLEGPQFHPQPQPLHSTTGKIPPIMEEMGKVGSHRGKAQGH

SEQ ID NO: 160839 - protein, 87 aa, Glycine max
  Coding DNA Sequence Number=SeqID_44061
MVAKSVTKHYSQQNTKTETGEALNRKTKTKHHTNQNNKTLNNTDTTLTQHESIKQLNIKHESLAIMNLWTLLPGNGAKFDRGRTRIK

SEQ ID NO: 160840 - protein, 54 aa, Glycine max
  Coding DNA Sequence Number=SeqID_44062
MSHFQRVFQRKCKKSSNVLLCAVVRWQANDASGGHPWSVVVEVGGVGRGFREED

SEQ ID NO: 160841 - protein, 153 aa, Glycine max
  Coding DNA Sequence Number=SeqID_44063
  Gene Ontology: Mol. function=nucleic acid binding
  Homolog annotation: Hit_ID=Q1SJY4; Match level="QueryCoverage=68%, HitCoverage=20%, E-value=4e-09, Identity=35%"; Hit description=Zinc finger, CCHC-type
  Pfam annotation: Domain name=zf-CCHC; Domain location=84-101; Score =25.0; E_value=7.4e-05; Accession=PF00098.13; Description=Zinc knuckle
MKAPKCQKNKKASSSREQVLRSSSKALKVDNSSDEESEEDPVEDELAFISRNIRKMWKNNGGSRCNNSLKRVLKEKKDRYKSSIICYGCKKLGHFKSECPGLEKAQDKKKHYKTKDKKGFMSTWEDLDNSLSKEDEEEANLCLMTDTSSIESE

SEQ ID NO: 160842 - protein, 152 aa, Glycine max
  Coding DNA Sequence Number=SeqID_44064
MADSTHSKSHLDCIEEAIAKLTSNQLSLTANQNSMTTKLDELLQKMALETRFTPSQYKDPTGGKVPRPPPFRSWKTPKTPPTFSLKRLSLEELANRREKGLCFNCDEKYHRGHKYAFKVFLLIAKEDDETQTDPSFSDPQLDTPDEVVSPQV

SEQ ID NO: 160843 - protein, 42 aa, Glycine max
  Coding DNA Sequence Number=SeqID_44065
MVHVEEDRDLNMVGWTLWSVLSGKSGVLDMNLVEWEVVCLGD

SEQ ID NO: 160844 - protein, 734 aa, Glycine max
  Coding DNA Sequence Number=SeqID_44066
  Gene Ontology: Mol. function=RNA-directed DNA polymerase activity; Cellular component=nucleus; Biological process=RNA-dependent DNA replication
MKRLKQRLKVWNKDQFGHTLKKVKKIEADLNKLEEETSDRQLDPQEASKRKQLQEALWVAAQSHESILRQKARSRWIREGDCNSWYFHLMLNANRRHNSLQGIRVDGDWIENPGQVKDAVRQFFLHRFHESEQFRPRLNGIHFQSIDTSQNEMLVGCFQEDEVKQAVWDCGSDKSPGPDGLKFKFIKEFWHLLKPDVLRFLDEFYVNGVFPRGCNASFLTLIPKKADPQLLNDYRPISLKGVMYKIVSKLLAKRLKKVMSFIIDERQSAFIAGRHMLHSVIIANEVVEEAHRNKKPCLIFKVDYEKAYDSVSWNFLLYMLRRMGFCSRWIHWIEGCLRSASVSVLVNGSPTAEFIPQRGLRQGDPLAPLLYNIVAEGLNGLMRAAIQKNLFRGFQVGANSVEISILQYADDTIFFGEATMESVRAIKVILRSFELVASLKINFAKSSVAAIRMLDQWSQQAASFLNCSLMSIPFVYLGIPIGANLRRCQLWDPIISKVPSKVVDKLVRLQRRFLWGGGDDQNKIAWIKWETVCRSKEEGGLGIKDIRNFNLALLGKWKWSLFYHNGDLWAKVLESKYGGWRSLNVASSDHTDSIWWRDLKQALHHQQLASAFHNGLSWRVGCGDKIKFWEDNWLNDDISLVAKYPRLYSISNQQNQVIQQLGAHTDSGWEWDFRWRRSLFDSEVTIADSFLHDIEGKTVHPCRKDEWVWRAEPSGIYSAHSAYNLLQGEITEDQ

SEQ ID NO: 160845 - protein, 177 aa, Glycine max
  Coding DNA Sequence Number=SeqID_44067
MYPWLNYFLKKLFILLSLPSSRVLLLPHHFFFFLKLPEAFGFHSPAFRFFFVTFVLLLPHLSLGLSRKSLTHGHHQPQCICSPSSSSSSAFRCVTTPPWVLTILAKLKVVLLPPHVGIVEVSIVALSSSVSFATVEVTDQVDHLIRKLLSDQHDVEKLMDQLDLETLFTHFPDQVDP

SEQ ID NO: 160846 - protein, 91 aa, Glycine max
  Coding DNA Sequence Number=SeqID_44068
MSVVISRLARHASYFAWLFVSGKAIVNACSSMTPNDDKGDDKKLKGQSKNEFKIFKIESRTLQDSRGKLISRIKIQEIKIQDSRFKNQEKA

SEQ ID NO: 160847 - protein, 73 aa, Glycine max
  Coding DNA Sequence Number=SeqID_44069
MDLNVKDRNHFSALDFSDNGNGQHIIEVEAPLYDTKHLENGMLKGVTSSKSTSSFIFIVMMIKDSFFLDIGGC

SEQ ID NO: 160848 - protein, 71 aa, Glycine max
  Coding DNA Sequence Number=SeqID_44070
MLSVRRDKRFTERDDDALSAQMHGRFSSRFSQLAKWAFNHMAQVAYNASTNSFSQDMQIFKDRNMIIEQHK

SEQ ID NO: 160849 - protein, 138 aa, Glycine max
  Coding DNA Sequence Number=SeqID_44071
MEIAPRKETNHKNKTSLTSIWTSPPKPASLSNTQEFDVEILDTPTPQPSPFLTLPPQTPQHSPKLASTPMSKKEVDALAKVKKKSLAKSRKKAKLNKTLEQKVASLPLWKLCLWKSIRKSCLKIQDWVPWQERFLKKL

SEQ ID NO: 160850 - protein, 84 aa, Glycine max
  Coding DNA Sequence Number=SeqID_44072
  Gene Ontology: Mol. function=RNA-directed DNA polymerase activity; Biological process=DNA integration
MEGAKPMKTPMHASNPRSKGESSKLVDQAIYKDSNLKVVKRILHYLVSTTNQSLFYKKNHDFRLAGYHDAEYAGDREELKSTSE

SEQ ID NO: 160851 - protein, 117 aa, Glycine max
  Coding DNA Sequence Number=SeqID_44073
MAVSDDSDNNFVGSTSDEVALMSKMFKERMKKKGNFYEKSSSSKDKQANICLMVDTDEKVEKYGLGLEIGASSSKSQFVSDKCDFCGKGQGLSWVPGQWMLMTHDGGKLYVPQPKSN

SEQ ID NO: 160852 - protein, 153 aa, Glycine max
  Coding DNA Sequence Number=SeqID_44074
MEKGNIVLFSFVVFLPLSIFFFTHHMDPIIEEVKYDVEVAFDSIAIQVYDPPLFCAYVCLLETELAKTREALAQALHDCAHAEKEARKWFLIRDYSYKKMSGWKPPHPPMPPSSLIHLILILMILMMSFLGNLMKKFTNKRGRKSKSLKLDII

SEQ ID NO: 160853 - protein, 131 aa, Glycine max
  Coding DNA Sequence Number=SeqID_44075
MGLLIKFYTRETLLEFVKPLHDILIQIVELSLLLDSFKLMFQKVTKVAMQENCDPNKKEMCFDDNKDDEKKPKTMISRSSQEQFKNQEKFDFKNQESRMIKIKIQDSRFEESRKDSIKISTKKFFKTMSST

SEQ ID NO: 160854 - protein, 275 aa, Glycine max
  Coding DNA Sequence Number=SeqID_44076
LLDWRGTILKQQSCLAIVDSMEFVESNPLFQNPKSMSYFVLLFQLGVGLAFGEVVVESGNSMVFSLVGVVVSGRHKEGVGVGVDEDGGEGEGTLEGFLGGGGGEWMLFSSGVEEGWPGYEHLYGCDKGHDLASVQPWVVGDVSDLLFRKSMSLQTDFKVDFKDNRQHNIPISPKIARQHDFGKILVESGFEKAIGSNLCYKSKIKQTLDQHIESGSLSSQINSSASQVDSPQAIITSPGNANPVAVVALENKDLAFLVAQLGSDSHQSNNNNNSD

SEQ ID NO: 160855 - protein, 448 aa, Glycine max
  Coding DNA Sequence Number=SeqID_44077
  Gene Ontology: Mol. function=RNA-directed DNA polymerase activity; Cellular component=chromatin; Biological process=chromatin assembly or disassembly
  Pfam annotation: Domain name=Chromo; Domain location=352-406; Score =31.3; E_value=3.3e-06; Accession=PF00385.14; Description='chromo' (CHRromatin Organisation MOdifier
  Pfam annotation: Domain name=zf-H2C2; Domain location=115-153; Score =4.2; E_value=0.1; Accession=PF09337.1; Description=His(2)-Cys(2) zinc finger
  Pfam module annotation: Pfam domain module=Chromo::zf-H2C2; Domain location=352-406::115-153
MDQQNWAAKLLGYRFDIEYKPGNENRGADALSRMYGEAELRALVHYPKWDGVQEAMEEVHRNKKLLSIIADLKQGKESKPGLVHRRGTLFYEGRLVLSSTSTLIPKMLKKFHKTHQGGHSRFYRTYRRMAANLFWFGMKRIVRQFVLGCDTCQRQKYLAAAPGVVVDRQSKYSHFIPLKHPYSARVLAEIFAREVVRLHGVVQTTRDSSEDEHSISSSNGWANISVVYVRKPPMLRRFLPGEVHVEANRMKNQADRKRADRHFEVGEWVFLKLRPHGQLTLGARINHKLAPCYYGTYKVLARVGAVAYRQQLPATTKINPVFHILMLKKAVGDNNVEETLPSELASDDTVSVEPEAMQARRVIQKGGEMVGQVLIHWKVQGMEEATWEEEFNIRSQLPQLRLEDKSPLEEVGIDGNVGPDVETRPKIWRVYERRNWGVKRRGEVARRN

SEQ ID NO: 160856 - protein, 214 aa, Glycine max
  Coding DNA Sequence Number=SeqID_44078
  Homolog annotation: Hit_ID=Q5QLQ8; Match level="QueryCoverage=92%, HitCoverage=71%, E-value=2e-50, Identity=51%"; Hit description =Cytochrome B561-like
MTGEETTGKKRVVTESLGWLTESSIMPKKHRAIAGVGASSILELKAELYKSQEDSKKSRELAGPDAEYQRAKNKIAPKDKFSVKNRGVDARAHKDKLELKAVSDGTASYVALERKAELYDKLVKGDLSDEEDQEKYCVDFFRKGIEHDELPPLLQPLSHNVLVENEDGAVNDDDSLMFKLKTIGPGRKAGAVDNADYKRNIRNRKYRGNNPNCD

SEQ ID NO: 160857 - protein, 477 aa, Glycine max
  Coding DNA Sequence Number=SeqID_44079
  Gene Ontology: Mol. function=RNA-directed DNA polymerase activity; Cellular component=chromatin; Biological process=chromatin assembly or disassembly
  Pfam annotation: Domain name=RVP_2; Domain location=182-275; Score= -54.3; E_value=0.017; Accession=PF08284.2; Description=Retroviral aspartyl protease
MHLRAEENHWKLIEMLSRTSRSTSGNGSATKSPSTPLGVDEFRQSVKKVDLPMFDGDDPVRWIVHAEVYFQVQETHSDVTLKMELLEHYGGISEGDIFERLATIQQEGWHQGPSVKHAYAWCIVMITDDEPGQSNRNGVTGEKRRLVWFLLDGGGSEKGETNMVVVEEQTNKEEDEAECNLMFLRSIVVEAGQKPQKMKLVQDMGWQIEATKPMNIKLGDGYLARAQGICPGVELEIGGLKFTVDTVLFDLEGVDLILGIAWLAPLGTIMVDWGEQVLQFKVQDQWVTIQGENNKHGAQTSLQTLLGKRNSWGVLEGFREVFIEPHGLPPKRSKEHAINLVKSQGPVNVNELLQSRVIRPCQSAFSSPVILVRNDDSWRLCVDYRALNKDLKSGYHQVQVREGDVHKTAYRTHEDHYEYMELDSPLESLERSVASVTAPPVKSVQKWLTPKNVKGVRGFLGLTGYYRNFIKDYGKNG

SEQ ID NO: 160858 - protein, 40 aa, Glycine max
  Coding DNA Sequence Number=SeqID_44080
MEGFKHLDLQQCEKFKEFGAPEFHHDCAKELEIHSEFKVC

SEQ ID NO: 160859 - protein, 529 aa, Glycine max
  Coding DNA Sequence Number=SeqID_44081
  Gene Ontology: Mol. function=identical protein binding; Biological process=negative regulation of enzyme activity
  Homolog annotation: Hit_ID=Q9ZTT3; Match level="QueryCoverage=43%, HitCoverage=36%, E-value=2e-77, Identity=56%"; Hit description =Subtilisin-like protease C1
  Pfam annotation: Domain name=Peptidase_S8; Domain location=80-389; Score=-45.6; E_value=0.00025; Accession=PF00082.12; Description =Subtilase family
  Pfam annotation: Domain name=Subtilisin_N; Domain location=23-77; Score=21.8; E_value=0.001; Accession=PF05922.7; Description =Subtilisin N-terminal Region
  Pfam module annotation: Pfam domain module=Peptidase_S8::Subtilisin _N; Domain location=80-389::23-77
MAGQNQIWEHNLLDATTRVFSGDDYERNLNGSSNAAPKSVLHHYKRSFSGFVVKLTEEEANRIAVVSVFPNGKKQLYTTKSWDFIGFPQHAQRSNTENDIIIGVIDTGIWPEFESFNDKGFGPPPNLKSPRDIDDHGTHIASTAAGNRVSMASMLGLGQGTSRGGATLTCIAVYKACWNDHCDDADILAAFDDAIADGVDILSVSLGGSNDQNYFGDASSIGAFHAMKNGIVTLFAAGNSSPSPAFIDNLYPWSISVVASTLDKICWSPEQAIGVMSLECGAGAIQDGAQVEDMKCDEVWNVKVLDQSSQFVHLEALRHTIWNFKRRWSDNNQRPWVAIDYTSLIDVGYDGAKVHHLFHYKSNHNPLLLELDMGKPPNCRRKPFHFQAIWMGHEEETYRRLKGIGRKLKDKDNKYHLRLQKDLCGELEEILFQEVLWFQKSWCKWLKFGDKNSHYFHCTTLLRKQSNLYARLLNEKGYWVPNSIDLEEMEIEMLGRNITEEEIKKVVYDMCSLKALRDDGFQALLYQSQ

SEQ ID NO: 160860 - protein, 163 aa, Glycine max
  Coding DNA Sequence Number=SeqID_44082
  Gene Ontology: Mol. function=ATP-dependent helicase activity; Cellular component=nucleus; Biological process=mRNA processing
  Homolog annotation: Hit_ID=P93008; Match level="QueryCoverage=55%, HitCoverage=12%, E-value=6e-16, Identity=63%"; Hit description=DEAD -box ATP-dependent RNA helicase 21
  Subcellular localization annotation: CTP_CleavageSite=27; ConfidenceScore=5.18e-01
MSPTRSVAMNKSSPTTTPSIPNPHPTAIETKKGTKTTETGTMIVTEIETEIENALEHERARDRDREAKRHNRERERDMNSLYQIPHEAHLFFGRRFRAGMDCHEQKKLIAKIEKDMTASRRKRASRKSPRRPTPSATKRLPSNYTTPSTYSSIDIGARRSSRR

SEQ ID NO: 160861 - protein, 301 aa, Glycine max
  Coding DNA Sequence Number=SeqID_44083
  Homolog annotation: Hit_ID=Q1SLA4; Match level="QueryCoverage=24%, HitCoverage=13%, E-value=3e-08, Identity=36%"; Hit description=Zinc finger, CCHC-type; Lipocalin
MKTEEGDTSSKEMSYLSSLLSTNFFVGSDVPYLSMEEDQRDGDKMSKDKSEEEKDFISCPIVNILDSECVVWCAPWKGSLVVHVLRKTVGFKMLEYKLQQGWAQYGKIRIVDMPDYYYLVQFTSEKDYRHALFEGSWMVADHDRVKTMINTTLKIDKLTSIYSREEKVTVKPTATTLVEKEPKAQTKKEGGPIRADVTRWEWDHNSISGQGRTTKGNTSSWKAKAQGGFVEGMKNMGVGSNGVRDWRVIRMKKRKGKEVMRNTKALISMFATRVHYDEMDIVFNANKSVIMVVKASSSNHY

SEQ ID NO: 160862 - protein, 129 aa, Glycine max
  Coding DNA Sequence Number=SeqID_44084
  Gene Ontology: Mol. function=identical protein binding; Biological process=negative regulation of enzyme activity
  Homolog annotation: Hit_ID=Q9SUN6; Match level="QueryCoverage=79%, HitCoverage=12%, E-value=5e-16, Identity=46%"; Hit description =Putative serine proteinase
MGNINVAHLVVVVLFCFGLFLPCLCQGNSDDATTDVYVVTLRHAPVSHYYGELRREVNGFKDAAAPGRTQFNKPRRYDNITKTDKRYDSYISRVHDSLLKKVLNGEKYLKLYSYHYLINGFAVLVTQQQ

SEQ ID NO: 160863 - protein, 48 aa, Glycine max
  Coding DNA Sequence Number=SeqID_44085
MVAEVMAGDKEAVEVDMAEAEATLDWCLVVVEGRRTMGLDWRLRARGR

SEQ ID NO: 160864 - protein, 119 aa, Glycine max
  Coding DNA Sequence Number=SeqID_44086
MALSGPVTSTIMDHHFNVDSLLLGHHESCEGCFLTHQNFITLIMCVVDGAKEELHLVLMYTLSLFHVFGYNGGDAKVQFQRDAQGHGKHVHASLITTYEEKGNGKDEKLGKEGEEEDGV

SEQ ID NO: 160865 - protein, 81 aa, Glycine max
  Coding DNA Sequence Number=SeqID_44087
MAGKAPTVFIPEGDKSGWLMMNLDAGAMFPPYWPRKFGIVLDLIWQWRNFFVFNGALGSDCEMMMKITKLEKELNYECNKF

SEQ ID NO: 160866 - protein, 114 aa, Glycine max
  Coding DNA Sequence Number=SeqID_44088
MCTSITTLTQIWMTLLLGNILPSYHNSNLPLPKCQLVYAILTQGLHRKILHAKASIATESSTATTGGGPAAASCRCTTATSAAATISGVHLCSPAEDGALDPCIYAACDRPAGG

SEQ ID NO: 160867 - protein, 132 aa, Glycine max
  Coding DNA Sequence Number=SeqID_44089
MGGINYNPMLAIRQLGYPMRVEQKDRELRGSSNGVVGCYHKWLKARMQEITWLPNLKGPSGEEVEVPEESEEVQALKAELERTQVVKEKFKMIAIRVKKRCDELRDVKMAMAEALERETKRARKEEWGQNKF

SEQ ID NO: 160868 - protein, 330 aa, Glycine max
  Coding DNA Sequence Number=SeqID_44090
  Gene Ontology: Mol. function=RNA-directed DNA polymerase activity; Biological process=RNA-dependent DNA replication
MEAMKDQMTSMMEAMLSIRQIMEDNVAAVSATSTAAEADPTHPSDINQTTHPAPNMVGQGREVLGSTSGPHTVQNRNAFPPYGLPPNYTPPNVVHVPNENANHSVPILLESQQPQLEHAPFSQPMGEAREEPWDHALGECEPYPTYATKGPAIEESEKLDLIEERLRAIKGIGDYPFADMAKLCLVPDVVILPKFKVLDFDKYKGTICPKNHLKMYCHKMGAYSRDEKLLIHFFQESLAEAAITWYTNLEASQIRSWKDLMGSGGPSSTPMMEREMITMIVDTLPVFYYEKMVGYMPFSFTDLVFAGERIERTQLAKPKITYSRLASQSR

SEQ ID NO: 160869 - protein, 152 aa, Glycine max
  Coding DNA Sequence Number=SeqID_44091
LLLSTKFRALLSLSLHSSPSSSKLLSMASYGEAKESIDEEDPRPTSSNGACIKASERLALDFDMIEPFLKRGHLVRPHVGYNENSADQYFNFNTLSWRRYDECMRLHCHQAIRRPSMTTDQPPLPMFPWTGSMRVWLLLLRILKCDEELRPT

SEQ ID NO: 160870 - protein, 90 aa, Glycine max
  Coding DNA Sequence Number=SeqID_44092
MGSNQVPSFKKRFYHVKIKSLEVASPWELGQWMDQVQRQAFRKTYRKIWDLAMIEVSMEAIASLTYGMEKEEREETPLQGEDESRRSSPP

SEQ ID NO: 160871 - protein, 199 aa, Glycine max
  Coding DNA Sequence Number=SeqID_44093
MGETDKVQEWIKANLEAMKEQMAIMMEGMMSMKKIMKVNAAIVAATSAIAEVDLTPPFGLNQINHPISDMHSFPLYGLAPNHTLPNVAHTPNEDVDNSAPIPIESQQPQADHAHVFQPMGETHEIPHHNLTDFEPHLGYAIEEQAVGGRIPLAMVEKGKLDHIEERLGAVEGGGSYALADMAKLCLVPLHHHHSEVQGV

SEQ ID NO: 160872 - protein, 275 aa, Glycine max
  Coding DNA Sequence Number=SeqID_44094
  Gene Ontology: Mol. function=RNA-directed DNA polymerase activity; Biological process=RNA-dependent DNA replication
MLGHKISARGIEVEIAEIYVIEKLPQVNVRTLGVSSDMQDSIVFKFDEEFLTTFQTLKSSLICAPIMVALEWSKEFELICDVDSKPRLIRWVLLIQEFDIVIKDKKGFENVVADHLSRLVNEEVTQDEQEIRDEFPNESLLHVKERPWFADMANYKAAGMNELSWHVSLSEFMSHRHMFLHFWVFDECPCMGLAYNLMLSPTVFQYHMHGLSTWSHAKPQYHFVFSDSFHFSYMSLARSLALSPSVCLFPCMGLAHSLAPSSNWFCFGAKRPMAA

SEQ ID NO: 160873 - protein, 52 aa, Glycine max
  Coding DNA Sequence Number=SeqID_44095
MEKPDMKTFKDKKGKKVYITWEDNDMDSSDIILGKQRCVFDKAGLEYKPEKQ

SEQ ID NO: 160874 - protein, 103 aa, Glycine max
  Coding DNA Sequence Number=SeqID_44096
RKAAAAQKTYPVKQIDVALVKEFYSNIFDLKDGSLKQCKVQGQAIRFDPQTLNDFLRTPVIILEEEQLATYSQYLYTYPDHQAIMAKLCTPGGQFILNVEGAL

SEQ ID NO: 160875 - protein, 64 aa, Glycine max
  Coding DNA Sequence Number=SeqID_44097
  Subcellular localization annotation: CTP_CleavageSite=20; ConfidenceScore=5.21e-01
MSFINNRVASNNSLWRPPVVVGGGKGVSRVISLSELISLSENALLAPSVNFRAKRKPFSGRDLQ

SEQ ID NO: 160876 - protein, 118 aa, Glycine max
  Coding DNA Sequence Number=SeqID_44098
AKHACAPKPQCLSVEAELSASIWLIGKERHHLHPPKLDLTDQDSLPKRLGKDTDIIVPRKLLPERNMAVYYIEFDEFKEELERSHWDEELTDFGDGNIDVAIVKEFYANLYDPEDKSP

SEQ ID NO: 160877 - protein, 181 aa, Glycine max
  Coding DNA Sequence Number=SeqID_44099
  Gene Ontology: Mol. function=ATP binding
  Homolog annotation: Hit_ID=UPI00006DB03B; Match level="QueryCoverage =95%, HitCoverage=88%, E-value=5e-50, Identity=57%"; Hit description =COG3911: Predicted ATPase
MSDKLRRIVLTGGPGSGKSTLIEVLHRRGYPHSQEAGRAIIQEQVSIGGNALPWGDRQAFAERMLDWELRSWREATGATCWFFDRGLPDIAGYLTLCGLPIPAPLTAAIGAFRYADTVFIAPPWRAIYAQDSERKQSFAEAEQTYRAMLAAYRQHGYQLQELPRASPDERADFLLDALGCR

SEQ ID NO: 160878 - protein, 93 aa, Glycine max
  Coding DNA Sequence Number=SeqID_44100
MESHEHIFQFSWVPYRGFEEHLPRHAYRDMEIWFAWTSVEQTHFEIPHPQSMYCTSSPVHQTFSWTSECRTGCHDITLQNMQIVFDCMNRLNK

SEQ ID NO: 160879 - protein, 69 aa, Glycine max
  Coding DNA Sequence Number=SeqID_44101
MGLAGKDVLSTNIICFKVFGSALSAASHLGLSACCKKIFGVAKSAKCCCCAKPQMLTGSYNFKLGLARG

SEQ ID NO: 160880 - protein, 83 aa, Glycine max
  Coding DNA Sequence Number=SeqID_44102
MERKDKELRGSNNGVIGDYHKWLKARTQGITWLPKLKDLSGKEAEVLKESEEVQALKPELERMRVVKEKLKTTVTRVRKEFDE

SEQ ID NO: 160881 - protein, 207 aa, Glycine max
  Coding DNA Sequence Number=SeqID_44103
  Gene Ontology: Mol. function=helicase activity
  Homolog annotation: Hit_ID=Q9LTU4; Match level="QueryCoverage=64%, HitCoverage=9%, E-value=5e-34, Identity=49%"; Hit description =Helicase-like protein
MLMDLTKNHMLGKVIVYMYIIEFQKRGLPHVHLLLFLHPDNKYPSLDEIDQIISAEIPSQQDDPELYSLVKNHMVHGPCGSLNPGSPCMKEGKCSHFYPKMFHLHIVLDADGFPVYRRRNNGNAIEKNGVIIDNRVTAVLIDEDNGQTENGGTHNDEIKEYLDCRKPAVKDYTSIFQANIVFSTKTMMILMMYCLSQVSLIQSLSHG

SEQ ID NO: 160882 - protein, 152 aa, Glycine max
  Coding DNA Sequence Number=SeqID_44104
  Gene Ontology: Mol. function=helicase activity; Biological process =protein amino acid phosphorylation
  Homolog annotation: Hit_ID=Q1SN45; Match level="QueryCoverage=93%, HitCoverage=8%, E-value=2e-24, Identity=39%"; Hit description=AAA ATPase
  Pfam annotation: Domain name=DUF889; Domain location=1-149; Score =59.3; E_value=1.6e-15; Accession=PF05970.5; Description=Eukaryotic protein of unknown function (DUF889)
MRLQNNMQATDQEETATFAQWIIDIGDGIIGDENDGYATIEIPQELLITEYNDPIHSIISSTFPYLSHHHNDPEYFQTRAILASTNETVQQVNDYMLTMIPGEQMEYLSSDSVDKSETIESCHFRSLTTEFLNSLTTSGLPNHCSNSRLEHQ

SEQ ID NO: 160883 - protein, 116 aa, Glycine max
  Coding DNA Sequence Number=SeqID_44105
MYCRKMGAYTKDEELLIHFFQESLTGVAVTWYANLEPSRVHSRKDLMVAFVRQYQYNFDMIFQRIRPKVERPGSPSGTLNDGKKMRTMIVDTLPVFYYEKMVGYTPSSFADLVFAG

SEQ ID NO: 160884 - protein, 109 aa, Glycine max
  Coding DNA Sequence Number=SeqID_44106
  Gene Ontology: Mol. function=nucleic acid binding; Biological process= apoptosis
MPTRITLQLADRSITRPYGVIEDVLVKVKHLIFPADFVVIDIEEDADIPLILGRPFMSIASCDKDLPDQNVCLMVHVMEERKPEKKDQSELQIALSACPRAKPGHASGT

SEQ ID NO: 160885 - protein, 98 aa, Glycine max
  Coding DNA Sequence Number=SeqID_44107
MASKKRKAPSTPSQVRFDRSRFTSQEAWESNIDAAIVKEFYANLYDPEDKSPKQVRVRGHLVKFDEDTLNTFLMTPVILEEGENLCAYSRFSLLRPDP

SEQ ID NO: 160886 - protein, 50 aa, Glycine max
  Coding DNA Sequence Number=SeqID_44108
MVQLSAHHCAKPNIFTLYAKCAIQNSVFKKQRQRHLGCYLCTQTSAPSHL

SEQ ID NO: 160887 - protein, 50 aa, Glycine max
  Coding DNA Sequence Number=SeqID_44109
MGQGGIPPMLGEGACRNLLAPITKEEMRRGIMSMKSFKALGLDGFHAFFL

SEQ ID NO: 160888 - protein, 99 aa, Glycine max
  Coding DNA Sequence Number=SeqID_44110
  Gene Ontology: Biological process=electron transport
  Homolog annotation: Hit_ID=Q8S9W7; Match level="QueryCoverage=53%, HitCoverage=9%, E-value=4e-13, Identity=64%"; Hit description=FAD binding domain containing protein-like
MCARKWSTRPSSTEKELDPQNLFSSENGEMAYFMGGNQKNLKGVLWRGFAYVVKIDIVALIKGITEAMAMSTRKLESVDICHAPYYIIHSMIMCLYFIS

SEQ ID NO: 160889 - protein, 47 aa, Glycine max
  Coding DNA Sequence Number=SeqID_44111
MSLPATTYHQKTKTLDEASLLSSESETQHDYRSTSTSYVSHRLGYRA

SEQ ID NO: 160890 - protein, 85 aa, Glycine max
  Coding DNA Sequence Number=SeqID_44112
MAITDGQWWWRRSLQVLREGLGEEKEEEDGCFMLLNVFEGCNTRPSEFGSPEQADPAPIFSALEPPKKLLEDPTVNESRMAILLK

SEQ ID NO: 160891 - protein, 109 aa, Glycine max
  Coding DNA Sequence Number=SeqID_44113
MTKFTKHGINQQFQLKHETTNERKKKKHKIGTELDRGRGTNLDRRRGAKMVVNHAREPQRCWKAFTTIDYDEEGERVVQNENNTIEVLESLWRQSTKTKREKGSNSDEG

SEQ ID NO: 160892 - protein, 61 aa, Glycine max
  Coding DNA Sequence Number=SeqID_44114
MLGGVDGDPVLRGTRIKGYVGVQWYLEICRGGQETLGTSGGVIFPKTKLDPSRPNPGIVSQ

SEQ ID NO: 160893 - protein, 79 aa, Glycine max
  Coding DNA Sequence Number=SeqID_44115
  Subcellular localization annotation: CTP_CleavageSite=43; ConfidenceScore=5.52e-01
MATLTTAFLPSKLKPHSGHQAYPFTHRRTPLRNKINRAVMPVRAESGGVRLQGCSGQPYTTRKMTFYDTDSTTVIGEPP

SEQ ID NO: 160894 - protein, 73 aa, Glycine max
  Coding DNA Sequence Number=SeqID_44116
  Homolog annotation: Hit_ID=Q1SW54; Match level="QueryCoverage=83%, HitCoverage=6%, E-value=6e-08, Identity=48%"; Hit description =Protein kinase
MQKGMFGRNSCDIAQTSDDKHFVWTMDLSYNKDLTGPLPESIGELKKLATFFKGPIPDNIGNMQEILYAVSYS

SEQ ID NO: 160895 - protein, 326 aa, Glycine max
  Coding DNA Sequence Number=SeqID_44117
  Gene Ontology: Mol. function=nucleic acid binding; Cellular component= intracellular; Biological process=transport
  Homolog annotation: Hit_ID=Q9FME2; Match level="QueryCoverage=82%, HitCoverage=51%, E-value=3e-28, Identity=34%"; Hit description =Similarity to RNA-binding protein
MVTGCLTGKDNLRRKFAQSFFLAPQDNGYFVLNDVFRYVEDHEPSELPPVTGDGDAAAVTVTPETGKIIIQNFFIFSFKIYSGVGFMLFSFFTEPSHFANSSAPDPTNSHVNKGQTVAENAYEPSNHHERHIPIENVDNVEPHFQSNGNDDSQATELASSAQEKKSYASIVKVQKEGLVATKVYVQTNTLKSGPNKTENKVVESVESTEVSEAALDSVNNPESSDAHEEVEGHSIYIRNLPLNVTAAQLELEFKKFGPIKPGGIQVRNNKVIIRSTMHSNYPFAFYSVLMKFCLKNETHTTPKTRATTNNNHLWVKEAIYMVTIRT

SEQ ID NO: 160896 - protein, 155 aa, Glycine max
  Coding DNA Sequence Number=SeqID_44118
MASKEDLILLWALQTSHQIDWVHLVRYRMHKALHQIGWAFFLQHFNVPLDVEPFVKVKHSFAIGATIVASFGYRMDMDGQWVRKQDLPPTTPDERTPSPPPPRAPFSSLLHDVLSELRDLQTFVGDRFDAMDSRITSLEDDMSFICRCFDPPTDP

SEQ ID NO: 160897 - protein, 501 aa, Glycine max
  Coding DNA Sequence Number=SeqID_44119
  Gene Ontology: Mol. function=enzyme activator activity; Cellular component=centrosome; Biological process=cell division
  Homolog annotation: Hit_ID=Q4TU48; Match level="QueryCoverage=99%, HitCoverage=99%, E-value=0.0, Identity=76%"; Hit description=Cell cycle switch protein CCS52A
  Pfam annotation: Domain name=WD40; Domain location=266-302; Score =21.0; E_value=0.0042; Accession=PF00400.22; Description=WD domain, G- beta repeat
  Pfam annotation: Domain name=WD40; Domain location=307-345; Score =35.5; E_value=1.8e-07; Accession=PF00400.22; Description=WD domain, G-beta repeat
  Pfam annotation: Domain name=WD40; Domain location=349-390; Score =19.5; E_value=0.012; Accession=PF00400.22; Description=WD domain, G -beta repeat
  Pfam annotation: Domain name=WD40; Domain location=437-475; Score =38.1; E_value=3.1e-08; Accession=PF00400.22; Description=WD domain, G-beta repeat
  Pfam module annotation: Pfam domain module=WD40::WD40::WD40::WD40; Domain location=266-302::307-345::349-390::437-475
MEDSSGHLNIPPAAAAATLRHVDRMINSNHYTSPSRTIYSDRFIPSRSASKFALFDIAWPPGGGDDSSSAYTTLLRTALFGPDIEPPHSPAMTLPSRNIFRYKTETRQSMHSHSPFLCDDSVPGVVHGPVKAPRKVPRSPFKVLDAPALQDDFYLNLVDWSSHNVLAVGLGNCVYLWNACSSKVTKLCDLGIDDLVCSVGWAQRGTHLAVGTSNGKVQRRRCGGSIAVVDAEALMHFVSSKLVFAKTMKETWQKEVSIGIWDASRCKKIRSMEGHRLRVGTLAWSSSLLSSGGRDKNIYQRDIRAQEDFVSKLSGHKSEVCGLKWSYDNRELASGGNDNRLFVWNQHSTQPVLKYCEHTAAVKAIAWSPHLHGLLASGGGTADRCIRFWNTTTNSHLSCMDTGSQVCNLVWSKNVNELVSTHGYSQNQIIVWRYPSMSKLATLTGHTYRVLYLAISPDGQTIVTGAGDETLRFWNVFPSPKSQMVNQLVTPTNLSKVIFSD

SEQ ID NO: 160898 - protein, 102 aa, Glycine max
  Coding DNA Sequence Number=SeqID_44120
  Gene Ontology: Cellular component=extracellular region; Biological process=cellulose and pectin-containing cell wall organization and biogenesis
  Homolog annotation: Hit_ID=Q9LN94; Match level="QueryCoverage=91%, HitCoverage=33%, E-value=1e-32, Identity=71%"; Hit description =Expansin-A7 precursor
  Pfam annotation: Domain name=Pollen_allerg_1; Domain location=38-102; Score=53.5; E_value=6.9e-13; Accession=PF01357.11; Description=Pollen allergen
MSKPAFMKIAQWQAGIIPVMYRSVKQCLRVPWVRSGGLRFSFQGNGYWLLVYVMNVGGGGDIANMWVKGSGTEWISMSHNWGASYQAFATLGGQERFGQCWS

SEQ ID NO: 160899 - protein, 114 aa, Glycine max
  Coding DNA Sequence Number=SeqID_44121
MWREQPLSRYHDRHLLPTIKYISIGIIIFLGTQIFLGLLVLSLNALELSLGHQWAKCESTAKRSFSVLSVTEESGRASISRPRANREINALSAAVVFSQAQRTTDTKLKSTYSR

SEQ ID NO: 160900 - protein, 157 aa, Glycine max
  Coding DNA Sequence Number=SeqID_44122
  Gene Ontology: Cellular component=chloroplast thylakoid membrane
AFYYEGKAIMSNEEFDNLKEELMWEGSSVVMLSSDEQKFLEASMAYVSGKPIMSDKEFDELKLRLKLNISLLLVLFTDLVTVFQIEGSEIVAEGPRCSLRSRKVYSDLSVDYLKMLLLNVPATVIALGLFFFLDDLTGFEITYLLEWLPSCTSLAKV

SEQ ID NO: 160901 - protein, 63 aa, Glycine max
  Coding DNA Sequence Number=SeqID_44123
  Subcellular localization annotation: CTP_CleavageSite=40; ConfidenceScore=5.20e-01
MHCTLDTNLFSFWCSPHSVQWQALMPPPKAVSTFSYGHCRSTRNSSKHCKYATPPPPPPPQKF

SEQ ID NO: 160902 - protein, 202 aa, Glycine max
  Coding DNA Sequence Number=SeqID_44124
AEEIGVKGAVHGRGGVNVKASLLAVNMVMVVIWNQSGGSVTGKVQGGGGDSYMQSILIPKYICIEVERLQRHFIWIDHETSMGWHIVAWEILTQPNTLYAVSSTVDYDTCPICFEEPEMDLHLLRDCGQSRHVRQDLLLEFPMEQTGPVRCQCGFMQMDLMWGASVRLPSPTSLLKWRPPPSGVWAILAALEHAWSLRHLCV

SEQ ID NO: 160903 - protein, 76 aa, Glycine max
  Coding DNA Sequence Number=SeqID_44125
MYVRDIPRELHCQMLSQKNSWANTCKSIKSFSMDFNYFYKGSEKSQVCHHQKGGDCRSKLHDDEPSNFDDAKSPSD

SEQ ID NO: 160904 - protein, 293 aa, Glycine max
  Coding DNA Sequence Number=SeqID_44126
  Gene Ontology: Mol. function=oxidoreductase activity; Cellular component=apical plasma membrane; Biological process=L-ascorbic acid biosynthetic process
  Homolog annotation: Hit_ID=Q0PGJ6; Match level="QueryCoverage=98%, HitCoverage=87%, E-value=1e-125, Identity=75%"; Hit description=Aldo- keto reductase
  Pfam annotation: Domain name=Aldo_ket_red; Domain location=1-265; Score=312.0; E_value=1.1e-90; Accession=PF00248.11; Description =Aldoketo reductase family
MVVGYRHIDCAQIYGNEKEIGSMLKKLFEEGVVKREDLWITSKLWNTDHAPEDVPLALDRTLKDLQLDYVDLYLFIYDILSCKPINLPFQIHWPTSMKKGSVGFNPENLVQPNIPNTWKAMEALYDSGKARAIGVSNFSTKKLADLLAIARVPPAVNQVECHPSWQQDKLQAFCNSKGVHLTGYSPLGSPGTTYFKSDVLKHPIINMVAEKLGKTPAQVALRWGLQMGHSVLPKSTNETRIKENFDVSGWSIPEDFLAKFSEIQQARLLRGTTFVHETYGAYKSVEELWDGEI

SEQ ID NO: 160905 - protein, 121 aa, Glycine max
  Coding DNA Sequence Number=SeqID_44127
MEWKKKKVYSHTLSGDAGDFIVFVSGTCSVIQKKAEWNLSTIQDLLVQQDHDRALEDERSASINETKCEHDLVSSCSRDKTHVKGLVGETQEYLCVKVANQSLLFEDGVVLTQNGDGRTSL

SEQ ID NO: 160906 - protein, 161 aa, Glycine max
  Coding DNA Sequence Number=SeqID_44128
MKPRQLSDAIHEEVGAICLGQTGKPKREDGAMLSTSDVMPIQRQGETASVAEIDDTLHENEPDFQFTRQRSDGQSLCELLLSFVYKFQHLPLFLNFIPILVCWTLLGHDSCRILLELMLGSPPWCCNYKIIFWGQTPLQHGLDTGQENEPTPTPGWTLIRH

SEQ ID NO: 160907 - protein, 89 aa, Glycine max
  Coding DNA Sequence Number=SeqID_44129
MLLEIVDTTMPVFDGASPISMEEYNLVKNRDRRIIKHYVHYGFEELASFALLTSVGNPSTFQEAMNNREKDRWMGVMVEEMESLQKNQI

SEQ ID NO: 160908 - protein, 419 aa, Glycine max
  Coding DNA Sequence Number=SeqID_44130
  Gene Ontology: Mol. function=identical protein binding; Cellular component=cytoplasm; Biological process=negative regulation of enzyme activity
  Homolog annotation: Hit_ID=O82007; Match level="QueryCoverage=93%, HitCoverage=52%, E-value=1e-126, Identity=56%"; Hit description =Serine protease
  Pfam annotation: Domain name=Peptidase_S8; Domain location=122-403; Score=-2.0; E_value=1.1e-06; Accession=PF00082.12; Description =Subtilase family
  Pfam annotation: Domain name=Subtilisin_N; Domain location=33-115; Score=49.9; E_value=8.3e-12; Accession=PF05922.7; Description =Subtilisin N-terminal Region
  Pfam module annotation: Pfam domain module=Peptidase_S8::Subtilisin _N; Domain location=122-403::33-115
MDSFFFIAFTFVLSFHIHFAHGNELNSATSSSKTYIIHVTGPQGKTLAQSEDLESWYRSFMPPTIMSSEEQPRMIYSYRNVMSGFAARLTEEELRSVQKKNGFISAHPERMLHRQTTHTPQFLGLQQDMGFWKESNFGKGVIVGVVDSGIEPDHPSFSDAGMPPPPLKWKGRCELNATFCNNKLIGARSFNLAATAMKGADSPIDEDGHGTHTSSTAAGAFVDHAEVLGNAKGTAAGIAPYAHLAMYRVCFGEDCAESDILAALDAAVEDGVDVISISLGLSEPPPFFNDSIAIGAFAAMQKGIFVSCAAGNSGPFHGSLVNGAPWVLTVGASNIDRSIAATAKLGNGQEFDGESVFQPSDFSPTLLPLAYAGKNGKQEAAFCANGSLNDCDFRGKVVLCERGGGIGRIAKGEEVKRVG

SEQ ID NO: 160909 - protein, 269 aa, Glycine max
  Coding DNA Sequence Number=SeqID_44131
  Gene Ontology: Mol. function=DNA binding; Biological process=DNA integration
MHAYLSNLVKSLVFAYVCVISLIPFRISIVIANNWRVKDLLEQQGLLKALRKSQPNNTKTLGCKELQERVVAIIRLCLANEVLYHVMELKSPGEGSNLQQHVNAFNQMINDLERHDVKVEDEDKAYILIFSLPYSYEHLVATLTYTKDSISLEPELKKSSEGTSRSAYVAKTNDSYYYIEGDVYYNGGDVLFGSSTQRTVGNIYRLLGSTVIGRVAFVESDNDVTKFWHLRLGHLSDHGMTNLHKRGLLKGVQSCKLDLCENYVLGKHI

SEQ ID NO: 160910 - protein, 100 aa, Glycine max
  Coding DNA Sequence Number=SeqID_44132
MKEDLKKLRDMNKDSVNSQTNVVKSVEDEDDVFLATNDEVAKTKWVMDFATSKHICMGSVRMKLHDDAIQTFSNVRFVPFAIVNMISMGEMTSQGYKYVG

SEQ ID NO: 160911 - protein, 698 aa, Glycine max
  Coding DNA Sequence Number=SeqID_44133
  Gene Ontology: Mol. function=identical protein binding; Cellular component=cytoplasm; Biological process=negative regulation of enzyme activity
  Homolog annotation: Hit_ID=O65836; Match level="QueryCoverage=95%, HitCoverage=90%, E-value=0.0, Identity=55%"; Hit description=P69F protein
  Pfam annotation: Domain name=PA; Domain location=365-464; Score=83.5; E_value=6.5e-22; Accession=PF02225.12; Description=PA domain
  Pfam annotation: Domain name=Peptidase_S8; Domain location=128-600; Score=75.6; E_value=1.6e-19; Accession=PF00082.12; Description =Subtilase family
  Pfam annotation: Domain name=Subtilisin_N; Domain location=39-121; Score=54.4; E_value=3.8e-13; Accession=PF05922.7; Description =Subtilisin N-terminal Region
  Pfam module annotation: Pfam domain module=PA::Peptidase _S8::Subtilisin_N; Domain location=365-464::128-600::39-121
RKLLLNMDAFLFIVFTFVLSFQTHFAQGSELPRTTSSSKTYIIHVKGPQDKSLDQTEDLESWYHSFMPPTIMSSEEQPRMIYSYLNVMSGFAARLTEEELIAVEKKDGFISARPERILHRQTTNTPQFLGLQKQTGLWKESNFGKGIIIGVLDTGITPGHPSFSDAGMSPPPPKWKGRCEINVTACNNKLIGVRTFNHVAKLIKGAEAAIDDFGHGTHTASTAAGAFVDHAEVLGNAEGTASGIAPYAHLAIYRVCSKVCRESDILAALDAAVEDGVDVLSISLGSKRAKPFFDHGIAIGTFAAMQKGIFVSCAAGNDGPLPGSVINGAPWILTVGASNINRSIAATAKLGNGQEFDGESIFQPSDFSPTLLPLAYAGMNGKQEDAFCGNGSLNDIDFRGKVVLCEKGGGIEKIAKGKEVKRAGGAAMILMNDEKSGFSLNIDVHVLPTTHVSYDAGLKIKAYIYSTATPTATILFKGTIIGNSLAPVVTSFSGRGPSLPSPGILKPDIIGPGLNILAAWPFPLNNNTASKSTFNIMSGTSMSCPHLSGVAALLKSSHPHWSPAAIKSAIMTSADIISHERKHIVGETLQPADVFATGSGYVNPSRANDPGLVYDIKPDDYIPYLCGLGYKDTEVEIIAGRTIKCSETSSIREGELNYPSFSVVLDSPQTFTRTVTNVGEANSSYVVTVSAPDGVDVK

SEQ ID NO: 160912 - protein, 250 aa, Glycine max
  Coding DNA Sequence Number=SeqID_44134
  Gene Ontology: Mol. function=DNA binding; Biological process=DNA integration
  Homolog annotation: Hit_ID=Q1SDN3; Match level="QueryCoverage=52%, HitCoverage=10%, E-value=1e-34, Identity=53%"; Hit description =Polynucleotidyl transferase, Ribonuclease H fold
MDTLLKIIEKILAIQIIFHRIEEEEAELFMVMVEAQMLTEAAKCAIIVVSLTTLRQSASRNMDIHQDIVYIRRLEISTKKMIGTVDVETDSPSPTPLPPQPEPIFVDQPYTETTFFEHSLRRSDRVRTRPIKYNDYQTNFTNNPGTKHPISSVISYNKLSSHYHSFILNVSTNFEPKSYTEACKHDSWVRAMHDEIFALERNHTWVLTDLPQNKNVIGCKWVYKIKHNVNGSIERYKARLVTKGYTQIEG

SEQ ID NO: 160913 - protein, 111 aa, Glycine max
  Coding DNA Sequence Number=SeqID_44135
  Gene Ontology: Mol. function=protein serine/threonine kinase activity; Biological process=protein amino acid phosphorylation
  Homolog annotation: Hit_ID=Q1S9G6; Match level="QueryCoverage=75%, HitCoverage=17%, E-value=2e-19, Identity=64%"; Hit description =Protein tyrosine kinase, putative
MVKASDPKKMEEAEVKVEIGGVQHHRNSELVSVEDLDIGWGRLWYTIWEVELATRGFAEGNVIRERGYTVVYRGVLHDASVVAVKNLLNNKKSIQLNLAKSNTILGYEKES

SEQ ID NO: 160914 - protein, 106 aa, Glycine max
  Coding DNA Sequence Number=SeqID_44136
MVRKALPTGDNLGRRNIEGQESGCNCPFCWGIEESLDQILLCCASISLVKRSKTTLAYCVVTRGRFTLIVQETNSDLREGSTLSGGRIVRGGQFYYSGKIETINWR

SEQ ID NO: 160915 - protein, 343 aa, Glycine max
  Coding DNA Sequence Number=SeqID_44137
  Gene Ontology: Mol. function=DNA binding; Cellular component=nucleus; Biological process=regulation of transcription, DNA-dependent
  Homolog annotation: Hit_ID=Q9SEC4; Match level="QueryCoverage=97%, HitCoverage=98%, E-value=2e-45, Identity=59%"; Hit description=Myb -related transcription factor
  Pfam annotation: Domain name=Myb_DNA-binding; Domain location=19-66; Score=47.9; E_value=3.3e-11; Accession=PF00249.21; Description=Myb -like DNA-binding domain
  Pfam annotation: Domain name=Myb_DNA-binding; Domain location=72-184; Score=7.5; E_value=0.95; Accession=PF00249.21; Description=Myb-like DNA-binding domain
  Pfam module annotation: Pfam domain module=Myb_DNA-binding::Myb_DNA -binding; Domain location=19-66::72-184
FCVSAMGRQPCCDKLGVKKGPWTAEEDKKLIKFILTNGQCCWRAVPKLAGLRRCGKSCRLRWTNYLRPDLKRGLLTEAEEQLVIDLHARLGNRARALKVKAGKEGAKGGCGRRWRPRVPFEHYKKTLHVNHRAVEKAMFAVIFDVTEAVGTSIAATTNPTWSKIAARLPGRTDNEIKNHWNTHIKKKLLKMGIDPVTHEPLNKQAAASSQDSSSSPAEHLPQPGNNLDDQVKETNGVLLNSEENSSSSQAENSSGDDSLLLESICSDDSLLNSMWLDETPLVEALWDTTPNLENTNNNMSLLPSWEENCAWLLDCQDFGIHDFGFNEIEANALQTVGMKEEGH

SEQ ID NO: 160916 - protein, 73 aa, Glycine max
  Coding DNA Sequence Number=SeqID_44138
MLGVRENTGYRKKFPYKCLGVATCTQHYCWGTQQTVKWRNCPSAIILPEEGSSGKFPEIIFPESFRKNLLPEE

SEQ ID NO: 160917 - protein, 259 aa, Glycine max
  Coding DNA Sequence Number=SeqID_44139
  Gene Ontology: Mol. function=RNA-directed DNA polymerase activity; Cellular component=nucleus; Biological process=RNA-dependent DNA replication
MERNENGKQRVEKQWERERGHKYCKQNKKRPCLSQRIMDDKAIIPIWGRRNMLNELYVEGVWEDDPYRLKDEVFKFYDERFKEVEEERPRLDGGTLRGTLMSFMPMGSFQGVAIGPLYLSLQKWTFPRTWVNIGLSPLWVACIKQSAFLSGRSLLHSALMANEVVKKAKRRRKSCMIFKVDYEKVYVFVNWNILFYMLGRLGFNSKWIIWVKECLESNFVSILVNRSPTKEFKILKELRQRDPIAVFLFNVVMKGWVVS

SEQ ID NO: 160918 - protein, 69 aa, Glycine max
  Coding DNA Sequence Number=SeqID_44140
MFGGTGYSDTYIYKRSQLVGVSNQAKPCGLVQPVLQKSWAGLKFETRKPFRPVPFSLQIWRTTGNQLAD

SEQ ID NO: 160919 - protein, 47 aa, Glycine max
  Coding DNA Sequence Number=SeqID_44141
MSEVLAKPLGTTTRCGSGGSREREREETQSIKSGEIRSVGELKSEAA

SEQ ID NO: 160920 - protein, 138 aa, Glycine max
  Coding DNA Sequence Number=SeqID_44142
  Gene Ontology: Mol. function=carbonate dehydratase activity; Cellular component=extracellular region; Biological process=one-carbon compound metabolic process
  Homolog annotation: Hit_ID=Q84UV8; Match level="QueryCoverage=97%, HitCoverage=47%, E-value=1e-33, Identity=53%"; Hit description =Bifunctional monodehydroascorbate reductase and carbonic anhydrase nectarin-3 precursor ...
  Homolog annotation: Hit description=(EC 1.6.5.4) (EC 4.2.1.1) (Nectarin-III) [Contains: Nectarin-2]
MEKLATLVLICCLFTALLFLSLPVMSQEVEDESDFSHDEKSENGPSRWGDIHPKWSLCNNGSMQSPIDLLNERVQIGSHLGRLQMNYQPSNATIKNRGHDIKLEWVAGSGYLQTNETKYVLKQCHWHSPSEHTIDMAK

SEQ ID NO: 160921 - protein, 236 aa, Glycine max
  Coding DNA Sequence Number=SeqID_44143
  Subcellular localization annotation: CTP_CleavageSite=21; ConfidenceScore=5.08e-01
MAIDFWSNKKTFGYAPPNFVSCNSHFICVDKNISFSRNLHSERFSRHTLFQNGHPGSTNPSPLRELSIMGEFTIQISNDLVNQLVDDAVPKKKTRKTRRKVARETEKPQSNETIKPDSAVTPGWPVQSPLFLPATLPVQPVHSELEGIQSVLQESERVLERLQKQEENMLQEVTQKAKDLHDKEYKLPNPKPEPCMAERLATLSCYKEHIKDPLKCASLVTGFADCLRRFGRLGDK

SEQ ID NO: 160922 - protein, 490 aa, Glycine max
  Coding DNA Sequence Number=SeqID_44144
MAYAELSAAREDRLKAALAKHVAAQRRLESTLDALLLKLPLRTNHHYPSSSVQSPLPPPSPMPTPPLLPTLIQSRPTPLPAFHLSNLGHVSAAIPISDHLFSVVLSYGHAIAPHDKHGENRDITLFKRGPGFFGTIMVSRKCLPAVFALWTGAKTSAFLQDKPWDPGITFGSHALQPQHLEDKALDPGPRNQFLSCRLVTFGAFVESPWLSSMTAIPASTTATHTTRQTELKYRLGQTYQLNLATDVDTLATTIDNLLQRLGPRNPIPHFSSSIPAKAPISAIIISTPRLMLSPPPTPTPPPMPPPTSMSIAPPCPTPVQPFTAPLPTPLPMPAAYLPDLQHTRATVSCNKLFGTVASYGRATTPNDKALEGRNMTLFEIGTKYHGHTMVACKHQPTMFALWTAADPEESRRNRPWDSGIDFGSHYLKPNTLRTRCFRWARECYEEHQGSAGSKLYADQKKSHNSSLLKRLSATGIAEAHAACTVREGSA

SEQ ID NO: 160923 - protein, 100 aa, Glycine max
  Coding DNA Sequence Number=SeqID_44145
MLKILQAIPNSGTSWQVPVGTLPLLIPNWKVLVQWEGLSTDDTSWEEWDKFKATYHLEDKVFLDGIGNVKKKKMQQNLTTGPNERPKRKIIPPRHLRDFV

SEQ ID NO: 160924 - protein, 275 aa, Glycine max
  Coding DNA Sequence Number=SeqID_44146
  Gene Ontology: Mol. function=monooxygenase activity; Cellular component=membrane; Biological process=electron transport
  Homolog annotation: Hit_ID=Q0H212; Match level="QueryCoverage=98%, HitCoverage=69%, E-value=1e-104, Identity=64%"; Hit description =Abscisic acid 8'-hydroxylase
  Pfam annotation: Domain name=p450; Domain location=1-267; Score= -127.7; E_value=3.7e-05; Accession=PF00067.12; Description=Cytochrome P450
MFVLNKDQLFKPTFSASKERMLGKQAIFFHQRAYHANLRMLVLRTIMPEAIKDIISEIESIAQSCLKSWEGKYSILNACTSHTRRARKELAQILAQIISTRRNMKQDRNDLLGLFMSEKAGPTDEQIIDNIIGVIFAARDTAATVLTWIVKYLGENPHILEAVTESIIRGKEENGEQIGLNWSDIKNVLMTSRVIQETLRIASILSFTSREAIEDVEIQGYLIPEGWKVLPLFRNIHHRPDNFKEPEKFDPSRFEVPPKPNTFMHLAMGSMDVRQ

SEQ ID NO: 160925 - protein, 66 aa, Glycine max
  Coding DNA Sequence Number=SeqID_44147
MVEQKESQEFWKRKIATDLDSMPLVNATSHLMVILRIETPRRQNLTSAECLKLESIFGGNMAEHRA

SEQ ID NO: 160926 - protein, 166 aa, Glycine max
  Coding DNA Sequence Number=SeqID_44148
MMKWVNLGSSIEEGSKGLQFWAWKEGRFGILRGAKVMHFNGRSISTRNKLVCQGRIPWEKNKKPWEMDVCQGFCQGLNPWEKRPSQISLPGISSLAKKRGAGPGKIPGKIPVKIPVLAPVFSLTHLHTFLTRCCTDTSQIIQCQGFCQGQTPVKRDIFFLKKKFNK

SEQ ID NO: 160927 - protein, 582 aa, Glycine max
  Coding DNA Sequence Number=SeqID_44149
  Gene Ontology: Mol. function=RNA-directed DNA polymerase activity; Biological process=RNA-dependent DNA replication
VEEHVIFAKFPEDFFQVRHMLGYALRVDDHVIHIYLNVSSDLMFKDSFHQSLDESWSSYIQNRLPGSLALGTQTFHRLAYRCWAEASLWQIMSGWIPGMSDGSDKFFNGFWASVGGVVLRIYVKLTVQVGLVDGYGATFRLSTQHSYAYFWSALTVTISIVSVGNFIFKCGMETMVPSSLSVLLPTKTKYNDPGHHEVRYDDGDNQRVIFLDGVDPLEVPIRESDRRETSVVAHAVVISVFICLDLRLFFCLLLGSCATFFYVLWVLLLLGDCLGCVMLVPGPFGERLVLVWHMPLVRLVQVGLDVCFVLFELMSDCLRTCRGIVRELGMQCYLGVKISDLDDCMPKSVHEFSEGLVVCLLQTGQGDRGHAVRHAGGVLCIESFDEGVEAVYGPKWESTIPGGSRVRGQTEVDVVEWGPELHTSAWKGVVVAFADNSRLIGNSRELIDNVRDKHLLIDKSPTPRKFLSESELLLGFECASGLKVVRPWLKLSARQSKKIMRPATFGVILLLMLSVSMCMGRDKKTFKDQMNVRNEKFPNHENENHNPGFAYGGRSVNNHHYIPRQDFNNNDGADKIGNGSGY

SEQ ID NO: 160928 - protein, 937 aa, Glycine max
  Coding DNA Sequence Number=SeqID_44150
  Gene Ontology: Mol. function=uroporphyrinogen-III synthase activity; Cellular component=nucleus; Biological process=tetrapyrrole biosynthetic process
  Homolog annotation: Hit_ID=Q1T097; Match level="QueryCoverage=69%, HitCoverage=53%, E-value=0.0, Identity=86%"; Hit description =Transposase family tnp2, putative
  Pfam annotation: Domain name=Transposase_21; Domain location=295-521; Score=446.9; E_value=2.6e-131; Accession=PF02992.5; Description =Transposase family tnp2
  Pfam annotation: Domain name=Transposase_24; Domain location=684-816; Score=51.9; E_value=2.1e-12; Accession=PF03004.5; Description=Plant transposase (PttaEnSpm family)
  Pfam module annotation: Pfam domain module=Transposase_21::Transposase _24; Domain location=295-521::684-816
WMYDRTFPGRTGLKPHFVQGVEGFISWAWAQEICTTEGGIRCPCLKCKCRYIIADPGHVNQHLKRVGFMPDYWIWIYNGEKFQNFGVEVNAQASTSHGGTNVEYNEEEGNREQFNMMDDMVADALGVELSYGDDVEDDQEEQLPNEKAQRFYQLLSECNTPLYEGSSHSKLSMCVWLLAHKSNYGSPDAGVDDVTKMLKAATLFKDNLPASYYDAQRLVMKLGLAVKKIDCCRNGCMLFYDNEFGINDGALEECKFCQSPRYSVRKQKRVAVKSMFYLPIIPRLQRMFASMKTASQMTWHHSNGILGVMRHPSDGEAWKHFDRVHPDFAADPRNVRLGLCSDGFTPYIQASAKPYSCWPVVVTPYNLPPEMCMTKPYMFLSCIVPGPDNPKAGIDVFLQPLIDDLKRLWVGEWTYDISRKQNFRMRAALMWTINDFPAYGMLSGWSTHGRFACPHCMEHTKAFTLDNGGKSSWFDSHRRFLPHNHPFRRSRNGFKKDERVLDGPPPKITSEEVWLRVCDYPKVTDFGQTVPIPGYGVDHNWTKKSVFWDLPYWKDNLLRHNLDVMHIEKNVFDNIFNTVMDVKGKTKDNEKARKDLELYCKRRDLELKPQPNGKLLKPKAIYSLTAQEAKLVCKWLKDLRMPDGYSSNLARRNFHIRAAARLSDMLRNARVRYERKRTRPHWIGEPLMAQLVDYWASADFKEKSEKAKKNRASEKGGCIHTGGCISNAEHARRLAKKLGREPYINELHKQTHTYSSGQFVDDRSRICQEEYDRQLAEALSRGCSVDEALSLRTWTKVAGDKSKGRLYGAGNLAGNYRKGIAATLKFTLNAGEGSSRQPELTPEMREMIQKLTQEQLAVQMASQEQLVQQLLQKQQDYFQEQLSQFRQAQGWPTREQQGTGTSQRNAQNVRAPILDDNHDPYEVYGENEEDVETEEED

SEQ ID NO: 160929 - protein, 126 aa, Glycine max
  Coding DNA Sequence Number=SeqID_44151
MRFGAIAFVLMLAFCCCTGSDRWRNIEVKMHGKNKQVSSENNDHHSIPLKDYGKPGSGHHDVTAADDNNDHHYIPRKDFGTIASIIVIIRKIVLVMANLAEELKLIPGPGIDNLLTRIMPSILATN

SEQ ID NO: 160930 - protein, 367 aa, Glycine max
  Coding DNA Sequence Number=SeqID_44152
  Gene Ontology: Mol. function=RNA-directed DNA polymerase activity; Biological process=RNA-dependent DNA replication
MDELSEGAKGYIQLEEMSKFKNKVRQTGHKLEKHKANIKADLHKSDKRHMPDKHQPLSKGPRYEHYTPLTKNCTTILEEAFNLEVPIWLPQTKPPRPGSDTTKYYRYHRGIGHNTKDCWALKDKIEKLIQTVTKQEQDPEDIKKSSTGTKKQTKEEPKIKADKDTNNNGVSDNLHKNENPPNKSEDSSTDILYWKTFKRVEVYPDTVHPHVGLLFVCERVDTRGYVDLMTTFGQGKLSKSFNIRYLLVNADTLYFVLVGKRTLNELGTIVSMPHLKMKFPTLTMEIVTVKADQKHSSNDRERMVSNLSPDRLPTQLGHYNSNLNPGSARSSVRTSPVTSTGASSTCYAEMWIYLPYIHLTCQESIPT

SEQ ID NO: 160931 - protein, 223 aa, Glycine max
  Coding DNA Sequence Number=SeqID_44153
  Homolog annotation: Hit_ID=Q8S747; Match level="QueryCoverage=77%, HitCoverage=47%, E-value=2e-27, Identity=44%"; Hit description =Putative acid cluster protein 33
MKTWPKDTESLLWKSKRGHVEIRGRGYYLGGRMVETLSRDDLASRLSLTTDAASVEPLLLSDSFITIMDTNDYCAIPQQLRDQLGERYPEARRAYLKTGGDFPFLSKTGGDFPFLSRPDEDNLHLQLHLRRVDVEARPDLVHNVPKGDIGGSPGKENNRDGSDKSHKDDKGGSENPPAKYEINPTSPESSGSGNLDKQTLDSSERFHLDHELTLYAFPGGFTR

SEQ ID NO: 160932 - protein, 429 aa, Glycine max
  Coding DNA Sequence Number=SeqID_44154
  Gene Ontology: Mol. function=racemase and epimerase activity, acting on carbohydrates and derivatives; Cellular component=integral to membrane; Biological process=carbohydrate metabolic process
  Homolog annotation: Hit_ID=Q1T6B0; Match level="QueryCoverage=98%, HitCoverage=98%, E-value=1e-153, Identity=63%"; Hit description=NAD -dependent epimerase/dehydratase; TonB box, N-terminal
  Pfam annotation: Domain name=3Beta_HSD; Domain location=95-380; Score= -81.0; E_value=5e-07; Accession=PF01073.9; Description=3-beta hydroxysteroid dehydrogenaseisomerase family
  Pfam annotation: Domain name=Epimerase; Domain location=94-351; Score= 215.8; E_value=1e-61; Accession=PF01370.11; Description=NAD dependent epimerasedehydratase family
  Pfam annotation: Domain name=NAD_binding_4; Domain location=96-322; Score=-58.1; E_value=7.1e-05; Accession=PF07993.2; Description=Male sterility protein
  Pfam annotation: Domain name=Polysacc_synt_2; Domain location=94-398; Score=-196.8; E_value=0.091; Accession=PF02719.6; Description =Polysaccharide biosynthesis protein
  Pfam annotation: Domain name=RmlD_sub_bind; Domain location=93-421; Score=-155.7; E_value=0.00068; Accession=PF04321.7; Description=RmlD substrate binding domain
  Pfam annotation: Domain name=adh_short; Domain location=92-262; Score= -33.4; E_value=0.00087; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=95-380::94-351::96-322::94-398::93-421::92-262
  Subcellular localization annotation: CTP_CleavageSite=35; ConfidenceScore=5.10e-01
MSQVNEHHHAPSTPGKLKPEKSPYNHRLRIHSSLSKLTLWSSFFLAFILFLFILSPPSPSASPRRSLGDSWGGPHWEKRVAKSARRSSPSSLSVLVTGAAGFVGSHVSLSLKRRGDGVLGIDNFNRYYDPALKRARQRLLDRAGVFVVDADLNDAALLRKLFDVVPFTHVMHLAAQAGVRYAMQNPQSYIHSNIAAFINLLEASKSANPQPSIVWASSSSVYGLNSKVPFSEKDRTDQPASLYAATKKAGEEIAHSYNHIYGLSITGLRFFTVYGPWGRPDMAYFFFTKDILKGKQIAIFESPDGGTVARDFTYIDDIVKGCLGALDTAKKSTGSGGKKKGPAQFRVFNLGNTSPVPVTELVAILEKLLKVKAKKKVLPMPTNGDVKFTHANISLAHRDLGYRPTTDLETGLRKFVKWYLEFYSKKTSW

SEQ ID NO: 160933 - protein, 129 aa, Glycine max
  Coding DNA Sequence Number=SeqID_44155
  Gene Ontology: Mol. function=oxidoreductase activity; Cellular component=membrane; Biological process=electron transport
  Homolog annotation: Hit_ID=Q2MIZ4; Match level="QueryCoverage=90%, HitCoverage=30%, E-value=2e-17, Identity=48%"; Hit description =Cytochrome P450 monooxygenase CYP706A12
MAERTVLHFLATLVHLFDWTIPQGEKLESIGTVTAQHWFLHCVSSFPWHGSTSSNSPTTLRRGFPIFGNLLSLDPDLLHTYFAGLTQIHGPILKLRLGSKLTSPGMVLEVLKETDTVFASHDVTAAAPT

SEQ ID NO: 160934 - protein, 200 aa, Glycine max
  Coding DNA Sequence Number=SeqID_44156
  Gene Ontology: Mol. function=oxidoreductase activity; Cellular component=membrane; Biological process=electron transport
  Homolog annotation: Hit_ID=Q2MIZ4; Match level="QueryCoverage=85%, HitCoverage=57%, E-value=5e-33, Identity=40%"; Hit description =Cytochrome P450 monooxygenase CYP706A12
MVFESRHAHIKEMQDYVYNLKEYWKSHSTTLVLALCIIISTAWLCFLKLTNNTQKRLPSGPSGLPIFGNLLSLDQDLLHTYFVGLAQIHSPILKLRLGSKLTSPAMALEVLKEIDTIFASHNVTTAERAAIYNGFDIAWTPYWPSGGCCGRCFLTVINVITNKMWGGPVEGAERESMWGGVQGASDGDDAAFGKPNVSDF

SEQ ID NO: 160935 - protein, 58 aa, Glycine max
  Coding DNA Sequence Number=SeqID_44157
MLRATRKENTLDYHDVSDTKRNKDATSSSKSPNPYVKIHDKGKMLMMKVFIMLLSMER

SEQ ID NO: 160936 - protein, 118 aa, Glycine max
  Coding DNA Sequence Number=SeqID_44158
MAMVPKVRSPLFKELLVATISNADFALPVGCLDTKGNEEKASSSNSPNSSVAIHDKGKTIDEVAQGKTSIYEDQSGLKSWLGESHNHGNDDMGVVEEDFDIEGQNICTICLDTRNSGL

SEQ ID NO: 160937 - protein, 185 aa, Glycine max
  Coding DNA Sequence Number=SeqID_44159
  Gene Ontology: Mol. function=structural constituent of ribosome; Cellular component=ribonucleoprotein complex; Biological process =translation
  Homolog annotation: Hit_ID=Q6L4B2; Match level="QueryCoverage=70%, HitCoverage=80%, E-value=3e-67, Identity=95%"; Hit description=40S ribosomal protein S13, putative
  Pfam annotation: Domain name=Ribosomal_S13_N; Domain location=51-105; Score=107.7; E_value=3.5e-29; Accession=PF08069.3; Description =Ribosomal S13S15 N-terminal domain
  Pfam annotation: Domain name=Ribosomal_S15; Domain location=110-181; Score=75.9; E_value=1.3e-19; Accession=PF00312.12; Description =Ribosomal protein S15
  Pfam module annotation: Pfam domain module=Ribosomal_S13_N::Ribosomal_ S15; Domain location=51-105::110-181
MLRVPSSCPGPIRPAQRAKLGFRVVECAEERRSRNPNQKKRSFKRVTATSHGSKGISSSALPYKRTPPSWLKISSQDVEENICKFAKKGLTPSQIGVILRDSHGIAQVNSVTGSKILRILKAHGLAPEIPEDLYHLIKKAVSIRKHLERNRKDKDSKFRLILVESRIHRLARYYKKTKKLPPVWK

SEQ ID NO: 160938 - protein, 489 aa, Glycine max
  Coding DNA Sequence Number=SeqID_44160
  Homolog annotation: Hit_ID=Q33AQ0; Match level="QueryCoverage=77%, HitCoverage=71%, E-value=2e-86, Identity=66%"; Hit description =Esterase/lipase/thioesterase family protein, putative, expressed
  Pfam annotation: Domain name=Abhydrolase_1; Domain location=143-349; Score=-9.2; E_value=0.041; Accession=PF00561.10; Description =alphabeta hydrolase fold
MESLLWKSKKGHVEIRERKRLLPWVEEWWGQKRFYRVCCLEGKGYRVISVDIPRVWNNTEWIQAFEKFLDAIDVHHCHKAQWCVYMAEFLPSTMFCHLSLITLSIVHHIILLGAVTCYNFGIWILCEMSIHMYPKEGMVPRHFQGFIFEAKFFCNIFEDPACEPKYISIPPIQASLLTKLKIHLYGTSLGGFLAQLFAQQRPRRVRSLVLSNTFLETRSFSAAMPWAPIVSWTPSFLLKRYVLTGIRDGPHEPFIADSVDFVVSQVETLSREDLASRLSLTTDAASVGPLLLSDSFITIMDTNDYCAIPQQLKDQLGERYPEARRAYLKTGGDFPFLSRPDEVNLHLQLHLRRVGVEARPDLVHNVPKGDIGGSHSKENNQDDSDKSHKDDRGGSENPPAKYEINPTCPESSGSGNLDKQPLDSSKRCHLDHELTLYAFPGGFTREKRIVPPGTPLHFVWEYIVLFCLLRHVSCLYIIWNYSLEFRQVV

SEQ ID NO: 160939 - protein, 683 aa, Glycine max
  Coding DNA Sequence Number=SeqID_44161
  Gene Ontology: Mol. function=protein-tyrosine kinase activity; Cellular component=integral to membrane; Biological process=protein amino acid phosphorylation
  Homolog annotation: Hit_ID=O49654; Match level="QueryCoverage=96%, HitCoverage=96%, E-value=0.0, Identity=51%"; Hit description=Leucine rich repeat receptor kinase-like protein
  Pfam annotation: Domain name=LRRNT_2; Domain location=23-64; Score =40.2; E_value=6.9e-09; Accession=PF08263.3; Description=Leucine rich repeat N-terminal domain
  Pfam annotation: Domain name=LRR_1; Domain location=116-138; Score =12.7; E_value=1.2; Accession=PF00560.23; Description=Leucine Rich Repeat
  Pfam annotation: Domain name=LRR_1; Domain location=140-162; Score =16.8; E_value=0.08; Accession=PF00560.23; Description=Leucine Rich Repeat
  Pfam annotation: Domain name=LRR_1; Domain location=164-186; Score =15.8; E_value=0.16; Accession=PF00560.23; Description=Leucine Rich Repeat
  Pfam annotation: Domain name=LRR_1; Domain location=188-210; Score =15.9; E_value=0.14; Accession=PF00560.23; Description=Leucine Rich Repeat
  Pfam annotation: Domain name=LRR_1; Domain location=212-234; Score =20.7; E_value=0.0051; Accession=PF00560.23; Description=Leucine Rich Repeat
  Pfam annotation: Domain name=LRR_1; Domain location=92-114; Score =10.3; E_value=3.3; Accession=PF00560.23; Description=Leucine Rich Repeat
  Pfam annotation: Domain name=Pkinase; Domain location=408-673; Score =5.6; E_value=6.8e-09; Accession=PF00069.15; Description=Protein kinase domain
  Pfam annotation: Domain name=Pkinase_Tyr; Domain location=408-673; Score=1.0; E_value=1.6e-12; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=23 -64::116-138::140-162::164-186::188-210::212-234::92-114::408 -673::408-673
MSFLHLFFHLFLLVAFIPQIVHGNAELRALMDLKSSLDPKDKLLGSWTSDGDPCSGSFLGVVCNEHNKVANISLPGRGLSGRVSPAVAELKCLSGLYLHYNLLSGDIPGEIANLKELLDLYLNFNNLSGTIPSDIGNMTSLQVLQLGYNQLEGTIPEELGSLKQLNVISLQHNKLTGEIPQSLGHLEKLRKLYLSYNNFSGTIPVKLADVANLEVLDIQNNHLSGTIPSALQRLREGFQGANNRDLCGDDFSALKTCNKDRIFGVSQISAPNISIYRNPPITFPKPVNAHLHCNQTHCSKSRSFLLLVIAASVTTTVITLISSGIFIFVRYRRQRQKVRNPSDYSEGQHSPYQPKEFYRSSSPLVNLEHYYTGWDSLADGHNESGLSLEYLNRFRFNIDEIESASGHLSEANLLSKSKFSAVYKGILRDGSLVAIRSISVTCCKAEEGEFLKGLSLLTSLRHENIVKMRGFCCSRSRGEWFFVCDFATRGNLSQYLDKEDGSAHVIEWSKRVSIIRGIAKGIGYLHSNEASKPTIVHQNISVEKVILDHEFNPLITDAGLPKLLADDVVFSALKASAAMGYLAPEYLTTGRFTEKSDIYAFGVIVLQVLSGKVLMGGTIRVAVEAFRFEDFVDTNLKGDYSKSEAAILSKLAIQCTLEVPEQRPTMVEVIQELTMLPNPSHSS

SEQ ID NO: 160940 - protein, 116 aa, Glycine max
  Coding DNA Sequence Number=SeqID_44162
  Homolog annotation: Hit_ID=Q339Q0; Match level="QueryCoverage=75%, HitCoverage=10%, E-value=2e-23, Identity=61%"; Hit description=Large secreted protein, putative, expressed
MYIDKGDDGPGWSTTWKALLWAHLHNSEHAYCMIKHFIVLVEPDHGFGFEGGLFSNLFTAHPLFQIDANFGQGQSLFSLTLVEAMPSKVILMMPKNQELSKFQRFKNLVSRIKIQE

SEQ ID NO: 160941 - protein, 195 aa, Glycine max
  Coding DNA Sequence Number=SeqID_44163
  Gene Ontology: Mol. function=RNA-directed DNA polymerase activity; Biological process=RNA-dependent DNA replication
  Homolog annotation: Hit_ID=Q9FJR9; Match level="QueryCoverage=51%, HitCoverage=15%, E-value=1e-19, Identity=49%"; Hit description =Similarity to maturase-related protein
MGGGEDKDDGVEDGVGGGQPSYGMFSRVEKHMNLVRTKMIGWKMESSVSTGITMDIESLISDSQHYPLLNQIDNACHDMSSLEDNSNADGFGFGLGEGVVVSFVFGGFDEELELGDLLAFHIEDDIAEGEEGGATGVGAGGDLLVGEDPEVEAAEEAGEVCDGMVGVVEVIDPHLTAKGGTVFFEGGGRGEAARG

SEQ ID NO: 160942 - protein, 591 aa, Glycine max
  Coding DNA Sequence Number=SeqID_44164
  Gene Ontology: Mol. function=aminoacyl-tRNA ligase activity; Cellular component=endoplasmic reticulum; Biological process=translation
  Homolog annotation: Hit_ID=Q10HJ4; Match level="QueryCoverage=58%, HitCoverage=55%, E-value=1e-155, Identity=73%"; Hit description =Expressed protein
  Subcellular localization annotation: CTP_CleavageSite=57; ConfidenceScore=5.05e-01
MAWRKGCEEVANSKPLFLTIYTVVIIGIVVSSFFVFSAIYSTNPPSAQSSAWLSSISSDETRVTDQTLKVSRSAAVLIVPTPSPGSQNEWPTSIWDDPPPNKKMPPLEDFRLTKKLVQQRVKDNAVIVTFGNYAFMDFILTWVKQLRDLGVSNFLVGAMDTKLVEALYWKGIPVFDMGSHMSTVDVGWGSPTFHKMGREKVILIDSILPFGFELLMCDTDMVWLKNPLPYLARYPEADVLTSSDQVIPTVVDDSLENWPEVSGAYNIGIFHWRPTESAKKLAKQWKEMLLADDQIWDQNGFNDIVHRQLGPSVDDESGLVFAFDGKLKLGILPASIFCSGHTYFVQAMYQQLRLEPYAVHTTFQYGGTEGKRHRLREAMLFLDPPEYYNPPGGFLSFKPHIPKNLLLSGEHNVESHFTLVNYQIKQIRAALAIASLLDRTLAKEASTQKNSDEGETAGLGSSELVGLIAIRAAGTEIRCTVKRGKQKPEGIKRGKHQTNMEWPLTLVTGQKGHWRTAEVARKVINVAGKGAASRRVHQNAKNKGKKFARKGTVSIKVHRGQWVPGGGQFLLFPQPSSRYHVKMRETEGYLD

SEQ ID NO: 160943 - protein, 134 aa, Glycine max
  Coding DNA Sequence Number=SeqID_44165
MEWFYRISHPFMSLPKLGEPPIHPPVVHDDTYIIPNPPVLLVRSAFMPQQPTPATVDVDMPRHAMAACQKVAESLEHIINMRMVTARTDAYTLTEHCLRLARVSLSKEMFMFAQDEGGIHRTEMVVDDNDDSWD

SEQ ID NO: 160944 - protein, 70 aa, Glycine max
  Coding DNA Sequence Number=SeqID_44166
MGHREWSVRVVLQQYAQLKWSRVVPELDERLQLCTCLRSNNSNYGYAVEIQRGSGPARLRKGPGLCAGEA

SEQ ID NO: 160945 - protein, 59 aa, Glycine max
  Coding DNA Sequence Number=SeqID_44167
MDIRRYMSVEGEDEPSTTTKEKTHEEDNGENDPLFVHRRTPHGEDDGVKNVCVEEKTLT

SEQ ID NO: 160946 - protein, 279 aa, Glycine max
  Coding DNA Sequence Number=SeqID_44168
  Homolog annotation: Hit_ID=Q2HRX8; Match level="QueryCoverage=35%, HitCoverage=16%, E-value=1e-13, Identity=38%"; Hit description=IMP dehydrogenase/GMP reductase
  Pfam annotation: Domain name=DUF1723; Domain location=134-183; Score =52.9; E_value=1.1e-12; Accession=PF08330.1; Description=Protein of unknown function (DUF1723)
MVRTRGLGRALGKVISKALGREDDHHSDDVPQRRRPTASARRQREAAPIVEHEPVVAADDPVIAADVHAPGADTGDDAEGFPGGPRDPSVLTEYANHVAVSIWNGEKFGRPAHEIEGLVAAIRLSSLIACSVNTSNRGLIFAFVEKWHRKTSSFHLPVGEVSITLDDVTSLLHLPIVGAFHTFEPLHVNEDVLMLVELLEVSEEVVRAETTQCHGPYCWIYEHFPSVAECMADPDYDEVSPRASTMGARCRQALTREGHAPVQIRPEYSYRGCRFMGVI

SEQ ID NO: 160947 - protein, 282 aa, Glycine max
  Coding DNA Sequence Number=SeqID_44169
  Pfam annotation: Domain name=DUF1442; Domain location=83-282; Score =283.8; E_value=3.2e-82; Accession=PF07279.2; Description=Protein of unknown function (DUF1442)
MTGKALLTVRQRDKNNICEEKQAEKNRSYPNLTTTYSQSQTEKNQSEENETSLVPRDSIQSIHRNSSICKHKHALCVFYGIISFIYCRIFRESGVAELVSAMAAGWNAQLIVETWSEGGVMATSVGLAVARTHTGGRHVCVVPDERSRSKYAERMGEAGMSAEIVVGEAEEVMEGLAGGIDVMVVDSTRVNFSRVLRLAKLSNKGAVLISKNVNSATNSATSGFRWRSVLEEGSRRVVRSVYLPVGKGLEIAHVSAIGGGSAAKKWFKHVDQQSGEVHVIRR

SEQ ID NO: 160948 - protein, 275 aa, Glycine max
  Coding DNA Sequence Number=SeqID_44170
  Homolog annotation: Hit_ID=Q1SP02; Match level="QueryCoverage=31%, HitCoverage=18%, E-value=2e-09, Identity=40%"; Hit description=IMP dehydrogenase/GMP reductase
  Pfam annotation: Domain name=DUF1723; Domain location=92-141; Score =49.0; E_value=1.5e-11; Accession=PF08330.1; Description=Protein of unknown function (DUF1723)
MVRIRGLRRALGRALGRHVSGDEKEAPQRCRQHQHVDNGQLQLQSLGRRERIELKFTSHGRKVEKFGRPTPKIEGIMVVTGLSSLITCSLETSDTGLLFAFAERWHKETSSFHLSVGELTITLKDVVSSLHLPIISAFQTFDTIDVEEVVDFLVELLKVSRQDTKDEIEKCRGAYVRLAWLRDAYHSKCDARQWTLAAGAYYCIYLGSMSISIQLHPLLQSYRIYHFLVELLFVSFNMCNLGSTSISLQLHPLLQMRITMRGNHVLVAGSAGRHY

SEQ ID NO: 160949 - protein, 236 aa, Glycine max
  Coding DNA Sequence Number=SeqID_44171
  Gene Ontology: Mol. function=translation release factor activity; Cellular component=cellular_component; Biological process =translational termination
  Homolog annotation: Hit_ID=Q10P29; Match level="QueryCoverage=72%, HitCoverage=69%, E-value=3e-53, Identity=64%"; Hit description =Immature colon carcinoma transcript 1 protein, putative, expressed
  Pfam annotation: Domain name=RF-1; Domain location=78-226; Score= -22.3; E_value=0.0034; Accession=PF00472.11; Description=Peptidyl -tRNA hydrolase domain
  Subcellular localization annotation: CTP_CleavageSite=49; ConfidenceScore=5.47e-01
MSTGTTRMLVKEMLQLSSSTLHFSSAFRALSPPLPFSIQLRRSRRPAIRCASSDSDKVSSRLSQVQHLLQQAEHRALSADQGPPPKITLDHVTVSFARSGGPGGQNVNKGGSLVVFVCADWAVNTKVDMRFNVKNAYWLSDRVREKILQTEKNRINKDGELVISSTKTRTQKDNIEDALAKLQEIIDAASHVPPPPSEDQKKKIAKMAAIGEQKRLKSKKVLSDKKAFRRSKNSWD

SEQ ID NO: 160950 - protein, 251 aa, Glycine max
  Coding DNA Sequence Number=SeqID_44172
  Gene Ontology: Mol. function=protein binding; Cellular component =cellular_component; Biological process=vesicle docking during exocytosis
  Homolog annotation: Hit_ID=Q1RVB0; Match level="QueryCoverage=99%, HitCoverage=34%, E-value=1e-119, Identity=94%"; Hit description=Sec1- like protein
MSGRKPLYRKAFVFFSSPIARELVMEIKKDAQVLPRIGALREMNLEYFTIDSQGFITNNERALVELFGDEENNRKAVACLNVMATRIATVFASLREFPFVRFRAAKSLDATTMTTFHDLIPTKLAAGVWDCLMKYKKTVPNFPQTESCELLIIDRTIDQIAPVIHEWTYDAMCRDLLNMEGNKYVHEVPSKTGGPPERKEVLLEDHDPIWLELRHAHIADGYLFHLQLKQHDPLGIDGLANARLVNGCMRR

SEQ ID NO: 160951 - protein, 52 aa, Glycine max
  Coding DNA Sequence Number=SeqID_44173
MYNRDGNKLIFVANLNEDHEPNYELLPLARGDFSLDQEAEIPIEIPKRMNIE

SEQ ID NO: 160952 - protein, 316 aa, Glycine max
  Coding DNA Sequence Number=SeqID_44174
  Gene Ontology: Mol. function=protein binding; Biological process =vesicle docking during exocytosis
  Homolog annotation: Hit_ID=Q1RVB0; Match level="QueryCoverage=95%, HitCoverage=43%, E-value=1e-136, Identity=82%"; Hit description=Sec1- like protein
MVEWIMIMSFICVQMMSFFVQIAGKINRIIRESGLRELGKLEQDLVFGDAGMKDVIKFLTTYEDTSRENKLRLLMILASIYPEKFEGEKGLNLMKVAKLTDEDTIAINNLRMLGGEPDTKKTSTSSFALKFDMHKVKKKRAARKDRSGEEETWQLSRFYPIIESLICGDWMIIIQELIEKVSKNELSKLDYPCLNDPSPTFHGTPYAGPVTQNPPAHSMRSRRTPTWARPRGSDDGYSSDSVLKHASSDFKKMGQRIFIFIVGGATRSELRICHKLTGKLKREVILGSSSIDDPAQYITKLKMLTAQELSLDDLQI

SEQ ID NO: 160953 - protein, 120 aa, Glycine max
  Coding DNA Sequence Number=SeqID_44175
  Gene Ontology: Mol. function=transferase activity; Cellular component= mitochondrial inner membrane; Biological process=protein kinase C activation
  Homolog annotation: Hit_ID=Q7XHM3; Match level="QueryCoverage=92%, HitCoverage=14%, E-value=5e-25, Identity=51%"; Hit description =Selenium-binding protein-like
  Pfam annotation: Domain name=PPR; Domain location=16-50; Score=18.1; E_value=0.031; Accession=PF01535.11; Description=PPR repeat
  Pfam annotation: Domain name=PPR; Domain location=51-85; Score=4.3; E_ value=2.3; Accession=PF01535.11; Description=PPR repeat
  Pfam annotation: Domain name=PPR; Domain location=87-120; Score=2.6; E_value=3.7; Accession=PF01535.11; Description=PPR repeat
  Pfam module annotation: Pfam domain module=PPR::PPR::PPR; Domain location=16-50::51-85::87-120
MTTYINHHCEKQISICDIIKMISAYGLHGRGEEAIITYYKMLQQGFKPDMITVVGVLSAYSKAGLVDEGISIYKSLMTKYKIKPTVEICACVVDMLGRSAQLDQALEFIKEMPLDPSPIV

SEQ ID NO: 160954 - protein, 208 aa, Glycine max
  Coding DNA Sequence Number=SeqID_44176
  Homolog annotation: Hit_ID=Q1SQF0; Match level="QueryCoverage=22%, HitCoverage=3%, E-value=1e-12, Identity=69%"; Hit description=Paired amphipathic helix
MTENYKSNNNNCKSNNNNNNNFKQKQQKHDDIIQSIAAGNKQPLVPHLEFEYSDVGIHEDLYKLVHYSCEELFSNSTSHIILAYLPQFGYWVDQPRVAEVHQDHRHCNEVNAKAHKGIQVGLKEVKVSHLYFTDDSDLFLEEYNDPFVNVLLLIILSHEDCLCLTISLIKRGPAGLNGDNKILLQAPAAASQGYRLIAPSLLLYHTHI

SEQ ID NO: 160955 - protein, 73 aa, Glycine max
  Coding DNA Sequence Number=SeqID_44177
MLKGLQVVARGVLGHVEGVHRSCQRSSRFRLNHVERDLGHAKGVPSSGQKSTRLCQKDLKSCLRDSRLWLNEY

SEQ ID NO: 160956 - protein, 755 aa, Glycine max
  Coding DNA Sequence Number=SeqID_44178
  Homolog annotation: Hit_ID=Q1RVB7; Match level="QueryCoverage=96%, HitCoverage=96%, E-value=0.0, Identity=75%"; Hit description=Zinc finger, BED-type predicted
MAATNAGLAAADSASADEAAAKTAQKRYEGLLMVRNKAIKGKGAWYWTHLEPLLVHNTETGLPKAVKLRCTLCDAVFSASNPSRTASEHLKRGTCPNFNSAAKPISSVSPVLLPSSTSPPPSASPFNHRKRTTTSPSASGSGSGSLYHAPSRFGSGLIPQQQHLMLSGGKDDLGALAMLEDSVKKLKSPKTSPGLALSKAQIDSAIEFLGDWVYESCGAVSFSSLEHPKFRAFLAQVGLPAVFPREFTGTRLDARFEEAKVESEARIRDAMFFQIASDGWKWKRERESYYEDDSNSNSGLVNLSVNLPNGTSLYRRALFVTASAPSKYAEEVMWETITSICGNLVQQCVGIVADRFKAKALKNLENQNHWMVNLTCQYQGFNTLIKDFAKELPLFRTVVQNCLKLANLFNYTSQVRNSFHKYQLQEYGHTWLLRVPAHEFEFGPVCAMMEDTLSSVRALQLVLMDEPFKMVAIEDQGAREVGDMIRDVGFWNDLEAVHGLVKLVKDMAQEIEAERPLVGQCLPLWDELRAKVKDWCSKFHIAEGVVDKLVEKRFKKNYHPAWAAAYILDPLYLVRDTSGKYLPPFKYLTPEQEKDVDRLITRLVARDEAHIALMELMKWRTEGLDPVYAQAVQMKERDPVTGKMRIVNPQSSRLVWETYLTEFKSLGKVAVRLIFLHATSCGFKCNWSLWRWVCAQGHHSRTALNKVQKLIFIAAHSKLERRDFSSDQDKDAELFTLANGEDDVLNDVLVDTSSV

SEQ ID NO: 160957 - protein, 149 aa, Glycine max
  Coding DNA Sequence Number=SeqID_44179
  Gene Ontology: Mol. function=catalytic activity; Biological process =metabolic process
  Homolog annotation: Hit_ID=Q1RVC0; Match level="QueryCoverage=50%, HitCoverage=25%, E-value=3e-26, Identity=71%"; Hit description =Sterol desaturase
MDLSGVCCLNNIQQYRELVQVDAKLRVKLISIKDLPEATLSFPLINTSILPSLLSPLYEKFAHHSLVPALYDFPRSITKYIPFYGGAEYHDYHHYVGRQSQSNFASVFTYCDYIYGTDKGYRYQKKILQKLKEELANGVEQNGGSYKTD

SEQ ID NO: 160958 - protein, 248 aa, Glycine max
  Coding DNA Sequence Number=SeqID_44180
  Gene Ontology: Mol. function=catalytic activity; Biological process =metabolic process
  Homolog annotation: Hit_ID=Q1RVC0; Match level="QueryCoverage=65%, HitCoverage=58%, E-value=5e-64, Identity=70%"; Hit description =Sterol desaturase
MQELKNDEQTSHKGEKGERGVCWCLSMGKKEWPLVRKSEQGTVRDRKNHGRPEKGGNPEDQDLGPVGIGRRKSNGSMVLMVHAVNLLVTPIVVQKPVDPVIGVILYEKVDQKLRQDLPPRRIRDELEGADDEEEHAHDVFVALEGFGEGQTDFRLDLVGSDEGEALEFEEDEGEGDEGEDEEEEQNVVAVEEVIRLGGGVVEPEGFRGGEGTGKRCVIFADVVDAALDACLLPQIFAGIFKMHNCPYL

SEQ ID NO: 160959 - protein, 53 aa, Glycine max
  Coding DNA Sequence Number=SeqID_44181
MEAIDPWTLESLVSKVYLASEFMYEGQTMGLTVLEWYKVLEHVGDNGAYFHNS

SEQ ID NO: 160960 - protein, 185 aa, Glycine max
  Coding DNA Sequence Number=SeqID_44182
  Gene Ontology: Mol. function=nucleic acid binding; Biological process= DNA integration
  Homolog annotation: Hit_ID=Q2HSF6; Match level="QueryCoverage=89%, HitCoverage=11%, E-value=4e-12, Identity=29%"; Hit description =Glycoside hydrolase, family 1; Zinc finger, CCHC-type; Polynucleotidyl transferase, Ribonuclease H fold
  Pfam annotation: Domain name=zf-CCHC; Domain location=66-83; Score =11.2; E_value=0.014; Accession=PF00098.13; Description=Zinc knuckle
KKKGIELKASSSIQEESDKEDLNEIEEDDDFSFFVKRFNKFLGNKGNQTRINFNSKKRGEDSSFFPKFYECNQPGHLRVDCLSFKRRMKKSDWKTFKDKKAKKTYITWEDNDMDSSGDSENEIVNLSLMAKNYESEEDDFLKKSWYIDSGWSKHITGDASKFTHISPKNSGHVTTTKVKFLELEK

SEQ ID NO: 160961 - protein, 219 aa, Glycine max
  Coding DNA Sequence Number=SeqID_44183
  Homolog annotation: Hit_ID=Q1RZ08; Match level="QueryCoverage=99%, HitCoverage=65%, E-value=8e-27, Identity=46%"; Hit description =Peptidase aspartic, active site
MSLTENATSCCMAPDEHIMTGHHSCKLRNQVDVICLRVSSDSNMKFWHSLSVEDKSYAVNSFHLFANVLVAFWLFLVASSYFLLSKNVNLSGGCRGKRAEKVSSSVRTISDATTENDATAANDTFSCSESFSSNNSWGELCTKCDAYYEISDFDKASYMHSLLSLEGEDSEWLADSMPCELSYENPSTPLSSYKCDAYHEISDFEQGSYMHSLLSLDDE

SEQ ID NO: 160962 - protein, 152 aa, Glycine max
  Coding DNA Sequence Number=SeqID_44184
MNILTAHDQGWEQDLSPYNQYKEERTPNLESVFEEFRAYHASSKANQNSMKNHEIHFGKSYSIENYQGRPELQPYYQNEAERGSNLDKLLMQFKEKTKSTQQALQSVEIQTRKYFVEVEAQEESPVKEHESREKDEEQAQQQGVKYSTVENQ

SEQ ID NO: 160963 - protein, 710 aa, Glycine max
  Coding DNA Sequence Number=SeqID_44185
  Homolog annotation: Hit_ID=Q9SSM3; Match level="QueryCoverage=19%, HitCoverage=80%, E-value=1e-51, Identity=62%"; Hit description =Similar to jacalin
  Pfam annotation: Domain name=F-box; Domain location=45-93; Score =31.1; E_value=4e-06; Accession=PF00646.23; Description=F-box domain
  Pfam annotation: Domain name=Jacalin; Domain location=549-680; Score =125.0; E_value=2.1e-34; Accession=PF01419.7; Description=Jacalin -like lectin domain
  Pfam module annotation: Pfam domain module=F-box::Jacalin; Domain location=45-93::549-680
MISGSKRKRSLGDNLDCVREAARLKETPGEKDSDEMDTSDDGSVDRISQFPDHVIHHILSHLRNVNDAIRTSVLSKRWRELWYSYSVLIFDERKFAAKIGHEDSSNKGMMFRDYVSNSLLTSNAKNLQIRKLVLHMTSFDLLEDAPCLELWLNIAIYRNIKELDLHVGIKNGECYTLPQTVFSSKTLTGIRLSGCKLGTCNNIKLPYLQKLYLRKIPLVENFIQNLISCCHSVEDLRIIKCSGLKHLHVSNLIRLKRAEIHHCIQLKKVEISAPNLDTFWYCGKKTSPCKVSLEGCTSLKRLTLEHPQVTRDFCENQFSNFPLLEKLDLSMSNNKSRFIIISNPHLEKFTLKGCKKLGIVLVEAPNLLSFECKGETMPWVEIHPFGLTQAKLSFVPKSEPRVVGYGDKIWIRMKSFIQKFNRERFKLVLYSNKSIVIHEDLNNVILPPVPDLGCEIINSSACIDDALNSLLRKLHPVTLSIISPTDSKFPKQNIITAGSLLELLLPLTGKMTIADVNFEDLNDVKFEDIEEGKSRKRSIILGPWGGNGGNSWDDGTFTGVREIKLVYGHCIDSIQVVYDRNGKPLTAKKHGGVGGNKTAEIKLQFPDEFLVSVSGHYCPVVRGGTPVILSLTFKSNRKTFGPYGVEEGTPFTFSIDGGCVVGFKGRSDWYLDAIAFTLCNTRSKSLLQKVQRGLFWLTSTAPKSSSSKDG

SEQ ID NO: 160964 - protein, 62 aa, Glycine max
  Coding DNA Sequence Number=SeqID_44186
MVRISPTSLNRDVLKTFITVQVLNESPRATTAEMQTRKRVNFELGLVSLLWGEGLRRVWSLR

SEQ ID NO: 160965 - protein, 445 aa, Glycine max
  Coding DNA Sequence Number=SeqID_44187
  Gene Ontology: Mol. function=transcription regulator activity; Cellular component=nucleus; Biological process=regulation of transcription
  Homolog annotation: Hit_ID=Q8S0N2; Match level="QueryCoverage=57%, HitCoverage=67%, E-value=6e-31, Identity=38%"; Hit description=BHLH transcription factor-like
  Pfam annotation: Domain name=HLH; Domain location=347-394; Score =27.2; E_value=5.9e-05; Accession=PF00010.16; Description=Helix-loop -helix DNA-binding domain
MDGLSWDASSQLVANTPVLWSTQSQDLEGDYHHSMPHLSSSVLNNQTGYAYPSSEKARGMVQLSTMSEIMSMMPNTNLPQRITATMPVKSGAAGASWEEALISQSCPSLSVNMNQTSNYVADLNKAHQQQQQLINGTQNGKATTCSLDQSIDCLLSATNNSNTDASVEDDGISMILSDCRNLWNNFSYGSAASSGESDSNASINARNSDMRYPSVSELDESVSQSFSDQYLSQGRVIDSEVICTKRSSSSCFSIAQNSSATEGGFRLISETSPKSKRPRWIHKHPGSSNINFQQPNSSVTPSFEEPDPEVIAQMKEMIYRAAAFRPVNLGLEAVEKPKRKNVRISTDPQTVAARQRRERISERIRVLQKIVPGGSKMDTASMLDEAANYLKFLRSQVKALENLGNKLDTMNCPPTNIDFSFNPSFPIQTHFPIQNPSSHIQYSKG

SEQ ID NO: 160966 - protein, 91 aa, Glycine max
  Coding DNA Sequence Number=SeqID_44188
  Gene Ontology: Mol. function=RNA methyltransferase activity; Biological process=RNA processing
  Homolog annotation: Hit_ID=Q9FEB7; Match level="QueryCoverage=85%, HitCoverage=14%, E-value=1e-34, Identity=79%"; Hit description =Putative RNA methyltransferase
MHYTSHHCKLNADPNRPGMHMKLIKFLLNLRAPRIVYVSCNPATCARDLDYLCHGVVEQNIKGCYKLISLQPVDMFPHTPHIECVCLLELQ

SEQ ID NO: 160967 - protein, 505 aa, Glycine max
  Coding DNA Sequence Number=SeqID_44189
  Gene Ontology: Mol. function=protein dimerization activity; Cellular component=endoplasmic reticulum; Biological process=proteolysis
  Homolog annotation: Hit_ID=Q0GXX6; Match level="QueryCoverage=80%, HitCoverage=90%, E-value=0.0, Identity=77%"; Hit description=Auxin conjugate hydrolase
  Pfam annotation: Domain name=M20_dimer; Domain location=213-323; Score=38.6; E_value=2.1e-08; Accession=PF07687.4; Description =Peptidase dimerisation domain
  Pfam annotation: Domain name=Peptidase_M20; Domain location=108-426; Score=212.3; E_value=1.1e-60; Accession=PF01546.18; Description =Peptidase family M20M25M40
  Pfam module annotation: Pfam domain module=M20_dimer::Peptidase_M20; Domain location=213-323::108-426
  Subcellular localization annotation: CTP_CleavageSite=24; ConfidenceScore=5.10e-01
MGFFFKWVNLFVFFHFLAATPIFSDSSSSSNAFVTTKFLDLAKDPLVFDWMIGIRRKIHENPELGYEEFETSKLIRTELDKLGISYKYPVAVTGVVGFIGTGLPPFVALRADMDALPLQEMVEWEHKSKVPGKMHACGHDAHVAMLLGAAKILKRHENEIRGTVVLVFQPAEEGGGGAKKILDAGVLENISAIFGLHIVPTYPIGEVASRSGPIFAGSGFFEATINGRGGHAAIPQHSIDPILAASNVIVSLQHIVSREVDPLDSQNIAQVVTVGKFQGGGAFNVIPDSVTIGGTFRAFSKESFMQLRQRIEQVITGQAAVQRCNATVNFLDDEKPFSPPTVNNGDLHGYFESVAGSLLGVNNVKEMQPLMGSEDFAFYQEVFPGYFFLLGMDNASNEHLESPHSPYFKINEDALPYGAALHDSDRMNNHSFERSSNAFASSLISASSLLTFPVHETDKQLLIAACLDTILNRMSPEFSKAVNIITPTSAPKLSIRLQGQSEAAK

SEQ ID NO: 160968 - protein, 83 aa, Glycine max
  Coding DNA Sequence Number=SeqID_44190
MSQPTIRREGDAGLAGAFSKKGKCAESPPTFIRGKRQKKPKRCGLRTLSVKGSGVVFTRGEGCFLCSYVFLNCDKEIRPTQFF

SEQ ID NO: 160969 - protein, 432 aa, Glycine max
  Coding DNA Sequence Number=SeqID_44191
  Gene Ontology: Cellular component=cell surface; Biological process =pathogenesis
  Homolog annotation: Hit_ID=Q1RZ08; Match level="QueryCoverage=91%, HitCoverage=69%, E-value=5e-47, Identity=37%"; Hit description =Peptidase aspartic, active site
MHSLLSLEDEDSEWLSDSKPYRCSSENPSTSISYKCDASEISDLDKASYIHSLLILEDENSEWLSDSKLFGGSISENPSTPISYKFDASSEISDFSKASYMHSLLSLEHEDSEWLSNSKPFGCSSESISTPLSYKCHASSVISDFSKASCMHSLLSLEDEDSAEWLSDSKSFGWSSENPSTPLSSKCDAFSDISDLDKSSYMHPSISIEDENSDWLSVSKSYGFSSENSTPLSYKFDAYNYEISDLDKASYLHSLLILEDEDSEWLSDSSSWSIVVPPSVSTSSSFTGVNCGNSEEEFSADEPLFWPFEGKLNWNSEEPWTSFCSSPRRRFDSRSTTSRIKGCNNKQKGNEALCIVNYETSRLSMWPKSSEKIVPLVCEDFYSNKDHLLGKEYSALCQELTIEALVGLKEFDGHEGLDSEFDQVFLMDQYLQ

SEQ ID NO: 160970 - protein, 111 aa, Glycine max
  Coding DNA Sequence Number=SeqID_44192
MVALEEITNMQWKKKHMERENEAHSWSLEIKIEAFCDKNAHGEGKRSTFMEFGDKNDSFKRNNEHAVKKIDKKAHREEKRSITFEFFVRHLRHFRPAFGEQQHQGIVFERW

SEQ ID NO: 160971 - protein, 176 aa, Glycine max
  Coding DNA Sequence Number=SeqID_44193
MDSEAEALEHMKKRDRGHQSVSLENKTGDSTVVKMSEKNNNADADDCMILDDHEGEEHYCGKGTNARSVSFLPRSQEKIGDSAKVVIEQDMKGGEHKYGFNNNKREKPEKVRVVDDETGDKHELYEVLRMPSRTKNRCFKFFTEGRRGIINIIFYIYQTPNPMHVNTLNTLTIPAY

SEQ ID NO: 160972 - protein, 404 aa, Glycine max
  Coding DNA Sequence Number=SeqID_44194
MRAPALLAQCLPGLVPHDRGSLSISSVPEKDFHLPSPAVEILPSKTVHTEKDNGENIDHFKGLVSVADIVGFSGSETISLKPDGYLKSWTSSIDLVSVLKHEIRDGQLTFRGKRVLELSCNYGLPGIFACLKASGLLSLLELHCLLGVTTKSFNISFGVILQADNQGASVVHFQDQSAETVRCTTIPNVLANLKQARDRQSRQPESPLTPSRQTLAPSVNFYAGDWEELPSVLSIAKSDGYEVMPGMSLSFSEEDFMDGCSSQDGSIIGHESHSRRSRKLSGSRAWERGSEADQGEGGYDIILMTEIPYSVTSLKKLYALIKKCLRPPYGVVYLAPTKRHYVGFSNGVRQLRSLVDEEGIFGAHLVKDLADRDVWKFFHNNNGGLNLNAQFTCIISMKLPHLVE

SEQ ID NO: 160973 - protein, 320 aa, Glycine max
  Coding DNA Sequence Number=SeqID_44195
  Gene Ontology: Mol. function=exonuclease activity; Cellular component= intracellular
  Homolog annotation: Hit_ID=Q013L2; Match level="QueryCoverage=47%, HitCoverage=19%, E-value=2e-10, Identity=32%"; Hit description =Chromosome 08 contig 1, DNA sequence
MKKLLSSGIILVGHSLHNDLRVLKLDHVRVIDTSYIFQSLDGSIHKRPSLNSLCQAIREKGAPHNCLDDAKAAMDLVLAKIKHGVDKEFPIALVQEHVPESELAKLLLHKIPNTVNIETLHKILPGNFKIELKPSRKGQGANYSAFAIFRSPPEADGAYENVQGSQLKLYITEAYLVTVGLLIYLTLVMYITLCQDTYGHPQKLVTFRLSTGLSVNLFVRKMVTEEPNDQTPSKRALQINEAVDVSKKAKMDPKIEEDASAGFGKGDTDAHSKEIEALNQQLKQSEMVIESLRKQLTQKDFEISMLHKMISSKKKKKQTV

SEQ ID NO: 160974 - protein, 160 aa, Glycine max
  Coding DNA Sequence Number=SeqID_44196
  Gene Ontology: Mol. function=protein prenyltransferase activity; Cellular component=cytoplasm; Biological process=protein amino acid prenylation
  Homolog annotation: Hit_ID=Q1RZ11; Match level="QueryCoverage=83%, HitCoverage=32%, E-value=2e-39, Identity=62%"; Hit description =Protein prenyltransferase, alpha subunit
MESGSSEGEEVQQRVPLRERVEWSDVTPVPQNDGPNPVVPIQYTEEFSEVMDYFRAVYLTDERSPRALALTAEAVQFNSGNYTVSLSLSLTIKTVLSHLYLPLPQITVRCQVWHFRRLLLESLKVDLNDELEFVERMAAGNSKNYQMWCDALLCSFFHTL

SEQ ID NO: 160975 - protein, 58 aa, Glycine max
  Coding DNA Sequence Number=SeqID_44197
MAQPPPRERTQREMVAPDFTYESLCIQYSKGSKGCKSNGLSLVIHYIQHAQLVAFLCK

SEQ ID NO: 160976 - protein, 185 aa, Glycine max
  Coding DNA Sequence Number=SeqID_44198
  Gene Ontology: Cellular component=nucleus; Biological process =regulation of progression through cell cycle
  Homolog annotation: Hit_ID=Q52UN1; Match level="QueryCoverage=99%, HitCoverage=37%, E-value=1e-54, Identity=62%"; Hit description =Cyclin-related protein 1
METPRLCPPLAQIEFPYYDEIMVPDDLIEEETEPEHSGSQPDRKTSISANYPDVLNVNQLLDSVLETARQVASFSTSSTPLPYDQMKNQCEALVTGKQQKMSVIQSFKHQQESKAIILSSENEVNVSSLPAKALEYSNGDLKLVTQQQFQAQDQARHQSHESGQQHSLRLPPSSPYDKFLKAAGC

SEQ ID NO: 160977 - protein, 673 aa, Glycine max
  Coding DNA Sequence Number=SeqID_44199
  Homolog annotation: Hit_ID=Q1SB60; Match level="QueryCoverage=92%, HitCoverage=89%, E-value=1e-149, Identity=48%"; Hit description =Double-stranded RNA binding; Fungal hydrophobin
MQVCSLELMASSSDVCPTEDALKAFLEYLVDPVLPAKPSTPDNPPSPSQQHLVAKQVHSVVLLYNYYHRKQYPELAFLPFVEFCKLALVLRPTLSVHMKSMLKPDETELVEQLSLTEDKILNACNICTCLDASKNVPDVEGWPISKVSVLLIDSKKENCFLLFSYITEGVWSVVEKDVDTFSQSSEITSGAIQTYKKRRVIKKPTKKELNSEEDGILQIGYSPVKEAAGINKTDITSFESYTVYSQSKVKTASRFYIMKCSQLINKEFIQPIKSLIERLRGPLINRSSSCWTVTSVVEYFHVLPYSEIISEWISRETFSNSLQGSRLAEKNTMMGCPEVKKSYISSEGMSIGLDIKPSIDAIEALNQNENNGSCAVTCSASIKDSQNVYVDNTLASPSKNKEECQHIANTLQVNEDQEIENPFVQHYSNRSKNPIKAEYGGSTRMLITEGGTKDQSKGKILSKTAKASFENDPTEECVLIAYNPISDLEKFQTIASKGKTLSKTAEASFENDPIEERALIAYHPISDLEKFQTIASKGKALSQIAKASSENDSIEECALIANNPNSDLEKLQIIASKGMTLSQTAKASFENDSIKECALITNNLNSDLEKLQILIASKGKSLSQTALNALMQKRNALVKPVHCFFYWQECLYPFSRFLLFAMLGHIEHIHLVI

SEQ ID NO: 160978 - protein, 49 aa, Glycine max
  Coding DNA Sequence Number=SeqID_44200
MNRLKVVVTSEAPAHWEMVLQGIRQMRSSADEHQPVAREKAADTVPSKV

SEQ ID NO: 160979 - protein, 180 aa, Glycine max
  Coding DNA Sequence Number=SeqID_44201
  Gene Ontology: Mol. function=calcium ion binding; Cellular component =flagellin-based flagellum; Biological process=ciliary or flagellar motility
  Homolog annotation: Hit_ID=Q9SCA1; Match level="QueryCoverage=84%, HitCoverage=66%, E-value=3e-67, Identity=83%"; Hit description =Calcium-binding protein
MNLSESTEATPFHHLLELLEIDHAVSININLGYHVLAVLDGSALLQAEGGQDGPQLVDGDEAVGVLVEDVEGLPHVLLLVALVHDGLVELPELVDVDAAIAVDVNPLDHLAELLVRNEDAKILQRVVQLLLRYSSVAVAVEHLEHALQLVGGGGRDAPSWGPDRGGMSVRGCKEGKSYAK

SEQ ID NO: 160980 - protein, 152 aa, Glycine max
  Coding DNA Sequence Number=SeqID_44202
  Gene Ontology: Mol. function=identical protein binding; Biological process=negative regulation of enzyme activity
  Homolog annotation: Hit_ID=Q1SED0; Match level="QueryCoverage=89%, HitCoverage=22%, E-value=3e-32, Identity=51%"; Hit description =Orn/DAP/Arg decarboxylase 2; Protease-associated PA; Proteinase inhibitor I9, subtilisin propeptide
MTDKVSRHLSNVTPWITTVGTGTLDRDFLAYVALKNGFNFSGVSLYHGNALPNSHLPLVYAGNGSKRLDDEIHQSIRDGVNTVANDEELVANAHLLLGYRSWVEKPMMLLRSIWFPMRNQQLRLCSREQRWGFSHHRWLLRLTQEVACRGLT

SEQ ID NO: 160981 - protein, 579 aa, Glycine max
  Coding DNA Sequence Number=SeqID_44203
  Gene Ontology: Cellular component=nucleus; Biological process =regulation of progression through cell cycle
  Homolog annotation: Hit_ID=Q5N857; Match level="QueryCoverage=100%, HitCoverage=65%, E-value=1e-112, Identity=39%"; Hit description =Cyclin-like
MGVMSRRVVPVCGNLCVFCPSLRARSRQPVKRYKKFIADIFPRNQAAEPNDRKIGKLCEYASKNPLRIPKITDNLEQRCYKDLRNENYGSVKVVLCIYRKLLSTCKEQMPLFANSLLGIIRTLLEQTRADEMQILGCNTLVEFIDSQSAQTIWDQHRLQRTFKPNIVIPKTYTPKSPSGPLPPDSVILENFKDLQSKSNLAKVEKLNSQSQSQLVQGFPEKGAETEPKLDTKDPAYWSKVCLYNIAKLAKEATTVRRVLELLFHNFDSENHWSSEKGVASCVLMYLQSLLAESGDNSHLLLSSLVKHLDHKNVAKKPILQIDIINTTMQLAQNVKQQASVAIIGAISDLIKHLRKCLQNLSEASSNGNDAYRLNAELQSSLEMCILQLSKKVGDIGPILDLMAVALENIPITTIIARSTITAAFPDALFHQLLLAMAHPDCETQIGAHSVFSMVLMPSMFSPWLDHKTKIAQKAQNDSFSTQHETFSGAENLNGKLEEGKAIASVNGKKYVIHPYHRYSFSPKLTDGKDDRSSLRLSSHQVSLLLSSIWVQATSVENGPANYEAMAHTYSIALLFSRSK

SEQ ID NO: 160982 - protein, 138 aa, Glycine max
  Coding DNA Sequence Number=SeqID_44204
MASSSEQEFVTHYRALVNRFPRSHGFWDSEVASRVGEKLEFRLREIGVTNVQFDPHEKQSLPEISFSNLRLFSHVDDPLLQETPSELVKHQLDVGVGKYVELHQPVKNHRYPSCGGGACWHRGPGSCLTPLTEYCGRV

SEQ ID NO: 160983 - protein, 259 aa, Glycine max
  Coding DNA Sequence Number=SeqID_44205
  Gene Ontology: Mol. function=transferase activity; Biological process= DNA integration
  Homolog annotation: Hit_ID=Q1SB55; Match level="QueryCoverage=97%, HitCoverage=99%, E-value=1e-116, Identity=82%"; Hit description =FAR1; tRNA-binding arm
  Pfam annotation: Domain name=FAR1; Domain location=77-248; Score =111.6; E_value=2.2e-30; Accession=PF03101.5; Description=FAR1 family
MDHQSGQGFDSDDSDLDMQAEISDKHEKVDEFSKNLEICGGEDEMFVEQPVADISTDIEAVEPFIGMEFNSREEAREFYIAYGRRIGFTVRIHHNRRSRVNNQVIGQDFVCSKEGFRAKKYLHRKDRVLPPPPATREGCQAMIRLALRDRGKWVVTKFVKEHTHKLMSPSKVPCRGSGKHLVSEDEKDKRIRELSLELYNERQKCKRRCAAYEEQLNVILNDLEKHTEHISKKVAAVVRSIREIEEEKSDSDGGQLEPS

SEQ ID NO: 160984 - protein, 435 aa, Glycine max
  Coding DNA Sequence Number=SeqID_44206
  Subcellular localization annotation: CTP_CleavageSite=24; ConfidenceScore=5.37e-01
MYKGASKKRKLPVRNSNVYLCNTRSKTVQNFTSSLKATTQAPSRCFEFYVRSDEGIGLCIDLNSSPSDWTNRYRNEVRVSEKVCRKKESRSLWQDLSCSGGSSTQGKSSFIWNTKSGHFDDCNGPTRYAPSLKLVKDVTGLDQQNKGGCPSIYDSLTPCAMTVHVEKNVNENQSTDSNNSPIDPAQHAPPEVSYGAPNNYISGAESCAKDVSKKILDSITTDIAFIKSICGSVGNSQSGLNTLGHENSKHDNEISEDCAMLNGFCPVNPGMICPGALLSSSLELQVSEVLSDPKNCSDMEQGGLIYSSEIDLDTDGKNLPSLTEEWFPNPFYFLKMPVYYSNWKWAKLLMEGRVQSNYSSQKHFSKCSQFDDPHTKSGLECGDQESKMKLHKKRKHIYSEVQSSSDKPVGMFLRSMKKALTVQPRRSMRLISKVL

SEQ ID NO: 160985 - protein, 576 aa, Glycine max
  Coding DNA Sequence Number=SeqID_44207
  Gene Ontology: Mol. function=protein binding; Cellular component =cytoplasm; Biological process=ubiquitin cycle
  Homolog annotation: Hit_ID=Q84QE1; Match level="QueryCoverage=89%, HitCoverage=92%, E-value=1e-150, Identity=53%"; Hit description =Avr9/Cf-9 rapidly elicited protein 189
  Pfam annotation: Domain name=F-box; Domain location=37-83; Score =25.7; E_value=0.00017; Accession=PF00646.23; Description=F-box domain
MGQAPSTPVSSPDLSRREIFNTGHADFSDESIVGGRDYTADIPDECLAGIFQFLSSVDRKTCSAVCRRWLRVDGENRQRLSLNAKASLVDFVPSLFSRFDSVTKLALRCDRKSASVNDDALVLISLRCRNLVRLKLRGCREVTELGMAGVAKNCTNLKKLSCGSCAFGAKGVYAFVNNSTVLEEVSIKRLRGVENGNGDGAESVPLSVTSSSSLKSICLKELVNGHSFAPLIINSKKLETLKLIRCSGDWDVTLESVGKLNSGLVEIHLEKVQVSDVGLLGVSKCLKLESLHLVKAPECSDVGLCQVAERCKMMKKLHIDGWRTNRIGDSGLMAVAKHCPNLQELVLIAMFPTSLSLTAIVSSCQGLERFALCGICTVGDAEIEGIVAKCGALRKLCIKGCPVSNAGIAAFASGCPNLVKLKVRKCRRVNGEVVEWLREKRSPLVLSIDFSTEVEALDGSGSDVGPQESSTAFPPIDTTQVSLVDDALSSSNSSSSSNNNNNRLSMLRNKFGFLAGRNLMPCAFRRWANIDDISMIQLGALSLELNGEDESIRDGGLHVEPMDEEGECGGREMRGW

SEQ ID NO: 160986 - protein, 373 aa, Glycine max
  Coding DNA Sequence Number=SeqID_44208
  Gene Ontology: Mol. function=protein serine/threonine kinase activity
  Homolog annotation: Hit_ID=Q337P5; Match level="QueryCoverage=65%, HitCoverage=32%, E-value=3e-41, Identity=37%"; Hit description =Pleckstriny domain-containing protein, putative, expressed
  Pfam annotation: Domain name=DUF1336; Domain location=92-304; Score =336.8; E_value=3.6e-98; Accession=PF07059.3; Description=Protein of unknown function (DUF1336)
PQGLGLWIVEFEFYASLSVVLVFTNTCIAEPQNCALCLPFFYFLSSLHSVQRQTLHTFMASVGDRKESEWMDRIISEGAIPLLEPDNCSNGWATPPGDAFMVRGPEYFTTRVKVPAGDYMLKPLGFDWIKSSVKIGEILKDPNSRVRKAIDNEFPEGDKPFVWAFNLQVPTKDNYSAIAYFTTKESVLEDSLMDKFLKGDNAFRNSRLKLIANIVKGPWIVRKAVGEQAICIIGRALSCKYCTGENFIEVDIDIGSSMVASAIVHLAFGYISTLTVDLAFLIESQAESELPEKILGAFRFSDLDPASARTIELSTVVSCDNAQTSLPTRLWKSIGQGFSHILHSGPLEDGSTSGSEHTNDVDHKDNPTDITNW

SEQ ID NO: 160987 - protein, 134 aa, Glycine max
  Coding DNA Sequence Number=SeqID_44209
MWFSSFLSPFLMRHSKVRPNAPSDDQSSQLTHNPQLDHGGWSRRGREFCEARRAFLNSYHLSLERKNNVSFKEKLKKSVKEVNEAAMGVVLGMRRGVSKRRVGIKVFRVKMSSHSMVLVTLRCFIPWLNKSKVI

SEQ ID NO: 160988 - protein, 541 aa, Glycine max
  Coding DNA Sequence Number=SeqID_44210
  Gene Ontology: Mol. function=receptor activity; Cellular component =integral to membrane; Biological process=protein amino acid phosphorylation
  Homolog annotation: Hit_ID=Q308N9; Match level="QueryCoverage=40%, HitCoverage=97%, E-value=2e-78, Identity=66%"; Hit description=Salt -tolerance protein
  Pfam annotation: Domain name=LRRNT_2; Domain location=246-294; Score =34.3; E_value=4.2e-07; Accession=PF08263.3; Description=Leucine rich repeat N-terminal domain
  Pfam annotation: Domain name=LRR_1; Domain location=327-349; Score =11.9; E_value=1.7; Accession=PF00560.23; Description=Leucine Rich Repeat
  Pfam annotation: Domain name=LRR_1; Domain location=351-373; Score =9.1; E_value=5.7; Accession=PF00560.23; Description=Leucine Rich Repeat
  Pfam annotation: Domain name=LRR_1; Domain location=375-397; Score =17.2; E_value=0.059; Accession=PF00560.23; Description=Leucine Rich Repeat
  Pfam annotation: Domain name=LRR_1; Domain location=399-420; Score =16.4; E_value=0.1; Accession=PF00560.23; Description=Leucine Rich Repeat
  Pfam annotation: Domain name=LRR_1; Domain location=422-443; Score =8.2; E_value=8.5; Accession=PF00560.23; Description=Leucine Rich Repeat
  Pfam annotation: Domain name=LRR_1; Domain location=460-482; Score =10.8; E_value=2.7; Accession=PF00560.23; Description=Leucine Rich Repeat
  Pfam annotation: Domain name=LRR_1; Domain location=484-502; Score =6.1; E_value=21; Accession=PF00560.23; Description=Leucine Rich Repeat
  Pfam annotation: Domain name=zf-B_box; Domain location=1-47; Score =43.0; E_value=1e-09; Accession=PF00643.14; Description=B-box zinc finger
  Pfam module annotation: Pfam domain module=LRRNT_2::LRR_1::LRR_1::LRR_ 1::LRR_1::LRR_1::LRR_1::LRR_1::zf-B_box; Domain location=246-294::327- 349::351-373::375-397::399-420::422-443::460-482::484-502::1-47
MKIQCDVCERAPATVICCADEAALCAKCDVEVHAANKLASKHQRLLLQCLSSKLPTCDICQDCDEPIHSAGSLSANHQRFLATGIRVASSSNCTKDNEKSHSEPPNRSAQQVSAKIPPQQVPSFTSSWAVDDLLELTGFESPEKKESLQFGELEWLTDVGIFGEQFAQEALAAAEVPQLPETHNSSSVASYKTSKSYMSHKKPRIEVLNDDDDDEYFTAKFLAWSEALVIEKNHFFYWDDQLLCSPSDDTLALLEIKRAIDPNSVTPSSYLNSWDFTVDPCEITGSQFLGILCNLPLDNSSSRVTEVDLDGIGREGFLTPAIGNLTELTVLNLNNNKFRGPIPETIAKLRKLTRLTMSLNFFTGAIPQGITQLKNLQYIDVSGNRLSGLIPTSITGLRSLTYLSLSNNGFAGRIPNLTGLWQLNTLDLSVNQFYGDLPNLPVSLRNMYFHHNIPKGLLIHLKWLVVSDNRLSGAISGDVLSLRNVVHLNVSFNRFTVLEQMLFSATGDKDHLQNVLASTTYDIGRIITASMLFGYTLLLRK

SEQ ID NO: 160989 - protein, 311 aa, Glycine max
  Coding DNA Sequence Number=SeqID_44211
MEAASELDQGMKVLDSCLANINWRLKPSSKRRLQLDVLALITRMRAVVMVDYGGIMPQLQHHLSSLLQLALRDSPSIFEHIRVMVIQDMIYLIHITEIAHFVRSSFNSQQHPLLFVDLEHQPPKMITQIEESQLAMQLVSIQRLFLTVFSPEEPKSADDPKANANANAACQSSSSPSAHCIDLSNCMDNTDITVPTLNGWLLGYPVVYLFGKDHISDAIYHLSTKYLHIFQVFVCRNSTLKKGTQAEELLSFSVPYDLSMRGSNEQWAEAFLAHMQAKWERCASAWKSLKMEVLPVRIELNPTKYRAYFKE

SEQ ID NO: 160990 - protein, 316 aa, Glycine max
  Coding DNA Sequence Number=SeqID_44212
  Gene Ontology: Mol. function=zinc ion binding
  Homolog annotation: Hit_ID=Q10NX4; Match level="QueryCoverage=35%, HitCoverage=34%, E-value=3e-18, Identity=41%"; Hit description=FAR1 family protein, expressed
  Pfam annotation: Domain name=FAR1; Domain location=199-316; Score =46.7; E_value=8e-11; Accession=PF03101.5; Description=FAR1 family
MEMEALNILLPPDICNMIAPKESSEDVPIWKGSKDDSFSLKEAYLYLAKKIDDNRNMNSDHFKLLRKWKGPQKVPISKAQARVHFRTCCEQLAKPEKLTLVVSVQRGIDMQVEFGIDASINGETVGNATIVQINSSTADGNKVGCSSFNPAYKQGHDDNITQDSSGGDTIPSGIPAVSVASVDEPYVGQEFESEAAAHAFYNAYAKRVGFIIRVSKLSRSRRDGTAIGRALVCNREGYRMPDKREKIVRQRAETRVGCRAMILVRKVSSGKWVITKFIMEHTHPLTPGKGRRDCIYEQYPTLELAFAKGTTQRKVH

SEQ ID NO: 160991 - protein, 43 aa, Glycine max
  Coding DNA Sequence Number=SeqID_44213
MENDGAERLGHDTVEDRKGSDWMRIESWWGCEDKDLDITYQFL

SEQ ID NO: 160992 - protein, 77 aa, Glycine max
  Coding DNA Sequence Number=SeqID_44214
MAWDELKAITDGMMAPWAMAGYFNFVLFNQSSTACWLWGFVAILSAGIGVILMRVLANASWQEVFISIRITLSKLWA

SEQ ID NO: 160993 - protein, 902 aa, Glycine max
  Coding DNA Sequence Number=SeqID_44215
  Gene Ontology: Mol. function=protein serine/threonine kinase activity; Cellular component=integral to membrane; Biological process=protein amino acid phosphorylation
  Homolog annotation: Hit_ID=Q6RZU8; Match level="QueryCoverage=99%, HitCoverage=99%, E-value=0.0, Identity=62%"; Hit description =Crinkly4-like protein
  Pfam annotation: Domain name=APH; Domain location=509-690; Score= -17.5; E_value=0.1; Accession=PF01636.13; Description=Phosphotransfera se enzyme family
  Pfam annotation: Domain name=Pkinase; Domain location=508-793; Score =129.0; E_value=1.3e-35; Accession=PF00069.15; Description=Protein kinase domain
  Pfam annotation: Domain name=Pkinase_Tyr; Domain location=508-780; Score=99.7; E_value=8.4e-27; Accession=PF07714.7; Description =Protein tyrosine kinase
  Pfam module annotation: Pfam domain module=APH::Pkinase::Pkinase_Tyr; Domain location=509-690::508-793::508-780
MNLCPVLFGTLFEVVVFSCLWLQVSSLGSMSSIAVSYGDKGSVFCGLKSDGSHTVTCYGINSAIIYGTPTHFPFLGLTAGDGFVCGLLMSSNQPYCWGSSGHVEMGVPQPMVKGAQYLEISAGDYHVCGLRKPLTGRHRNTSLVDCWGYNMTNNYVFDGQVQSISAGSQFNCGLFSQNRTVFCWGDETSSQVIYMIPQGIRFQKISAGGYHVCGILEGVNSRAVCWGRSMLDLGEELSISLTRSGQGNVELAPNDPMLSVVGGKFHACGIRSHDRGVVCWGYSFKAGTPVPSGIKAFEIGAGNYFTCGILVEKSLMPVCWGVGFPTSLPLPVSPRMCRSAPCAPGYYETQQNGLCKSPDSHICMPCSAACPPEMYQRSGCNLKSDILCEYNCSLCSSPECLSNCSSSYSNAASGKRSERFWSMQLPVLIAEIAFAVFLVSIVSITVVLYVRYKLRDCQCSGPKVKKLKGSSSNQKDQKCKIRPDLEEFKIRRAQMFSYEELERATSGFKEESIAGKGSFSCVFKGVLKDGTVVAVKRAIVSPNMQKNSKEFHTELDLLSRLNHAHLLNLLGYCEEGGERLLVYEYMAHGSLHQHLHGNKVMQEQMDWVRRVTIAVQAARGIEYLHGYACPPVIHRDIKSSNILIDEEHNARVADFGLSLLGPADSSSPLAELPAGTLGYLDPEYYRLHYLTTKSDVYSFGVLLLEILSGRKAIDMQFEEGNIVQWAVPLIKSGDIAAILDPTLKPPPDLDALRRIANVACKSVRMRGKDRPSMDKVTTVLERALAQLMGSPCIEQPILPTEVVLGSNRLHKKSSSNRSASESTDVEDQRFEFRAPSWITFPSVTSSQRRSGSEADVEGKNAEGRNLSNVGGGGGGGGDVLRSLDEEIGLASPRERLFLQHNF

SEQ ID NO: 160994 - protein, 722 aa, Glycine max
  Coding DNA Sequence Number=SeqID_44216
  Gene Ontology: Mol. function=strictosidine synthase activity; Biological process=biosynthetic process
  Homolog annotation: Hit_ID=Q58L86; Match level="QueryCoverage=55%, HitCoverage=97%, E-value=1e-176, Identity=72%"; Hit description =Strictosidine synthase family protein
  Pfam annotation: Domain name=DAO; Domain location=424-651; Score= -32.8; E_value=0.00081; Accession=PF01266.14; Description=FAD dependent oxidoreductase
  Pfam annotation: Domain name=Pyr_redox_2; Domain location=424-579; Score=-39.0; E_value=0.071; Accession=PF07992.4; Description =Pyridine nucleotide-disulphide oxidor
  Pfam annotation: Domain name=SGL; Domain location=107-350; Score= -54.7; E_value=6e-06; Accession=PF08450.2; Description=SMP -30GluconolaconaseLRE-like region
  Pfam annotation: Domain name=Str_synth; Domain location=200-287; Score=123.9; E_value=4.6e-34; Accession=PF03088.7; Description =Strictosidine synthase
  Pfam module annotation: Pfam domain module=DAO::Pyr_redox_2::SGL::Str_ synth; Domain location=424-651::424-579::107-350::200-287
MEKIKIKLLMKDETFLQHPFVLAVVLVLGLVMMDPFHLGPVAEHEFRPVKHSIAPYHQVMKNWPRDNMSRLALHGKSEFKNQVFGPESLEFDNMGRGPYTGLADGRVVRWMGEQHGWETFAVVTSNWTEKLCFRGNDSTTEKQWKHEKTCGRPLGLRFDKESGDLYIADAYYGLLVVGPNGGLATSLATHVEGKPILFANDLDIHKNGSIFFTDTSKRYNRVAHFFILLEGEATGRLLRYDPPTKTTHVVLDGLVFPNGVQFSKDHSFLLYTETTNCRLMKLWIEGPKSGTVELLADLPGFPDNVRINEKGQFWVAIDCCRTPAQEVLSHNPWLRNIYFRLPIRMSLLARAMGMKMYTVISLLDDKGEVLEVLEDQQGQVMKLVSEVREEQGKLWIGTPRANSRVPTSQSFCTASSDRDSIEYDVVIVGAGPAGLSAAIRLKQMCRERNADLSVCVLEKGAEVGAHILSGNVFEPRALNELLPQWKEQEAPITTPVSSDKFWFLTKGRAISLPSPFNNKGNYVISLSQLVRWLGAKAEELGVEIYPGFAASEVLYDANNKVIGIGTNDMGISKDGSKKENFQHGVEIKGRITLLAEGCRGSLSEKIMKKYNLREKGGSEHQTYALGIKEVWEIDEKKHQPGAVIHTLGWPLDHKTYGGSFLYHMKDKQISIGLVVALNYQNPFMNPYEEFQKLKHHPAIKSFLEGGTVIQYGARTLNEGGFQ

SEQ ID NO: 160995 - protein, 263 aa, Glycine max
  Coding DNA Sequence Number=SeqID_44217
  Gene Ontology: Mol. function=protein dimerization activity; Cellular component=nucleus; Biological process=regulation of transcription, DNA-dependent
  Homolog annotation: Hit_ID=Q0GPE2; Match level="QueryCoverage=62%, HitCoverage=87%, E-value=2e-42, Identity=59%"; Hit description=BZIP transcription factor bZIP51
  Subcellular localization annotation: CTP_CleavageSite=49; ConfidenceScore=5.59e-01
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQMVEPSNAVGASASTPASGAPTSSTENVVIGTNERPRVRHQHSQSMDGSTTIKPEMLVSGSEDMSAADSKKAMSAAKLAELALIDPKRAKRQYASCKCHVMFITILNPLHIYYLISSSCCF

SEQ ID NO: 160996 - protein, 150 aa, Glycine max
  Coding DNA Sequence Number=SeqID_44218
  Gene Ontology: Mol. function=electron-transferring-flavoprotein dehydrogenase activity; Cellular component=integral to membrane; Biological process=electron transport
  Homolog annotation: Hit_ID=Q337B7; Match level="QueryCoverage=89%, HitCoverage=23%, E-value=4e-57, Identity=74%"; Hit description =Electron transfer flavoprotein-ubiquinone oxidoreductase ,mitochondrial, putative, expressed
  Pfam annotation: Domain name=ETF_QO; Domain location=75-149; Score =31.8; E_value=1.1e-10; Accession=PF05187.3; Description=Electron transfer flavoprotein-ubiquinone ox
FPGGAIIGCSAGFMNVPKIKGTHTAMKSGMLAAEVTFGALNEGLDMDMYWDALRNSWIWEELHKSRNYRPAFEYGLIPGLALSGLEHYIFKGRHPVTLKHGKPDHEAMNAAKSHSPIHYPKADGVLSFDVPTSLHRFWNTYSLLLLTVES

SEQ ID NO: 160997 - protein, 78 aa, Glycine max
  Coding DNA Sequence Number=SeqID_44219
MAVQRQRPTIARKSRMMGRKGRTLMGKRMKVDPTQSLLLHNLQGLPISRFRMIDHNPTTILATNDPRSDPAQKPDIGA

SEQ ID NO: 160998 - protein, 129 aa, Glycine max
  Coding DNA Sequence Number=SeqID_44220
  Gene Ontology: Cellular component=nucleus
  Homolog annotation: Hit_ID=Q0KIN6; Match level="QueryCoverage=63%, HitCoverage=18%, E-value=1e-30, Identity=68%"; Hit description=WD domain containing protein, putative
  Pfam annotation: Domain name=WD40; Domain location=37-75; Score=36.5; E_value=9.3e-08; Accession=PF00400.22; Description=WD domain, G-beta repeat
MARLTDQLDPYDLRITLIHTHHCEKSAWTILVLVKSLDLYGKLDGHEGCVNAVEFNSTGDLLVSGSDDRQVMFWNWASKTRLFAYPSGHTDNIFQTKIIPFTDDCRIVTSAGDGQPQNSRLQFPVLPLF

SEQ ID NO: 160999 - protein, 141 aa, Glycine max
  Coding DNA Sequence Number=SeqID_44221
MLSYNLRQGRWRYDFTGSRFSSINQKQAQHRCKGFIIHELEVRRKHPRLVEECPELLRAMDPNALHYCHICCIICIYSAILLIRDLYPWCSNWRSPRGGLGSSSSMDSFASWKMNENGMEKEEREETPLQGEDESRRSSPP

SEQ ID NO: 161000 - protein, 68 aa, Glycine max
  Coding DNA Sequence Number=SeqID_44222
MSRNLTDCTTIPSLTLECCRTLWIVQQCFLSTSGMSRNFADCLMMGAKFLQAVMRRSHPSKQMVPGQN

SEQ ID NO: 161001 - protein, 80 aa, Glycine max
  Coding DNA Sequence Number=SeqID_44223
MLTSPKRVQMTTLASACQSNLGSPNDEVWITERCLRMLPDSWVMIAKGGVVDKSETFAPTYPPFVMRNSDLRSSFFCETK

SEQ ID NO: 161002 - protein, 63 aa, Glycine max
  Coding DNA Sequence Number=SeqID_44224
MGTLIKLGYSTGLVKVKKPPKKQGSCDVMKYSALLQLTMVFDKIFQLRVASSDSVNGGVVVTK

SEQ ID NO: 161003 - protein, 261 aa, Glycine max
  Coding DNA Sequence Number=SeqID_44225
  Gene Ontology: Mol. function=nucleic acid binding
  Homolog annotation: Hit_ID=Q52ZH7; Match level="QueryCoverage=92%, HitCoverage=41%, E-value=8e-65, Identity=54%"; Hit description=FPA
  Subcellular localization annotation: CTP_CleavageSite=56; ConfidenceScore=5.14e-01
VTWTPELIASLTSLLPATTQSSTTGGPMAVAGPSIVKPSFPSVAPNDGNQSHLWKQAQQIPDPSSHPPQQFGSIHNVQYQPYPPASSTDHPAQVVSGSSCFQDTNSSLQQPVAVSSTPMTNFILPPQNGQVAVSPQVSQQYQVEVPHGTEKDYGVVQGTDASVLYSSKAFQQPNNFISSSNQVANAASQQQSVMPFTVDKDNSVPTNQQPQPALFGVGQGVSELEADKNQRYQSTLQFAANLLQQIQQQQTQGGHGPGNQQ

SEQ ID NO: 161004 - protein, 632 aa, Glycine max
  Coding DNA Sequence Number=SeqID_44226
  Gene Ontology: Mol. function=nucleic acid binding
  Homolog annotation: Hit_ID=Q58T22; Match level="QueryCoverage=97%, HitCoverage=71%, E-value=1e-115, Identity=47%"; Hit description=FPA
  Pfam annotation: Domain name=RRM_1; Domain location=20-85; Score =66.2; E_value=1e-16; Accession=PF00076.12; Description=RNA recognition motif. (a.k.a. RRM, R
  Pfam annotation: Domain name=RRM_1; Domain location=202-268; Score =30.0; E_value=8.4e-06; Accession=PF00076.12; Description=RNA recognition motif. (a.k.a. RRM, R
  Pfam annotation: Domain name=RRM_1; Domain location=97-162; Score =67.7; E_value=3.8e-17; Accession=PF00076.12; Description=RNA recognition motif. (a.k.a. RRM, R
  Pfam annotation: Domain name=SPOC; Domain location=470-566; Score =83.5; E_value=6.4e-22; Accession=PF07744.3; Description=SPOC domain
  Pfam module annotation: Pfam domain module=RRM_1::RRM_1::RRM_1::SPOC; Domain location=20-85::202-268::97-162::470-566
MPPPSKSVEGEEWGTPTNNLWVGNLPTEVTDSDLMELFAPYGSLDSLISYSSRTFAFVLFRRIEDAKAAKSNLQGALLRGFQIRIEFARPAKPCKQLWVGGFSPTVAREDLEAEFRKFGKIEDFKFFIDRGTACVEFLNLDAAARAMKVMNGKRLGGRQICVDFLRSQSTRRDFLVDHGQFQARPQHLQPSIGRNNQPSKILWIGFPPSFQIDEQMLHNAMILFGEIEKIKSFPSRHYSFVEFRSIDEARRAKEGLQGRLFNDPQITIMYSSSELAPGKDYPGFYPGGKGPIPDGLGNEHPFRPLQTDVFGHNRPMVPNNFPGQLPPGHNVPMRPFGSQGLEPLISGPDFNEMGPSWKRPSPPAPGMLPSPVPGIRPPTRSTSGAWDLLDINQFQRDSKRLRIDDALFIGDAPFPLRNIDDRGLGVEQPFAIDSVIDGGGSGPKSHLGPVGTRITSGVPGSVQPDIDHIWRGIIAKGGTPVCRARCVPIGKGIVTEIPDIVDCAARTGLDMLTKHYADAIGFDIVFFLPDSEEDFASYTEFLCYLKAKNRAGVAKFVDNTTLFLVPPSDFLTKVLKVTGPERLYGVVLKFPLVPSSTSMQQPMHLPSPSTQYMQRIPPSQAEYGSILVKEEQ

SEQ ID NO: 161005 - protein, 51 aa, Glycine max
  Coding DNA Sequence Number=SeqID_44227
MAIQADTVIDTDDTSLHGHQIAGPIGDTSHVECLPQVQLAREVAQISLAIQ

SEQ ID NO: 161006 - protein, 81 aa, Glycine max
  Coding DNA Sequence Number=SeqID_44228
MEQDREQGIEGGINYDNKETEDTNENNSEGAAQGLERPKANFVEAMPSKIILMMPKNQKSNKFQESRSRFKNNQDQDSRFK

SEQ ID NO: 161007 - protein, 340 aa, Glycine max
  Coding DNA Sequence Number=SeqID_44229
  Gene Ontology: Mol. function=protein binding; Cellular component =autophagic vacuole; Biological process=culmination during fruiting body development
  Homolog annotation: Hit_ID=Q9FGS2; Match level="QueryCoverage=99%, HitCoverage=66%, E-value=1e-156, Identity=75%"; Hit description =Arabidopsis thaliana genomic DNA, chromosome 5, TAC clone:K6A12
  Pfam annotation: Domain name=WD40; Domain location=130-169; Score =39.8; E_value=9.2e-09; Accession=PF00400.22; Description=WD domain, G-beta repeat
  Pfam annotation: Domain name=WD40; Domain location=173-210; Score =27.0; E_value=6.5e-05; Accession=PF00400.22; Description=WD domain, G-beta repeat
  Pfam annotation: Domain name=WD40; Domain location=214-252; Score =26.1; E_value=0.00012; Accession=PF00400.22; Description=WD domain, G-beta repeat
  Pfam annotation: Domain name=WD40; Domain location=260-298; Score =17.5; E_value=0.049; Accession=PF00400.22; Description=WD domain, G -beta repeat
  Pfam annotation: Domain name=WD40; Domain location=302-340; Score =27.5; E_value=4.7e-05; Accession=PF00400.22; Description=WD domain, G-beta repeat
  Pfam annotation: Domain name=WD40; Domain location=46-84; Score=32.1; E_value=2e-06; Accession=PF00400.22; Description=WD domain, G-beta repeat
  Pfam annotation: Domain name=WD40; Domain location=88-126; Score =18.4; E_value=0.026; Accession=PF00400.22; Description=WD domain, G -beta repeat
  Pfam module annotation: Pfam domain module=WD40::WD40::WD40::WD40::WD4 0::WD40::WD40; Domain location=130-169::173-210::214-252::260 -298::302-340::46-84::88-126
ANTLYEEMVEKLRASGLEQLARQQVDGIVRRSEEGAEFFFDSNIPSTCKYRLRAHEGGCASMLFEYNSSKLITGGQDRLVKMWDANTGSLSSTLHGCLGSVLDLTITHDNQSVIAASSSNNLYVWDVNSGRVRHTLTGHTDKVCAVDVSKISSRHVVSAAYDRTIKVWDLVKGYCTNTVIFRSNCNSLSFSMDGQTIFSGHVDGNLRLWDIQTGKLLSEVAAHSLAVTSLSLSRNGNVVLTSGRDNLHNLFDVRSLEVCGTLKAMGNRVASNWSRSCISPDDNHVAAGSADGSVYIWSISKGDIVSTLKEHTSSVLCCRWSGIAKPLASADKNGIVCVWT

SEQ ID NO: 161008 - protein, 176 aa, Glycine max
  Coding DNA Sequence Number=SeqID_44230
  Gene Ontology: Mol. function=cysteine-type endopeptidase activity; Cellular component=endoplasmic reticulum; Biological process =proteolysis
  Homolog annotation: Hit_ID=P25803; Match level="QueryCoverage=79%, HitCoverage=38%, E-value=3e-64, Identity=82%"; Hit description =Vignain precursor
MEYPNIMILLITYISSNFREVKYYPSDYAEKMLIFLLTALALILYISDSTFLPPIYGRRNPVNVLIHESTIPTWRASEHSVMINLGASIDAPEFMVGHVSEPVQLQLVRLVHFIGTVDMHHVAFEHVEAVVLLIEASRNRVVAPPSLVQIPQPFLGFQVLFIELKALSNSQNQSKG

SEQ ID NO: 161009 - protein, 314 aa, Glycine max
  Coding DNA Sequence Number=SeqID_44231
  Gene Ontology: Mol. function=peptidase activity; Biological process =aromatic compound metabolic process
  Homolog annotation: Hit_ID=Q2QTQ5; Match level="QueryCoverage=93%, HitCoverage=72%, E-value=3e-95, Identity=59%"; Hit description =Expressed protein
  Pfam annotation: Domain name=BAAT_C; Domain location=67-203; Score= -86.2; E_value=0.077; Accession=PF08840.1; Description=BAAT  Acyl-CoA thioester hydrolase C t
  Pfam annotation: Domain name=Peptidase_S9; Domain location=42-207; Score=-74.3; E_value=0.021; Accession=PF00326.11; Description=Prolyl oligopeptidase family
  Pfam module annotation: Pfam domain module=BAAT_C::Peptidase_S9; Domain location=67-203::42-207
MSADSLLGFLILSCMQPRYDYSGYGQSSGKVITLLFFLGLFDSFDPSTPLIDIIAQPSENNTYADIEAAYKYLEENYGTKQEDIILYGQSVGSGPTLDLATRLPRLRAVVLHSPILSGLRVMYPVKRTYWFDIYKNIDKIPLVKCPVLIIHGTDDEVVDCSHGKHLWELCKEKYEPLWLKGGNHCNLELYPEYLRHLRKFISIIEKSPSQWQTLWRSIGGVEEARRSVDCFEAPRMSADLRDKPRKSTDKQEQLKFQGHKLSNVETVEKSRISFDHVAGSQRNKENHDKSRKSVDVHFGRTRKSLDWLDKIRAR

SEQ ID NO: 161010 - protein, 189 aa, Glycine max
  Coding DNA Sequence Number=SeqID_44232
DVFTAAIGRLEHPGRVRAAGAGVTIKHYFGSAPRTSRNSSSLPPEELQQLLTQQIRDQLEESITEKETKTGDSDRCGLYIEADPACLVGVEEVKDPNAPVPIPTDETAVSPAKPPQKPDSEVTWDATVFGVFNPDFPLYIKHEDLSEIAHGGQCLSISVLQLWILHLTETSMRAGNSDIYGFLEPQSIQ

SEQ ID NO: 161011 - protein, 108 aa, Glycine max
  Coding DNA Sequence Number=SeqID_44233
MKSWMQNSKRDVYLGAYPNGLDNYLKGIIKSALKGLDDTPQPKSKCNRQKGSIECGYYMIHWMSTIILGSFRNNWETYFNDVRQLEAERLKMFRIQWAKYYLNVRNQT

SEQ ID NO: 161012 - protein, 165 aa, Glycine max
  Coding DNA Sequence Number=SeqID_44234
MTGRLLAGSLALESRILHYLIVHILLPRSLNLAQVSEEDLIVMWAFHTGRQIDWAHLVRYRMHKALRLNAPSPYPHLVTLFLQHFNIPLDSEPYVPIKRSFLIGAASILDRFDGLQTYVGERFDALEQQVDMRFDEMDSRITKVEGDVTYIRTCFDLPPPPPPSS

SEQ ID NO: 161013 - protein, 93 aa, Glycine max
  Coding DNA Sequence Number=SeqID_44235
  Gene Ontology: Mol. function=structural constituent of ribosome; Cellular component=ribonucleoprotein complex; Biological process =translation
  Homolog annotation: Hit_ID=O22860; Match level="QueryCoverage=64%, HitCoverage=88%, E-value=6e-27, Identity=95%"; Hit description=60S ribosomal protein L38
  Pfam annotation: Domain name=Ribosomal_L38e; Domain location=1-64; Score=146.6; E_value=6.7e-41; Accession=PF01781.8; Description =Ribosomal L38e protein family
PKQIHEIKDFLLTARRKDARSVKIKRSKDVVKFKVRCSKYLYTLCVFDSEKADKLKQSLPPAELHKWFKRAGCVILTAVDEDQVLLWILGIHI

SEQ ID NO: 161014 - protein, 123 aa, Glycine max
  Coding DNA Sequence Number=SeqID_44236
MSDLRIETEWQKARWRLDKIFYLFLLCINYLPELDSYAYCLMTEACRDRCSSFQVKSNNKFHNPRSSVTFSLRTAEAWVSIYPSVIQISPAKETPQASLQQFYENPSIYLTVKKKVFLSLKFI

SEQ ID NO: 161015 - protein, 255 aa, Glycine max
  Coding DNA Sequence Number=SeqID_44237
  Gene Ontology: Cellular component=nucleus; Biological process =regulation of progression through cell cycle
  Homolog annotation: Hit_ID=Q2ABE7; Match level="QueryCoverage=51%, HitCoverage=41%, E-value=1e-37, Identity=60%"; Hit description =Cyclin D3-1
MNKQVIKFYLMTQADLVRKSKRKMLELVCRGCRVRGKKETYLLKVNKKGNVRLLNFGSDGEASDGSELNHPWLVILKAEAEEKTVKVVDRKNSGESRERVMGVDFEHPLHGFPASKVQGRVGLETAAMSTLVRPKTCRFGARKEGTQGRSCLGNDRSPPLLRSSIGCPKGISGWCGHDGGKPSWMWDFIGVWNATMEPFSEPARGRSDPVLFIQMFLWLQTRMKHGPCTIITPHVTLVLYNLMDPSFIPSSQTSC

SEQ ID NO: 161016 - protein, 97 aa, Glycine max
  Coding DNA Sequence Number=SeqID_44238
MVATEQRTVGVGLNQSYERAIERHFYYYLFCRLDLREMRLGGVGADKEKEKMGSYSYIHIVQAVETESESVMVVKGECRYRGGCGFWKLSSWFPAHH

SEQ ID NO: 161017 - protein, 557 aa, Glycine max
  Coding DNA Sequence Number=SeqID_44239
  Gene Ontology: Mol. function=serine-type endopeptidase activity
  Homolog annotation: Hit_ID=Q1RW49; Match level="QueryCoverage=82%, HitCoverage=85%, E-value=6e-27, Identity=22%"; Hit description=IMP dehydrogenase/GMP reductase
  Pfam annotation: Domain name=Tweety; Domain location=92-485; Score= -198.3; E_value=0.053; Accession=PF04906.4; Description=Tweety
MALFICTQGRASETCCRSWGEFPARFISQIIQLKMVIVNGTNGLVSLVVILVLIFPEVASQALSPSDSVADNVSVAISQPDNTIRVDPLDHFQKYRGGFNITNKHYWSSVIFTGVFGYAIGVLCIFCGIVYETFLVISTVCHKNDRGRRMKKVFPCNYKSCDLSLILLTILLTIFTIAATGLVLAGSARFHSEAKNSVNIIIKTANEASETIHNTTGALKDMESNFMEANNKAEASVNLDSTTDRLDDASANIEKQARKNRRLINKSLKLVFVITTVIISLNLAAVITLSVSGILRLQRALYLLIVLCWLMTVICWLFFGAYFFLEKFSGDVCTALGSFQENPYKNSLSSILPCDELLSAKSVLSDVSAGIYDLVNKVNANISAMQATSAVNLVQVCNPFSAPPKYLYQPENCPANTIRIGDIPKVLKPFSCSNTIDGTCDNGYLIPGSEYMRVEAYTSSIQDLLNVYPSMENLLECQVVKEAFSQVLVNHCKPLKKYAKMVWLGLLFLAVIMVLLVVLWTIKARHEHRYHLSDGSVEPHCAPTKALESGIAKEIEI

SEQ ID NO: 161018 - protein, 278 aa, Glycine max
  Coding DNA Sequence Number=SeqID_44240
  Gene Ontology: Mol. function=isomerase activity
  Homolog annotation: Hit_ID=Q53LS7; Match level="QueryCoverage=80%, HitCoverage=70%, E-value=6e-35, Identity=33%"; Hit description =ProFAR isomerase associated, putative
  Pfam annotation: Domain name=DUF1530; Domain location=117-206; Score =75.7; E_value=1.5e-19; Accession=PF07060.2; Description=ProFAR isomerase associated
MENRGSDDDENGNGCPCPFFSNLLKDDATHPSSSHSLSQPNDSLEGVPPYPLYKRFSSALLKCMDSETFCRTGANLAMTDEFEDSSMQQKRNEWHRLIVEKGFEIENILKSVSFEFHVQEPFFSQLNDGLKTIEGRCATGKYNRIKSGNLILFNKSVVFEVQGVRRYPTFFAMLEAESLGKVLPGVESSEEGELILKELSYEGVQSLLGLMHTTGTIPNALPPPISTLLASFNFPCNPNENGLTDGARALAKHACRSSSGYWGSLNGNGLSSHGICCL

SEQ ID NO: 161019 - protein, 197 aa, Glycine max
  Coding DNA Sequence Number=SeqID_44241
  Gene Ontology: Mol. function=DNA binding; Cellular component=nucleus
MFWNRQNIVSVKFSNQEEASMACCFLIFGLLNRGWFSILAERVSDPAVKSSNFTARSNVSPYAPPMITMDNDDGISYTAIGGPTGDLLEQNAQALNQISTNLSAFQCMMLLDALEAIFESGVSSITYLKATKQRESRCEQVQENINLFCQTRDNILKIMNELNDSPEVMKQMPPLPVKVNEELASSILPRTNLPPQS

SEQ ID NO: 161020 - protein, 404 aa, Glycine max
  Coding DNA Sequence Number=SeqID_44242
  Gene Ontology: Mol. function=protein binding; Cellular component =ubiquitin ligase complex; Biological process=ubiquitin cycle
  Homolog annotation: Hit_ID=Q2HTR2; Match level="QueryCoverage=94%, HitCoverage=74%, E-value=5e-88, Identity=46%"; Hit description =Cyclin-like F-box
  Pfam annotation: Domain name=F-box; Domain location=7-53; Score=29.6; E_value=1.1e-05; Accession=PF00646.23; Description=F-box domain
MGGVAAVTIDDIPDNCLACIFQLFPPADQKKLSLVCRRWLKVEGHTHHRLCLTLPYSSVLASIFSRFDSVTDLTLQCPNLMSMCDGNLVVISDLCPNLIRLQITKCSYLSYAGLEVLARSCERLKSFSCTSCTFGPNSIDALIHHCTTLEQLSIEYSTVTTHGAQFLNFYPLIRAKNLTTVKIVQCSVEEYWDMFFHSLASQVTSLLEVHLDGCGVSDNGLRAISKLPNLETLHLVKTHKCTHAGLVAVAEGCNKSLRKLCINVSDWKGTNKIGDKGLIAFAKCCSNLQELVLIGMNPSKASLKILASNCQSLEHLGLWGSNKFGDTEICCIAGKCVALKELHIERCPRVYDRDIKTLAAKCPNLVRVKVFECKWVTERDEYVRYHRRLVHVTCKPRTACRSPL

SEQ ID NO: 161021 - protein, 257 aa, Glycine max
  Coding DNA Sequence Number=SeqID_44243
  Gene Ontology: Mol. function=cysteine-type endopeptidase activity; Cellular component=endoplasmic reticulum; Biological process =proteolysis
  Homolog annotation: Hit_ID=O24323; Match level="QueryCoverage=94%, HitCoverage=78%, E-value=3e-75, Identity=45%"; Hit description =Cysteine proteinase precursor
  Pfam annotation: Domain name=Peptidase_C1; Domain location=84-244; Score=143.3; E_value=6.7e-40; Accession=PF00112.13; Description =Papain family cysteine protease
MGTNRSSKATIFILFFTVLAVSSALDLSIISYDRSHADKSGWRSDEEHNAGNRTYKVGLNRFADRSRMMTRPSSRYAPRVSDNLSESVDWRKEGAVVRVKTQSECEQSMQDVVVDLRDYALEFIINNGGIDTEEDYPFQGAVGICDQYKINAVDGYERVPAYDELALKKAVANQPGIFTGKCGTSIDHGVTAVGYGTENGIDYWIVKNSWGENWGEAGYVRMERNTAEDTAGKCGIAILTLYPIKSGQNPSNPDNSS

SEQ ID NO: 161022 - protein, 526 aa, Glycine max
  Coding DNA Sequence Number=SeqID_44244
  Gene Ontology: Mol. function=protein kinase activity; Cellular component=integral to membrane; Biological process=protein amino acid phosphorylation
  Homolog annotation: Hit_ID=Q2LJM1; Match level="QueryCoverage=93%, HitCoverage=94%, E-value=3e-68, Identity=48%"; Hit description =Putative receptor kinase
  Pfam annotation: Domain name=LRR_1; Domain location=100-121; Score =18.5; E_value=0.025; Accession=PF00560.23; Description=Leucine Rich Repeat
  Pfam annotation: Domain name=LRR_1; Domain location=123-145; Score =14.1; E_value=0.5; Accession=PF00560.23; Description=Leucine Rich Repeat
  Pfam annotation: Domain name=LRR_1; Domain location=147-169; Score =17.4; E_value=0.052; Accession=PF00560.23; Description=Leucine Rich Repeat
  Pfam annotation: Domain name=LRR_1; Domain location=171-192; Score =11.0; E_value=2.5; Accession=PF00560.23; Description=Leucine Rich Repeat
  Pfam annotation: Domain name=LRR_1; Domain location=193-215; Score =2.9; E_value=82; Accession=PF00560.23; Description=Leucine Rich Repeat
  Pfam annotation: Domain name=Pkinase; Domain location=275-502; Score=- 84.7; E_value=0.0016; Accession=PF00069.15; Description=Protein kinase domain
  Pfam annotation: Domain name=Pkinase_Tyr; Domain location=335-502; Score=-143.4; E_value=0.0011; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=100-121::123 -145::147-169::171-192::193-215::275-502::335-502
  Subcellular localization annotation: CTP_CleavageSite=70; ConfidenceScore=5.00e-01
MAIDPHLLLFLLLAPSNAHCSKLQRRHLPPFVFTDATALLVFKLKADVNNHLDFSPLTRGLRFCAWHGVECNGPKVLRLVLQNLDLGGAWAPKTLTRLDQLRVLSLQNNSLTGPIPDLTGLFNLKSLFLDNNHFTASLPPSLFSLHRLRNLDFSHNNFSGPIPTAFTTLDRLHSLLLSFNSFNGSIPPFNQSSLKIFRASANNLSGAVPVTPTVFRFPPSSFALNPQLCGEIIRVQCRPAQPFFGPVAPPTAALGQNAQVHGVNGIIRQPYEKKRHDRRALIIGFSAGIFVLVCSLACLAAAVRKQRSRSKKDERTGMMAADAAAREEGAAVMRMEMEEKVKRAEVAKSGGEAQVYTLEQLMKGSAELLGRGARPLHWTSCLKIAEDVAQGLAFIHQAWRLVHGNLKSSNVLLGPDFEACITDYCLSVLTHPSIFDEDGDSAAYRAPETRNPNHHPTHKSDVYADDNENEDNRMYMLLQVATTCSLTSPEQRPTMWQVLKMLQEIKEIVLLEDSSQLDLRSSNAIP

SEQ ID NO: 161023 - protein, 958 aa, Glycine max
  Coding DNA Sequence Number=SeqID_44245
  Gene Ontology: Mol. function=microtubule motor activity; Cellular component=microtubule associated complex; Biological process =microtubule-based movement
  Homolog annotation: Hit_ID=Q8GS71; Match level="QueryCoverage=93%, HitCoverage=87%, E-value=0.0, Identity=72%"; Hit description=Kinesin- like protein
  Pfam annotation: Domain name=Kinesin; Domain location=54-417; Score =474.8; E_value=1.1e-139; Accession=PF00225.13; Description=Kinesin motor domain
LSEKNNNTLSVSHLLSRASKFFFDSLSPSLCASLLLRCFHMEAGEDCCVKVAVHVRPLIADEKLQGCKDCVTIVSGKPQVQIGAHSFTFDHVYGSTGSPSSSMFEECVAPLIDGLFQGYNATVLAYGQTGSGKTYTMGTGFKDGCQTGIVPQVMNVLFSKIGTLKHQIDFQLHVSFIEILKEEVRDLLDTSSMSKPETANGHAGKMTSPGKPPIQIRETSNGVITLAGSTEVSVATLKEMAACLEQGSLSRATGSTNMNNQSSSITYSSSFMCPTSRSHAIFTITLEQMRKLNIPGDSCSNDTMNEEYLCAKLHLVDLAGSERAKRTGSDGLRFKEGVHINKGLLALGNVISALGDEKKRKEGVHVPYRDSKLTRLLQDSLGGNSRTVMIACISPADINAEETLNTLKYANRARNIQNKPVINRDPMSNEMLKMRQQLEYLQAELCARAGGSSEEVQVLKERITWLEAANEDLCRELHEYRSRCPIVEQSEREAYDGSTYIVKTDAVKRSLPITEAEYPMSETVGDSREMEEVAKEWEHTLLQNSMDRELHELNKRLQQKESEMKLFGISDAEVLKQHFGRKIMELEDEKRVVQRERDCLLAEVENLAANTDGQTQKLEDIHAQKLKTLEAQILDLKKKQESQVQLLKQKQKSDEAAKRLQDEIQCIKAQKVQLQQRIKQEAEQFRQWKASREKELLQVLQRKTEEAAMATKRLKELLEARKTSSRETLVTMNGSGANGQGNEKSLQRWLDHELEVMVKEHEVRFEYEKQSQVRAALAEELAMLKQVNEFAAKGLSPPRKNGFARASSMSPNARMAKIASLENMLSISSNSLVAMASQLSEAEERERAFSNRGRWNQLRSMGEAKNLLQYMFNSVADASMSSYVNNRCQLWENDMEIREMKDQVKELVGLLRQSEMKRKEVEKELKVREQAVGTTLATPPSVRLLLLGEALYAKKPMI

SEQ ID NO: 161024 - protein, 338 aa, Glycine max
  Coding DNA Sequence Number=SeqID_44246
  Gene Ontology: Mol. function=oxidoreductase activity; Cellular component=vacuole; Biological process=response to oxidative stress
  Homolog annotation: Hit_ID=O22862; Match level="QueryCoverage=89%, HitCoverage=90%, E-value=1e-120, Identity=68%"; Hit description =Probable peroxidase 26 precursor
  Pfam annotation: Domain name=peroxidase; Domain location=51-297; Score=317.3; E_value=2.7e-92; Accession=PF00141.13; Description =Peroxidase
MGRVMCVAFPLVALVVVSMCYGMADAEVKTQNLRWHYYKVTNTCRDAEEYVRHQVNLFWKNDRSITAKLLRLVYADCFVTGCDASILLDEGANPEKKAAQNRGLGGFAAIDKIKTVLESRCPGIVSCADILHLATRDAVKLAGGPGYPVLTGRKDGMKSDAASVDLPSPSVLQQKVLEYFKSRNLNEVDMTTLLGAHTMGRTHCSFIVDRLYNYNGSGKPDPSMSATFLESLRKLCPPRKKGQADPLVYLNPESGSSYNFTESYYGRILSHETVLGVDQQLLYSDDTKQISEEFAVGFEDFRKSFATSMYKMGNYRVLTGNQGEIRRYCRYTNKGNPN

SEQ ID NO: 161025 - protein, 68 aa, Glycine max
  Coding DNA Sequence Number=SeqID_44247
MKVNLPRSFIVLKKKGNTMLYIVHKGGGTRLELHVKDLEEAKVVEGCEEKGVGTEGGACENNGDGGNK

SEQ ID NO: 161026 - protein, 604 aa, Glycine max
  Coding DNA Sequence Number=SeqID_44248
  Gene Ontology: Mol. function=Rab GTPase activator activity; Cellular component=intracellular; Biological process=regulation of Rab GTPase activity
  Homolog annotation: Hit_ID=Q655M0; Match level="QueryCoverage=92%, HitCoverage=80%, E-value=1e-145, Identity=50%"; Hit description =Putative GTPase-activating protein
  Pfam annotation: Domain name=TBC; Domain location=361-554; Score= -26.7; E_value=1.1e-05; Accession=PF00566.9; Description=TBC domain
MYCGEEEKQWTCGKAGAANLRKVSSIVRDIGDPCLSQSPVKVNRMLKSDKWQTMSDSEGKVFGFRKALKLIVLGFRMLHAHEFGAPGHVLLDNNDCGMGVDPSIRPEVWEFLLGCYSLSSTAEYRRRLRAARREHYSDLIKQCQTMHSSVGTGSLAYVVGSKVMDMRTSSKDGRKSQAKIEGSTYDNNVEVGKCYDRSIICTEVENSSHWESSNNGVDLVSLRVSADNAACDSSGKKNSSSPKSGGEEEESDRVTECSFDFPPLSVTNLFEKSGKDKNSGTEHGDKLPAPEQSRFEVDSMHSFQINNNVELVIESNCQQPLATLNPMDSEIGIASPDEEEPELLSENQVYEAQMVNQLKISDVPQPAMIRSPISQGWPVNEERVSEWLWTLHRIVVDVVRTDSHLEFYEDKRNLARMSDILAVYAWVDPSTGYCQGMSDLLSPFVVIFEDNADAFWCFEMLLRRMRENFQMEGPTRVMNQLRALWHILELLDKEMFAHLSKIGAESLHFAFRMLLVLFRRELSFNEALSMWEMMWAADFDEFMAYDLEENCLEALELHLPRDSSNGMREEIADSDGGSVKNAILVLNRQKIIRETHSFDDMIKA

SEQ ID NO: 161027 - protein, 680 aa, Glycine max
  Coding DNA Sequence Number=SeqID_44249
  Gene Ontology: Mol. function=zinc ion binding; Biological process =regulation of transcription
  Homolog annotation: Hit_ID=Q7X9C0; Match level="QueryCoverage=93%, HitCoverage=65%, E-value=0.0, Identity=70%"; Hit description=NIN -like protein 2
  Pfam annotation: Domain name=PB1; Domain location=580-662; Score =80.3; E_value=5.9e-21; Accession=PF00564.15; Description=PB1 domain
  Pfam annotation: Domain name=RWP-RK; Domain location=308-359; Score =114.5; E_value=3e-31; Accession=PF02042.6; Description=RWP-RK domain
  Pfam module annotation: Pfam domain module=PB1::RWP-RK; Domain location=580-662::308-359
MGALFNYLFTKKIEGSNDKCIYFGFLQLVNLRTVKTLRCLPQSLSNNKKATLTEIVDVLRSVCHAHRLPLALTWIPCGYTECSRGEASRIRIKGGHSTSSEKSVLCLEESACYITDRAMAGFIRACMEHHLEEGKGIAGKALQSNHPFFYPDVKTYDISEYPLVHHARKYNLNAAVAIRLRSTYTNDDDYILEFFLPVNMRGSSEQQLLLDNLSGTMQRICSSLRTVSETELSGIESSPVGLGKKNAPSFFPLSSRNSDIPLINGDCDSVQKMSLKATTNLKDNEIEPSPNQERNGSKRQVQKNRSTSEKNVSLSVLQQYFSGSLKDAAKKIGVCPTTLKRICRQHGIPRWPSRKINKVNRSLKKIQTVLDSVQGMEGGLKFDPSMGAFVAGGSIIQEIDAPKSTIKDPVPVTQDAFSVPPAPCSEGENFSIKLEGKLKKTNVSSVDYSEDSKSMAINDGSCQMASLCTKVQDCPEQACLGSVLAKEHDKRILNKGGLSVEKFKHNIVGQSSKSLIADEMDIGVDGDDGVVERNHPTSSSLTDSSNGSGSMMHSSSSGSRSFENQDQSKVKSTIIDCGSKLIVKATYREDTIRFKFDPSEGCFRLYEEVAARFKLQNGLFQLKYLDDEEEWVMLVNDADLQECIEILDDIGTRSVRFLVRDMPSVLSSSGSSNSYLGGSS

SEQ ID NO: 161028 - protein, 118 aa, Glycine max
  Coding DNA Sequence Number=SeqID_44250
  Gene Ontology: Mol. function=oxidoreductase activity, acting on the CH-OH group of donors, NAD or NADP as acceptor
  Homolog annotation: Hit_ID=Q84JM5; Match level="QueryCoverage=60%, HitCoverage=11%, E-value=6e-13, Identity=59%"; Hit description =Angustifolia
MTSLNKIESIAMLLHSLAYLPHAAQCRLRSYHLILYLGSVNRAIDSALVTNLNLRLVHVDTSHVEKITNTVMVTTHGDEVGGGCHTCIDLDEEDEWGQEEEEGREAVESDGGVGQRKG

SEQ ID NO: 161029 - protein, 323 aa, Glycine max
  Coding DNA Sequence Number=SeqID_44251
  Gene Ontology: Mol. function=protein binding; Cellular component =peroxisomal membrane; Biological process=protein import into peroxisome matrix
  Homolog annotation: Hit_ID=Q2LGJ9; Match level="QueryCoverage=31%, HitCoverage=50%, E-value=2e-32, Identity=70%"; Hit description =Putative glycine-rich protein
  Subcellular localization annotation: CTP_CleavageSite=61; ConfidenceScore=5.22e-01
MAFQASPFEVYDTRISNSPPPKPWEQAGSSSGPAPFKPPSAGNTSDVVEASGTAKPGEIVSSSDRSAAVNRNTLGRPVPSRPWEQNYGNSTYGGYGSTMNYNSGYGSGMYGSSYGGLGGGMYGSSYGGGMYGNSMYRGGYGGLHGSSGMYGGGMYNSALGGPIGGYGMGGGPYGDQDPNDPFGAPPSPPGFWISVLRVLGVLMSHVRQYTMISGVMLMQGVVNFFGRISILIDQNTQAFHLFMTALLQLFDRSGMLYGELARFVLRLLGIRTKSKKVYPPGPNGQPLLGPGPHNPSGNVNYIEAPKAAPSGSWDNVWGNDANQ

SEQ ID NO: 161030 - protein, 48 aa, Glycine max
  Coding DNA Sequence Number=SeqID_44252
MADKAMQIYASMIGLLLLLPPISSLSPYRSDIYKHDLVETLKQDCLHY

SEQ ID NO: 161031 - protein, 208 aa, Glycine max
  Coding DNA Sequence Number=SeqID_44253
  Homolog annotation: Hit_ID=Q9LVJ8; Match level="QueryCoverage=95%, HitCoverage=31%, E-value=5e-47, Identity=49%"; Hit description =Arabidopsis thaliana genomic DNA, chromosome 3, P1 clone: MDC16
MNLQQAGQSKSSNGYGRRKSEREGATKSENKILSGKLNANRLANAGAVTGSKGGSYESPSHDRLVYVTTCLIGHQVEVQVKNGSIYSGIFHATNTDKDFGIILKMACLTKDGSLRGQKSGTEFVSKPLSKILIIPAKDLVQVTAQDVAITRDGLANEYHHDMHQEIMVDSLISQSRHVDLGRELKPWVPDEDDPQCPELENIFDGHWE

SEQ ID NO: 161032 - protein, 767 aa, Glycine max
  Coding DNA Sequence Number=SeqID_44254
  Homolog annotation: Hit_ID=Q1SCT7; Match level="QueryCoverage=60%, HitCoverage=95%, E-value=1e-133, Identity=58%"; Hit description =Ataxin-2, N-terminal
  Pfam annotation: Domain name=Ataxin-2_N; Domain location=1-82; Score =106.1; E_value=1e-28; Accession=PF06741.3; Description=Ataxin-2 N -terminal region
  Pfam annotation: Domain name=CBFB_NFYA; Domain location=647-703; Score=129.6; E_value=8.6e-36; Accession=PF02045.6; Description=CCAAT- binding transcription factor (CBF-BNF-YA) subunit B
  Pfam annotation: Domain name=PAM2; Domain location=271-288; Score =2.0; E_value=5.7; Accession=PF07145.5; Description=Ataxin-2 C -terminal region
  Pfam annotation: Domain name=PAM2; Domain location=362-379; Score =27.0; E_value=6.5e-05; Accession=PF07145.5; Description=Ataxin-2 C -terminal region
  Pfam module annotation: Pfam domain module=Ataxin-2_N::CBFB _NFYA::PAM2::PAM2; Domain location=1-82::647-703::271-288::362-379
GWDQFETNEALFGVKSTFNEDLYTTKLEKGPQTRELERQALRIAREIEGEETQDLHLAEERGLHLHEDFDIDEETRFSSVYRGKRVDDSGFDEGVLFDSHNSETFGGETFGGVFGSVVKRPGEISGGKGNDGAQTLANSSSVDISINDYFFDKLSESERENEKDKADIIAQKEKLNELDTTEDHTLSSQSNTGVDLSRSGSSDHAKQLASELPAKSYSTSDGESRIQENSNSNQHGDNGITKEENLIQAEDVQLSKSEDSQGPLYMNKDGSDKGVLSPNASSYAPSSHTSSKTHEKMGSHGDLVDGSASGKANGETKSVNSRGTQSGSDLVGSIPASSALGLSPSSSVGSLSSEKSTLNPNAKEFKLNPNAKSFIPSPARPPTPVSDGSFYFPTNVTTVPSMPGMPMGIGIGPTFASPQPVIYNPQVAQMPSQGYFHPNAPQYGQLLGHPRQALYMPSYMPVGLEPEWKTMNCLCEKDSGLFSSHSTAPYVLGCPSWATSEFEVQRSSMSRSLSSKVDVLPQQCHNSKTFNFQFQEQDASSTKSTDQSYPEVGTVQSGQISVQHSSTDSTLIRNEGKSMGCVIRSFMGSQDFPFPPPLLDHRPILAHIACHYADPCYSGLVAAAYSPQSKPVETAPVRIPLQLDFAEEPIYVNSKQYHAILRRRQYRAKLEALNKPIKDRKPYLHESRHQHALKRARGAGGRFLNTKKQLQSNHTPGNIAESKMHHIENYRDGADVSYAFNSDARNMQNDAADKGGGTTQQPLFVYM

SEQ ID NO: 161033 - protein, 406 aa, Glycine max
  Coding DNA Sequence Number=SeqID_44255
  Gene Ontology: Mol. function=binding; Cellular component =mitochondrial inner membrane; Biological process=transport
  Homolog annotation: Hit_ID=Q8L9F8; Match level="QueryCoverage=82%, HitCoverage=100%, E-value=1e-97, Identity=55%"; Hit description =Mitochondrial carrier-like protein
  Pfam annotation: Domain name=Mito_carr; Domain location=191-287; Score=101.9; E_value=1.8e-27; Accession=PF00153.17; Description =Mitochondrial carrier protein
  Pfam annotation: Domain name=Mito_carr; Domain location=309-402; Score=90.2; E_value=6.3e-24; Accession=PF00153.17; Description =Mitochondrial carrier protein
  Pfam annotation: Domain name=Mito_carr; Domain location=96-180; Score= 33.5; E_value=7.6e-07; Accession=PF00153.17; Description =Mitochondrial carrier protein
  Pfam module annotation: Pfam domain module=Mito_carr::Mito_carr::Mito_ carr; Domain location=191-287::309-402::96-180
RDALSSLLFPSMDAETVDLLNLYPTGQDPLSLIPPSLSISLHGQEFEGKRKQNQILISGGFEKVAKMNLGAAEEEESAAQVRVPAEIDWHKLDKSKFFCLGAALFSGVSATLYPVVVLKTRQQVFPSQISCIKTAFSLIRLEGLRALYRGFGTSLMGTIPARALYMAALEITKSSVGTATLKFGVAEPTAATVANGAAGLSAAMVAQLVWTPVDVVSQRLMVQGVSNSSKSSNQYMNGIDAFRKILKKDGAKGLYRGFGISILTYAPSNAVWWASYSVAQRMVWGGVGWCLCKKGCGGEGELRPDSKTVMAVQGVSAAMAGGMSALITMPLDTIKTRLQVLDGDENRRRGPTVMQTVRKLVREGGWMACYRGLGPRWASMSMSATTMITTYEFLKRLSMKNQEVLT

SEQ ID NO: 161034 - protein, 123 aa, Glycine max
  Coding DNA Sequence Number=SeqID_44256
  Gene Ontology: Mol. function=peptidase activity; Cellular component =chloroplast thylakoid membrane; Biological process=lipid transport
  Homolog annotation: Hit_ID=Q1T4I0; Match level="QueryCoverage=54%, HitCoverage=54%, E-value=6e-21, Identity=74%"; Hit description=Plant lipid transfer/seed storage/trypsin-alpha amylase inhibitor
MRITSLKLPQTPAKPELHAMYRGLQFAWSKEYKGQYSGALGLRQARPRSLSSFNHHHDESLGNTLSTVVEKQAQVHCYIEVDAQHISFESSAKAHSSFKISETLNEVAAWGLWWLPKLHVDQT

SEQ ID NO: 161035 - protein, 308 aa, Glycine max
  Coding DNA Sequence Number=SeqID_44257
  Gene Ontology: Mol. function=nucleic acid binding; Biological process= DNA integration
MPDASNPMPPISTFVKLLPDVSKIEVFTGQNFCCWQEHVHILLDVHVVVFAFSTPKPDVVDDASQLQQWVQANKESKEISDSLILKYTVEDMVRQRFIIANYYRWIMNEEKDIKVQINEYHNLLEDLKTKNISLPDQFVYELLITHKHTSLSDLITHIIIEDTNRKESVAARTKAMYAKANTVQQDKPFHKRYADKIDHNTKNKYKYNNPRVAPSNLIPRAPTSNFFQEKWSLFCLWEARTFFSSVQACQALARGLATHGYEGFTMRGGVKERKGVNETPRRGGSVVVCSVPWTDSLFIAAEVGFGPS

SEQ ID NO: 161036 - protein, 601 aa, Glycine max
  Coding DNA Sequence Number=SeqID_44258
  Gene Ontology: Mol. function=protein serine/threonine kinase activity; Cellular component=ubiquitin ligase complex; Biological process=protein amino acid phosphorylation
  Homolog annotation: Hit_ID=Q1SLQ3; Match level="QueryCoverage=60%, HitCoverage=52%, E-value=1e-148, Identity=71%"; Hit description =Protein kinase
  Pfam annotation: Domain name=Pkinase; Domain location=96-354; Score =119.2; E_value=1.1e-32; Accession=PF00069.15; Description=Protein kinase domain
  Pfam annotation: Domain name=Pkinase_Tyr; Domain location=96-359; Score=92.5; E_value=1.3e-24; Accession=PF07714.7; Description =Protein tyrosine kinase
  Pfam module annotation: Pfam domain module=Pkinase::Pkinase_Tyr; Domain location=96-354::96-359
MKHEKFTQEDVVKAWLAEEATLSLAEVKRKKTKAAMESAEMSKCLAEMKSHKGKQTEIRAMHEEEDRNKALNASAHNKILFKRYNIKEIEVATNYFDNALKIGEGGYGPVFKGVLDHTDVAIKALKPDISQGERQFQQEVNVLSTIKHPNMVQLLGACPEYGCLVYEYIENGSLEDRLFQKDNTPTIPWKVRFKIASEIATGLLFLHQTKPEPVVHRDLKPANILLDRNYVSKITDVGLARLVPPSVANKTTQYHKTTAAGTFCYIDPEYQQTGLLGVKSDIYSLGVMLLQIITGKPPMGVAHLVEEAIDKGKLLEVLDPNVKDWPLEETLSYARLALKCCEMRKRDRPDLSSVILPELNRLRNLGEVAIYTDIVPAKQGKFDQIANLMEQCSKSVHDIPCTRYVADQNQVKVTETVYCEPDPTMLPTCHPAEADRYDAGAVFGDFKEHGHGEVEVRARRVAPAAIVVWKSVVRGTEVVGGDEDGRLAGVTPHHCLSFAHLISKHAPQLSPLFKSAVLNAPLCTLIPNSVLNSNFEYSNSYEVPEEEAMTFAVKSQGSTLDRRWKLPSWSTVGAEGISGGAVKCIEIEKNTNDESTMLGRY

SEQ ID NO: 161037 - protein, 265 aa, Glycine max
  Coding DNA Sequence Number=SeqID_44259
  Gene Ontology: Mol. function=protein serine/threonine kinase activity; Biological process=protein amino acid phosphorylation
  Homolog annotation: Hit_ID=Q1SCT2; Match level="QueryCoverage=45%, HitCoverage=19%, E-value=1e-27, Identity=57%"; Hit description =Protein kinase; UspA
IVAKELVLHGIDVSNALTDYIIDNSINNLVVGASRWNAFIRKFKDVDVPTSLVRSVPESCTVHVISKGKVQNIRRADHSQNISNALSKSLKGIRGSFRSDEDLNRKSVKYGHRQGSNNDGVSSVTSRMTNGETTSPKLSNESCSSQNSSNRSSVTGDTSKLLGYQLIETSHENQDVVENSGSYTYRSKSCKISQLSSNTYFENCIEQFGCFVLLLVPILNVALALGFFAHFSFISGLLKLGYLTAELGNRKKEPKTRTGEKDKEV

SEQ ID NO: 161038 - protein, 118 aa, Glycine max
  Coding DNA Sequence Number=SeqID_44260
MTVKVVGMGNGDELMVSLRNRCRHSDKTPLSPPYIAGFKLVRDNILKYRSMITSSISVGALWCQLELAKPGDAYKMTLVACREDEYPFLHPSHDGVGCLIQVTEFWMTPLPKREDKLG

SEQ ID NO: 161039 - protein, 39 aa, Glycine max
  Coding DNA Sequence Number=SeqID_44261
MEDTWESVTRRSSEFILTGINTDIRLAPTFGIHRVGRVP

SEQ ID NO: 161040 - protein, 115 aa, Glycine max
  Coding DNA Sequence Number=SeqID_44262
MKAQVEKDEGPNNPCGVYPDLSSFTGSGVYPDLSSFTGSGVYPDLSSFTGSGVYPDLSSFTGSGVYPNLSSLFGSGVNQKLYSLYQTIHPVRFTSSGMRASALDTGSILSYYFSL

SEQ ID NO: 161041 - protein, 308 aa, Glycine max
  Coding DNA Sequence Number=SeqID_44263
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=4e-39, Identity=29%"; Hit description= UPI00006A17C9 related cluster
LHALAFRGLHALAIKGLHVLAIRGLHVLASRGLHALTFRGLRILTYRGLDVLAFRGLHVFTIRGLHVLAIRGLHVLAIRGLHALAFRGLHVLTFIGLHALTFGGLHVLAFIGLHAHTFRGLHVLTSRGLHVLALRTPRPHLQRTARVHVLAIRGLHVLSFIGLHALNFRRLDFLAFRGLDVLAFRGLQAVAFGGLHALTFRGLRVLTFRGLDVLAFRGLHALGFKGLHALAFIGLHTLTFRGLRVLDFVGLHALTFRGLQVLAIKGLHVLSNRGLHILTFKGLHVLAFRGLHVLTIRGLHAPFNPPDI

SEQ ID NO: 161042 - protein, 74 aa, Glycine max
  Coding DNA Sequence Number=SeqID_44264
  Pfam annotation: Domain name=zf-CCHC; Domain location=8-25; Score =18.8; E_value=0.00077; Accession=PF00098.13; Description=Zinc knuckle
MQEKTRSMKCFKCLGRGHITYQCPTKKNMIMRGQDIYSSQDEVTTSTSSSESEEAKGEESSEEIYPQGEGQPLM

SEQ ID NO: 161043 - protein, 241 aa, Glycine max
  Coding DNA Sequence Number=SeqID_44265
MQQQRPIALKPDVEFDQTNAMFFYFKDMYENSHLASTSEYDNEDTSNHMHMVPILRLVKIYKFNDWQMCFLRQEGDNGFYQRLIHDIPLIRTCFIFNLHQYPKAAMQRVIVKAWTRHPILKKHLFSPDQNPWVPCQGMVAELQSNNRRSSNFRCCLATYKLILDLSTPREITTLIAFAPTGVSEERIQEMLHLQQASREETMEKRFLFERMETNPVIENTLEALLKSINDYVLFNMNMLMQ

SEQ ID NO: 161044 - protein, 51 aa, Glycine max
  Coding DNA Sequence Number=SeqID_44266
MIREKGSDNQLSEDGGGGLDDGDFGGEGGGLGIGFAVDVDAGIIAEGGEGG

SEQ ID NO: 161045 - protein, 170 aa, Glycine max
  Coding DNA Sequence Number=SeqID_44267
MEGGGVACARRGDLDTCCLVFLSVNVTWTRSGYFLMNGSILHLRVEVRVKEPTKEEFITKHNSPPKQIPMLSRRLGGSNKRLPSKSPTAAHLLPRTKVRDHHRHQSHGTKIAKGEIVEASFMMMNQAILMMPKAQVIDSRLQDQASRIQSKIQDSRFKRRNLEATSQDFI

SEQ ID NO: 161046 - protein, 69 aa, Glycine max
  Coding DNA Sequence Number=SeqID_44268
ARVSTKESCVVKVSVSKVLDEDASVPFLTSEDLHRHQKKPIEPVDTSNPIDDPLVDLVKVPFDLYLHPY

SEQ ID NO: 161047 - protein, 201 aa, Glycine max
  Coding DNA Sequence Number=SeqID_44269
MSLPSEDCTSSPAEGCTPSPLEGYASSFSVCSISTPEENIRSFALRCLTETCAPGKGASSFLLSVPRPPPDIGGRPTVRAHPEREAITHLQHSAQRPQCQSPPTDVSVGLCRHDIGIAPTRRLVDPKKSNRALGFPALVTGLCQSYKVPVPQRGHRDIGIAPTKTPSGPGEVQQGPGVSSSGYGSLSVLQGARPPGKVTSS

SEQ ID NO: 161048 - protein, 79 aa, Glycine max
  Coding DNA Sequence Number=SeqID_44270
MSQSFDMIGVVDDNKETFKLGVQVVDLWFDQEREKSSHLEMVLMDGKGLCSILMLCQRDRIHVMVKKEDQSYPNLFFVL

SEQ ID NO: 161049 - protein, 161 aa, Glycine max
  Coding DNA Sequence Number=SeqID_44271
  Homolog annotation: Hit_ID=Q10DI5; Match level="QueryCoverage=43%, HitCoverage=24%, E-value=2e-08, Identity=47%"; Hit description =Expressed protein
  Subcellular localization annotation: CTP_CleavageSite=59; ConfidenceScore=5.54e-01
MILVSRIQVHCGGAMFSKCSSLLSLPEFITVTNPPTFSNPAPKFIPRRRSSTRPFHLTLAKAEGNLDSDSPSTSSSSPSPFATDQTVFVTGEDVPLEGVIQFEKPTSSPPFEKWGRVALLAGADVLALFVFATIGRYSHGLSVLDLETLRTADPFIAEFEV

SEQ ID NO: 161050 - protein, 141 aa, Glycine max
  Coding DNA Sequence Number=SeqID_44272
MEKMNMHKKKGPLRVHRSHSNLKNKTNQRSREENRTRNIVGIDHGRDSEKGHFGALAARPGELSLRPEVMSLPSQMLALESWGLENARKRPFCTPSLVSFVFRIETPSGSSLCNVTYVQCRKSTSKNQKINEQWSPDEIRV

SEQ ID NO: 161051 - protein, 32 aa, Glycine max
  Coding DNA Sequence Number=SeqID_44273
MNGLYKGVVATTKSWAVGIPLIGLIAAILIEF

SEQ ID NO: 161052 - protein, 345 aa, Glycine max
  Coding DNA Sequence Number=SeqID_44274
  Gene Ontology: Mol. function=DNA binding
  Homolog annotation: Hit_ID=Q1SWX1; Match level="QueryCoverage=62%, HitCoverage=41%, E-value=2e-21, Identity=31%"; Hit description=IMP dehydrogenase/GMP reductase
MGLDQAPSFKKRFYHVKVKNLELASLCKLGQRIDQVQHQAFSKVYGKIWNLVMIEVSIEAFTSLTQYYDQSLRCFTFGDFQLAPTIEEFEGILRCPLGGRKPCLFSGFYPSMARIEIMVKISEQELDRVKQNRNGVAGIPRKCLEEKAEALASQEEWATFTDVLALLVFGTILFLNIDGLVDLAVIDAFLAYHHNKESPVIAVLADVYDTFNLRCKKSSARIVCCTPSLYVDMSVPYKVIACDPERRIRKAWNRVERKNKELRGSSNGVIGSYYKWLKSRTQAITWLPKLKVLSGKKVEIPEESEEVQALKAELETTRVVKEKLKVAVTRVRKECDDLKDINITT

SEQ ID NO: 161053 - protein, 59 aa, Glycine max
  Coding DNA Sequence Number=SeqID_44275
MDGYVAIADKLERLLNLRILTEGIEVYTVAEECLSIARSYIGQPTIGHRSRRRRRTDGH

SEQ ID NO: 161054 - protein, 120 aa, Glycine max
  Coding DNA Sequence Number=SeqID_44276
MTPTYDALLYYNGRWNMSHQRDFVSYSFTGKNPKIFDIPSGCNINGLEDVIKQPGHSGYSENVIKFEIIELKTNDDVLKVLVQSNYWKQFGLIEILAIFSKPVIKMEDDMSQSQHDSMQN

SEQ ID NO: 161055 - protein, 48 aa, Glycine max
  Coding DNA Sequence Number=SeqID_44277
  Gene Ontology: Mol. function=protein kinase activity; Cellular component=cytoplasm; Biological process=protein amino acid phosphorylation
  Homolog annotation: Hit_ID=Q7XZK5; Match level="QueryCoverage=96%, HitCoverage=8%, E-value=3e-16, Identity=80%"; Hit description =Calcium-dependent calmodulin-independent protein kinase isoform 1
TDVDGNGSIDYLEFISATMHRHKLEGDKHLYKAFQYFDKDYSGRVLQD

SEQ ID NO: 161056 - protein, 252 aa, Glycine max
  Coding DNA Sequence Number=SeqID_44278
  Gene Ontology: Mol. function=histone-lysine N-methyltransferase activity; Cellular component=nucleus; Biological process=chromatin modification
  Homolog annotation: Hit_ID=Q6ZW69; Match level="QueryCoverage=90%, HitCoverage=47%, E-value=1e-133, Identity=96%"; Hit description=CDNA FLJ41529 fis, clone BRTHA2014792, weakly similar to ENHANCER OF ZESTE
  Pfam annotation: Domain name=SET; Domain location=99-228; Score =182.7; E_value=8.8e-52; Accession=PF00856.18; Description=SET domain
MEKKLPIQPVAQMSSNKDIITLKDLHTEELPQYIHMNQNEFCIRRHKKQKEEDIAICECKYDADDPDNACGDSCLNVLTSTECTPGYCPCGVLCKNQKFQKCEYAKTKLFKTEGRGWGLLADEDIKAGQFVIEYCGEVISWKEAKRRSQAYENQGLKDAFIICLNASESIDATRKGSLARFINHSCQPNCETRKWNVLGEIRVGIFAKHDIPIGNELAYDYNFEWFGGAKVRCLCGALKCSGFLGAKSRGFQ

SEQ ID NO: 161057 - protein, 263 aa, Glycine max
  Coding DNA Sequence Number=SeqID_44279
  Gene Ontology: Mol. function=histone-lysine N-methyltransferase activity; Cellular component=nucleus; Biological process=chromatin modification
  Homolog annotation: Hit_ID=Q6ZW69; Match level="QueryCoverage=98%, HitCoverage=52%, E-value=1e-114, Identity=86%"; Hit description=CDNA FLJ41529 fis, clone BRTHA2014792, weakly similar to ENHANCER OF ZESTE
MSRRILIYGKMMMTGIWPPMYSVEKIPVYDSAEDEPVSNFNGQTEPSLDVMVKAEQLLESTAFHVQPLDSVQMKDLDVKKIKTDVADEHMNLYYQDGEQTLSRKNAISRIRSNTAGRNYLLGPRSMSTKRSRSYNGVRFKNLTEKKIDAKFAAALLAFKEAQEEILNCELSSMQKIKDDATSALDSLYDEIRPAIEEHERDSQDSVSTTVAEKWIQACCLKLKAEFDLYSSIVKNVACTAQRAPGQGKPTEVDNENEIKLLTG

SEQ ID NO: 161058 - protein, 137 aa, Glycine max
  Coding DNA Sequence Number=SeqID_44280
  Homolog annotation: Hit_ID=Q6CQE5; Match level="QueryCoverage=34%, HitCoverage=43%, E-value=2e-08, Identity=63%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGR

SEQ ID NO: 161059 - protein, 220 aa, Glycine max
  Coding DNA Sequence Number=SeqID_44281
  Homolog annotation: Hit_ID=Q8TGM6; Match level="QueryCoverage=46%, HitCoverage=82%, E-value=8e-11, Identity=53%"; Hit description =Protein TAR1
  Subcellular localization annotation: CTP_CleavageSite=37; ConfidenceScore=5.41e-01
MTSPRAYQQPGLGPPSQSASVNVPSRSADRLSPFHIRPGHIAGPHPLPSRQFQALFDSLFKVLFIFPRGTCSLSVSRQYLALDGIYRPIGAAFPNNPTRRQRLVVRQGPGTTGLSPSLAPPSRGLGPGPPLRTLLQTTIRTPRATDFHGRRALGLMASGATCVQRLDGSRDSAIHTKYRISLRSSSMQEPRYPLPRVIVCKCCVVTTPAGHRLRAPGSRT

SEQ ID NO: 161060 - protein, 77 aa, Glycine max
  Coding DNA Sequence Number=SeqID_44282
MKVKHMRYATNTLDSSLHAMWYHFSVKNLVGRLGVHDRTCLTMGKSGLQEHSNRMTPKAYTLKSPSVPLPPDSVRLK

SEQ ID NO: 161061 - protein, 91 aa, Glycine max
  Coding DNA Sequence Number=SeqID_44283
MSFGFMLVLAKRLSRAPNLTCLASSLAEAMKGCEGLFGLCRKLVFEGFGAPSKTPHVVDLDGNKDEDSDKGDGRDEGEEEGEAKENGMGGI

SEQ ID NO: 161062 - protein, 85 aa, Glycine max
  Coding DNA Sequence Number=SeqID_44284
MEDILKMEYLFKRLAKCLDSTRSRELHPYNQYEEERTPNLEGVFTEFMAYHASSKVHQNSMQNKEIHVGKSYSMENYLWEQQLQT

SEQ ID NO: 161063 - protein, 41 aa, Glycine max
  Coding DNA Sequence Number=SeqID_44285
MPFEGLRERLRAKSVHEGDNFEIMKAISIMSGKTIPFNFMS

SEQ ID NO: 161064 - protein, 98 aa, Glycine max
  Coding DNA Sequence Number=SeqID_44286
  Gene Ontology: Mol. function=transferase activity; Biological process= DNA integration
  Homolog annotation: Hit_ID=Q1S5C0; Match level="QueryCoverage=98%, HitCoverage=16%, E-value=1e-09, Identity=31%"; Hit description =Polynucleotidyl transferase, Ribonuclease H fold
MPISNNNNNQETTNNNEFCNKSKSLLVIYTCSLCEAFGNRRMTNKERNHDPCVVVFKSLDFILHSNNPFGICTSFLPGCRLNLKGNIMSKLLIRCSQL

SEQ ID NO: 161065 - protein, 156 aa, Glycine max
  Coding DNA Sequence Number=SeqID_44287
  Gene Ontology: Mol. function=transcription factor activity; Cellular component=nucleus; Biological process=regulation of transcription, DNA-dependent
  Pfam annotation: Domain name=AP2; Domain location=34-92; Score=4.5; E_ value=0.00017; Accession=PF00847.10; Description=AP2 domain
MSVLCITSFALHLAGPPIKRRKRHRRKNLHNQEQCVMRGVYFKNMKWQAAIKVDKKQIHLGTVGSQEEAAHLYDRAAFMCGREPNFELPEDEKRELSKFKWDEFLAMTRQAITRKKHKRRLSPGPDNGHDILPLPKDDWDSKQGVIEDAEQETPVS

SEQ ID NO: 161066 - protein, 55 aa, Glycine max
  Coding DNA Sequence Number=SeqID_44288
MGACLWTRFEKVLEAIKEVEGLRIKVFQDEFSIGRSGENGNMVVVKDESLAQINE

SEQ ID NO: 161067 - protein, 161 aa, Glycine max
  Coding DNA Sequence Number=SeqID_44289
  Homolog annotation: Hit_ID=Q9M3H8; Match level="QueryCoverage=36%, HitCoverage=13%, E-value=3e-07, Identity=42%"; Hit description =Putative UDP-glycose
  Subcellular localization annotation: CTP_CleavageSite=30; ConfidenceScore=5.27e-01
MCHLLFSVTTTQVDVPSTCTTKDVPSNVLRQSSQAGKGRIKRILRLCRFEFFEKGEGRHKRIQAVSPSFFWKREKRDTKRIQANKVWKPSSYPWPPMVDVKEIMGWKRIENGLRKVTKDEGGSLKKRVQEMKEKAHKVVQEGGSSYDTVSILVQTLKQIKV

SEQ ID NO: 161068 - protein, 66 aa, Glycine max
  Coding DNA Sequence Number=SeqID_44290
  Subcellular localization annotation: CTP_CleavageSite=25; ConfidenceScore=5.29e-01
MYLLLFSITTTQVDVPSTCTTKYVPSNVLRQRILRRFPLNLCKGKTKDISGEFSLAEEQGLEKQKT

SEQ ID NO: 161069 - protein, 141 aa, Glycine max
  Coding DNA Sequence Number=SeqID_44291
MDRNGESTKRTMRYSLVKNSNPYMKQKKDGHGTKTNMGNNIVIATNSGTGNATLYRYYKQCVDDNKPDMLVVLETRVDPRKLRHTFSILGYDGVDFVDGQGFAGRIIVAWRTHIWCRWFLTVDGSYFFLKTAVDGSFSNFH

SEQ ID NO: 161070 - protein, 120 aa, Glycine max
  Coding DNA Sequence Number=SeqID_44292
MAGTFFLLKKQNSLEIMSSEKEMTPNRVVNWPFRTLYHYFGDSTLPIEYYDAKVLHASEDRIGKMVRVDQNTLTQERGKFGMWRDVLTKENQTHGKESTTIKGMGINKQTEEQYRPFEGL

SEQ ID NO: 161071 - protein, 94 aa, Glycine max
  Coding DNA Sequence Number=SeqID_44293
  Homolog annotation: Hit_ID=Q1S8I9; Match level="QueryCoverage=44%, HitCoverage=8%, E-value=9e-14, Identity=83%"; Hit description =Probable integrase-common tobacco
MWGIDVIGAIEPKVSNEHRFILFVIDYFTKWVEAASYANVTRNYRSKVSWRIKDDDKGDDKKLKDQSKNNSSESRTIQEFKIRIKKNSRLKKKV

SEQ ID NO: 161072 - protein, 205 aa, Glycine max
  Coding DNA Sequence Number=SeqID_44294
  Gene Ontology: Mol. function=DNA binding; Cellular component=nucleus; Biological process=regulation of transcription, DNA-dependent
  Homolog annotation: Hit_ID=Q8H6E9; Match level="QueryCoverage=61%, HitCoverage=49%, E-value=1e-47, Identity=63%"; Hit description=Myb -like protein P
  Pfam annotation: Domain name=Myb_DNA-binding; Domain location=14-61; Score=47.9; E_value=3.3e-11; Accession=PF00249.21; Description=Myb -like DNA-binding domain
  Pfam annotation: Domain name=Myb_DNA-binding; Domain location=67-112; Score=53.1; E_value=9.2e-13; Accession=PF00249.21; Description=Myb -like DNA-binding domain
  Pfam module annotation: Pfam domain module=Myb_DNA-binding::Myb_DNA -binding; Domain location=14-61::67-112
MVRAPFYDKNGLKKGAWSREEDEKLTAYVKRHGHSNWRQLPKFAGLARCGKSCRLRWLNYLRPNLKHGNYTLEEEKIIIKLHQEFGNKWSLIAEKLPGRTDNEVKNYWHGHLKKIKSNEITTSKLKSKPGYSIEKAHWPCPGKVPQKETTIPLPLLFHYQPWIVPYQKKNLFLHWYLTKNSAAIFGLNHSSQKIRLLMRYVVVKA

SEQ ID NO: 161073 - protein, 59 aa, Glycine max
  Coding DNA Sequence Number=SeqID_44295
EPFAAWLGVLTERQKGSGAFSKITGQIFLVALLNLHVGCKAKNAFFAGVITIIEVAHEK

SEQ ID NO: 161074 - protein, 633 aa, Glycine max
  Coding DNA Sequence Number=SeqID_44296
  Gene Ontology: Mol. function=RNA-directed DNA polymerase activity; Cellular component=extracellular region; Biological process=RNA -dependent DNA replication
MELRDKEDANKLDVKWEMQPAVSRAGGLICLWNESSFRLDRKVCGQGFIYLEGIWVPDAHRMAIVNIYAPCDMIQKRNLWGQITQLKALNPDVLWCILGDFNNIQTAKERVGLSQRRVNDATMDEFNEWIENIQVEEVPCAGRKFTWYKPNGTAKSRLDRFLVTADWLSKMARFHTVYSGKKFLGSLSGWFKNLGRIIRQKLVNIEKELNKIEAEGDVRQLSAQVLMCRKNLQEELWSAAQSFESLLRQKARSRWIKEGDINSRFFHRFANPKCKSSTLRGVFVNDVWVDEPGRVKAETYLFFKNRFQEVEWVRPKLDGVRFKEIGQQHNIRLSGPFSENEVKEATDMLRFMDEFYVHGSFPNGCNASFVTLVPKGVMPLLIDETQSAFIEGRHLLQSTIIANEVIHEAKTRNKPCLVFKVDYEKAYDSVSWEFVLYMLKRLGFCGKWISWIEGCLKPTSISILVNGSPTSEFIPQRGLGQGDPLAPFLFNIVVEGLNGLVKEAMDKNLYQGFKVGRNEVNISILQYADDTLFLGKASMENVRAIKVSAASYLNCELLTIPFLYLGILIGANPRGSELWDPIVKKWAEQKKIAWVKWESVCLPKEKGGMGIKDLRKFNYALLEAVEYQLSGRI

SEQ ID NO: 161075 - protein, 138 aa, Glycine max
  Coding DNA Sequence Number=SeqID_44297
  Gene Ontology: Mol. function=protein disulfide oxidoreductase activity; Cellular component=chloroplast; Biological process =glycerol ether metabolic process
  Homolog annotation: Hit_ID=P0AA25; Match level="QueryCoverage=70%, HitCoverage=90%, E-value=2e-50, Identity=98%"; Hit description =Thioredoxin 1
  Pfam annotation: Domain name=Thioredoxin; Domain location=33-136; Score=171.1; E_value=2.8e-48; Accession=PF00085.10; Description =Thioredoxin
MDPGKLRLLSATGAVNLPQVDLQTVRLSIGGGGPWWIHSRSFDTDVLKADGLILVDFWAEWCGPCKMIAPILDEIADEYQGKLTVAKLNIDQNPGTAPKYGIRGIPTLLLFKNGEVAATKVGALSKGQLKEFLDANLA

SEQ ID NO: 161076 - protein, 184 aa, Glycine max
  Coding DNA Sequence Number=SeqID_44298
  Gene Ontology: Mol. function=RNA-directed DNA polymerase activity; Biological process=RNA-dependent DNA replication
MATLNSPLAHDEVQNDLFDMKPWKAPGPNGWVVVDKVEFVNQFKPISLCNIDYKVLFEVVVNRLKPLMSSLISPFQMDFILKRSIRENVVVAQELLHSIRRMQVVDKNQWVPMRLGRLPWSKFNIYDASFEFIWLDVGSNVLRLEDKLFIKVALLKFNHRENTWESLSKENLLGKWISSIWWIE

SEQ ID NO: 161077 - protein, 115 aa, Glycine max
  Coding DNA Sequence Number=SeqID_44299
GSSRCGVSMENNDGLWWLMVAVGDGESAWNFRIGFGRKKEEEMMFFLSYMKAKAETKFREDPTINEGWAAFLPRQFIPSTFAYLWLWTWSPTGQPQVVGNAPAFVDELRGLGGGG

SEQ ID NO: 161078 - protein, 184 aa, Glycine max
  Coding DNA Sequence Number=SeqID_44300
  Gene Ontology: Mol. function=phosphoinositide binding; Biological process=cell communication
  Homolog annotation: Hit_ID=Q00V04; Match level="QueryCoverage=41%, HitCoverage=11%, E-value=9e-09, Identity=41%"; Hit description=[U] KOG2273 Membrane coat complex Retromer
  Pfam annotation: Domain name=PX; Domain location=12-130; Score=70.5; E_value=5.2e-18; Accession=PF00787.14; Description=PX domain
MKIPNPAKGEKQRLRIREERDAPRPPRSATFYTYLITTLINLLEYGGAGSEFAVKRRFRDVVALSKQLAEAYRGFFIPERLDKSMMESQVMQKQEFVGQRRVALEKYLRKLAAHSVIGRSEELRLFLEAKGRLPLAKTTYVASRMLDGTVRLPRQLFSGEAELGEMAQLAKGRRDLLKIFKELK

SEQ ID NO: 161079 - protein, 52 aa, Glycine max
  Coding DNA Sequence Number=SeqID_44301
MSCTHFSYSGELHFRTEIYQSTRHLEMNGWQKELAQLPSLIELFSATEWSEA

SEQ ID NO: 161080 - protein, 66 aa, Glycine max
  Coding DNA Sequence Number=SeqID_44302
MFLSRFCVSLVLPSVFVSSLWLILGNELNHVLIHINRIIEKYRQCCFNMSQTGNVTEHQSEQCLYQ

SEQ ID NO: 161081 - protein, 66 aa, Glycine max
  Coding DNA Sequence Number=SeqID_44303
MAENLHEITHGNVLDALRKLLGKWGRSLPPSSPRRARLLPPEATAFWRNILESPGGLVAIFTPPVY

SEQ ID NO: 161082 - protein, 167 aa, Glycine max
  Coding DNA Sequence Number=SeqID_44304
  Gene Ontology: Mol. function=nucleic acid binding; Cellular component= nucleus; Biological process=type I hypersensitivity
  Homolog annotation: Hit_ID=Q5N8W4; Match level="QueryCoverage=44%, HitCoverage=24%, E-value=5e-27, Identity=79%"; Hit description =Putative RRM-containing protein SEB-4
MKYYFEQFGEILEAVVISNKAIGRSKGYGYVTFREPEAAMRACMDPAPVIDCRRANYNLASLGVQRSRPSTAKHVFIRTNYNGNINMLQREVSTKSTYAEAQSYNEDMKLTSNPTPTMAARLNYSMAATMGLRSPRVPQSLHQKPKKVLRLTKGSRNRPSYSIEQHR

SEQ ID NO: 161083 - protein, 423 aa, Glycine max
  Coding DNA Sequence Number=SeqID_44305
  Gene Ontology: Mol. function=RNA-directed DNA polymerase activity; Biological process=RNA-dependent DNA replication
  Homolog annotation: Hit_ID=Q8H6Q8; Match level="QueryCoverage=95%, HitCoverage=14%, E-value=3e-21, Identity=23%"; Hit description=CTV.20
MEKATPSDPRPAPIIEDIKQDNFGKVEITFNRRNSFSSRIEASRSEYESARRSFSVRTRSIPVGLTRSELHNQFPTVNLQGLDTTSSIPRTTYNQDQEDDQNIDKETLRKDFYSPANEPQRRWFFQNYKGTNRKQIQDKFYEFVERVKVNVLFFDWFHAYTIKKDIDYPWKQDIIGDPSTNLITNWQANYTNKYLQILGETIKTKVVPKQKSVEETSPSIPIEKPLFKPFKVSEKAKRKIRELRKTKSLVEGVGDNHSELLNKIGSLLKVISETPQTSENTSKMVTRSTSKLINVINEDSDQNSDNTTEIGSVSEKNINPINSKHWKTPSKLYYQRPTAPDLLLEERGENNFKSFSANNIYEWNIDAQTEYNIMNTLQHMTMVATAYQTSLECSEETIIDILVARFSGQLKGWWDNYLTNEEK

SEQ ID NO: 161084 - protein, 258 aa, Glycine max
  Coding DNA Sequence Number=SeqID_44306
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-29, Identity=32%"; Hit description= UPI00006A17C9 related cluster
  Subcellular localization annotation: CTP_CleavageSite=35; ConfidenceScore=5.00e-01
GGPLGTSTLTFRGLHALTFKGYTPSPSEGYTPSLSEAYTPSPSEGCTLSFRGLHILTFNGLDVLTFRELDVLTLRGLHVLHFRGLHVLTFRGLHVLTFRGLDVLTFRGLHVLTFRGLHTLAFIGLHAPTFKGLHVLTFRGLHVLTLRGLHAITFRGLHILTFRGLHILTFKGLHVLHFRKLHVLPFRGLHVLTFRALHVLTFRGLHVLTFRGQHALAFRGLHVLVFRGLLALAFRGLIALAFRGLHVLPFRGLHVLTF

SEQ ID NO: 161085 - protein, 176 aa, Glycine max
  Coding DNA Sequence Number=SeqID_44307
  Homolog annotation: Hit_ID=Q1SLB1; Match level="QueryCoverage=49%, HitCoverage=20%, E-value=3e-09, Identity=41%"; Hit description=RNA -directed DNA polymerase
MAEELSSMMKVAIKKNMFKGFFELVSALKVNFYKSSFGAIGLDRDTLEDFAELLNCRLMTFHFTYLGLSVGANPRKEQMGDMFDELEKYLQQKKEGWIRYTKILVYRMCLLLLSGNNGNFSLMREWCIGDGSLTRFWEDSWLGEESIASQFPSEYLGGGDVGSNGKINSLLYWSAR

SEQ ID NO: 161086 - protein, 48 aa, Glycine max
  Coding DNA Sequence Number=SeqID_44308
MENRVNDCGEEKEGGGGVSGSPDVLWRRCPTVVVVEDKPFLFFDGSAI

SEQ ID NO: 161087 - protein, 119 aa, Glycine max
  Coding DNA Sequence Number=SeqID_44309
  Subcellular localization annotation: CTP_CleavageSite=24; ConfidenceScore=5.07e-01
MLLWLSVRVLLLSMLVLRLSVRVLVSVVVVVVPVFFCRSLLLLVVVPVVGDFENHIALRVWNGEERPELKSSSHGRKMVKFGRPASEIEGLVVASGLSPLITCSLDTGDRGLMSALVER

SEQ ID NO: 161088 - protein, 86 aa, Glycine max
  Coding DNA Sequence Number=SeqID_44310
MSELDESFAQMKIKDIVKSTAASNQNHLSSNSLLLELVNEIAPPNVKADNRQKSSFGLATPLTYIAKTTFVDSDWLVRPVDPRTNP

SEQ ID NO: 161089 - protein, 112 aa, Glycine max
  Coding DNA Sequence Number=SeqID_44311
MEELINKTQFSPQIILTSSRRLGGSTEESHFLSSTAVILLPRTKVRDHHMYQPHGTKIARGNSLSVCTRRSHLGKLGSKCRGHPVVHRQLPPTVISLSLKGVPNRVTYPLVQ

SEQ ID NO: 161090 - protein, 206 aa, Glycine max
  Coding DNA Sequence Number=SeqID_44312
  Gene Ontology: Mol. function=ribonuclease H activity; Cellular component=intracellular; Biological process=DNA integration
MCEDFKIQHSNSTPYRPKMNEAVEAANKNVKKIIQKMTVSYKDWHEMLPFTLHDYWTSVCTLTGATSFSLVYGMEVVLPFEVEVPSLRILVEFELKESEWAQVRFDQLNLIEGKRLTAMSHGRLYQRRVKNAFDKKVRSRKFSEGDLVLKKVSQALKDNRGKWAPNYEGPFIVKKSFSGGTLVLANMDDTELPSPVNADVVNRYYA

SEQ ID NO: 161091 - protein, 90 aa, Glycine max
  Coding DNA Sequence Number=SeqID_44313
MYKDNWTQPWPMGSEIYPKAHENPRAFSCIFGPIFLESSNALRGLPRDDLPKNHLKMYCWKMGAYSRDDKLLMHFFQDSLARATSARGKT

SEQ ID NO: 161092 - protein, 544 aa, Glycine max
  Coding DNA Sequence Number=SeqID_44314
  Gene Ontology: Mol. function=RNA-directed DNA polymerase activity; Cellular component=intracellular; Biological process=RNA-dependent DNA replication
  Pfam annotation: Domain name=RnaseH; Domain location=332-460; Score =10.6; E_value=5.9e-06; Accession=PF00075.14; Description=RNase H
MAPEGMEKTMFVTLWGTFCYKVMSFGLKNTGATYQWAMVALFHDIMHREIDVYVDDMIAKSKTEEEHLANLQKLFERLWKYKLRLNPAKCTFEVMSRKLLGFVVSQKGIEVNPEKVKAILEMSEPHTEKQVRATCKPLFKLLCKDQSVHQNNDCQEAFGRIKQCLMNPPVLMPPVAGRPFFLYMIVLDDSMGCMLGQHDDFRKRERAIYYLSKKFTAYEMNYYLLERTCYALVWASHRLRQYMLSHTTWLVSKMDPVKYIFKKPALTGQIAWWQVLLSEFDIVYVSQKAIKGSSLADYLAQQPLNDYQPMHPKFPNKDIMALFKENLEDKDKDKWVVWFDGASNALGHRVGAALVSPENQCIPFTARLGFDCTNNTAEYEACSLEIQAAIDFNVKSLKVYGDSTLVIHQLKGEWETRDHKLIPYQSYIKKLVEFFDDVSFHHAPREENQMTDALATLALIFQLALHGDLLCIEFRCHGKSTHCYLIEEEQDGKPWYFDIKRCIESKEYPPEASDNDKRMLRRLAAGFFLSGSVLYKRNHEMVLL

SEQ ID NO: 161093 - protein, 444 aa, Glycine max
  Coding DNA Sequence Number=SeqID_44315
  Gene Ontology: Mol. function=RNA-directed DNA polymerase activity; Cellular component=intracellular; Biological process=RNA-dependent DNA replication
MEVCPQSSCERKGETTDIDSLSAKVTNITRLSGMTHSGRIFAAPNLLAQPANTKGKAKEVEESANNATPAPEEDIPAGRLAEKKEGSNRKEPHRALLVKVLNEAQVAQDISVEGFEGIVSNITANNYLTFTEEEIPAEGRGHNRALHVSFKCMDHVMAKVLIDNSSSLNVMPKSMLEKLFFKASHLRLSSMAVRAFDGRRRKVRGEIDLPIQIGPHTCQGLLVIISGEEDLLVSCPSSMPFVEAAEESLETTFQSFEVAINATVESLPMCPHIYGVSRHARARLRARHGLGKEQPRQGQLGKHQGELWKSRPQVREAPPCHLNESVVSAGLRREEEVAMVHDEFPWGHPDWVQPCPPGFQLGNWRVLEQPKVFSDPAVDFEREADRIEEEEDDAGFSPELERMVKVGTCMATSIHDKLVTLLRDNQDIFAWSYQDMPGLNVDIV

SEQ ID NO: 161094 - protein, 172 aa, Glycine max
  Coding DNA Sequence Number=SeqID_44316
  Gene Ontology: Mol. function=RNA-directed DNA polymerase activity; Cellular component=intracellular; Biological process=RNA-dependent DNA replication
MAPEDMEKTTFITLWGTFCYKVMSFGLKNTGATYQWAMVALFHDMMHREIEVYVDDMIAKSKTKEEHLVNLWKLFERLRKYKLRLNPTKCTFRVKSGKLLGFIVSQKGIEVDPEKVKAILEMPEPHTEKQVQGSYHNSRLPASRSSSSYTRINPFVGTMTFKRHLKGSNSAS

SEQ ID NO: 161095 - protein, 642 aa, Glycine max
  Coding DNA Sequence Number=SeqID_44317
  Gene Ontology: Mol. function=RNA-directed DNA polymerase activity; Cellular component=intracellular; Biological process=RNA-dependent DNA replication
  Pfam annotation: Domain name=G-patch; Domain location=382-426; Score =28.8; E_value=1.9e-05; Accession=PF01585.13; Description=G-patch domain
LLLHHGAVAVNVVEADVDLIVGNKEDTCLMDPVNDRNKDEQHVCMQSGDEETPKKPKPLVIHFTRATTPRQHQGTPMASGSGPAPFPYKSRKAIPWSGHVFVAPDLPARPANTKGKAKEIEELASDATPTSEEDILAGRFAKKKEGSDRKEASEFLRIIQQSEFKIIEQLNKTPARVSLLELLMSSEPHRALLVKVLNEAQVAQEISVEGFKGIVSNITANNYLTFTEEEIPAEGWGYNGALHITVKCMDHVMAKVLIDNGSSLNVMPKSTLEKLPFNASHLRPSFMVVLAFDGSRREVMGEIYLPVQIGPHTCQVTFQVMDINPGLLVIISGEEDLLVSCPSCMPYVEVTEESLEMTFQSFEVVSNAFVESLLTCPHMSNTTIMVAHIMLGHGYEPGTGLGKKNDGKASLVNVKENYGRFKLGYKPARAGIRKSGRERRNWGTGTQSKMQVREAPPCHLNVSFFSTGLRREEEVSMVHDEPLQEHPDWVQPCIPEFQLGNWRVMERPEADQMEEEEGDSGFSPELERMVAQEDRALKPHQEETKIVNLGVGNERKEVQVGTGMATSIHDKLVTLQQDYQDIFAWSYQDMPGLNDDIVKHKLPLNPGCSPVKQKLKRMRPEMSLKIKDEVKKQFNVGFLAVA

SEQ ID NO: 161096 - protein, 67 aa, Glycine max
  Coding DNA Sequence Number=SeqID_44318
MKEGLEASFSTESLSSILKIPLRLNCSSPCSGSTASKDGSWRSPLINGGGGGACNTRPSEIWLAWAS

SEQ ID NO: 161097 - protein, 67 aa, Glycine max
  Coding DNA Sequence Number=SeqID_44319
  Pfam annotation: Domain name=Wound_ind; Domain location=1-44; Score =44.0; E_value=4.9e-10; Accession=PF08186.2; Description=Wound -inducible basic protein family
  Subcellular localization annotation: CTP_CleavageSite=57; ConfidenceScore=5.01e-01
MIYDVNSPLFRSFLSQKGGSSDKSFCVLPMLLHTCPSNKKIRKNTDTLRHALWDSLSCFGRGTFGGK

SEQ ID NO: 161098 - protein, 142 aa, Glycine max
  Coding DNA Sequence Number=SeqID_44320
MDEVSLATLVKLRTPWSWNMLGVPNNVAENALALCFLPHLFAFFLLVFVSSSFVPVICHCCVAAKLPWCRCCVSAVEGRRPENRLKRAKSNRSILSEEVLPIASAKEASPEEGSSGRTKDSSGEATKRRFFRYNKTFYRKKE

SEQ ID NO: 161099 - protein, 134 aa, Glycine max
  Coding DNA Sequence Number=SeqID_44321
MGGPYCVQIQNKHAFPPYGLPPNYTPPNVAYTPNEDVNNSALILIESRQPHHVHVSQPMGETHEIPHHNLAEFELCLGYATKGQAVGDIPLQNTLEGSQYHPQPHLLHSTAGKISLIMKEMGEVGSSRGKAQGR

SEQ ID NO: 161100 - protein, 372 aa, Glycine max
  Coding DNA Sequence Number=SeqID_44322
  Gene Ontology: Mol. function=protein kinase activity; Cellular component=nucleus; Biological process=ubiquinone biosynthetic process
  Homolog annotation: Hit_ID=Q12HK8; Match level="QueryCoverage=65%, HitCoverage=43%, E-value=2e-69, Identity=53%"; Hit description=ABC-1
QQEQLIASPLGQLAHHAEVDKADAVTAQRHDVAGVGIGVIQPMLQYHAHKGAGAALRQQWAVKARCRQLLRARGRPLPIDFRHDDVRLTRKHPGDAVAVMPFVGQIQFMIERRRQRSDHLPRPIARQRGALLLHGFRQRGQQPQIGVDGFRQAGPQHFDHDLFAAVQACAVDLRHRRRRQRRTIEFGEQPLGFAAQVGNDLRRQRFPWQHRCLAVQTIQFVGPGRIQQVGTRGQDLTEFDEGRAQCLERFAQPLRQGLCVLLGGFSAGAAQQSPQAQQTQNVLQAITNQNGAATAPRCAAPCGCGRLPRYPAAQRRRRSTMSAAAGTGGYRPRTVRRSPRRRRRSAATAFAGRLPVRRSDRHCWRDARQNRR

SEQ ID NO: 161101 - protein, 428 aa, Glycine max
  Coding DNA Sequence Number=SeqID_44323
  Gene Ontology: Mol. function=transferase activity; Cellular component= cytoplasm; Biological process=D-ribose metabolic process
  Homolog annotation: Hit_ID=Q6VWJ5; Match level="QueryCoverage=99%, HitCoverage=100%, E-value=1e-129, Identity=60%"; Hit description =Fructokinase 3
  Pfam annotation: Domain name=PfkB; Domain location=102-416; Score =213.0; E_value=6.9e-61; Accession=PF00294.14; Description=pfkB family carbohydrate kinase
  Subcellular localization annotation: CTP_CleavageSite=47; ConfidenceScore=5.65e-01
MALHCGTFCFWTVASHPPSSVKLSQPTIKASSFSSPLAPPLVKLNVRGKAFPGDGTPETKESPLVVCFGEMLIDFVPTVNGLSLAEAPAFKKAAGGAPANVAVGISRLGGSSAFIGKVCGFGWFLGLIVHGKGRWRFCLEVATGSVFKWGGFDFSILCNVLEVGEDEFGYMLANILKENNVNNEGMRFDPGARTALAFVTLRSDGEREFMFYRNPSADMLLQEDELDLDLIRKAKIFHYGSISLITEPCKSAHIAAAKAAKDAGVVLSYDPNLRLPLWPSADSAREGILSIWETADIIKISEEEISFLTKGENPYDDAVVHKLFHPSLKLLLVTEGAEGCRYYTKEFSGRVKGLKVDAVDTTGAGDAFVAGILSQLAVDLSILQNEDELRDSLKFANVCGALTVTERGAIPALPTKEAVLNAMLKPVS

SEQ ID NO: 161102 - protein, 70 aa, Glycine max
  Coding DNA Sequence Number=SeqID_44324
  Gene Ontology: Mol. function=RNA-directed DNA polymerase activity; Biological process=RNA-dependent DNA replication
  Homolog annotation: Hit_ID=Q2HTR6; Match level="QueryCoverage=94%, HitCoverage=19%, E-value=2e-09, Identity=51%"; Hit description=RNA -directed DNA polymerase
MEQVSSQSRRRRHSHLKQALMSKRSKKLFGIVIVLKVRARMDDFLRFISKFRAHGMLPRGTNASFIALVP

SEQ ID NO: 161103 - protein, 298 aa, Glycine max
  Coding DNA Sequence Number=SeqID_44325
  Gene Ontology: Mol. function=RNA-directed DNA polymerase activity; Cellular component=exocyst; Biological process=RNA-dependent DNA replication
MDGIIDDRQSVFFGDRFLFQSTLVANETIEEAKRKKKECLFLKVDYNKTFDLVMGFGEKWNGWIKSCLSTSFILMLVNESSILKFKMQRGLRQGTYYPSFLFNIVADDLCGIMGKAIATLSNVLTIKNMLRSFELISGLKVNYHKSFFGAIGVEDYVLEEFTTIMNYKITKLPFVYLGIPIGANPRKEKTWRPIVDKVLHEDLLSKLENVGIKLPQDVWLWHQGPNGAFTTNSAYWIETIEHVFFLCHSAFQIWSECYHWLDECTVMPNSVDIHFLKHRGSTSSKTTGHMRWVLWAPV

SEQ ID NO: 161104 - protein, 469 aa, Glycine max
  Coding DNA Sequence Number=SeqID_44326
  Gene Ontology: Mol. function=protein serine/threonine kinase activity; Cellular component=membrane; Biological process=protein amino acid phosphorylation
  Homolog annotation: Hit_ID=Q8LGB4; Match level="QueryCoverage=93%, HitCoverage=83%, E-value=1e-166, Identity=66%"; Hit description =Protein kinase-like protein
  Pfam annotation: Domain name=APH; Domain location=132-310; Score= -12.5; E_value=0.045; Accession=PF01636.13; Description =Phosphotransferase enzyme family
  Pfam annotation: Domain name=Pkinase; Domain location=130-410; Score =115.5; E_value=1.6e-31; Accession=PF00069.15; Description=Protein kinase domain
  Pfam annotation: Domain name=Pkinase_Tyr; Domain location=130-410; Score=61.4; E_value=3.1e-16; Accession=PF07714.7; Description =Protein tyrosine kinase
  Pfam module annotation: Pfam domain module=APH::Pkinase::Pkinase_Tyr; Domain location=132-310::130-410::130-410
MWEYALACVGVVPCGGNNDLNGQRKTTLEHNKAWLLADSGAELASADPRSVHSSFRFSFCSQVEVESFNMSYSASAAAAATFLMVNLDYESQVRELKWRRIQSLEKSLSPVANTLIRFSYDEILSATRNFSKERVLGRGALSCVFRGRVGIWRTAVAIKRLDKEDKECAKAFCRELMIASSLNDTNVVPLVGFCIDSEEGLFLVYKYVSGGSLEHHLHGRKKGVKGSSPLPWSVRYEVAIGIAEAVAYLHNGTERCVVHRDIKPSNILLSSKKIPKLCDFGLASWTSAPSVPFLCKTVKGTFGYLAPEYFEHGKVSDKTDVYALGVVLLELLTGRNPIEAKRPPGEENLVVWAKPLLRKGKGAIEELLDPQVKYNSSYTDQMVRMIDAASVCVTSEESRRPSIGEIVAILKGEVEHVLSRRRKSGYFGNGYMIDNYPKLQETNNEMKSHLALAMLGVPECEDDDFVYCR

SEQ ID NO: 161105 - protein, 50 aa, Glycine max
  Coding DNA Sequence Number=SeqID_44327
  Gene Ontology: Mol. function=calcium ion binding
  Homolog annotation: Hit_ID=O81092; Match level="QueryCoverage=96%, HitCoverage=59%, E-value=3e-15, Identity=78%"; Hit description =Polcalcin Ole e 3
  Pfam annotation: Domain name=efhand; Domain location=11-39; Score =38.2; E_value=2.9e-08; Accession=PF00036.22; Description=EF hand
LKALGSVTAEEVQRMMEEIDTDGDGYISYAEFTEFAKANRGLLRDVAKIF

SEQ ID NO: 161106 - protein, 71 aa, Glycine max
  Coding DNA Sequence Number=SeqID_44328
MPYYKISNSKSGHGSIPCLISSIHEVTQSLGLHKGLKGGAAVCFWSGEQAVKMMNLRDRILLGFIYVHTNL

SEQ ID NO: 161107 - protein, 186 aa, Glycine max
  Coding DNA Sequence Number=SeqID_44329
  Gene Ontology: Mol. function=peroxidase activity; Cellular component =chloroplast thylakoid membrane; Biological process=response to oxidative stress
  Homolog annotation: Hit_ID=Q5QHW7; Match level="QueryCoverage=99%, HitCoverage=50%, E-value=8e-91, Identity=81%"; Hit description =Chloroplast thylakoid-bound ascorbate peroxidase
AGPPSPADHLRQVFYRMGLNDKEIVALSGAHTLGRSRPDRSGWGKPETKYTDIKEKRDEDLLVLPTDAALFEDPSFKVYAEKYAEDQEAFFKDYAEAHAKLSNLGAKFDPLEGIVIDDSPNAGGEKFVAAKYSTGKSELSDSMKQKIRAEYEAIGGSPDKPLQSNYFLNIMIVIAVLAFLTSLLGN

SEQ ID NO: 161108 - protein, 52 aa, Glycine max
  Coding DNA Sequence Number=SeqID_44330
MEKIAQVKGVSFDECMCEIRGINFWQALEELVRDDKGCCAFKELVVAGTEKV

SEQ ID NO: 161109 - protein, 184 aa, Glycine max
  Coding DNA Sequence Number=SeqID_44331
  Gene Ontology: Mol. function=peroxidase activity; Biological process =response to oxidative stress
  Homolog annotation: Hit_ID=Q5QHW7; Match level="QueryCoverage=55%, HitCoverage=24%, E-value=4e-28, Identity=66%"; Hit description =Chloroplast thylakoid-bound ascorbate peroxidase
  Subcellular localization annotation: CTP_CleavageSite=75; ConfidenceScore=5.67e-01
MAERVLLLTPSQSHHSPTTMAVLGGAASARIIPSVSLSTSSRSFFSLSSSSKLKCLRSSPRISHLFLNQQRAEVRVSSGGYGTVSAPKSVASDPDQLKSAREDIKELLNSKFCHPILVILGGVKPLPLRVVQSTCAALDTCKLQIATNGPSLLVVLLSFTFAEPTVSEACKEAVKYQLIVNSDF

SEQ ID NO: 161110 - protein, 87 aa, Glycine max
  Coding DNA Sequence Number=SeqID_44332
  Gene Ontology: Mol. function=ribonuclease H activity
MANFLAGFIGNDQTTSNWWSLDIDSASNVKGSREKIILEGPDNVTLEQALKLNFKASNNQAEYEALIAGLKLAREVEAKKLRCYTNS

SEQ ID NO: 161111 - protein, 34 aa, Glycine max
  Coding DNA Sequence Number=SeqID_44333
MEYAAGEVDRDIGVGYSWLGLTQDWRCDNGLLEG

SEQ ID NO: 161112 - protein, 127 aa, Glycine max
  Coding DNA Sequence Number=SeqID_44334
MGSNEQMQKMESSKFRSLEGAFFLIVIRYEGEPWCSDKSCALVTCWSWVRIRKQSLCICKGKAAYNIPPPYLRIAKSLWAMGGWKEQSYQLKNGTQCHLVETMGLQIPVFFKFSATPIIHLKETSSS

SEQ ID NO: 161113 - protein, 244 aa, Glycine max
  Coding DNA Sequence Number=SeqID_44335
  Gene Ontology: Mol. function=nucleoside-triphosphatase activity; Cellular component=membrane; Biological process=DNA replication
  Homolog annotation: Hit_ID=Q9CAQ8; Match level="QueryCoverage=98%, HitCoverage=65%, E-value=1e-103, Identity=82%"; Hit description =Putative replication factor C; 24844-22715
  Pfam annotation: Domain name=AAA; Domain location=73-238; Score=44.2; E_value=4.4e-10; Accession=PF00004.19; Description=ATPase family associated with various cellular activities (AAA)
  Pfam annotation: Domain name=AAA_3; Domain location=73-194; Score= -15.2; E_value=0.015; Accession=PF07726.2; Description=ATPase family associated with various
  Pfam annotation: Domain name=AAA_5; Domain location=73-197; Score= -13.1; E_value=0.018; Accession=PF07728.4; Description=ATPase family associated with various
  Pfam module annotation: Pfam domain module=AAA::AAA_3::AAA_5; Domain location=73-238::73-194::73-197
MAQTTHPMDIDDHTYTASPDKGKSVVFAGNPPAAGKAIPWVEKYRPQSLDDVAAHRDIVDTIDRLTTENRLPHLLLYGPPGTGKTSTILAVARKLYGSQYQNMILELNASDDRGIDVVRQQIQDFASTQSLSFGVKSSVKLVLLDEADAMTKDAQFALRRVIEKYTKSTRFALICNHVNKIIPALQSRCTRFRFAPLDAVHVTERLKHVIKAEGLDVEDSGLAAFVRLSNGDMRKALNILQVVC

SEQ ID NO: 161114 - protein, 87 aa, Glycine max
  Coding DNA Sequence Number=SeqID_44336
MALRLVKSSVQGPEDYSVGYLCLVVGLRMFNKGDESRAFALSVGDASSIGACRPRIFFINGFLCFLEDKWQRNGEGRERGDTTSKRR

SEQ ID NO: 161115 - protein, 55 aa, Glycine max
  Coding DNA Sequence Number=SeqID_44337
  Gene Ontology: Mol. function=structural constituent of ribosome; Cellular component=intracellular; Biological process=translation
  Homolog annotation: Hit_ID=Q1S7V4; Match level="QueryCoverage=100%, HitCoverage=18%, E-value=5e-16, Identity=76%"; Hit description =Ribosomal protein S3Ae
MAVGKNKRISKAKKVGKKKAADPFTKKDWYDIKAPSVFQVKNVGKTLVTRTQGTK

SEQ ID NO: 161116 - protein, 183 aa, Glycine max
  Coding DNA Sequence Number=SeqID_44338
  Homolog annotation: Hit_ID=Q9SD55; Match level="QueryCoverage=40%, HitCoverage=35%, E-value=6e-19, Identity=57%"; Hit description=Zinc -finger-like protein
  Pfam annotation: Domain name=PHD; Domain location=129-173; Score=7.6; E_value=0.0098; Accession=PF00628.19; Description=PHD-finger
  Pfam annotation: Domain name=zf-C3HC4; Domain location=130-170; Score= 39.2; E_value=1.4e-08; Accession=PF00097.15; Description=Zinc finger, C3HC4 type (RING finger)
  Pfam module annotation: Pfam domain module=PHD::zf-C3HC4; Domain location=129-173::130-170
MDGEGKQSSKKNPYVELEEVDFDFILAKGMQEQEREFTMLSTIESESDEYLSDSSIDNDDNGERSNDDGDEDMEMEEDEIDLDELSYEELMELEEFIGEETRGLSANEISLCLYPYTCQCAESKSGIDRCVICQVEYEEGEALVALQCEHPYHSDCISKWLQIKKVCPICSNEVSTPNMTSNP

SEQ ID NO: 161117 - protein, 176 aa, Glycine max
  Coding DNA Sequence Number=SeqID_44339
MSCDRDYYSLFCLPETCESVGKQRQIMVICPLFEDSNVLRPRLLQALLPSRDNRVRWQAKTNYGHPLLLFLRLLQSPLPSRHKQVSLIGLSLVVDWVGFVTFQKEVCKILKMGAKWSLWGPFPAPGPTIKLRGEATSSPGRARLLLEETSSLSGRAAVAQSVKFRNIPEAEEGMVV

SEQ ID NO: 161118 - protein, 220 aa, Glycine max
  Coding DNA Sequence Number=SeqID_44340
MGNVIETFASGLGNAIGKLFNSPIEYLSGKSCSSVCGPTWDLICYIENFCVANLLKLAMVFMLLYIVSMFGSILVLSCVLCYTSSREEDEEEEEEEEEEEEEEEEEEEEEEEEEEEEEEEEEEEEGASAKTSRSISRRRRDYKGSHLRRSLQPRKHHARVEISRDLRYKRNHSHGDPSYTSIATKHGNYIGTFHDIKVTRTSKFAKGITKRKRVLPRQRR

SEQ ID NO: 161119 - protein, 104 aa, Glycine max
  Coding DNA Sequence Number=SeqID_44341
MAKVADDHNLSPCTNRLDCLWKARGVDDHNLSSRVNKLDCLSKARGADDHNLSLRANGLDCLWMVKVADNHNFSSRANGLDCLWKARGADDHNFSPHANKLACL

SEQ ID NO: 161120 - protein, 206 aa, Glycine max
  Coding DNA Sequence Number=SeqID_44342
  Gene Ontology: Mol. function=structural constituent of ribosome; Cellular component=intracellular; Biological process=translation
  Homolog annotation: Hit_ID=Q1S7V4; Match level="QueryCoverage=99%, HitCoverage=68%, E-value=1e-103, Identity=89%"; Hit description =Ribosomal protein S3Ae
  Pfam annotation: Domain name=Ribosomal_S3Ae; Domain location=1-167; Score=330.9; E_value=2.2e-96; Accession=PF01015.8; Description =Ribosomal S3Ae family
TASDGLKHRVFEVSLADLQGDEDHAFKKIRLRAEDVQGKNVLTNFWGMSFTTDKLRSLVRKWQTLIEAHADVKTTDNYTLRMFCIGFTKRRSNQVKRTCYAQSSQVKQIRRKMTEIMVNQTTSCDLKEVVRKLIPEMIGKEIEKATSSIYPLQNVFIRKVKILKAPKFDLGKLMEIHGDYSEDVGVKVDRPVDETMPEGATEVVGA

SEQ ID NO: 161121 - protein, 226 aa, Glycine max
  Coding DNA Sequence Number=SeqID_44343
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q9XI05; Match level="QueryCoverage=89%, HitCoverage=100%, E-value=1e-97, Identity=89%"; Hit description =Proteasome subunit beta type 3-A
  Pfam annotation: Domain name=Proteasome; Domain location=50-211; Score=80.7; E_value=4.5e-21; Accession=PF00227.16; Description =Proteasome A-type and B-type
MWGKNIGKESFSSGNFDAFRKKDVDLRVQRECPSGYGGEELLRHRERSETRCSAPDHRHRFPEDFQNPRQAVHRPLGLATDAQTLYQRLLFGHKLYQLREERDMKPQTFASLVSAILYENRFGPYFCQPVIAGLGDDDKPFICTMDAIGAKELAKDFAVAGTASESLYGACESMFKPDMEPEELFEMISQALLSSVDRDCLSGWGGHIYVVTPTEVKERILKGRMD

SEQ ID NO: 161122 - protein, 278 aa, Glycine max
  Coding DNA Sequence Number=SeqID_44344
  Gene Ontology: Cellular component=integral to membrane
  Homolog annotation: Hit_ID=UPI0000547462; Match level="QueryCoverage =52%, HitCoverage=55%, E-value=2e-11, Identity=31%"; Hit description =PREDICTED: similar to putative protein family member, with at least 4 ...
  Homolog annotation: Hit description=transmembrane domains, of eukaryotic origin (1O709)
  Pfam annotation: Domain name=DUF887; Domain location=35-268; Score= -88.4; E_value=0.0018; Accession=PF05967.2; Description=Eukaryotic protein of unknown function (DUF887)
MGGGKRNTVETFFLATLILWLASLCFQIFFNKRWELLSVIAGCFFYQTSNCLIRFFFSTHKDPLFVNTSVSLLHSLFTSASVIFILFRELCNGPSGMFDHSKLVEDAWPWAFEALSFSCGYFAYDQWDMLRYRLYNGWIPSILVHHLVLLICFTLALYRNVTINYLILTLICELHSIFLHVRKVRRMAGVRDAKSILVRLEWFLNWVTFFVARSAPHILITAKLIKDAHKFEKGMELPLALCGMAGMNLLNIGLGIDLLKAFKRERKSQLGNLHHHRE

SEQ ID NO: 161123 - protein, 48 aa, Glycine max
  Coding DNA Sequence Number=SeqID_44345
MLEHFHRILTQALQSSPWLVGSRKLYPSVRMTEDEVGTNVGSMTNARN

SEQ ID NO: 161124 - protein, 344 aa, Glycine max
  Coding DNA Sequence Number=SeqID_44346
  Homolog annotation: Hit_ID=Q2HV05; Match level="QueryCoverage=91%, HitCoverage=41%, E-value=1e-118, Identity=60%"; Hit description =Peptidase S8 and S53, subtilisin, kexin, sedolisin; WD40-like
  Pfam annotation: Domain name=WD40; Domain location=31-73; Score=19.0; E_value=0.017; Accession=PF00400.22; Description=WD domain, G-beta repeat
  Pfam annotation: Domain name=WD40; Domain location=83-124; Score =19.5; E_value=0.012; Accession=PF00400.22; Description=WD domain, G -beta repeat
  Pfam module annotation: Pfam domain module=WD40::WD40; Domain location=31-73::83-124
MEFLYRTGGDGPLVAFGASDGVIRVLSMMTWKLVRRYTGGHKGSISCLMSFMAASGEALLVSGASDGLLIIWSADHGQDSRELVPKLSLKAHDGGVVAVELSKVMGGAPQLITIGADKTLAIWDTVSFKVYCMVAHTLQPHLVAVGTNIGVIICEFDARSLPPVAPLPTPSDSKEHSAIFVIERELKLLNFRLNNSANPSLGNNSSLSETGRPKGDFFEPLPIKQGKKHISTPVPHDSHSVLSVSSSGKYLAIVWPDIPYFSVYKVSDWSIVDSGSARLLAWDTCRDRFAILELALPPRIPIVPKGSSSKRAKEAVAAQVAAAATAAASTTSYTFFGFVTSGLF

SEQ ID NO: 161125 - protein, 117 aa, Glycine max
  Coding DNA Sequence Number=SeqID_44347
MASIKGLPTNPKRIKVIPEWPTQPTPLIELVRNHVPLWENAHERGFQTLPYSNMPNTTNIHVIILFTNVEGRSSEFQEPLDLRSNPFQGGGNDAILPPKGNGLKTPRRLSQRSRRRP

SEQ ID NO: 161126 - protein, 95 aa, Glycine max
  Coding DNA Sequence Number=SeqID_44348
  Homolog annotation: Hit_ID=Q105A0; Match level="QueryCoverage=41%, HitCoverage=5%, E-value=3e-12, Identity=80%"; Hit description =Isoamylase isoform 3
MQIHGYRMSLWAEHTVLLKSASYNQRALNALEGDDKASAQMMPKYPVEVDRKGKIPHLLELGINAVELLSVFEFDELDFQRRPNPRDHMVTLYLD

SEQ ID NO: 161127 - protein, 217 aa, Glycine max
  Coding DNA Sequence Number=SeqID_44349
  Gene Ontology: Biological process=response to stress
  Homolog annotation: Hit_ID=Q2QQA6; Match level="QueryCoverage=75%, HitCoverage=77%, E-value=2e-16, Identity=34%"; Hit description =Universal stress protein family protein, expressed
  Pfam annotation: Domain name=Usp; Domain location=58-194; Score=38.0; E_value=3.4e-08; Accession=PF00582.16; Description=Universal stress protein family
MLSSSSSASFLRQLSAKKEAWKERRYNSSGGDWGVSFGGCETSVNLMEGFNMMQGNVGRKRVMVVVDDTSHSKHAMLWALTHVANKGDSLTLLHVVPPHKAPESSCSTYLVNYLGSLCKDCKPGVEVEALVIQGPKLATVMSQVKKLEVSVLVLGQKKPSSLFSCLCGSNGSSSTEEFVEFCINKAECLTIGVRKRSQGTNGYLISTRWQKNFWLLA

SEQ ID NO: 161128 - protein, 293 aa, Glycine max
  Coding DNA Sequence Number=SeqID_44350
  Gene Ontology: Mol. function=sugar porter activity; Cellular component=membrane; Biological process=transport
  Homolog annotation: Hit_ID=Q6ZJN0; Match level="QueryCoverage=70%, HitCoverage=60%, E-value=2e-90, Identity=78%"; Hit description =Putative glucose-6-phosphate/phosphate translocator
  Pfam annotation: Domain name=DUF6; Domain location=23-152; Score =30.4; E_value=6.2e-06; Accession=PF00892.11; Description=Integral membrane protein DUF6
  Pfam annotation: Domain name=UAA; Domain location=14-249; Score= -130.1; E_value=0.00065; Accession=PF08449.2; Description=UAA transporter family
  Pfam module annotation: Pfam domain module=DUF6::UAA; Domain location= 23-152::14-249
MEESFVFQWSVIRSLLSILQWWAFNVTVIIVNKWIFQKLDFKFPLSVSCVHFICSSIGAYVVIKLLKLKPLITVDPEDRWRRIFPMSFVFCINIVLGNVSLRYIPVSFMQTIKSFTPATTVVLQWLVWRKYFDWRIWASLVPIVGGILLTSVTELSFNMFGFCAALFGCLATSTKTILAESLLHGYKFDRLLAKRYALACMEAFLTSIHYDTKFTTMFLELLCICLLQKKQKNVVTGKLMEMPNQVAKNHRFRRENEFRKDPIPSDIESVGGISAAISAVGVGGLNASRKAHL

SEQ ID NO: 161129 - protein, 155 aa, Glycine max
  Coding DNA Sequence Number=SeqID_44351
  Gene Ontology: Mol. function=DNA binding; Cellular component =mitochondrion; Biological process=DNA integration
  Homolog annotation: Hit_ID=Q1SFD6; Match level="QueryCoverage=94%, HitCoverage=10%, E-value=1e-59, Identity=68%"; Hit description =Integrase, catalytic region
  Subcellular localization annotation: CTP_CleavageSite=45; ConfidenceScore=5.01e-01
MQLIGYSDADWAGCMDSRKSISGYCFFIGKSLVSWRAKKQATVSRSSSEAEYRALSSAAYLRVQLTRTPTLYCDNQSAVHIASNPVFHERTKHLEIDCHLVREKLLKGTLKLLPVSTSDQVADFLTKALAPPKFHDFVSKLSMINIYHDKLEGGC

SEQ ID NO: 161130 - protein, 1073 aa, Glycine max
  Coding DNA Sequence Number=SeqID_44352
  Gene Ontology: Mol. function=nucleoside-triphosphatase activity; Cellular component=membrane; Biological process=cell cycle
  Homolog annotation: Hit_ID=Q10NR0; Match level="QueryCoverage=66%, HitCoverage=57%, E-value=1e-49, Identity=25%"; Hit description=AT hook motif family protein, expressed
MDATVTQLSPSCNAAEPPRRIVRRRLVQTTLFPHKPPEPVEKNDKEDERHEDYSDAENHKKRKKPKAKTTPRKKASKNATPKKNASANGTNKGSTSRQVLADYDPVNATEHDLFLEAKLAAEAGKKVQDMADSGSNLSTTKSEEERTTCGPIHVFENTQDDTPSLDWRNWAFLENTTTMNYGPEILNSSVLEGSVESLNFDKLRSSLDPSGVSISQNALSSDRLCIHPENLEEVSPSDSASLAEKTCPPTCEDAKQDLEVDESVTTTVQAGIFRKSDTEPPSRFLQESMRSYYRSCVDKAENSLWTYKYKPTKAVEVCGNDESVNFLRDWLHLWHERRYKSRKDISDMDKSDMRDVDDDYKCSCSDYDSEDINEEDSLQNVLLITGPIGLNASDCRNGTAVRNYFGDTLGSLGFKRASEITSSSQKKTTKLSPASALQSGKAADEVNDGVNELITISDDEAHIPSGSSQKLLGKNNVVASCDKVQTLILIEDVDILSPEDRGCIAAIQQIAETAKGPIILTSNSVNPGLPGNFDVLHVSFMLPSPQELLCHLYTVCLTEGVNIHPLLLEKFIHSCDGDIRKSIMHLQFWFQSKRFQKDVMTQTCYGSLPFDLELGHQILPKIMPWDFPSEISELIENEIAKLTNIMEENSRGLVTEELLPINEQQNDLNVQCMEADYIEAKKVEMIKRNGSLTDYSELEIQYNAISEFSNSSGSPLTSSRHNGRRKLVVMSSDSEDEDSNNGYPVDTHEEANTRQSMKENNGYPSELQLNGNYPSTSVRKLLCSELEHSEEEHFKYSETTDDTYVNETCKSLDVSCVPESTFVPETEIENGTESMYEAVSSGPLFGPQEVSVYNELKPFTFSVPRHLTKLSQNLDLLDTEISDHSCKGVQQDVLDEHMETIVNVMDECSRVDFKLKPTCLQSNSFAETEKIQKLWGDLLECRMDLRQHATSEQLGAFQVVRLASGLNNLISEADLFHERDIMEPSAFLSGETTSIRYHEQIMTSTIAEHGFCFYAKLIADEASKLGCANCVDITSEMLASTIKLTGQDLARSKVIYTGKQVEWNSPINNTQKR

SEQ ID NO: 161131 - protein, 204 aa, Glycine max
  Coding DNA Sequence Number=SeqID_44353
  Gene Ontology: Mol. function=GPI anchor binding; Cellular component =membrane; Biological process=cell wall catabolic process
  Homolog annotation: Hit_ID=Q93ZH0; Match level="QueryCoverage=51%, HitCoverage=25%, E-value=7e-40, Identity=75%"; Hit description=LysM domain GPI-anchored protein 1 precursor
MYSSLASVMGLPTSMRFTKEIKSRNDLDSGEGQRCPAKQVKLFPSSVRTEQPQKTLNPSNPFPHCTTLLVSQVASLTLSISRMPNPNPKHLFHATLFLSILLQALSKSTIEPCSNSDSCNALLGYTLYTDLKVSEVASLFQIDPIALLTANAIDISYPDVEHHILPSKLFLKVPISCSCVDGIRKSVATHYKTRPPRASPPSPT

SEQ ID NO: 161132 - protein, 292 aa, Glycine max
  Coding DNA Sequence Number=SeqID_44354
  Gene Ontology: Mol. function=transcription factor activity; Cellular component=nucleus; Biological process=regulation of transcription, DNA-dependent
  Homolog annotation: Hit_ID=Q6Z2N2; Match level="QueryCoverage=90%, HitCoverage=98%, E-value=2e-51, Identity=46%"; Hit description =Putative TFIIH basal transcription factor complex p34 subunit
  Pfam annotation: Domain name=Tfb4; Domain location=12-233; Score =114.4; E_value=3.3e-31; Accession=PF03850.5; Description =Transcription factor Tfb4
  Subcellular localization annotation: CTP_CleavageSite=42; ConfidenceScore=5.05e-01
MPSASSKLYADDVSLLVVTLDTNPFFWSTFPFPFAEFLSQVLAFLNSILLLGQLNQVIVIATGCNSCGYIYDSTSDKNHGSTTGTMPALYSNLLHNLDEFLARDRQLDADAAHAPGTVPSSLLSGSLSMALCWLSDIQRAFRSGPMPPQPRVPIDSCYIGSNNSAFLQQASYITGGIYYKPPQLDGLYQYLSTVFATDLHSRAFLRLPKSVGVDFRASNFETCTSINCMNYAGVSAISKQLTWAMCVLYAYPYSVSTMISVQPVAISLAEIIISQTLLISQLNSRLVRVLFP

SEQ ID NO: 161133 - protein, 181 aa, Glycine max
  Coding DNA Sequence Number=SeqID_44355
  Gene Ontology: Cellular component=nucleus
  Homolog annotation: Hit_ID=Q2R2Z3; Match level="QueryCoverage=86%, HitCoverage=31%, E-value=2e-18, Identity=35%"; Hit description =Expressed protein
MAEDSEGTAKKEEILESQIETAMRSRVSLFKEQSDSLTFEGVRRLLEKDLGLEEYALDVHKRFIKQCLLKCLEGVGDDDGAKISGKEGEKGTSTQESEEPKEECEAKDAKDLCPEDEEKMEDSPVLGLLKEQKRAKLETKDDKGNGTKVVPIEALIKKAVRKRSSYIKANAEYAADFFNYL

SEQ ID NO: 161134 - protein, 349 aa, Glycine max
  Coding DNA Sequence Number=SeqID_44356
  Gene Ontology: Mol. function=GPI anchor binding; Cellular component =membrane; Biological process=cell wall catabolic process
  Homolog annotation: Hit_ID=Q93ZH0; Match level="QueryCoverage=86%, HitCoverage=73%, E-value=1e-117, Identity=70%"; Hit description=LysM domain GPI-anchored protein 1 precursor
  Pfam annotation: Domain name=LysM; Domain location=106-148; Score =24.5; E_value=0.00039; Accession=PF01476.10; Description=LysM domain
  Pfam annotation: Domain name=LysM; Domain location=47-86; Score=7.5; E_value=0.094; Accession=PF01476.10; Description=LysM domain
  Pfam module annotation: Pfam domain module=LysM::LysM; Domain location=106-148::47-86
  Subcellular localization annotation: CTP_CleavageSite=56; ConfidenceScore=5.68e-01
MPSTSLTPTWSTTFSPRSSSSKSPSPAPASTIFANSSLLNIRPAPPTPFDIADAVYAGLVSSNQLHEANSISDPSILDVGQNLVVPLPCTCFNGSDNSLPAIYLSYVVRLVNTLTAVAARYFTTLTDLMNVNAMGSTAINDGDILAVPIPACASNFPKSASDFGMLVPNGSYAITAGHCVQCSCGPKNLDLYCMPASLAVSCSSMQCRGSNLMLGNVTVQQTSGGCNVTACNYDGIVNGSIVTTLSPSLQPQCPGLQEFPPLVAPPTTVARDTVFAPAPAPLFDGDGPASPKSSLVPSTGLPGGFSPANGPISGISSGASAACSLVKPFPALTYALVLLLVKLMIPVAL

SEQ ID NO: 161135 - protein, 95 aa, Glycine max
  Coding DNA Sequence Number=SeqID_44357
MDEQERDDETPWASIWPKWALGLHISALREIFVKRTEGGTCNTKDSDAQIIECQPRDKEVQIYSNIKRLEVTCQLGSRLLRVECSCSCVRTDMED

SEQ ID NO: 161136 - protein, 240 aa, Glycine max
  Coding DNA Sequence Number=SeqID_44358
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=74%, HitCoverage=46%, E-value=6e-48, Identity=49%"; Hit description =Nodulin-like protein
  Pfam annotation: Domain name=DUF6; Domain location=69-199; Score =25.7; E_value=0.00016; Accession=PF00892.11; Description=Integral membrane protein DUF6
  Pfam annotation: Domain name=TPT; Domain location=60-199; Score= -21.6; E_value=0.01; Accession=PF03151.7; Description=Triose -phosphate Transporter family
  Pfam module annotation: Pfam domain module=DUF6::TPT; Domain location= 69-199::60-199
MKMKEVACQAKVIGTIVTFGGTLLMALYKGPIVSVMGSSTSHAGQPENVNSPTGNHWILGTCFLLIGCAGFSAFYILQTITLRKYPTEMSLATWVCFVGALQSSVVAAIAERHHPHTWALGWDTRLFAPAYAGIVTSGVQYYIQGMVIKSMGPVIVTAFNPLRMIIITTLACIVLSEQLYLGSIIGAIVVVLGLYLVVWGKYKECHGRPMPPSLTKDTSPEDQRQLPVTAPKNDTNDTKG

SEQ ID NO: 161137 - protein, 237 aa, Glycine max
  Coding DNA Sequence Number=SeqID_44359
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=99%, HitCoverage=60%, E-value=2e-51, Identity=43%"; Hit description =Nodulin-like protein
  Pfam annotation: Domain name=DUF6; Domain location=69-199; Score =13.5; E_value=0.011; Accession=PF00892.11; Description=Integral membrane protein DUF6
  Pfam annotation: Domain name=TPT; Domain location=60-199; Score= -29.3; E_value=0.029; Accession=PF03151.7; Description=Triose -phosphate Transporter family
  Pfam module annotation: Pfam domain module=DUF6::TPT; Domain location= 69-199::60-199
MKIKEVTCQAKVIGTVITFGGTLLMAIYKGPVLSVMRSSASHAGQPENVTNPSGNHWIIGTCFLLIGCAGFSAFYILQVITLRKYPAEMSLATWICFVGALQSSIVAVFVERHHLHAWALGWDTRLFAPAYAGIVSSGVQYYIQGVVIKLMGPVIVTAFNPLRMIIITTLACIVLSEQLYLGSIIGATVVVLGLYLVVWGKYKECHGRSMPPSSANDNPPEDQRQLPVTATRNDNKT

SEQ ID NO: 161138 - protein, 68 aa, Glycine max
  Coding DNA Sequence Number=SeqID_44360
MEVASGGSYLACRGELGGSLLPPFCYKMAFGAEGKGFNTSDIQFSLKISEGKKKEGKNPSQGASVMLS

SEQ ID NO: 161139 - protein, 113 aa, Glycine max
  Coding DNA Sequence Number=SeqID_44361
MHCQAPETIYSCKGTRGTTSVVQDCELVLLYMARITLERKSKTINIQVLSPIASTAENESPTRSWLCKESQQRESCHGPRQRLHNYCFHREPTTATLSLCSISTTRAMSAFLV

SEQ ID NO: 161140 - protein, 243 aa, Glycine max
  Coding DNA Sequence Number=SeqID_44362
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=84%, HitCoverage=53%, E-value=7e-53, Identity=49%"; Hit description =Nodulin-like protein
  Pfam annotation: Domain name=DUF6; Domain location=72-202; Score =23.6; E_value=0.00069; Accession=PF00892.11; Description=Integral membrane protein DUF6
  Pfam annotation: Domain name=TPT; Domain location=63-202; Score= -24.2; E_value=0.014; Accession=PF03151.7; Description=Triose -phosphate Transporter family
  Pfam module annotation: Pfam domain module=DUF6::TPT; Domain location= 72-202::63-202
MEHMKIKEVACQAKVIGTVVTFGGTLLMALYKGPVLSFMRSSTSHASQPENVVTQTGNHWVIGTLFLLIGCAGFSAFYILQAITLRKYPAEMSLATWVCFVGALQSSIVAIFAERHHPHAWSLGWDTRLFAPAYAGIVTSGVQYYIQGMVSKIMGPVIVTAFNPLRMIIVTALACIILSEQLFLGSIIGAVVVVLGLYLVVWGKAKERRGIMTPSPAENNFPEDQRQLPVIAPRNDNINTNKA

SEQ ID NO: 161141 - protein, 407 aa, Glycine max
  Coding DNA Sequence Number=SeqID_44363
  Gene Ontology: Mol. function=porphobilinogen synthase activity; Cellular component=chloroplast; Biological process=tetrapyrrole biosynthetic process
  Homolog annotation: Hit_ID=P43210; Match level="QueryCoverage=99%, HitCoverage=100%, E-value=1e-132, Identity=63%"; Hit description =Delta-aminolevulinic acid dehydratase, chloroplast precursor
  Pfam annotation: Domain name=ALAD; Domain location=80-402; Score =445.7; E_value=6e-131; Accession=PF00490.11; Description=Delta -aminolevulinic acid dehydratase
  Subcellular localization annotation: CTP_CleavageSite=59; ConfidenceScore=5.64e-01
MASSIPNGPPSALNSQFYDDLRPPQRTFNFSFLQPVKFPRSQRLFVVRASDLEFEATVVAGKVPPKPAAPVGTPVVPSLPLHRRPRRNRKSPALRSAFQETSISPANFVYPLFIHEGEEDTPIGAMPGCYRLGWRHGLVEEVAKARDVGVNSVVLFPKIPDALKSPTGDEAYSENGLVPRTIRLLKDKYPDLVIYTDVALDPYSSDGHDGIVREDGCWIMDGSKCLTTACLSTKLGSECKDSTHSNHDKAHSSIAIITACNSSTESLSTENTSQPGVIMNDETVHQLCKQAVAQAQAGADVVSPSDMMDGRVGALRAALDAEGFQHVKPGLPYLDIISLLRDNSPLPIAAYQVSGEYAMIKAAGALKMIDEEKVMMESLMCLRRAGADIILTYSALQAARCLCGEKR

SEQ ID NO: 161142 - protein, 94 aa, Glycine max
  Coding DNA Sequence Number=SeqID_44364
MISFKITGSSNLWNYVLCARVGIAKQRTGSFIFAEQLHLGSIIGAIIIALGLYSVVWGKGKGKGKGKDYSDPTPPSPTTKKTETQHLPITSSDI

SEQ ID NO: 161143 - protein, 333 aa, Glycine max
  Coding DNA Sequence Number=SeqID_44365
  Gene Ontology: Mol. function=oxidoreductase activity; Cellular component=vacuole; Biological process=hydrogen peroxide catabolic process
  Homolog annotation: Hit_ID=Q93V93; Match level="QueryCoverage=97%, HitCoverage=98%, E-value=1e-92, Identity=55%"; Hit description =Peroxidase 44 precursor
  Pfam annotation: Domain name=peroxidase; Domain location=38-294; Score=345.8; E_value=7.4e-101; Accession=PF00141.13; Description =Peroxidase
  Subcellular localization annotation: CTP_CleavageSite=33; ConfidenceScore=5.10e-01
MVKFTIVVIFLFFMFPIAFADLRVGFYSSSCPRAEQIVGQVVQRRFNRDRSITAALLRMHFHDCFVRCNPPYISQSALKCIEKWIKGCDASILIDSTRGNQSEKAAGANGTVRGYELIDEIKKALERECPSTVSCADIITLATRDSVVLAGGLKYDVATGRRDGHVSQSSEVNLPGPRSTVSRVLEVFSANGMSLDEMVTLLGAHTVGFTHCSFFRDRLNDPNMDPSLRAGLGRTCNRPNSDPRAFLDQNVSSSMVFDNAFYKQIVLRRGVLFIDQQLALDTLSKGLVTVFAGNNAAFQRSFADAMVKMGNIKVLVGNEGEIRRNCRVFNSAS

SEQ ID NO: 161144 - protein, 83 aa, Glycine max
  Coding DNA Sequence Number=SeqID_44366
  Gene Ontology: Mol. function=oxidoreductase activity; Biological process=hydrogen peroxide catabolic process
  Homolog annotation: Hit_ID=Q43729; Match level="QueryCoverage=89%, HitCoverage=23%, E-value=2e-16, Identity=52%"; Hit description =Peroxidase 57 precursor
MAFDNEFYNQIRLKRGVLYIDQQLALDPLSKGLVYTFVGDDVLFKRNFSDAIVKMGSIKVLVGEVGEIRRNCRLYMYVDVQGF

SEQ ID NO: 161145 - protein, 312 aa, Glycine max
  Coding DNA Sequence Number=SeqID_44367
  Gene Ontology: Mol. function=oxidoreductase activity; Cellular component=vacuole; Biological process=hydrogen peroxide catabolic process
  Homolog annotation: Hit_ID=Q93V93; Match level="QueryCoverage=98%, HitCoverage=98%, E-value=3e-98, Identity=59%"; Hit description =Peroxidase 44 precursor
  Pfam annotation: Domain name=peroxidase; Domain location=36-274; Score=389.1; E_value=6.7e-114; Accession=PF00141.13; Description =Peroxidase
MKIKILYFYFILLPLAFADLKVGFYASSCPKAESIVKKVVQNRFNRDKSITAALLRMHFHDCAVRGCDASILINSTKANTAEKEAGANGSVRGYDLIDEAKKTLEAACPSTVSCADIITLATRDAVALSGGPQYDVPTGRRDGLVSNIDDVNIPGPNTPVSVTSQFFASKGITTQEMVTLFGAHTVGVAHCSFFDGRLSGAKPDPTMDPALNAKLVKLCSSRGDPATPLDQKSSFVFDNEFYEQILAKKGVLLIDQQLALDATTKGFVSDFAANGDKFQKGFANAIVKMGEIDVLVGNQGEIRRKCSVFNRN

SEQ ID NO: 161146 - protein, 92 aa, Glycine max
  Coding DNA Sequence Number=SeqID_44368
  Subcellular localization annotation: CTP_CleavageSite=39; ConfidenceScore=5.06e-01
MEEICCANNFGKNYFTKAKPYFLTVALQFGFAGGYIFTVASFNSGMCRFVFIVYRNAFAALALAPLHSSLRVFYLLNYLKNESYIKVGLSLK

SEQ ID NO: 161147 - protein, 281 aa, Glycine max
  Coding DNA Sequence Number=SeqID_44369
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=92%, HitCoverage=61%, E-value=5e-93, Identity=57%"; Hit description =Protein disulfide-isomerase precursor
  Pfam annotation: Domain name=Thioredoxin; Domain location=175-266; Score=64.2; E_value=4.2e-16; Accession=PF00085.10; Description =Thioredoxin
MKLLFVSKFSGEEFDNFTAEKLRADYDLGHTMNAKHLPRGESSVTGPIVSSPNSKRCYYGMDFKNSFLTPKRLSNVFLGGAESFKSKYRETAEQYRQQGLSFLVRDVKSTKGSFQYFGVKEDQVPLITVTRNDGKKFLKPNLEPDHMSTWLKAYKEGNIAPYFKSEPIPEANNEPVKVVVGDSLQDIVFNSGKNELAPILEEVAVSYQSDADVTIAKLDGVANDIPRETFEVRGYPTVYFRSASGKISQYDGNRTKEDIIEFIEKNQDKPAQQGKDELEKG

SEQ ID NO: 161148 - protein, 313 aa, Glycine max
  Coding DNA Sequence Number=SeqID_44370
  Gene Ontology: Mol. function=DNA topoisomerase (ATP-hydrolyzing) activity; Cellular component=chromosome; Biological process=DNA topological change
  Homolog annotation: Hit_ID=Q8RU34; Match level="QueryCoverage=82%, HitCoverage=30%, E-value=2e-40, Identity=34%"; Hit description=Bzip transcription factor-like
  Pfam annotation: Domain name=DUF632; Domain location=1-133; Score= -74.6; E_value=6.9e-06; Accession=PF04782.3; Description=Protein of unknown function (DUF632)
MWKFMLKCHQKQFQAIMESKSQSLKINVGLQGDEGLKAIVELEKELLNWCSQFNHWVKTQKSYVKNLNEWLIRCLPNEPEETADGIAPFSPSQLDAPPVFIICNDWNHAMSRISETGVAEAMHEFALKLHELWEKQDEAQRQRIKAEYLRKDFEKQLRTLHTEMGGSEHDHDKVLGKIALSKLASDSGVSPLDDLKVDLDSMKKKLHEERVRHKEAIKLVRDAANNSLQAGLIPIFKTLESFTSEVVKAHEQVRLQSAGDKKAPLELPYRGLLGTCFSDESFDSLLFADVLILFDSIEAKWLIHPFKPQEVIF

SEQ ID NO: 161149 - protein, 53 aa, Glycine max
  Coding DNA Sequence Number=SeqID_44371
MVYSADESDVLTLDHSNFSDTVSTYSLIVVEFYAPSFENLIGINSSKCVQNCY

SEQ ID NO: 161150 - protein, 503 aa, Glycine max
  Coding DNA Sequence Number=SeqID_44372
  Homolog annotation: Hit_ID=Q0GPD2; Match level="QueryCoverage=22%, HitCoverage=40%, E-value=1e-10, Identity=41%"; Hit description=BZIP transcription factor bZIP107
  Pfam annotation: Domain name=DUF630; Domain location=1-60; Score =127.1; E_value=5e-35; Accession=PF04783.3; Description=Protein of unknown function (DUF630)
MGCSGSKVEDFPAVVLCRERKAFLKAASEQRYALAAAHVAYFHSLSEIGHALHKFAEQDLTTTTGSSSPVLTLPSETKSINNNKLSSSSPSISHADSPDGSHLPLSSGSELSSPSPSHSHSSSPHIHDSPEPDPPPYGYYENYHYAHYMKRSVPNGKPMVYEEPERHVATIGQWPDPSYGYGNTGFYGFPGGNYPYYPQPGPSSSPPRPPPAPPSPPRVSTWDFLNFFDNFDNGYPGYPPRLGSSASSPDSKEVREREGIPELEDETEHETMKEKEKEFVPLKKEKKKMGEEKGFGVGVRDFGEGPSNTKTVPLQQVSSSEGSSKTVRFHDGSDNGSVEKEINSSPDTVASEERGAKKGVSFEIDEATVTTVDGDSSVLSSATTLSAHGTRDLREVVEEIQDEFVTASNFGKEVALLLEVCKRPYRSRVAALRVIFSRILQMLAPSRLPSDLVSIQFSSREIKLAQAYCGGEPGKDFKTNPENLSSTLEKLYAWEKKLYKEVK

SEQ ID NO: 161151 - protein, 58 aa, Glycine max
  Coding DNA Sequence Number=SeqID_44373
MVRMSRWAHVKSDLKITMMKNGGKTMMIGATHDGIVRVEDNGQEGEGKEGWQIVRGFW

SEQ ID NO: 161152 - protein, 297 aa, Glycine max
  Coding DNA Sequence Number=SeqID_44374
  Gene Ontology: Mol. function=nucleoside-triphosphatase activity; Cellular component=chloroplast
  Homolog annotation: Hit_ID=Q2PMM5; Match level="QueryCoverage=98%, HitCoverage=15%, E-value=1e-145, Identity=77%"; Hit description =Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWNEDSKISHIDQSKRDSTTKKKDRFLLFGDPSFLQTERTRDRIRGDSLKSFSGYSSMCRLFMEREKQMNNHLLPQEIEEFLGNPARATRSFFSDRWSELHLSSNPTERSTRDQNC

SEQ ID NO: 161153 - protein, 86 aa, Glycine max
  Coding DNA Sequence Number=SeqID_44375
GVVLAEVLLADSRFTRPDMGFHPTKLNFVPSDADEAPLDVSICLHAFGIVGCGSFSGVKSCEREDPFHPASLLGTLEDFKVPHVNH

SEQ ID NO: 161154 - protein, 77 aa, Glycine max
  Coding DNA Sequence Number=SeqID_44376
MTDKVDGDVIHRFKVQSNSQIFSLIVGAKDMSFIHKESKNPVTGPAVGPDPWPHHRSSAAQACLLVILTGCSAPILV

SEQ ID NO: 161155 - protein, 456 aa, Glycine max
  Coding DNA Sequence Number=SeqID_44377
  Gene Ontology: Mol. function=sequence-specific DNA binding; Cellular component=nucleus; Biological process=regulation of transcription
  Homolog annotation: Hit_ID=Q1T4J9; Match level="QueryCoverage=87%, HitCoverage=71%, E-value=5e-54, Identity=35%"; Hit description=DNA -binding WRKY
  Pfam annotation: Domain name=WRKY; Domain location=202-262; Score =137.7; E_value=3.1e-38; Accession=PF03106.6; Description=WRKY DNA -binding domain
MEAMLKLSSLCGQEIDDKRDTSICSEEDLCIEKGSKEDKLESAKAEMSKVKEENERLKMMIERVGKNYHSLQLRFFDILHRETSNKGVEDSAVSLDEVEEPKLVSLCLGTSPWEHKKDGIICNSSKHKENEDLEASLTLGLDCKGVSSKEQVSDMNTSEEKEEDSTNKLVRTKDGGDEISEITPPAKRARVCVRARCDSPVMHDGCQWRKYGQKIAKGNPCPRAYYRCTLAPACPVRKQVQRCADDMSILITTYEGTHNHPIPASATAMASTTSAAVSMLLSGSSTSQPTDHSFAYHANSPTLFSGVNFSLLDQPRANQVLLPTPSSHLLPTITLDLTSTPSYSLNQGNCLPSNFASTPRFPPLSLNFWSPESNIPLSFWGKGIPNNGTIPIDKTHIKPFNIGNQFQEHFYQHYFKNQTPFREALAETLTKAISTDTSFRSAIAAAVSSIRGQGSS

SEQ ID NO: 161156 - protein, 54 aa, Glycine max
  Coding DNA Sequence Number=SeqID_44378
MEKKLWKGIAIMSNVKVTLGARTGSEFKNLIKFVARIYNKTYIFGPTERFKEQT

SEQ ID NO: 161157 - protein, 308 aa, Glycine max
  Coding DNA Sequence Number=SeqID_44379
  Gene Ontology: Mol. function=hydrolase activity
  Homolog annotation: Hit_ID=Q2HVC5; Match level="QueryCoverage=85%, HitCoverage=81%, E-value=9e-56, Identity=43%"; Hit description=Cupin, RmlC-type
  Pfam annotation: Domain name=DUF1637; Domain location=40-305; Score =429.1; E_value=6e-126; Accession=PF07847.3; Description=Protein of unknown function (DUF1637)
MGIERTLADRKGRDFCELPRETIASSNSRRNRRRQRKKPPVQKLFETCKVVFASAGTGFVPPHEDIDELQSVLDGIKPEDVGLRPDMPYFRTSATQRVPRITYLHIYECEKFSMGIFCLPPSGVIPLHNHPGMTVFSKLLFGTMHIKSYDWVVDSPPESPTTLKPSERTSSSDPNRTLKYHKTLMYFSSHRDVNDQGPEMRLAKVKVDADFTAPCNPSILYPEDGGNLHCFTAVTACAVLDVLGPPYSDAEGRHCTYYHDFPFSNFSVDGLSIPEEEKNAYEWLQERDELEDLEVNGKMYNGPKIVES

SEQ ID NO: 161158 - protein, 51 aa, Glycine max
  Coding DNA Sequence Number=SeqID_44380
MMRNCEGEAEVGKDCGLIFDIKEAGRGAGMVGSVDRTMSSDMLAQAQKQGF

SEQ ID NO: 161159 - protein, 79 aa, Glycine max
  Coding DNA Sequence Number=SeqID_44381
MALLDFPAICTPLSCDSPMILLPTLQRWNSSLNKWSLDGFAVAVGDSYPGVSPHGDAPDLRPGPKSSVGAPEPSDVSPV

SEQ ID NO: 161160 - protein, 89 aa, Glycine max
  Coding DNA Sequence Number=SeqID_44382
MALPSRERRPHCCLHQRWVLIRREKLLMLLWEWVLIGRENKLFLLLPGWVLIKGITFFTIRFWCHLRAIEGNLVVGVVKLKLDIVQGFS

SEQ ID NO: 161161 - protein, 1116 aa, Glycine max
  Coding DNA Sequence Number=SeqID_44383
  Homolog annotation: Hit_ID=Q1STD0; Match level="QueryCoverage=97%, HitCoverage=97%, E-value=1e-127, Identity=32%"; Hit description =Prefoldin
  Pfam annotation: Domain name=DUF869; Domain location=64-993; Score =467.6; E_value=1.6e-137; Accession=PF05911.2; Description=Plant protein of unknown function (DUF869)
  Pfam annotation: Domain name=Pox_A_type_inc; Domain location=176-198; Score=0.6; E_value=67; Accession=PF04508.3; Description=Viral A-type inclusion protein repeat
  Pfam annotation: Domain name=Pox_A_type_inc; Domain location=41-60; Score=4.2; E_value=20; Accession=PF04508.3; Description=Viral A-type inclusion protein repeat
  Pfam annotation: Domain name=Pox_A_type_inc; Domain location=897-919; Score=12.9; E_value=1; Accession=PF04508.3; Description=Viral A-type inclusion protein repeat
  Pfam module annotation: Pfam domain module=DUF869::Pox_A_type _inc::Pox_A_type_inc::Pox_A_type_inc; Domain location=64-993::176 -198::41-60::897-919
MDQKTWLWRKKSSEKTIIAADNTDLSSKENEEVQALVADKEELEKNLKRLNNKLTSALSDCNAKDELVKKQTKVAQEVMEGLKKAEAEVLSMKQDLDEALQQRLVYEERVVHLDGALKECMQQLRFVREEQGQRIHDAVMKASKEFEKERLVLEEQLSETSKRLAKAEAENSHVNKSIFARENLIEDLKRQLNQAETDHCALMNRLESTENDNTSLKYEVRVLEKELEIRNEEREFNCRTADASHKQHLESVKKIAMLESECQRLRLLVRKRLPGPAALAKMKNEVDMLGRDSFEIRRSKLSSTSSVVESSVDTSPETPIRRINTLNEQLYTMEEENKTLKESLNRKMNELQFSRVMLSRTASKLLQLQSQIEESSKAHITVEQLRSYLTSHEFSLASMSDAGSDDKASCAESWASALISELEHFRSRKEKEPLSCKSVGASDIDLMDDFVEMEKLAVVSVERGTEISSASFKAVSEINGFSETGTKDTTPEVEGKEIIPVSDHISTATSETIPEVVGMEIIPVSDHISDLPKSNKKTCSIDILTGNSPGWLQDVVKMVLEQTHVTHKSSDDILDDIRVALRYVNNPDLFDFDSSKDSGHIDTQDPPQCIHCISCSNNSLVASGDENNTGILSIKRITLQSQEDLSKSIGKIIEIVERICLPSVDYDSSDPLHEGDGDIVSYKNVGMPTGYMVRVFQWKTSELSNVLRQFLHVCYDLLSGKTDYGNFAKELTILLDWIMNHCFSLQDVSSMKDAIKKQFDWDETQSEGETENEISHFAEEDKLQFPRENSSSLPQVTTLDGHDLQNGEIYCKEKEELTNIKDKLISAESQKEVLEGKLQSATDRIESLMNQLQESDKTIDSLRLEIHSFKESNGKLENEIRNQKLIISNPDAQHSEEELKEARNKVLALEVELEKKNSNCKELEAKCIELQFQLESMSKECSNHDIIEKDKPLHNDWEITAASEKLAECQETILNLGKQLKAMAAPKDASLFDNVIAAQFKANTNTAATTTTNVDPSLAPPKFMKVKSRSLLDQMLADDTKAKVPKGSNDNSNPITIPGVLEPLEKILVLNGVKDHEDRTTDNSLAIVPAKKPGSGSLWRKLLRRRKKSAILKISL

SEQ ID NO: 161162 - protein, 101 aa, Glycine max
  Coding DNA Sequence Number=SeqID_44384
GHFNFFKKYCMLLEENYRQLKKLVPIEEKSVSQIRNSSILRNEDYFSSCAMLSLNAKDPQELPWKKTVVPGESISTKTPSDAQEKKYKELAELGGINIGRE

SEQ ID NO: 161163 - protein, 159 aa, Glycine max
  Coding DNA Sequence Number=SeqID_44385
MEITKSLVSNNNNKKNKCTPSRLVGPDGVGLLVLPCKVELKDDSSLLVATYQPLPAAFTKQSSCYTKANSFYITCSKLKYSNQNWRNSVGLGWKRMKERLRDRKMQRSKVQRVRNRHMRLHDAKNKGEVVAICCSRGWAMQFPCVYEKSRLEIPMAHNV

SEQ ID NO: 161164 - protein, 153 aa, Glycine max
  Coding DNA Sequence Number=SeqID_44386
  Gene Ontology: Mol. function=ribonuclease P activity; Biological process=tRNA 5'-leader removal
  Homolog annotation: Hit_ID=Q2QZQ0; Match level="QueryCoverage=83%, HitCoverage=14%, E-value=8e-13, Identity=36%"; Hit description =Ribonucleases P/MRP protein subunit POP1 containing protein, expressed
  Pfam annotation: Domain name=POP1; Domain location=28-153; Score =51.8; E_value=2.2e-12; Accession=PF06978.2; Description =Ribonucleases PMRP protein subunit PO
MVTDGTKKPQVSVPTPPPPPWKINLQKYAESRALELHSLQSIIKNRVNSDYRSQKNKRRRKTVFDNQISRKWCRRKGQKLGIIDKALAKSGLEENHQKKLPRCVHRRYELKKNPENGFCTSGDVTKRLRTHVWHAKWFAMTKLWGYHLPLCLQ

SEQ ID NO: 161165 - protein, 499 aa, Glycine max
  Coding DNA Sequence Number=SeqID_44387
  Gene Ontology: Mol. function=protein serine/threonine kinase activity; Cellular component=cytoplasm; Biological process=protein amino acid phosphorylation
  Homolog annotation: Hit_ID=Q1SRR9; Match level="QueryCoverage=94%, HitCoverage=99%, E-value=0.0, Identity=83%"; Hit description=Protein kinase
  Pfam annotation: Domain name=Pkinase; Domain location=9-273; Score =143.3; E_value=6.4e-40; Accession=PF00069.15; Description=Protein kinase domain
  Pfam annotation: Domain name=Pkinase_Tyr; Domain location=9-273; Score=-112.3; E_value=1.4e-05; Accession=PF07714.7; Description =Protein tyrosine kinase
  Pfam module annotation: Pfam domain module=Pkinase::Pkinase_Tyr; Domain location=9-273::9-273
MEPRVANKFRLGRKIGSGSFGEIYLGTNTQTNEEVAIKLENVKTKHPQLLYESKLYKILQGGTGIPNVRWFGIEGDYNVLVMDLLGPSLEDLFNFCTRKLSLKTVLMLADQMINRVEFIHSKSFLHRDIKPDNFLMGLGRRANQVYAIDFGLAKKYRDTSTHQHIPYRENKNLTGTARYASMNTHLGIEQSRRDDLESLGFVLMYFLRGSLPWQGLKAGTKKQKYEKISEKKVSTSIESLCRGYPSEFASYFHYCRSLRFDDKPDYAYLKRLFRDLFIREGFQFDYVFDWTILKYQQSQIATPVRVIVPAAGQSSGLPPAVVNADRQTGGVNSRHTGWSSSDPARRRNSGPIANDGMSSRQKAPVPSDSTGSKDVMLSSSNFRSSGSTRRGAVSSSRDAAVGNETEPSHPLTMDASPGALRKISNAQRSSPIMSFEHNRTSSGRNTSNMKNYESTLRGIETLNFNDESHQLVKRPLLQYYKFQGLFHVQRRNYKFVSKM

SEQ ID NO: 161166 - protein, 336 aa, Glycine max
  Coding DNA Sequence Number=SeqID_44388
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1SSN5; Match level="QueryCoverage=98%, HitCoverage=23%, E-value=1e-136, Identity=78%"; Hit description =ATPase, E1-E2 type
  Pfam annotation: Domain name=Hydrolase; Domain location=67-328; Score= -0.8; E_value=0.056; Accession=PF00702.16; Description=haloacid dehalogenase-like hydrolase
MSVIVRDEEGNIILFCKGADRTLGPSIGFYNGIIKILFMLVEFIFYLLLPYYTITATPCFQRMPVKIHIIIFDRLSKNGKMCLEATTRHLNEYGEAGLRTLALAYRKLDDQEYSDWNNEFQKAKTAVGSEREAMLEQVSDIMERELILVGATAVEDKLQKGVPQCIDKLAQAGLKIWVLTGDKMETAINIGFACSLLRQGMKQICITMNSDSVTNDGKEVIKGNILSQITNASQMIKLEKDPHAAFALIIDGKTLTYALEDDVKHQFLGLAVGCASVICCRVSPKQKALVTRLVKEGTGKTTLAIGDGANDVGMIQEADIGVGISGVEGMQKNDWG

SEQ ID NO: 161167 - protein, 182 aa, Glycine max
  Coding DNA Sequence Number=SeqID_44389
  Gene Ontology: Cellular component=integral to membrane; Biological process=transport
MASTEGLVPITRAFLASYYDKHPFTPLSAHVSTLSSQIRSMANDFLTQHPPIQGESILINEADQQPPHKMDENMWKNREYIEETIFLLQSSNWPEALKQQSTADSVEFAITLGKLKDKLHITLKALESFQTKNAEHENKERHGKFMGQLTKLMSLGKPQEQADIFGKTVWLTHTSGEVARLD

SEQ ID NO: 161168 - protein, 302 aa, Glycine max
  Coding DNA Sequence Number=SeqID_44390
  Gene Ontology: Mol. function=translation initiation factor activity; Biological process=cellular metabolic process
  Homolog annotation: Hit_ID=Q2QYG9; Match level="QueryCoverage=64%, HitCoverage=92%, E-value=9e-35, Identity=42%"; Hit description =Eukaryotic translation initiation factor 2B family protein, putative, expressed
  Pfam annotation: Domain name=DUF567; Domain location=29-191; Score =150.0; E_value=6.1e-42; Accession=PF04525.3; Description=Protein of unknown function (DUF567)
MTKVHPNANASVCVSETETEKPNKNSDAMAVVLTVWKKSLLPNCNGFTVFDTQRGNLVFRVDNYVARNKDQILLMDAAGTPLLTIRRKRLSLVSDTWLVFEGEGSVKQKLLFTAARKNVNAKCTLAHIFNIKKEVAYEIEGSYAQRCCTFYNNNKIKVAEMKMKETFGADIFRLFVQPHMDTTLAMAFVILLDHILPCLKFTDKMIKQERVYTGDRDCRGGEGLFYSIRKVHTKSGIVEAKFITCLAGSEVSMGNKVADVSHVIGWLYAGEGVTLNFNVYFALKNLWVIRLYSWMPYCRVGL

SEQ ID NO: 161169 - protein, 169 aa, Glycine max
  Coding DNA Sequence Number=SeqID_44391
  Homolog annotation: Hit_ID=Q1STP6; Match level="QueryCoverage=84%, HitCoverage=74%, E-value=9e-50, Identity=71%"; Hit description =Harpin-induced 1
  Pfam annotation: Domain name=Hin1; Domain location=31-169; Score =30.8; E_value=3.8e-06; Accession=PF07320.4; Description=Harpin -induced protein 1 (Hin1)
MKVGSGKGRKVCLSLTGVVIAIVLLIVILALTVFKAKHPVTTVDSTKLEDFHMGLDTPKLRVDLNVTLHVDVSVKNPNKVGFKYSDSTAHLNYRGQLIGEVPIPAGEISSGETKGFNLTLTIMADRLLSNSQLLSDVASVAKPFVALEQEKNFSPVIARTPTRKLLQLT

SEQ ID NO: 161170 - protein, 891 aa, Glycine max
  Coding DNA Sequence Number=SeqID_44392
  Gene Ontology: Mol. function=RNA-directed DNA polymerase activity; Cellular component=mitochondrial respiratory chain; Biological process=RNA-dependent DNA replication
  Homolog annotation: Hit_ID=Q9LZA5; Match level="QueryCoverage=80%, HitCoverage=95%, E-value=0.0, Identity=53%"; Hit description =Maturase-like protein
  Pfam annotation: Domain name=Intron_maturas2; Domain location=499 -658; Score=92.5; E_value=1.3e-24; Accession=PF01348.12; Description =Type II intron maturase
  Pfam module annotation: Pfam domain module=Intron_maturas2::RVT_1; Domain location=499-658::86-331
MVASLHLHIRRIVFRNAHPRLHSTLTKPQLKALVLDHYSHGKFANLIQNVVASPPVLLTACQNLSPSFPPPDRFSIPATCLELLENRFDVASCCLPLTPSFVLPNLKLKVVIEAIRMVMEIVYDDRFVTFCYGGRVGMGRHTAIRYLKNSLENPTWWFTVRFKPHRFQHFHVEKLCSVIERKVNDSVFIDLIKRLFQCKALVIELGADWLGRGLPQECGLCSILINVYFDAFDKEIQEMRLRENRENRELDPKIIASGLYSDVFYKPVKVYAVRYLDEILLATSGSKMLALELRTGVVKTLELGLGLRVDKVNTAIHSAVSEKIEFLGMELQAVLPSILRPPMSEKAIRARKKYLRQKEVRALELRNARARNRRKLGLKIFSHVYKKIKQSDGFKFDFSIENQVREIFRSWADEVVQEFLGNIDECQEWHRSLSAGDFLQLRHIRNQLPPELVDAYDKFQEQVDQHLNPIKARKAIEEEERRVKEEEEQNYSKGTVEDLTKLCMKVEAPEILIRKAVKLVGFTNHMGRPRPIEFLVALEDADIIKWYAGIARRWLDYFCCCHNFKTVKTIVTYHLRFSCILTLAEKHESTKREVIKHFSKDLRVYDMNGNHEVHFPTEREVKMMGDRNLSDPKPVDGALSLAVVRLASDEPPCHCIAHFCDKTTTVFYRVHLLQNRLNVSPLDKEKWVQGMGVIHESLNRKCLPLCTDHVNDLYMGRITLQDIDCSYCVDETGSVIGVAAGLARNIVTGMVEGTVMMVGASEGAMSGVGFVGKIEVGELFVYCRIIRVRHFTAQPADDEDREMLQGRFSLLACCCSSTSCVRCCYSCHHRQDDILRSLGQASPGMSVLAAGSAAAYKMLQVEKGLTKDDKAHKLALRLEIVSSYVNILTYI

SEQ ID NO: 161171 - protein, 405 aa, Glycine max
  Coding DNA Sequence Number=SeqID_44393
  Homolog annotation: Hit_ID=O49289; Match level="QueryCoverage=38%, HitCoverage=17%, E-value=3e-44, Identity=56%"; Hit description =Putative DEAD-box ATP-dependent RNA helicase 29
  Pfam annotation: Domain name=DBP10CT; Domain location=24-86; Score =98.8; E_value=1.7e-26; Accession=PF08147.3; Description=DBP10CT (NUC160) domain
MEAGLSVKANEDFASNRLEAAVLDLVADDGAGIQKQRSMYHWDKRGKKYIKLNNGDRVAANGKIKTESGAKTKANKTGIYKKWKERSHVRISLKGTNNGDPQDSTSLTGSYQRGRSNFKGSKKQHSMPNAHVRSELKDMDQIRKERQTKANRVSYIKSKSTKGKRNIFYENYIRSVKSKRQRLGFWRYLALTRHPRQQQYLSIHFFVVLPTHSSQGRVCLVGWGKRRMASGDLCKDSMKDTPTDCVVPITPEAVTENGDLQSQSPLTLSVVRKQLIRACIDCDSDRALVDNNNNDIGIPRTPKDGVFDPFAPGPDNMARAPNSNKYLDEYRTTVARRLDFHPSFDVVAEADSDTLSDEKMVESVYENLLQVIVSKQAEGALAQMSDDCETPPSVLRFTGIADTCP

SEQ ID NO: 161172 - protein, 50 aa, Glycine max
  Coding DNA Sequence Number=SeqID_44394
MERKSLVGLCFFFVVVLASQMVVEAGNRGILFPEGCIEPVGSQQCKTGEG

SEQ ID NO: 161173 - protein, 238 aa, Glycine max
  Coding DNA Sequence Number=SeqID_44395
  Gene Ontology: Mol. function=nucleic acid binding; Biological process= transport
  Homolog annotation: Hit_ID=Q8H6Q8; Match level="QueryCoverage=38%, HitCoverage=2%, E-value=3e-19, Identity=50%"; Hit description=CTV.20
  Pfam annotation: Domain name=MP; Domain location=1-192; Score=30.7; E_ value=1.9e-06; Accession=PF01107.9; Description=Viral movement protein (MP)
MDDLSISKIPQDTLYVPQTIKDKHNFDYVINNVENNIPLGQDIWEEFHLLSKNSIFEHNRKYKYLQIGCVQVAIKPLIDIGIDATILMCLRDIRHNKFEDSLIGIVETSLGQGPVYFNCYPNKTVSLMDRNILESLFLNIHFHGLNMKEGSIPIALTYRIQYKVINLQGLDTTSSIPRTTHNKNKRMTKSQFNLQHILLCMNLMMLSDKFSIDKEILRKDFYSPKNEPQRRWFFQHFK

SEQ ID NO: 161174 - protein, 69 aa, Glycine max
  Coding DNA Sequence Number=SeqID_44396
MGAKYLEVVKRGSHPNNGWSPDEIRVILFYPHLFIYLPLIPHDGKLILFIYLPNSFAKTQRIKCMKYEF

SEQ ID NO: 161175 - protein, 88 aa, Glycine max
  Coding DNA Sequence Number=SeqID_44397
  Homolog annotation: Hit_ID=Q1SRK0; Match level="QueryCoverage=73%, HitCoverage=11%, E-value=2e-10, Identity=53%"; Hit description =Peptidase S8 and S53, subtilisin, kexin, sedolisin; Tetratricopeptide - like helical
MPQCDHFSSIGVDFVKLQVDLSQLFNEIKHLIVGPQRGREVIEHDSLNEEHKGLEEGDVVVDTSAFLYGVADNRWGDWERGKDCGKAR

SEQ ID NO: 161176 - protein, 42 aa, Glycine max
  Coding DNA Sequence Number=SeqID_44398
MACLQVNGDLDVSDGGERREVKWWLDRNIEMAITEATGLQMR

SEQ ID NO: 161177 - protein, 80 aa, Glycine max
  Coding DNA Sequence Number=SeqID_44399
MKRKKRAFAKRNTQWLSPRKNPEEHELSGLLSAPLQVIKRTASAHPLSERSALSQKLVACVKRSIHALSTRARTRPPISA

SEQ ID NO: 161178 - protein, 91 aa, Glycine max
  Coding DNA Sequence Number=SeqID_44400
MSWSPTFIGQLTSASKRVVEGTHENGQQRWWLVIVDGDVMAMGGVVGVIGCVGVSALMVVVVVVEGVWVVRWVVVMVFGEGERLGKKKVIM

SEQ ID NO: 161179 - protein, 149 aa, Glycine max
  Coding DNA Sequence Number=SeqID_44401
  Gene Ontology: Mol. function=L-ascorbic acid binding; Cellular component=proton-transporting two-sector ATPase complex; Biological process=ethylene biosynthetic process
  Homolog annotation: Hit_ID=Q1SMV3; Match level="QueryCoverage=91%, HitCoverage=36%, E-value=2e-37, Identity=54%"; Hit description=2OG -Fe(II) oxygenase
MAATSTDKLEAGTVSSYDRKSEIKAFDDSKTGVQGLVENGVTKVPLMFYCENSNLNDGITSASNSKISIPIIDLTVIHDDPILRDHVVGKVRYACEKWGFFQVINHGIPTHVLDEMIKGTCRFHHQDAKARKEYYTRKHLHMLGLNNGG

SEQ ID NO: 161180 - protein, 132 aa, Glycine max
  Coding DNA Sequence Number=SeqID_44402
MGKLVKHVADLMEQTKIGFLANTKTNPKGYCSAIFTRSGGEYDTGSEGEEELVIEGVGLNKVREMSAKEEKLKAKPPIVVDLPYSKNPTKRDNVEIVNVVIEVRDGKFKLGAGNEKVTFNVFNVVSPSRGWG

SEQ ID NO: 161181 - protein, 174 aa, Glycine max
  Coding DNA Sequence Number=SeqID_44403
MGDDPLSVARWKGEQIEGSSKEFRSIFGRYEKVKEVFIVERKNKWGRRFGFICFSDTEELVISFPRKSHCIGLTKFIHIGSCTNIKLKMKGLPVKKVWRVKNNNDKKSVGDDWKGMVINVNLDDKSWLTDSWVGTLVDLKMNDRSRKIHVMDGSEEVNLRYMGGDLVLTTGGVR

SEQ ID NO: 161182 - protein, 581 aa, Glycine max
  Coding DNA Sequence Number=SeqID_44404
  Homolog annotation: Hit_ID=Q1STQ3; Match level="QueryCoverage=27%, HitCoverage=89%, E-value=1e-39, Identity=57%"; Hit description =Bromodomain
  Pfam annotation: Domain name=Bromodomain; Domain location=121-208; Score=99.5; E_value=1e-26; Accession=PF00439.15; Description =Bromodomain
MEFLYALYVLLKSLDHSLTLLCQCNMSRLRKLQKTEGQRRSPRISALEAEAHVHSMRRHLDNGQGPAFRTRGRKNTKLRPNKFTLTSHIMQGVKHSCHQDIQKKSGDDKPSKLPSSPSLPEKQILQLVLDTLQRRDTYEIFAEPVDPNEVEDYYAIVKEPMDFGTMRAKLHEGMYRSLEQFEHDVFLIFDNAMHFNSSGTIYFRQARVINELAKKVFDLLKNNPEKFELEFSETRRKVGRRNQGDSRDSTDLKSSEIASGVPSKTVPCSSRGTPNKRSFKANHGSKHVEITAGTEERSRGRSSEIDRRCTYRPLSLEEDKSIFSTVYGKLKLLEHVNQQDIGYKDSLMLFAKDLGPTAQNIAKRKLLGCEIRTASTSAPCRPDTSNGREKVEGTLNAEREKDCRPLDGNALGCHRLSLGCHKEFPNKSFCFDSSYLQACAEDFTYSDQGSKETGKKSVRMLLDRSKLLNQENLSVSVLENFKAGSVVNSRLENSCELQSQPQAIESSDVSGYVQEKSQLQNNFMFRSNCAMGDREGTNEISCSADQAMKILKSDQTVSSASSFVFNLPYLKTRLDQINSSE

SEQ ID NO: 161183 - protein, 383 aa, Glycine max
  Coding DNA Sequence Number=SeqID_44405
  Homolog annotation: Hit_ID=O04342; Match level="QueryCoverage=33%, HitCoverage=33%, E-value=5e-32, Identity=57%"; Hit description =Expressed protein
MAYRRRHGISRASTFKEEVHPDHDNANDPTPLPSLSSSFSFTPSSSSSLAAQAIKASAARRDPSLSFTFPKSEHDQHHRSKSFDAYGDVSKSGVWGVLAKKAKEILEDDKSSPQHNNVVNIKPVVDIDKLKSHSFNTFAPNKAAGDHRTPIKLKEISPDQSNQTAADTWNPWQQPDQTGGGGASQTIHETQLKASRDVAMATAAKAKLLLRELKTVKADLAFSKARSAQLEEENKMLRDREGTDKGQNVTRADDDLIRLQLETLLAEKGRLASENEVYARENRFLREIVEYHQLTMQDLVYLDEGMEEVTEIYPLDTTGTVVPRVLPKSPRSPLSRGGSHTKSFFSVPQILEQEQENNVTSELDEAPPSIDISVSVSKDQHAK

SEQ ID NO: 161184 - protein, 106 aa, Glycine max
  Coding DNA Sequence Number=SeqID_44406
MTKNESKPNKTHMIQEASISTLSAPQRFYPDGMRPEFDFGALGIYNAPCWNVELRDGSGGTQVVEVPRAPLAEGLPLPPNIQETENRARVSALRSRARKRKGKGNS

SEQ ID NO: 161185 - protein, 353 aa, Glycine max
  Coding DNA Sequence Number=SeqID_44407
  Gene Ontology: Mol. function=DNA binding; Cellular component=nucleus; Biological process=regulation of transcription
  Homolog annotation: Hit_ID=Q1SSM9; Match level="QueryCoverage=94%, HitCoverage=92%, E-value=1e-105, Identity=61%"; Hit description =Homeodomain-related
  Pfam annotation: Domain name=Myb_DNA-binding; Domain location=14-61; Score=49.0; E_value=1.5e-11; Accession=PF00249.21; Description=Myb -like DNA-binding domain
  Pfam annotation: Domain name=Myb_DNA-binding; Domain location=67-112; Score=50.0; E_value=7.9e-12; Accession=PF00249.21; Description=Myb -like DNA-binding domain
  Pfam module annotation: Pfam domain module=Myb_DNA-binding::Myb_DNA -binding; Domain location=14-61::67-112
MGHHSCCNKQKVKRGLWSPEEDEKLINYITTYGHGCWSSVPKLAGLQRCGKSCRLRWINYLRPDLKRGSFSPQEAALIIELHSILGNRWAQIAKHLPGRTDNEVKNFWNSNIKKKLLSHDVVPSLATFSDIHGPPNSSMESFFPLTDNPILNSHHHLDQLFLPIIPSPILQAFDHHHHNNDIKHIDINNFNNNNANFLHFQNPMPETVPPISNNIPSLYQEDTWSSLGCVPIHLNPNQENQIMITKSDHTTPHLIVDKFVNPSTWQQQHSVEVEPPIVPKVCESIEDYVCSIPYSSSANSHEEAVACYTPAVICPQDQTAAPNQVEYIDALIMSSLPSTTTSSSSVSFFQANK

SEQ ID NO: 161186 - protein, 454 aa, Glycine max
  Coding DNA Sequence Number=SeqID_44408
  Gene Ontology: Mol. function=nucleic acid binding; Biological process= metabolic process
  Homolog annotation: Hit_ID=Q2HVD1; Match level="QueryCoverage=94%, HitCoverage=85%, E-value=1e-142, Identity=61%"; Hit description=IQ calmodulin-binding region
MLENVKDNVPDFCTGMGMLAISKEGEVTVSFKNNINLNDFYKPEQSTSLKRRKVGNLKLQTTFSFKHLLSANCGSQEEVEDLFNKRSPMVLSKKPKQMFSPTSSDQLDLAALMIQKVYKSYRIRRNLADCAVVCEELWWKDSMITAFNRCSISSFDSDKSEKAISKWTLARKMAAKVGKDLSKDDKAQKLALRHWLEAIDPRHRYGHNLHFYYLVWFHSQSCQPFFYWLDVGGGKELNLEECPTEQLQRQRIKYLGPCNGCINDNMSYLTLEEREAYEVIVEGGRLVYRQSRDLVHTTEDSKWIFVLSTSRILYVGQKKKGQFQHSSFLAGGATIASGRLVAQNGVLHAIWPYSGHYRPTEKNFMEFISFLEEHKVDMTNVKRDPIDEDVPPSNPVNEEPLFEYMEGNVGASDSANNCGKDVEENKPMSSKWTTGVGPRIGCLRVSSKFPSSGI

SEQ ID NO: 161187 - protein, 183 aa, Glycine max
  Coding DNA Sequence Number=SeqID_44409
  Homolog annotation: Hit_ID=Q1PEY6; Match level="QueryCoverage=36%, HitCoverage=39%, E-value=3e-08, Identity=44%"; Hit description =Allergen-like
PKAAPGPGPVSSPSNTVEPEKGLMEEAYYYRGVSKIGSSPPSCEHKCYGCTPCEAIQVPSTSSRRSHLGLQYTNYEPESWKCKCGPSLYSPENSVYTLCYPAVKFFDSAWDDFARYRLLRVSCGSEGKRVPVKDFSDDWPTNSSKIAFEKFVFITLLLRNNVDKREALENLDLILLCLDEIVG

SEQ ID NO: 161188 - protein, 108 aa, Glycine max
  Coding DNA Sequence Number=SeqID_44410
MQNNDRASESHAAHTGEYAASTSTNWYNFSSNIPYLLIQSKGNQYNSSHNCTPYPTTKKRLILSKRVYSTRTRGRSGPLQSLALKLGRFKVRAVIVDDIASEESNRKR

SEQ ID NO: 161189 - protein, 120 aa, Glycine max
  Coding DNA Sequence Number=SeqID_44411
MSLLNQFILVVATSQVNFCLKLQFSSLNEYNERVIALYNKRTCSIYIAHSKKQQQQLAAQTLPNWWDELKQNALQFQPSYISNTHHQAVLHPNPSHTVVQQQLVCTSFSELLLQSSQFLP

SEQ ID NO: 161190 - protein, 265 aa, Glycine max
  Coding DNA Sequence Number=SeqID_44412
  Homolog annotation: Hit_ID=Q6YVH4; Match level="QueryCoverage=32%, HitCoverage=22%, E-value=6e-16, Identity=50%"; Hit description =Putative heterogeneous nuclearribonucleoprotein A2
  Pfam annotation: Domain name=RRM_1; Domain location=4-61; Score=22.9; E_value=0.0011; Accession=PF00076.12; Description=RNA recognition motif. (a.k.a. RRM, R
ATGVWLTNAPYGNVIECQIMLDHNTGRSRGFGFVTFDDEDSVEKVFSGGKVHEIGGKQSYDGFGNGMDGYGGNSSRNRNHGKRGGQYTDSEMSGAFGHFDGNFEGSVATVYGGYGFGYGGPMYCFGGYGLNSYGNPGGYGGGISSYEDSGGYDSGKVAKKDDGPTYNHPYWKVTSMRCQCHQAWQKKKRKMTRVSKLVNRVLDKYEKLPASLKDHINLEEMLGMKMKRSVETQNTTSCGPQHPINEKLERFKVRPVFPYEEDNKN

SEQ ID NO: 161191 - protein, 290 aa, Glycine max
  Coding DNA Sequence Number=SeqID_44413
  Homolog annotation: Hit_ID=Q2HVD3; Match level="QueryCoverage=81%, HitCoverage=78%, E-value=1e-65, Identity=52%"; Hit description =SMAD/FHA
MEVEVHGEDGSKFALGRDQKTVFGRGCGFSTHDRTVSRRHVSFELDHSHSEDANARVSFQVMGKNPFWVYDGEALRLFRKFDKGHLQLGHRFCFSPNTPLWFTLTNIQPLPQLNLDEIHVSEIDPVKEFGFLVMGHEFDHYPKGMIRNAKNWDWFLEERRKDSEDEEDVEKQRRKMRGKRKMGKVNEDDEWTGESEDDKGLVANMRKGKLPRYSTRSKDSKGGIKDTKASKNSKQKKATSGDDTGEEEDDDDDDETLGGFIVADEGDDKEEENDDEEEEEFEDDDDELDD

SEQ ID NO: 161192 - protein, 79 aa, Glycine max
  Coding DNA Sequence Number=SeqID_44414
MLVKMHLHDCTNTLTEVNSLQGSFGVVVDLATIEWLLGSSNCRPSGMFYCHSSWFDDVRDREGLHVTVWICSIETDINT

SEQ ID NO: 161193 - protein, 66 aa, Glycine max
  Coding DNA Sequence Number=SeqID_44415
  Subcellular localization annotation: CTP_CleavageSite=36; ConfidenceScore=5.04e-01
MTTLACGNLNKLNSEALHVKFKPTSLSDFCNNRQVRLNLTSAIKIASSRYKICTTQGPSGNKGSRS

SEQ ID NO: 161194 - protein, 113 aa, Glycine max
  Coding DNA Sequence Number=SeqID_44416
  Gene Ontology: Biological process=defense response
  Homolog annotation: Hit_ID=Q9ZUL7; Match level="QueryCoverage=42%, HitCoverage=63%, E-value=2e-16, Identity=73%"; Hit description =Probable low-molecular-weight cysteine-rich protein LCR68 precursor
MLSNLGLRYSFGKFQVWVVYVISYGQGTIWAFLHVAHSPCFSGKLGTVSKRAIDLKGCASVSTTALRLAILKASQVASVGDFADAVSAPSTVSWLHAILRTSGCSFTIMFQGL

SEQ ID NO: 161195 - protein, 42 aa, Glycine max
  Coding DNA Sequence Number=SeqID_44417
MVGHLNTGHTFHTEGHAIHRKGHSLELINGTFATMLTAQGGI

SEQ ID NO: 161196 - protein, 96 aa, Glycine max
  Coding DNA Sequence Number=SeqID_44418
MEDKGRVKKLKERVERTWANELIVENGKKLNALHTCSMTQGSICMTKVDAHPYLPQQPYQLSNMDLTTSMDFDKTTKKIVFYDSPSNTVLKNCLRM

SEQ ID NO: 161197 - protein, 101 aa, Glycine max
  Coding DNA Sequence Number=SeqID_44419
MGIEEEEEWIEEEKGIMDIERGFPISEILRLWIYSLESSKSRAEGYFDVRRRGTEVPQELARDIIAQPKSTFRCANMEELKHEANIGGVGAAAVVDLVGQV

SEQ ID NO: 161198 - protein, 82 aa, Glycine max
  Coding DNA Sequence Number=SeqID_44420
MEKLKDLIKQVAPTGVPPNGIHISQLIRRLFFRQPGHSKYSENLIEYDITELKNDEDVLKEEGKSGQNPTSVKLLKVVYFGN

SEQ ID NO: 161199 - protein, 88 aa, Glycine max
  Coding DNA Sequence Number=SeqID_44421
  Gene Ontology: Mol. function=N-acetyltransferase activity; Cellular component=intracellular; Biological process=metabolic process
  Homolog annotation: Hit_ID=Q6DA69; Match level="QueryCoverage=98%, HitCoverage=52%, E-value=5e-23, Identity=64%"; Hit description =Putative acetyltransferase
MMTTATPLNLQVRPIIAADNPRIAQVIRDVSAEFGLTADKGYTVSDPQLDRLFELYSAADSAYWIVEHEGQVVGGGGVAPLACSAPDI

SEQ ID NO: 161200 - protein, 99 aa, Glycine max
  Coding DNA Sequence Number=SeqID_44422
  Gene Ontology: Mol. function=DNA-directed DNA polymerase activity; Biological process=DNA replication
  Homolog annotation: Hit_ID=Q6DA53; Match level="QueryCoverage=94%, HitCoverage=75%, E-value=5e-38, Identity=88%"; Hit description=DNA polymerase III, chi subunit
  Subcellular localization annotation: CTP_CleavageSite=61; ConfidenceScore=5.10e-01
MSFAAGVASPYSIGNQRCDTLYSGRAPVVSGILHKQADQQIARRTAASLRPGQLNRRAVARAFAGQVVRHKGVGRTLPQCFIQPIGLLFIFAGNQDALT

SEQ ID NO: 161201 - protein, 348 aa, Glycine max
  Coding DNA Sequence Number=SeqID_44423
  Gene Ontology: Mol. function=protein binding; Cellular component =nucleus; Biological process=nucleosome assembly
  Homolog annotation: Hit_ID=Q2HVE3; Match level="QueryCoverage=87%, HitCoverage=83%, E-value=2e-95, Identity=58%"; Hit description =Nucleosome assembly protein
  Pfam annotation: Domain name=NAP; Domain location=43-283; Score =409.5; E_value=4.8e-120; Accession=PF00956.9; Description=Nucleosome assembly protein (NAP)
MVELSIYLNPYLLEPHKKWEALAWPMFCAVITYHEEAGESAESQHDEVEAKFLEERSKLEAKYQKLYEPLYTKRYEIVNGVVEVEGVTNVAVPEEANKAAEDKGVPEFWLTAMKTNEALAEEVVEFITERDEGSLKYLKDIKWCRIDDPKGFKLEFYFDSNPYFKNSVLTKTYHMIEDDDPILEKAIGTEIEWHPGKCLTQKILKKKPSKGSKNAKPITKTEKCESFFNFFNPPQVPEDDDDIDDDAVEELENLMEHDYDIGSTIRDKIIPHAVSWFTGEAAQSDFEDIDEDDYEDEEGDDDDDEDEDEDEDEEDEEEKKGKSKSKSGGRAIPGKDQPMERPPECKQQ

SEQ ID NO: 161202 - protein, 1158 aa, Glycine max
  Coding DNA Sequence Number=SeqID_44424
  Gene Ontology: Mol. function=protein binding; Cellular component =membrane; Biological process=defense response
  Homolog annotation: Hit_ID=Q2HVE0; Match level="QueryCoverage=86%, HitCoverage=99%, E-value=0.0, Identity=76%"; Hit description=Disease resistance protein; AAA ATPase
  Pfam annotation: Domain name=LRR_1; Domain location=1052-1069; Score =1.4; E_value=1.5e+02; Accession=PF00560.23; Description=Leucine Rich Repeat
  Pfam annotation: Domain name=LRR_1; Domain location=609-630; Score =4.5; E_value=42; Accession=PF00560.23; Description=Leucine Rich Repeat
  Pfam annotation: Domain name=LRR_1; Domain location=632-653; Score =6.4; E_value=18; Accession=PF00560.23; Description=Leucine Rich Repeat
  Pfam annotation: Domain name=LRR_1; Domain location=655-677; Score =9.5; E_value=4.7; Accession=PF00560.23; Description=Leucine Rich Repeat
  Pfam annotation: Domain name=LRR_1; Domain location=679-700; Score =3.7; E_value=58; Accession=PF00560.23; Description=Leucine Rich Repeat
  Pfam annotation: Domain name=LRR_1; Domain location=702-721; Score =2.5; E_value=99; Accession=PF00560.23; Description=Leucine Rich Repeat
  Pfam annotation: Domain name=LRR_1; Domain location=723-744; Score =4.0; E_value=51; Accession=PF00560.23; Description=Leucine Rich Repeat
  Pfam annotation: Domain name=LRR_1; Domain location=746-768; Score =13.1; E_value=1; Accession=PF00560.23; Description=Leucine Rich Repeat
  Pfam annotation: Domain name=LRR_1; Domain location=770-794; Score =5.0; E_value=34; Accession=PF00560.23; Description=Leucine Rich Repeat
  Pfam annotation: Domain name=LRR_1; Domain location=796-818; Score =11.0; E_value=2.5; Accession=PF00560.23; Description=Leucine Rich Repeat
  Pfam annotation: Domain name=LRR_1; Domain location=820-841; Score =8.7; E_value=6.8; Accession=PF00560.23; Description=Leucine Rich Repeat
  Pfam annotation: Domain name=LRR_1; Domain location=843-864; Score =13.1; E_value=1; Accession=PF00560.23; Description=Leucine Rich Repeat
  Pfam annotation: Domain name=LRR_3; Domain location=609-628; Score =32.3; E_value=1.7e-06; Accession=PF07725.3; Description=Leucine Rich Repeat
  Pfam annotation: Domain name=NB-ARC; Domain location=176-464; Score =149.3; E_value=1e-41; Accession=PF00931.13; Description=NB-ARC domain
  Pfam annotation: Domain name=TIR; Domain location=16-147; Score =175.6; E_value=1.3e-49; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_3::NB- ARC::TIR; Domain location=1052-1069::609-630::632-653::655-677::679 -700::702-721::...
  Pfam module annotation: Domain location=723-744::746-768::770 -794::796-818::820-841::843-864::609-628::176-464::16-147
METSSSSQDPRIKYDVFISFRGTDVRCGFLSHLKKELRQKQVDAFVDDRLEGGDEISHSLDKAIEGSLISLVIFSKDYASSKWCLEEVVKIIECMHSNKQIVIPVFYNVDPSDVRHQKGTYGDAFAKHEKNKRNLAKVPNWRCALNIAANLSGFHSSKFVDEVELIEEIAKCLSSKLNLMYQSELTELVGIEERIADLESLLCLGSTIVGVRVIGIWGMGGIGKTTIAAAVYNRLYFEYEGCCFMANITEESEKHGMIYVKNKIISILLKENDLQIGTPNGVPPYVKRRLIRKKVLVVLDDINDSEQLENLVGALDWFGSGSRIIVTTRDKGVLGKKADIVYEAKALNSDEAIKLFMLNAFKQSCLEMEWIELSRRVIQYANGNPLALKVLGSFLYGKSQIEWESQLQKLKKMPQVKIQNVLRLTYDRLDREEKNIFLYIACFFKGYEVRRIIYLLDACGFSTIIGLRVLKDKALIIEAKGSGISIVSMHDLIQEMGWEIVREECIEDPGKRTRLWDPNDIHLVLKNNTGTKAIKSITFNVSKFDEVCLSPQIFERMQQLKFLNFTQHYGDEQILYLPKGLESLPNDLRLFHWVSYPLKSLPLSFCAENLVELKLPWSRVEKLWDGIQNLEHLKKIDLSYSKNLLELPDFSKASNLEEVELYSCKNLRNVHPSILSLKKLVRLNLFYCKALTSLRSDSHLRSLRDLFLGGCSRLKEFSVTSENMKDLILTSTAINELPSSIGSLRKLETLTLDHCKSLSNLPNKVANLRSLRRLHIYGCTQLDASNLHILVNGLKSLETLKLEECRNLFEIPDNINLLSSLRELLLKGTDIESVSASIKHLSKLEKLDLSDCRRLYSLPELPQSIKELYAINCSSLETVMFTLSAVEMLHAYKLHTTFQNCVKLDQHSLSAIGVNAYVNIKKVAYDQFSTIGTNSIKFLGGPVDFIYPGSEVPEWFVYRTTQASVTVDLSSSVPCSKIMGFIFCVIVDQFTSNDKNYIGCDCYMETGVGERVTRGHMDNWSSIHACEFFSDHVCLWYDEKCCLKNQECESESMEELMASYNPKISFEFFAKTGSIWEKRSDIIIKGCGVCPIYDTECDNFFKQMELELEITLQSMATKMSSKEATLSPKQESKKLIFPPHQIGTWKNATQGLKDILFL

SEQ ID NO: 161203 - protein, 557 aa, Glycine max
  Coding DNA Sequence Number=SeqID_44425
  Gene Ontology: Mol. function=transporter activity; Cellular component= integral to membrane; Biological process=transport
  Homolog annotation: Hit_ID=Q2Q0V7; Match level="QueryCoverage=96%, HitCoverage=97%, E-value=1e-136, Identity=60%"; Hit description =Patellin 1
  Pfam annotation: Domain name=CRAL_TRIO; Domain location=282-469; Score=87.9; E_value=3.2e-23; Accession=PF00650.10; Description =CRALTRIO domain
  Pfam annotation: Domain name=CRAL_TRIO_N; Domain location=86-270; Score=35.7; E_value=1.6e-07; Accession=PF03765.5; Description =CRALTRIO, N-terminus
  Pfam annotation: Domain name=EMP24_GP25L; Domain location=471-552; Score=53.4; E_value=7.5e-13; Accession=PF01105.14; Description =emp24gp25Lp24 family
  Pfam module annotation: Pfam domain module=CRAL_TRIO::CRAL_TRIO _N::EMP24_GP25L; Domain location=282-469::86-270::471-552
MAEEVPKTSTTQEEVVVSDVAPAEKPDTTNVVVVPLEKDAQPQQNEEETSPEKKKENVTETETESEVSKPSGDGNVPESGSFKEESTIVSDLPETEKKALQELKQLIQEALNKHEFSAVPTSNPPKDEKPDNKEEQNPAEEEEKQQVFDAAADVAEATEKEAAEVKVTETEVDEEKVAVSASSADEDGAKTVEAIEESVVSVTVSEEAKVEAVSASPEEVSIWGVPLLADERSDVILLKFLRARDFKVKEAFAMIKGTIRWRKEFKMEELLLEDLGDDLEKAVYMHGFDKEGHPVCYNIYGEFQNKELYKKSFSDEEKRYRFLRWRIQFLEKSIRKLDFNPGGISTIVQVNDLKNSPGPAKWELRQATKQALQLLQDNYPEFVAKQVFINVPWWYLAVNRMISPFLTQRTKSKFVFAGPSKSAETLLRYIAAEQLPVKYGGLSKDGEFGISDAVTEITVRPAAKHTVEFPVTENSLLSWELRVIGWDVSYGAEFVPTSEGSYTVIIQKARKVASSEEPVLCNNYKIGEPGKVVLTIDNQSSKKKKLLYRLKVKPSSD

SEQ ID NO: 161204 - protein, 205 aa, Glycine max
  Coding DNA Sequence Number=SeqID_44426
DPPLPPPLQAIAATEHPVTHQHQFLLLFHLPDHQPCFLSMTNVSGITHNSAIASFLTLIKVFLLRELLLMTVNMLIQVMMLEKWSGMTMLTSINLAHASEEDLILLWAFQIGRQIDMAHLVQYRIHKASRANAPLPYPHLVTFFLQYFNVPLDDEPFVKVKHSFAIGAGDVTSFGYRKDMDSQWVRKQDLPPPILDDIGKTWIVS

SEQ ID NO: 161205 - protein, 459 aa, Glycine max
  Coding DNA Sequence Number=SeqID_44427
  Gene Ontology: Mol. function=nucleic acid binding; Cellular component= intracellular; Biological process=chromatin modification
  Homolog annotation: Hit_ID=Q2HVE6; Match level="QueryCoverage=85%, HitCoverage=83%, E-value=1e-101, Identity=51%"; Hit description=Zinc finger, C2H2-type
  Pfam annotation: Domain name=RS4NT; Domain location=139-176; Score =17.9; E_value=0.015; Accession=PF08071.2; Description=RS4NT (NUC023) domain
  Pfam annotation: Domain name=zf-C2H2; Domain location=154-176; Score =20.5; E_value=0.0061; Accession=PF00096.16; Description=Zinc finger, C2H2 type
  Pfam annotation: Domain name=zf-C2H2; Domain location=181-202; Score =15.8; E_value=0.16; Accession=PF00096.16; Description=Zinc finger, C2H2 type
  Pfam annotation: Domain name=zf-C2H2; Domain location=77-99; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=139-176::154-176::181-202::77-99
TVLKQQSSLAIVDSMEFVESNPLFQNPKSMSYFVLLLQLGVGLAFGGLICKDKSEKSLLPLVVRRWSPKTLLATNRFICEICNKGFQRDQNLQLHRRGHNLPWKLKQRSSNEIIRKKVYVCPEASCVHHDPSRALGDLTGIKKHFCRKHGEKKWKCDKCSKKYAVQSDWKAHSKTCGTREYRCDCGTLFSRRDSFITHRAFCDALAEESSRSVTGIGIVANSTSTQPTAAAASHQQDIIHGNSNNFSLKKEQQAGFRPPWIGQPSPSSASSFLVSHQENPNPRGGGPGPTLLPPYQTAPHMSATALLQKASQMGATMSKTGSMIGTHQQQAHVSANAALNLSSRDHQMTPTLHGLVPFGNKAVPAVGNGVSPSLLHHIIDSFSSPFEGTSFEDTFGGAGGDAMTKTTTADDGARGNNNEALTRDFLGLRPLSHTDILNIAGMGSCINSSQHNQTPNPWQ

SEQ ID NO: 161206 - protein, 237 aa, Glycine max
  Coding DNA Sequence Number=SeqID_44428
MDPIKLDGIENEAAIILCQLEMYFPPSFFNVMVHLIVHLVREIKCCDFVVDVPEEAIEFYSEYIEKTKPVELPKSRHDKKVKGYDINKYSFYMKTQDDESTMHNSGDPFDERWSVVLHGKTIDVNVEDDDLIIDTCAGPLSTQMSPNIIGEEVDDVHANLGVERPLVHVDPMTRNTDGLHRKKLRTYLGIVSRDKVDVTYENWKQVPITQKDLIWEDIQAEFDILETSDLRMKKKIL

SEQ ID NO: 161207 - protein, 32 aa, Glycine max
  Coding DNA Sequence Number=SeqID_44429
AEISLSETGKVAETANNSELEQDAVVSGTSKS

SEQ ID NO: 161208 - protein, 137 aa, Glycine max
  Coding DNA Sequence Number=SeqID_44430
  Gene Ontology: Mol. function=protein serine/threonine kinase activity; Biological process=protein amino acid phosphorylation
  Homolog annotation: Hit_ID=Q6DXR4; Match level="QueryCoverage=89%, HitCoverage=24%, E-value=3e-14, Identity=46%"; Hit description =Putative serine-threonine kinase
  Pfam annotation: Domain name=NAF; Domain location=74-120; Score=23.3; E_value=2.4e-05; Accession=PF03822.5; Description=NAF domain
MPETWIAIPEIMENKWFKKGFKFYVDDDKLCNVVGDDYDTTSIAFVASFSDYSVSESDSEVETRRRNNNAPLPRPPSLNAFDIISFSPGFDLLGLFEEKRGETRFVATGIGYHYYFQVGGDCSVACFSALVGDSLVP

SEQ ID NO: 161209 - protein, 98 aa, Glycine max
  Coding DNA Sequence Number=SeqID_44431
  Gene Ontology: Mol. function=beta-galactosidase activity; Cellular component=beta-galactosidase complex; Biological process =carbohydrate metabolic process
  Homolog annotation: Hit_ID=Q2HVE7; Match level="QueryCoverage=67%, HitCoverage=44%, E-value=1e-28, Identity=88%"; Hit description =Glycoside hydrolase, family 35
MGQCPYAEIQQVEATCEHAFVVSAWMIKSFGEYWEDRLLKAKALGLNTIQTYVPWNLHEPAPGNLVFEGFANIEAFLNLCHKLGLLVMIRLRPYICAG

SEQ ID NO: 161210 - protein, 251 aa, Glycine max
  Coding DNA Sequence Number=SeqID_44432
  Homolog annotation: Hit_ID=Q1SX88; Match level="QueryCoverage=93%, HitCoverage=98%, E-value=3e-32, Identity=35%"; Hit description=Heavy metal transport/detoxification protein; Harpin-induced 1
MVHFQILNRTSTSHLALEVDAVAGFLPEGRVTLIPSQETLIPTFGVFKFPILAFTLVSKFTLSGNPFVALERVAGAEDGGFDERGVLLRVLEAGDGSVADVDVAGEDGDGGGVVGEEDLLVGVRGGDGDVKAGVQGVGGGGEVQVGEFQRRDGEGGVVRAVEEVEHRAGDADQEEEDQHGEDQPEEEGAAAPSPAPAPVVGLRAVGGAGGAVKLSLRRRERWVGGAAVNHGGLGGWVHPVCHGCVELLFFV

SEQ ID NO: 161211 - protein, 184 aa, Glycine max
  Coding DNA Sequence Number=SeqID_44433
MDMNLGYLISHQISIIAQHDSSRLGFLALIIALCKARGVTSDSRSLESLSPTINLAYIKKNCLNLDDPTMAFRGPREAKGKRSEAPPTSAAPDTFAHSLSTLPNPSTPSTSTLHLPQLPASSPTPLLAPSIPAPPTGPSSFTSETLFAMLQNLHRGVQPSLSRGGEVSAAQELVPAEQLSLSLS

SEQ ID NO: 161212 - protein, 116 aa, Glycine max
  Coding DNA Sequence Number=SeqID_44434
  Subcellular localization annotation: CTP_CleavageSite=48; ConfidenceScore=5.03e-01
MVNRQNSLVKDGSNHNNSKKRRLANSKSYIGNHAILMDSGSLFYTATRAFKFHSLSLGFISIYIFESGTTSDLRIIDAPFHDQLYFAVANQPCLLDVRIDAMYTKPSNQSNFICRH

SEQ ID NO: 161213 - protein, 106 aa, Glycine max
  Coding DNA Sequence Number=SeqID_44435
MGETHEIPHHNLADFEPWLGYATKGQAVGGIPFENTLESPQFRPQPQPLHFAVGRAPPAMAEKGKVDHLKERLRAIEGGEDYAFANLEELFLIPKHGHSQVQGARI

SEQ ID NO: 161214 - protein, 148 aa, Glycine max
  Coding DNA Sequence Number=SeqID_44436
MRCPCTRDHHHNTVIGKTKKEQVGEQTPETKAKDVTDPDDDSDSLAIIVIDDVETRVEEKKVVNTKKRKSQEKQGKTEEMAWEPKHVKKRGRGRSRKRKNMAQGINGKTRLQELGDANTQQNKLQQLTMRGSEDNIFFKRSLLEIHYV

SEQ ID NO: 161215 - protein, 101 aa, Glycine max
  Coding DNA Sequence Number=SeqID_44437
MGAESESGNVRSFEEKRENWEWKERRKTLTFVRMRLLRMDCVCWGEIKARFSPISASAKKSFGSKGGGGVANIVDNNTLEVLNTPFKHEEVKELVLQTVLG

SEQ ID NO: 161216 - protein, 95 aa, Glycine max
  Coding DNA Sequence Number=SeqID_44438
MSQHIQCGMLKTSAAVRPLHNPTTLIKQIQNLQTIHRKHFQRMEAESESENGGLRVRCLEEKTENWEWKERQKTLTLLAVTFCYDYALWQLASLT

SEQ ID NO: 161217 - protein, 462 aa, Glycine max
  Coding DNA Sequence Number=SeqID_44439
  Gene Ontology: Mol. function=oxidoreductase activity, acting on CH-OH group of donors; Cellular component=outer membrane-bounded periplasmic space; Biological process=alcohol metabolic process
  Homolog annotation: Hit_ID=Q9S746; Match level="QueryCoverage=93%, HitCoverage=70%, E-value=1e-164, Identity=66%"; Hit description =Protein HOTHEAD precursor
  Pfam annotation: Domain name=GMC_oxred_C; Domain location=282-437; Score=85.0; E_value=2.3e-22; Accession=PF05199.4; Description=GMC oxidoreductase
  Pfam annotation: Domain name=GMC_oxred_N; Domain location=28-210; Score=-68.2; E_value=0.0011; Accession=PF00732.10; Description=GMC oxidoreductase
  Pfam module annotation: Pfam domain module=GMC_oxred_C::GMC_oxred_N; Domain location=282-437::28-210
VGWDTKLVNESYPWVEKQIVHRPKFSDWQRAVRDGLLAAGVSPFNGFTYDHKYGTKVGGTIFDRFGRRHTAAELLASANPHKLTVLIHATVQNIVFDTTGPYKWVTITYMSENGDAIVAGKRPKATGVIFKDENGKQHEAYLGNDRQSEVIVSSGALGTPQLLLLSGIGPKAELQKLNIPVVLDNQFVGKGMADNPMNTIFVPSKRSVQQSLIETVGITNLGVYIETSSGFGQSKDSIHCHHGILSAELSTIPPKQRSQEAVKAYVKSKRDIPVEAFRGGFILSKVANPWSTGELKLKNTNVEDNPAVTFNYFSHPYDLRRCVEGIRLAIKVVQSEHVTNYTLCERETAEKMLNLSVKANINLIPKRPNDTKSVEQFCRDSVITIWHYHGGCHVGKVVNSEHKVLGVDRLRVVDGSTFSESPGTNPQATVMMMGSPIAKDAQALSFQLVPSSRFSDEFPVAG

SEQ ID NO: 161218 - protein, 396 aa, Glycine max
  Coding DNA Sequence Number=SeqID_44440
  Gene Ontology: Mol. function=sequence-specific DNA binding; Cellular component=nucleus; Biological process=regulation of transcription
  Homolog annotation: Hit_ID=Q5IY47; Match level="QueryCoverage=96%, HitCoverage=90%, E-value=2e-91, Identity=47%"; Hit description=DNA binding protein WRKY2
  Pfam annotation: Domain name=WRKY; Domain location=224-282; Score =129.5; E_value=9.2e-36; Accession=PF03106.6; Description=WRKY DNA -binding domain
MVDGGKGEGGGEQASPPSTAARHGTTLRPRASVESVFSGGYSPGPMALLSNFYGDGDECKSFSELLAGAMVDPTAPSPMPTTTFALPPGFIDSPSQVITHNLICYILYQQQHITKRDHGIPLGKIFIMLEISTIRKTRLNSVFAIEEGQFGITHQQMLAQISSQAVQTHSEHPFSISAVSATSSCAAQQLIPPSMPDSKVKESLDYSHSEQKLQSSVNVDNKPNNDGYNWRKYGQKHVKGSDFSRSYYKCTRPNCPVKKKLERSLEGHVTAIIYKGEHNHQRPHRSKIVKETQTSNENSVSKMDLGSSQATGEHGSGTSDSEEVDDHETEADEKNDEPDAKRRNTEARIQDPATLHRSVAEPRIIVQTTSEVNLLDDGYRWRKYGQKVVKGNPYPR

SEQ ID NO: 161219 - protein, 158 aa, Glycine max
  Coding DNA Sequence Number=SeqID_44441
MVARLTPDQKVACSIHVRGIEELVELSKQVDPPTHLSNPNSNLLTKQHNTSYKQTHLIKTSTHSATLYLRHLKPLALHRQLDALVLSLLSPHTCRPRLDPLTHSLSVTQLELNTSRDQASTHSRRESRLKTHSLPRLQPTLCREHATHSRYTLCHSLM

SEQ ID NO: 161220 - protein, 198 aa, Glycine max
  Coding DNA Sequence Number=SeqID_44442
  Gene Ontology: Cellular component=nucleus; Biological process =regulation of transcription, DNA-dependent
  Homolog annotation: Hit_ID=O22607; Match level="QueryCoverage=74%, HitCoverage=31%, E-value=9e-56, Identity=70%"; Hit description=WD-40 repeat protein MSI4
  Subcellular localization annotation: CTP_CleavageSite=80; ConfidenceScore=5.27e-01
MGRRQREWKCLVLAGSLLGFLGQMGSSARASHFQEPSPSLSFRTGRSLTTFPFLSFQILLTLFLSSQTDGSVPNTLVKPRVAAEFNEEARSPFFKKYKTVLHPGEVNRIREFQQNSKIVATHTDCPEVLIWDVETQPNRHAVLGATTSRPDLVLTGHKDNAEFALAMCPTEPFILSGGDDSRLILWDARLGSAPVVKV

SEQ ID NO: 161221 - protein, 660 aa, Glycine max
  Coding DNA Sequence Number=SeqID_44443
  Gene Ontology: Mol. function=nucleotide binding; Cellular component =cytoplasm; Biological process=membrane organization and biogenesis
  Homolog annotation: Hit_ID=P93042; Match level="QueryCoverage=99%, HitCoverage=83%, E-value=0.0, Identity=65%"; Hit description=Root hair defective 3
  Pfam annotation: Domain name=RHD3; Domain location=46-659; Score =872.7; E_value=1.7e-259; Accession=PF05879.3; Description=Root hair defective 3 GTP-binding protein (RHD3)
  Pfam annotation: Domain name=TACC; Domain location=258-461; Score= -69.1; E_value=0.078; Accession=PF05010.4; Description=Transforming acidic coiled-coil-containing protein (TACC)
  Pfam module annotation: Pfam domain module=RHD3::TACC; Domain location=46-659::258-461
MANNEKCCSTQLIDGDGAFNVAGIENFMKEVKLSECGLSYAVVSIMGPQSSGKSTLLNSLFCTNFTEMDAFKGRHVSTTPIHSLQQSNLAITINKDDTTFEKQSALFALAISDIVLINMWCHDIGREQAANKPLLKTVFQVMMRLFSPRKTTMLFVIRDKTKTPLENLEPVLREDIQKIWDSVPKPDAHKETPLSEFFIVEVVALSSFEEKEEQFKEQVANLRQRFYHSIAPGGLAGDRRGVVPASGFSFSAQEIWKIIKENKDLDLPAHKVMVATVRCEEIANEKYDLFATNKDWCELEEAVQSGPISEFGKKLNSLLIACLSEYDAEANYFDEGVRSAKQKQLQEKLFQLVQPTFQIVLGHMRSGILDKFKEAFDKALNGGEGFSSAANKCIEIYMAQFDEGCADVVIEIANWDTSKVREKLQRDIDAHVASVRASKMSELVSSYEEKLKEALSAPVETLLDAANSDTWPSIRKLLNHETQSAVSGFCVELIRFDVDEQTKKSMIVSLDDYAKGVIEAKAREEAGRVLIRMKDRFLTLFSHDSDSMPRIWTGKEDVRAITKSARSSCLKLLSVMAVIRLDDGDDIYNIEKTLIVALADSSSSSAKDKSMTAVKPLASSTWDQVPPSKTLITPVQCKSLWRQFKMETEYCVSQAISAQA

SEQ ID NO: 161222 - protein, 187 aa, Glycine max
  Coding DNA Sequence Number=SeqID_44444
  Gene Ontology: Mol. function=histone acetyltransferase activity; Cellular component=nucleus; Biological process=regulation of transcription, DNA-dependent
  Homolog annotation: Hit_ID=Q52ZH8; Match level="QueryCoverage=98%, HitCoverage=27%, E-value=2e-53, Identity=57%"; Hit description=FVE
MFDRRNLTSGGVGSPIYKFEGHDAAVLCTVLGIVIECLLTYNFDLFQWSPDKPSVFGSTAEDGILNIWDHDKVGKTTDSASSKASNTPPGLFFRHAGHRDKVVDFHWNASDPWTIVSVSDDCESSGGGGTLQEIVKCRRYENILICIIGFGHYCAYMADDRDIIYRPEEEVLTELDKFRSHIFGCNS

SEQ ID NO: 161223 - protein, 283 aa, Glycine max
  Coding DNA Sequence Number=SeqID_44445
MEPPPSYSYSPFPFSLERHTQIQMHDPILFFLFFASLSSLLFLSFSLFKRFSTKKEHHHHTQKVPSLLGEEQRPKKKRKKPKKKRTQGDDAANSGSGSDSGLRLESTCQYPFTSSSSVMQRKIKQQYDELVRCNHLKKLTLPQGYGVLHLTQGCVVFVSVSGVVQFANSLVDARNELQHKADVIQRKFVITKALLCKADRSSFDRLHQQIYKLELEQKRLEEDVFVYNSLQQQLKLSPAYQKMLELGACMEKEKSSELGENRDDDFAEISFEELLAQEKKDSF

SEQ ID NO: 161224 - protein, 712 aa, Glycine max
  Coding DNA Sequence Number=SeqID_44446
  Gene Ontology: Mol. function=hydrolase activity, acting on glycosyl bonds; Cellular component=beta-galactosidase complex; Biological process=carbohydrate metabolic process
  Homolog annotation: Hit_ID=O65761; Match level="QueryCoverage=99%, HitCoverage=98%, E-value=0.0, Identity=83%"; Hit description=Beta -galactosidase
  Pfam annotation: Domain name=Gal_Lectin; Domain location=634-711; Score=176.8; E_value=5.2e-50; Accession=PF02140.8; Description =Galactose binding lectin domain
  Pfam annotation: Domain name=Glyco_hydro_2_N; Domain location=308 -446; Score=-58.7; E_value=0.062; Accession=PF02837.8; Description =Glycosyl hydrolases family 2, sugar binding domain
  Pfam annotation: Domain name=Glyco_hydro_35; Domain location=1-213; Score=168.8; E_value=1.4e-47; Accession=PF01301.10; Description =Glycosyl hydrolases family 35
  Pfam module annotation: Pfam domain module=Gal_Lectin::Glyco_hydro_2 _N::Glyco_hydro_35; Domain location=634-711::308-446::1-213
MKHQMQKFTTKIVDLMKAERLYESQGGPIIMSQLTRVGMSTKTVIFTTGVFVQIENEYGPMEYEIGAAGKAYTKWAAEMAMGLGTGVPWVMCKQDDTPDPLINTCNGFYCDYFSPNKAYKPKMWTEAWTGWFTEFGGPVPHRPAEDLAFSVARFIQKGGSFINYYMYHGGTNFGRTAGGPFIATSYDYDAPLDEYGLLRQPKWGHLKDLHRAIKLCEPALVSGDPTVTKIGNYQEAHVFKSKSGACAAFLANYNPKSYATVAFGNMHYNLPPWSISILPDCKNTVYNTARVGSQSAQMKMTRVPIHGGFSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRAGVNKISLLSVAVGLPNVGPHFETWNAGVLGPISLSGLNEGRRDLSWQKWSYKVGLKGEILSLHSLSGSSSVEWIQGSLVSQRQPLTWYKTTFDAPAGTAPLALDMDSMGKGQVWLNGQNLGRYWPAYKASGTCDYCDYAGTYNENKCRSNCGEASQRWYHVPQSWLKPTGNLLVVFEELGGDPNGIFLVRRDIDSVCADIYEWQPNLISYQMQTSGKAPVRPKVHLSCSPGQKISSIKFASFGTPAGSCGNFHEGSCHAHKSYDAFERNCVGQNWCTVTVSPENFGGDPCPNVLKKLSVEAICS

SEQ ID NO: 161225 - protein, 80 aa, Glycine max
  Coding DNA Sequence Number=SeqID_44447
MKLTAMRNHREPPRNLTAAFALRSLCCWVTRLEDRPSPSTVNGDGTVYMASADGRIKVWRTEGEAKGHKFDGGGGAVGRW

SEQ ID NO: 161226 - protein, 162 aa, Glycine max
  Coding DNA Sequence Number=SeqID_44448
  Gene Ontology: Mol. function=hydrolase activity, acting on glycosyl bonds; Cellular component=beta-galactosidase complex; Biological process=carbohydrate metabolic process
  Homolog annotation: Hit_ID=Q93X58; Match level="QueryCoverage=90%, HitCoverage=17%, E-value=5e-72, Identity=84%"; Hit description=Beta -galactosidase
  Pfam annotation: Domain name=Glyco_hydro_35; Domain location=35-161; Score=1.8; E_value=2.1e-15; Accession=PF01301.10; Description =Glycosyl hydrolases family 35
MVICLKLIIMWNVALLLVFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKVRFQSSLYLKNW

SEQ ID NO: 161227 - protein, 76 aa, Glycine max
  Coding DNA Sequence Number=SeqID_44449
  Homolog annotation: Hit_ID=Q1SXD5; Match level="QueryCoverage=96%, HitCoverage=70%, E-value=2e-30, Identity=77%"; Hit description=Cupin, RmlC-type
  Pfam annotation: Domain name=Cupin_3; Domain location=1-64; Score =81.3; E_value=3e-21; Accession=PF05899.3; Description=Protein of unknown function (DUF861)
WGCPPGKFMLKFDAQETCYLLRGEVKVYPKGSSEFVQFAAGDLVTIPKGISCTWDVSIAVDKHYKFESSSTAPSSE

SEQ ID NO: 161228 - protein, 335 aa, Glycine max
  Coding DNA Sequence Number=SeqID_44450
  Homolog annotation: Hit_ID=Q9FHS9; Match level="QueryCoverage=27%, HitCoverage=49%, E-value=5e-13, Identity=45%"; Hit description =Arabidopsis thaliana genomic DNA, chromosome 5, P1 clone:MNJ8
  Subcellular localization annotation: CTP_CleavageSite=36; ConfidenceScore=5.54e-01
MASASLQFWSSIAPLSHRYTHRFASLTSLKFVTPISSTNTSPTLPNPEPDPQTLLQEIADSFDLPSDYFAKLPRDLRLDLNDAAFHLSSGPVLDECGQELGETLLNLSRAWELADTSTSHSLVKKLPLIEAKLTGSAKSALGKHLVSAGRRFQSMGQYGQGEPQKDVKLLLGPKEELRNHKIAKAVIAAGRALSASSTSAVIVEELKEETRVLKVGNYSVSGIDKVYFGELQVEITPDKANIGAVIGLVFGGWKQGKLNSCFNLEHMILSWEVAQGIQNIPDSSLQYANDNALLLAKSLKGALLAIFYSSTFLSALPRWDLFYLGYSSNQRKIEF

SEQ ID NO: 161229 - protein, 256 aa, Glycine max
  Coding DNA Sequence Number=SeqID_44451
  Gene Ontology: Mol. function=ribonuclease III activity; Biological process=RNA processing
  Homolog annotation: Hit_ID=Q014M6; Match level="QueryCoverage=45%, HitCoverage=13%, E-value=6e-12, Identity=34%"; Hit description =Homology to unknown gene
MEFDYKKIKSTSIKNLRLNLHAWVGVMIQIEISVLRASGDTHQRLPHNPNAHRKIKNNIVATPTPTPTITRKRERDISVFLPRAPPPPPIGHIEEVQDETYLGYEKWLPTPPKVVKPRSVFNAATLAYIGDCIYELYARRHFLFPPLSIEEYNDRVMAVVRCEAQDALLQKLLESNFLSDQERDVLRWGKNIVSSKTKTKKRAGAAVYNRASSLETLVSAFKPWVLSSVDINLAQSSCLILENFLYSSYICLNLKW

SEQ ID NO: 161230 - protein, 83 aa, Glycine max
  Coding DNA Sequence Number=SeqID_44452
MNNINGELKRNTDLIPHENEGRRATQEIDDHKRAEGKRVQGARDLGKEVQGAFDGARGERVQRKRFRGRGSGGARVQQNTVNA

SEQ ID NO: 161231 - protein, 51 aa, Glycine max
  Coding DNA Sequence Number=SeqID_44453
IGTAIEVEDEARAEKNVGRGAEVEIDTGKREGEAGAERDIRIVKEGDRKLG

SEQ ID NO: 161232 - protein, 152 aa, Glycine max
  Coding DNA Sequence Number=SeqID_44454
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=57%, HitCoverage=39%, E-value=4e-10, Identity=41%"; Hit description =Protein ULTRAPETALA1
MTIGDPHQQKTSQGNEKKTEGDNITQGLSKQRKEFRIGDDGKGVEGGRETSGFIAKTKTPLIKYYTHQANVANRKDSAMRKQNIHRDEFPRCKRCGKERRFHLKSTPDIKNYHDALNNKCRTCSLWPYQNWYLVLQNTLYVGKRYSGLTMCQ

SEQ ID NO: 161233 - protein, 135 aa, Glycine max
  Coding DNA Sequence Number=SeqID_44455
  Homolog annotation: Hit_ID=Q1RSD4; Match level="QueryCoverage=41%, HitCoverage=11%, E-value=7e-14, Identity=64%"; Hit description=Zinc finger, RanBP2-type
  Subcellular localization annotation: CTP_CleavageSite=53; ConfidenceScore=5.58e-01
MSSASKLTLYGIGTALFRTRRTAPVSVTPFLFFKPIPLPRPPRFLLLRDSSSSSAAAAEILPSVDHPWPEWVSFVDRLSTKGYLPKPSSSSDDTVSLYTNMNSLKDACLSFSRDRYDLFKFVFLFSPFHAKKYIN

SEQ ID NO: 161234 - protein, 470 aa, Glycine max
  Coding DNA Sequence Number=SeqID_44456
  Homolog annotation: Hit_ID=Q1S600; Match level="QueryCoverage=99%, HitCoverage=98%, E-value=1e-124, Identity=54%"; Hit description=IQ calmodulin-binding region
  Pfam annotation: Domain name=IQ; Domain location=117-137; Score=16.7; E_value=0.085; Accession=PF00612.17; Description=IQ calmodulin -binding motif
  Pfam annotation: Domain name=IQ; Domain location=143-163; Score=4.7; E_value=13; Accession=PF00612.17; Description=IQ calmodulin-binding motif
  Pfam annotation: Domain name=IQ; Domain location=95-115; Score=30.0; E_value=8.2e-06; Accession=PF00612.17; Description=IQ calmodulin -binding motif
  Pfam module annotation: Pfam domain module=IQ::IQ::IQ; Domain location=117-137::143-163::95-115
MGVSGKWIKALVARKKSEKPESLEKDGNKVKASKLHHQGKPAVEFDNGNLPNEFDNDATQPIGDDSGHTNIDAHYSPSTSQQAHDVAHNHQMREEWAAIRIQTAFRGFLARRALRALKGVVRLQALVRGYAVRKQAAITLRCMQALVRVQARVRARHVRIALETQATQQKLKQKLANKVQVRETELPMHPICVQHVFMKEGWCDSIGSIEEIQAKILKRQEAAAKRGRAMAYALAHQWQAGSRQQPVSSGFEPDKSNWGWNWLERWMAVRPWENRFVDINLRDGVIIHENGAKGGQNGTTHQSRPANKKPLSSNPHLYPVSLRTGSILSDGCDSSPTLSKSAGLPESSDTQPVKPNSKANVENSVEETYSKPGIESRSHSNPKERTSQADKQAKKRLSLPNNGFRAKSTDDQSLPRVYIKDEKAWGGPGSQTAKHPIGTSVKGTLSTQKPSRDKRKLNRGKDVNISKSVP

SEQ ID NO: 161235 - protein, 256 aa, Glycine max
  Coding DNA Sequence Number=SeqID_44457
  Gene Ontology: Mol. function=protein serine/threonine kinase activity; Cellular component=nucleus; Biological process=protein amino acid phosphorylation
  Homolog annotation: Hit_ID=Q9LV37; Match level="QueryCoverage=99%, HitCoverage=49%, E-value=3e-92, Identity=69%"; Hit description =Mitogen-activated protein kinase 9
IRNEKARRYLASMQKKQPIPFSKKFPNADPLGLNLLERLLAFDPKDRPAAEEALRDPYFHGLSNVDREPSSTQPISKLEFEFERRKLAKDDVRELIYREILEYHPQMLEEYLRGGEQTSFMYPSGVDRFKRQFAHLEEHYGKGERSTPLLRQHASLPRERVPAPKDENNQNNDVENPTGANHQSPPGSDVTNSGNPDAQNEPSRPNCSARSLLKSASISGSKCIDVKQSKVSEEEPLTGVNDELDELTQKVASLHA

SEQ ID NO: 161236 - protein, 74 aa, Glycine max
  Coding DNA Sequence Number=SeqID_44458
MRKQNIHRDEFPRCKRCGKERRFHLKSTPDIKNYHDALNNKCRTCSLWPYQNWYLVLQNTLYVGKRYSGLTMCQ

SEQ ID NO: 161237 - protein, 228 aa, Glycine max
  Coding DNA Sequence Number=SeqID_44459
  Gene Ontology: Mol. function=protein serine/threonine kinase activity; Cellular component=nucleus; Biological process=protein amino acid phosphorylation
  Homolog annotation: Hit_ID=Q9LV37; Match level="QueryCoverage=97%, HitCoverage=43%, E-value=1e-112, Identity=87%"; Hit description =Mitogen-activated protein kinase 9
  Pfam annotation: Domain name=Pkinase; Domain location=18-227; Score =181.7; E_value=1.8e-51; Accession=PF00069.15; Description=Protein kinase domain
  Pfam annotation: Domain name=Pkinase_Tyr; Domain location=18-224; Score=-18.8; E_value=2.6e-11; Accession=PF07714.7; Description =Protein tyrosine kinase
  Pfam module annotation: Pfam domain module=Pkinase::Pkinase_Tyr; Domain location=18-227::18-224
MGAPVVEFFTEYGEASRFEIHEVIGKGSYGVVCSAVDTQTREKVAIKKINDVFEHVSDATRILREIKLLRLLQHPDIVEIKHIMLPPSRREFRDVYVVFELMESDLHQVIKSNDDLTPEHYQFFLYQLLRGLKFIHTANVFHRDLKPKNILANANCKLKICDFGLARVSFNEAPSAIFWTDYVATRWYRAPELCGSFFSKYTPAIDIWSIGCIFAEMLSGKPLFPGKN

SEQ ID NO: 161238 - protein, 61 aa, Glycine max
  Coding DNA Sequence Number=SeqID_44460
MFIRSKDKPADVKDVINYDFPGSLEDYVHRSWCLRNCIHILHRRRGCIIISFICLAECARA

SEQ ID NO: 161239 - protein, 145 aa, Glycine max
  Coding DNA Sequence Number=SeqID_44461
MGPTPPPPWVLATAIIFRHCNVESGDVNKVVVHKEDEGVEFNMQVVGGGIGFKEEGWWEVGVGGGARGRRRVVGGGSWWRSSWKTKGGPSSWAGWRPIGRGRGRRSQASGRGGRGAGRGWWVTKVEDESAKEENSQCLIFFFYFN

SEQ ID NO: 161240 - protein, 548 aa, Glycine max
  Coding DNA Sequence Number=SeqID_44462
  Gene Ontology: Mol. function=two-component sensor activity; Cellular component=membrane; Biological process=signal transduction
  Homolog annotation: Hit_ID=Q8W229; Match level="QueryCoverage=85%, HitCoverage=80%, E-value=1e-176, Identity=68%"; Hit description =Putative ethylene receptor
  Pfam annotation: Domain name=GAF; Domain location=192-341; Score =54.0; E_value=4.9e-13; Accession=PF01590.16; Description=GAF domain
  Pfam annotation: Domain name=HisKA; Domain location=377-442; Score =34.2; E_value=4.5e-07; Accession=PF00512.15; Description=His Kinase A (phosphoacceptor) domain
  Pfam module annotation: Pfam domain module=GAF::HisKA; Domain location=192-341::377-442
MEITPPLLHHLWFLLLLLLLCYLVLCASATDVEFDNCNCDDGEGIWSIHSILVGQKVSDFFIAVAYFSIPIELLYFVSRSNVPFKLLFLQFIAFIVLCGMTHLLNAYSYHGPPSFQLLLSLTVAKFLTALVSCATALTLPPLIPLLLKVKVRELFLRQNVMELGQEVGMMKKQKEASWHVRMLTREIRKSLDKHNILYTTLVELSKALDLHNCAVWMPNEDRREMHLTHELKTNSAKNFQNSIPVNDPDVLEIRKTKGVKILGPESALGAASSGGSVELGAVAAIRMPLLHVSNFKGGTPELVETCYAILVLVLPSSSTRVWTYHEMEIVEVVADQVAVALSHASVLEESQLMRQKLEERNRALQQAKKNAMMASQARKSFQKVMSHGMRRPMHSVLGMLSLFQEDNLRSEQKIIGDTMLKVGHVLSSLINDVMEISENEKGGFRLEMKPFLLHSMVREAASIAKCLCVYEGFGFEIDVQKSLPETVMGDEARTFQITESSQSDEAISTIHYTGRRQYYNNEPKGGLSFSMCKKLVQGLKLKVFAYKN

SEQ ID NO: 161241 - protein, 113 aa, Glycine max
  Coding DNA Sequence Number=SeqID_44463
MFPSSNRTTTDNTLLTRTQTFSATEWLVNFHQNHGFQSPTGWILQVRYQNRSKSVKNQIPFQLRKQDVASFKLYQVLCIKALHMKARETIHYKRTVTDTRLQRNPLPKIPPQK

SEQ ID NO: 161242 - protein, 211 aa, Glycine max
  Coding DNA Sequence Number=SeqID_44464
  Homolog annotation: Hit_ID=Q1RV80; Match level="QueryCoverage=34%, HitCoverage=12%, E-value=3e-09, Identity=42%"; Hit description=SAM (And some other nucleotide) binding motif
MSSEGEAEAEAEAQYFCKDFDWEDLRAEIEANPSFAYHLESSSSSSSAPPESDVQAWKQFHLRHASGKFFKERRYLLKEFPELLSCPPNSMLLEVGCGNGSTALPILRANKDLIVYACDCSDETLERAKEIISAASTDASFKHRFRTFCCDLSTNGFPNWLACNPSQDNFLQKQSYCLSGVREDNGLHFTNLSPSEEFECCGGGVDFVTLV

SEQ ID NO: 161243 - protein, 91 aa, Glycine max
  Coding DNA Sequence Number=SeqID_44465
  Gene Ontology: Mol. function=S-adenosylmethionine-dependent methyltransferase activity; Cellular component=cytoplasm; Biological process=striated muscle development
  Homolog annotation: Hit_ID=UPI00006A1B47; Match level="QueryCoverage =85%, HitCoverage=29%, E-value=2e-12, Identity=45%"; Hit description =UPI00006A1B47 related cluster
MTEPCVTGLYDMTMLRFEPDKQVGFREYMRSDGTRSYFFCLDTVRSLFLGAGFTELELDYCCVKSVNRQKGKSMQRVWVHGKFQKPALSCQ

SEQ ID NO: 161244 - protein, 256 aa, Glycine max
  Coding DNA Sequence Number=SeqID_44466
MEFTAAITTLTKKLSNGGGYSVPKRSRYDGIISTSIKLHAPRFSYQFDDYRKIFCAATRGSISILELPKLNKRRNNDDVRRSKFDYSNVFNRFGNLGAVAVPFEKLVVEPKKKDSFRTHMKHDLQSKEYDASMTEEEMVVNLPVKRVDPPKEDKTQVIRTKEVVLISKYEDLHCMGTKNLPRFIHEVFHNSNNMIEISLLILEKKDKGAQPSLAEIYIDNRTRGNGSIATEKASNVIDELKKLMVEAPVQKVLKRS

SEQ ID NO: 161245 - protein, 182 aa, Glycine max
  Coding DNA Sequence Number=SeqID_44467
  Gene Ontology: Mol. function=transcription factor activity; Cellular component=nucleus; Biological process=regulation of transcription, DNA-dependent
  Homolog annotation: Hit_ID=Q9CAN9; Match level="QueryCoverage=99%, HitCoverage=70%, E-value=2e-25, Identity=36%"; Hit description =Transcription factor DREB1A, putative; 22554-23300
  Pfam annotation: Domain name=AP2; Domain location=13-76; Score=106.6; E_value=7.4e-29; Accession=PF00847.10; Description=AP2 domain
MASSSSLSSSKRHPLYHGIRCRGGKWVTEIREPRKTNRIWLGTFLTPEMAAAAYDVAALALKGGEAVLNFPDSVGGYPVPASKSPADIRTAAIAAAELMKPEASHNNNNVNASTTNEAEVVQYDNNNVFTSFDTEFMDEEAIFSMPSLLVDMAGGMLLSPPRMSPPSDDSTQSYVGETLWNF

SEQ ID NO: 161246 - protein, 63 aa, Glycine max
  Coding DNA Sequence Number=SeqID_44468
MYPQLAGKSMPNAKKNPHGSPKVHLVQKQVLSAKCDLRMVLIFETQHLLENISVMPINKISSE

SEQ ID NO: 161247 - protein, 116 aa, Glycine max
  Coding DNA Sequence Number=SeqID_44469
  Gene Ontology: Mol. function=phosphoric monoester hydrolase activity; Biological process=metabolic process
  Homolog annotation: Hit_ID=Q8GUC1; Match level="QueryCoverage=74%, HitCoverage=32%, E-value=1e-29, Identity=68%"; Hit description =Putative phosphatase
  Pfam annotation: Domain name=Put_Phosphatase; Domain location=4-114; Score=-50.0; E_value=1.5e-06; Accession=PF06888.3; Description =Putative Phosphatase
MAGNVVVFDFDSTIIECDSDNWVLDEFGLTEKFYQLLPNMPWNPLMDKMMNELHSQGKTIEDIVQVLNRTPMHPSIVPAIKASYSLGYIPFSFLFSLTLYYKYDMPNSIVGTKVNN

SEQ ID NO: 161248 - protein, 37 aa, Glycine max
  Coding DNA Sequence Number=SeqID_44470
MGVWWWKLFVAALAGILFSTQHCASQKDWSYLIRLLI

SEQ ID NO: 161249 - protein, 469 aa, Glycine max
  Coding DNA Sequence Number=SeqID_44471
  Subcellular localization annotation: CTP_CleavageSite=80; ConfidenceScore=5.01e-01
MASSGATPLCNNHSLIHLPKRSVLLKDYLRDDLSSCSTNGFKSFPRRQCCTTVGFFGEKDLQLQRKRRSTLPRRRSTTISALQRASGAVINAIKSLPPLSQKSGKAKKGVAGVLCRSFSRKVLSRRFWRKAAAREEGNEDVPRRRRSFHELIMLDHEEHRKATSLNEDSTTVFAAHAPSVTTSSACGSESWGDSEFTFTSAGASSSSESSNENYLVLEGTEEGAPHHKVEEVVTKEYWPNDEKEQFSPESILDCPFEDEEDIYKSQINSTSITLSFSQGRKHKHMHKRCHFESVVPLEPVVLEKMFARLELEDEPHNHYTKQCSRLLVPKVRAQNNLRRDNNHNHEDNARDLLNFVKRSITPNSLITKAENLLFDYFKQSIEENKDIDYSKKLQICKVAEDWINGQPQEMYLGWEVQGGRCVYIREMDKCEEWKSSDQDIQQLGQELANEVFTNLVNEFTLELTSCASH

SEQ ID NO: 161250 - protein, 85 aa, Glycine max
  Coding DNA Sequence Number=SeqID_44472
MRYHNCKQHSKSKNHSKHRHESKAKEDGDVVEVFKVIKYCPKLQNLVRLRLILVTMMMVFLDAFYRTLKHALLIIMVALKQSLNL

SEQ ID NO: 161251 - protein, 307 aa, Glycine max
  Coding DNA Sequence Number=SeqID_44473
  Gene Ontology: Mol. function=oxidoreductase activity, acting on CH-OH group of donors; Biological process=alcohol metabolic process
  Homolog annotation: Hit_ID=Q9M4V5; Match level="QueryCoverage=99%, HitCoverage=49%, E-value=3e-92, Identity=58%"; Hit description =Putative mandelonitrile lyase
  Pfam annotation: Domain name=GMC_oxred_N; Domain location=1-193; Score=-48.9; E_value=8.1e-05; Accession=PF00732.10; Description=GMC oxidoreductase
MGREAGWDGRVVNESYEWVEKIVAFEPQLKQWQSSVRDGLIEIGVVPNNGFTYDHIDGTKVGGTIFDQNGFRHTAADLLQYAKPTGITLLLDATVHRILFRVKDRSKPMAHGVVFRDSLGRRHKAYLKPDPRNEIIVSAGALGSPQLLMLSGIGPEEHLKAHNIRITLDQPLVGQGMSDNPMNAIFVPSPVPVEISLIEVVGITTFGTYIEAASGENFAGGSPKDYGMFSPKGKKKKMSNQNQINLVKFRVKYWATLNGASEAKNSGGPSQGNRSDGNSGPSSIQRWIHPGKNHGSNIKRAFGAPKP

SEQ ID NO: 161252 - protein, 124 aa, Glycine max
  Coding DNA Sequence Number=SeqID_44474
MGQLQRQAFCKAYGKIWDLTMVEVSTEAIASLAQYYDQPLRCFTFGNFQLTPMMQEFEEILGYPPRGRKPYLFSRFYPSLARISKIVKISTQELDRGKQVENGVIGVPRKCLEAKAKVLASQGE

SEQ ID NO: 161253 - protein, 297 aa, Glycine max
  Coding DNA Sequence Number=SeqID_44475
  Homolog annotation: Hit_ID=Q1T192; Match level="QueryCoverage=32%, HitCoverage=17%, E-value=2e-13, Identity=43%"; Hit description =Polynucleotidyl transferase, Ribonuclease H fold
MVKRTVKERRSEEGEDSVKRALNGVVPTGIPELWGELSCLDVGAGMAFGSGLSIFILYMTKDQKKLRLWRLSGEMDEMSANSWHHLHLFVKSRSGSSSSSTINSLVSMVGVWSLKVPGLLSASQLGEQVSSGVALPKYIVHLKEFEIVNESFDNMVVLELDYFLGLGYIIKSFEDDSYPTSLHVGRAVNIKVPPVCGGLVIPNKFYQNVFHELCLYGARALPHGVTPSPQCGFGVVGGGLDPSIGVLHLRLDYVLTMVEKKRETKGWAPRLRMSAREWPLLGGKKGRTSKIKDSSAQ

SEQ ID NO: 161254 - protein, 152 aa, Glycine max
  Coding DNA Sequence Number=SeqID_44476
  Gene Ontology: Mol. function=calcium ion binding; Cellular component =flagellin-based flagellum; Biological process=ciliary or flagellar motility
  Homolog annotation: Hit_ID=Q45W79; Match level="QueryCoverage=88%, HitCoverage=91%, E-value=2e-48, Identity=56%"; Hit description =Calcium-binding pollen allergen
  Pfam annotation: Domain name=efhand; Domain location=117-145; Score =31.9; E_value=2.2e-06; Accession=PF00036.22; Description=EF hand
  Pfam annotation: Domain name=efhand; Domain location=44-72; Score =31.0; E_value=4.1e-06; Accession=PF00036.22; Description=EF hand
  Pfam annotation: Domain name=efhand; Domain location=8-36; Score =36.8; E_value=7.7e-08; Accession=PF00036.22; Description=EF hand
  Pfam annotation: Domain name=efhand; Domain location=81-109; Score =32.5; E_value=1.5e-06; Accession=PF00036.22; Description=EF hand
  Pfam module annotation: Pfam domain module=efhand::efhand::efhand::efh and; Domain location=117-145::44-72::8-36::81-109
MCGPITEDLEYVFKKFDANGDGKISSSELGSIMKSLGQPATEEEVKRMIQEVDANGDGHINLGEFLELNTKGVDPDEVLENLKDAFSIFDVDGNGLITAQELNMVMASLGDACSIDECQKMIAGVDGNGDGMINFEEFQLMMTGNGNGNMNK

SEQ ID NO: 161255 - protein, 128 aa, Glycine max
  Coding DNA Sequence Number=SeqID_44477
  Gene Ontology: Mol. function=nucleoside diphosphate kinase activity; Cellular component=nuclear microtubule; Biological process =pyrimidine ribonucleoside triphosphate biosynthetic process
  Homolog annotation: Hit_ID=Q39839; Match level="QueryCoverage=99%, HitCoverage=74%, E-value=7e-54, Identity=85%"; Hit description =Nucleoside diphosphate kinase 1
  Pfam annotation: Domain name=NDK; Domain location=3-128; Score=215.4; E_value=1.3e-61; Accession=PF00334.9; Description=Nucleoside diphosphate kinase
MAEQTFIMIKPDGVQRGLDVFSIFGFSENGSMNVLIGEIISRFEKKGFYLKGLKLVTVDRPFAEKHYADLSAKPFFSGLVDYIISGPVVAMIWEGKNVVTTGRKIIGATNPAQSEPGTIRGDFAIDIG

SEQ ID NO: 161256 - protein, 101 aa, Glycine max
  Coding DNA Sequence Number=SeqID_44478
MARRRSSESSEDDVRKRSGSEYEDEERDRYRCGGGSSKKNSGHCGDSDLGEERNGAMKGGGMLSDRKSKSRERTEEFESSEEEGQIVNKERVREEKEGDGR

SEQ ID NO: 161257 - protein, 61 aa, Glycine max
  Coding DNA Sequence Number=SeqID_44479
MTVFKTGAFLHSATCGTTRQEAQSFPAQCDTWHRKIRGTPQDKRRSATTSAGLPGASPNTL

SEQ ID NO: 161258 - protein, 164 aa, Glycine max
  Coding DNA Sequence Number=SeqID_44480
  Gene Ontology: Mol. function=transferase activity; Biological process= sulfate transport
  Homolog annotation: Hit_ID=UPI0000E698AE; Match level="QueryCoverage =75%, HitCoverage=85%, E-value=4e-31, Identity=56%"; Hit description =conserved hypothetical protein
  Pfam annotation: Domain name=Rhodanese; Domain location=49-140; Score= 42.6; E_value=1.3e-09; Accession=PF00581.10; Description=Rhodanese -like domain
MQTTLPYTAGTSQQENAMSAVLFYPPASPQHSVAYLQHKLSYYTDAWDLAADLAQGVTQIVVIDARSREAYQAGHLCGALSLPHREMDAASTARLDRHRVYVTYCDGIGCNGSTKAALKLAELGFQVKELIGGLDFWKRDGHPMAWGAAAGEWPAAAPAAECGC

SEQ ID NO: 161259 - protein, 183 aa, Glycine max
  Coding DNA Sequence Number=SeqID_44481
  Gene Ontology: Mol. function=transferase activity, transferring nitrogenous groups; Cellular component=intracellular; Biological process=regulation of transcription, DNA-dependent
  Homolog annotation: Hit_ID=Q9HWL6; Match level="QueryCoverage=91%, HitCoverage=34%, E-value=8e-32, Identity=45%"; Hit description =Probable transcriptional regulator
  Pfam annotation: Domain name=GntR; Domain location=17-80; Score=81.5; E_value=2.7e-21; Accession=PF00392.11; Description=Bacterial regulatory proteins, gntR f
MQHAFLPLFRHQTQGGLRQRLCATLRQAIVSGHLRFGQKLPSSRQLAADLALSRVTVEAAYSQLESEGYVQRHSGRGTFVAIALPPPAEKATAQRAPRFSQRGTQVLATGGCQDPPFPLAFAAGSPELRAFPHRQWQRLSHSVQRALGSQVMGYGDPLGYAPLRQAVADYLALSRGVRCTAEQ

SEQ ID NO: 161260 - protein, 132 aa, Glycine max
  Coding DNA Sequence Number=SeqID_44482
  Gene Ontology: Mol. function=hydroxymethylglutaryl-CoA synthase activity; Cellular component=mitochondrial inner membrane; Biological process=acetyl-CoA metabolic process
  Homolog annotation: Hit_ID=Q6QLW8; Match level="QueryCoverage=98%, HitCoverage=43%, E-value=2e-39, Identity=47%"; Hit description=HMG -CoA synthase 2
  Pfam annotation: Domain name=HMG_CoA_synt_C; Domain location=1-132; Score=-0.5; E_value=4.4e-14; Accession=PF08540.1; Description =Hydroxymethylglutaryl-coenzyme A synth
MAHAYDFYKPNLASEYPVVDGKLSQTCYLMALDSCYNHLSHKHLMTSLNYRYDIQEGMQFSISDAEYFVFHSPYDKASQQLAKPQYDAKDGKRVILFSYGSGLTSTMFSLQLREGQHPFSLSNIAKVMFLAN

SEQ ID NO: 161261 - protein, 204 aa, Glycine max
  Coding DNA Sequence Number=SeqID_44483
MEWFVARDGGRVINGWKREEYLVSKGVVVVMVISGLILVTLAIVLLALHQLHKLEEYGSQPKRCVPECVPQLPNKLGCTEVVCASSINENLNMVVFNEARDSQAGDASCEAIRAVGDGGLGSKSCRHSSSSITNRNKDGVHLWPRMVVVAGLAGDKVKSNSTGLVTTGGDTHGGRLYDELGEFQTEDRRPSSILSSCSLAKEIS

SEQ ID NO: 161262 - protein, 610 aa, Glycine max
  Coding DNA Sequence Number=SeqID_44484
  Gene Ontology: Mol. function=pyridoxal phosphate binding; Biological process=metabolic process
  Homolog annotation: Hit_ID=Q9FGL6; Match level="QueryCoverage=95%, HitCoverage=95%, E-value=1e-130, Identity=43%"; Hit description =Arabidopsis thaliana genomic DNA, chromosome 5, P1 clone:MJM18
  Subcellular localization annotation: CTP_CleavageSite=5; ConfidenceScore=5.04e-01
MHPSRAEAEAASQPCFNGCFPSPLLASERSHRTTSKPKVNNDATSSHDDFVAATSSTLHPHTNFTNHESLPSLQDSYISFTKVFPQFSTTSEVDRIRAREYHHLNHSSNSCFDYTGYGLFSYDQQQRSYSYPTVASSSSSSLPYFTSDASFFDISYKSVNLQSQVLYGGHESELESRIRKRIMSFMNVSEAEYTLVFIANEVSAFKIVADSFQFQNNRQLLTVYDHSSEALDVMIESCKKQGVHVLSAEFSWPNLGMEWRKLKKMVTKNKREKRKGGLFVFPLHSRVTGAPYSYVWMSMAQEHGWRVLLDVCGLKPKEMGTLGMSLFKPDFMVCSFYKVFGENPSGFGCLFVKKSSVSALKDPGNAISIGIISLVPAFRHETNEQVVIETETEHHQQVEIEELSIPFDSSTDRNRLGTKNEGLEIHCRGLDHADSVGLLLISSRTKYLVNWLVNALMSLKHPHHEDSISLIRIYGPKISSLRGPAVAFNIFDWKGEKIDPALVQKLADRNNISLGSSYLRNIRFSDKNEEERHYWALETRGGSEVEGLGLSKKTRSQEPGIFVVTAALGLLTNFEDIYRLWAFLSRFLDADFVEKERWRYMALNQKTIEV

SEQ ID NO: 161263 - protein, 560 aa, Glycine max
  Coding DNA Sequence Number=SeqID_44485
  Gene Ontology: Mol. function=protein phosphatase type 2A regulator activity; Cellular component=protein phosphatase type 2A complex; Biological process=signal transduction
  Homolog annotation: Hit_ID=Q9FVD4; Match level="QueryCoverage=99%, HitCoverage=86%, E-value=1e-127, Identity=82%"; Hit description =Ser/Thr specific protein phosphatase 2A B regulatory subunit beta isoform
  Pfam annotation: Domain name=WD40; Domain location=106-145; Score =12.2; E_value=1.4; Accession=PF00400.22; Description=WD domain, G -beta repeat
  Pfam annotation: Domain name=WD40; Domain location=254-292; Score =10.5; E_value=2.1; Accession=PF00400.22; Description=WD domain, G -beta repeat
  Pfam annotation: Domain name=WD40; Domain location=28-66; Score=5.3; E_value=8.7; Accession=PF00400.22; Description=WD domain, G-beta repeat
  Pfam annotation: Domain name=WD40; Domain location=387-426; Score =10.6; E_value=2.1; Accession=PF00400.22; Description=WD domain, G -beta repeat
  Pfam annotation: Domain name=WD40; Domain location=446-483; Score =5.5; E_value=8.3; Accession=PF00400.22; Description=WD domain, G -beta repeat
  Pfam module annotation: Pfam domain module=WD40::WD40::WD40::WD40::WD4 0; Domain location=106-145::254-292::28-66::387-426::446-483
MNGGDEVVAAPAAPPHPLEWKFSQVFGERTAGEEVQEVDIISAIEFDKSGDHLATGDRGGRVVLFERTDTKDHGGSRRDLERMDYSIGRHPEFRYKTEFQSHEPEFDYLKSLEIEEKINKIRWCQTANGALFLLSTNDKTIKFWKSAMVSVLGTAEIVLRNIFALQLSPSTVTEIMVQEKKVKKISEMNVDPSKSMGNGSIASSSNSSSSRPYLVNGGSPDRYNYISNDFSFPPGGLPSLRLPMVSSHETSLVARCRRVYAHAHDYHINSISNNSDGETFISADDLRINLWNLEISNQSFNIVDVKPANMEDLTGLGSNFSTRLEPFKLGWTWVHLKKLAVRIRYCLSFGLVWLAQPHLDSILTSSRVGKHDKKITQGESRGKTGGLKVGREKQGVEEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVATGSYSNLFRVFGCAPGSAEATTLEASKNPMR

SEQ ID NO: 161264 - protein, 209 aa, Glycine max
  Coding DNA Sequence Number=SeqID_44486
  Gene Ontology: Mol. function=catalytic activity; Biological process =cellular metabolic process
  Homolog annotation: Hit_ID=Q6EPQ1; Match level="QueryCoverage=94%, HitCoverage=82%, E-value=6e-83, Identity=60%"; Hit description=DTDP -D-glucose 4,6-dehydratase-like
  Pfam annotation: Domain name=Epimerase; Domain location=16-204; Score= -52.3; E_value=0.0098; Accession=PF01370.11; Description=NAD dependent epimerasedehydratase family
  Pfam annotation: Domain name=RmlD_sub_bind; Domain location=15-208; Score=-166.0; E_value=0.0027; Accession=PF04321.7; Description=RmlD substrate binding domain
  Pfam module annotation: Pfam domain module=Epimerase::RmlD_sub_bind; Domain location=16-204::15-208
MDFPANGASAAHSLNFLIYGRAGWIGGLLGTLCRAQGIPFQYGSGRLQNRASLQADIAQLKPTHVFNAAGVTGRPNVDWCESHKVETIRTNVIGTLTLADVCRDHGLILINYATDCIFEYDSDHPLGSGIGFKETDIPNSMTILDELLPISIEMGKRNLTGIWNFTNPGVVSHNEILEMYRDYVDPNFTWKNFTLEEQAKVIVAPRSNN

SEQ ID NO: 161265 - protein, 258 aa, Glycine max
  Coding DNA Sequence Number=SeqID_44487
  Gene Ontology: Cellular component=nucleus; Biological process =regulation of transcription
  Homolog annotation: Hit_ID=O64647; Match level="QueryCoverage=94%, HitCoverage=71%, E-value=6e-39, Identity=41%"; Hit description =Putative PCF2-like DNA binding protein
  Pfam annotation: Domain name=TCP; Domain location=1-166; Score=54.2; E_value=4.4e-13; Accession=PF03634.4; Description=TCP family transcription factor
IRIPATCAARIFQLTRELGHKSDGETVRWLLEHAEPAIIEATGTGTVPAIAVSVGGALKIPTTSSNSNEEAAAAAASSNKKRKRPSNSEFVDINININDAVSKSSGLAPVHVPQGLVPVWAVSNPSMVIPANTFWMIPQAATTPNPSGGVAGPASQQPQLWALSPSVFNVAARPISPLVTTNIPEARPVMTACSNGSNSAVSTSTVGAKLATKSSMAPSVSSSGTKSGKTQMLRDFSLEICDKQELQLLGRSGTHAQS

SEQ ID NO: 161266 - protein, 175 aa, Glycine max
  Coding DNA Sequence Number=SeqID_44488
  Gene Ontology: Mol. function=sequence-specific DNA binding; Cellular component=nucleus; Biological process=regulation of transcription, DNA-dependent
  Homolog annotation: Hit_ID=Q9ZRB8; Match level="QueryCoverage=88%, HitCoverage=50%, E-value=3e-75, Identity=89%"; Hit description =Homeobox 2 protein
  Pfam annotation: Domain name=ELK; Domain location=78-99; Score=27.7; E_value=4.2e-05; Accession=PF03789.4; Description=ELK domain
MKHLFPLSFFKHILSDSLCDSGVSLGEGTGATMSDDEDDLQMDGSLDQSSAEGHDLMGFGPLLPTESERSLMERVRQELKIELKQGFKSRIEDVREEILRKRRAGKLPGDTTSVLKAWWQQHAKWPYPTEDDKAKLVEETGLQLKQINNWFINQRKRNWHSNSQSVTSLKSKRKR

SEQ ID NO: 161267 - protein, 227 aa, Glycine max
  Coding DNA Sequence Number=SeqID_44489
  Gene Ontology: Mol. function=sequence-specific DNA binding; Cellular component=nucleus; Biological process=regulation of transcription, DNA-dependent
  Homolog annotation: Hit_ID=O82743; Match level="QueryCoverage=82%, HitCoverage=72%, E-value=2e-18, Identity=36%"; Hit description =Agamous-like MADS-box protein AGL19
  Pfam annotation: Domain name=K-box; Domain location=71-176; Score =33.6; E_value=6.6e-07; Accession=PF01486.8; Description=K-box region
MIIHPSSILSCYRIKSEVPKKLFVVYWRCSSINKTVERYQRKIEDLGVSNKGIHENTQPPTVFSCVCHEIYRKWKLHADIPYKHLKEVDMSMAKKIEHLEDSRRKLLGDELDKCSIDELQQLENQLERSLDKIRATKNLVLPVIQNQLFRKRIEKLKEEEKCLLEVNKRLREQYRIERQRCLSDQDVEFATKKEGEEVETELFIGRPERRMPLKLKPTTYSAHAYIA

SEQ ID NO: 161268 - protein, 39 aa, Glycine max
  Coding DNA Sequence Number=SeqID_44490
MDDSNENPRLPHRRNPNESVSLDQLADSASIVTSSVFID

SEQ ID NO: 161269 - protein, 70 aa, Glycine max
  Coding DNA Sequence Number=SeqID_44491
MVPRSDYCHRASLATLTKASHYLLVRALPLYHGGKRRLDAPYELKGLEQKGYNKHIQYGWMFQEKEEDSS

SEQ ID NO: 161270 - protein, 82 aa, Glycine max
  Coding DNA Sequence Number=SeqID_44492
MGSNQAPSFKKRFYHVKVKSLDLASLRELGQRMDQVRCQAFHKAYGKIWDLALIEVSVEAIASLSQYYDQSLRCFTFGDFQL

SEQ ID NO: 161271 - protein, 147 aa, Glycine max
  Coding DNA Sequence Number=SeqID_44493
  Gene Ontology: Cellular component=cytoskeleton; Biological process =phagocytosis
  Homolog annotation: Hit_ID=O80516; Match level="QueryCoverage=81%, HitCoverage=45%, E-value=1e-51, Identity=80%"; Hit description =Expressed protein
  Pfam annotation: Domain name=ELMO_CED12; Domain location=2-127; Score= 108.6; E_value=1.8e-29; Accession=PF04727.4; Description=ELMOCED-12 family
MSLKYDVMQVSGKLYSIHTEPAGSNVKSFQVLLRKQEGDRSVWEYPFAVAGVNITYMLIQMLDLEAVKPRNLVGATFLKFLAENGSAFDLLYCITFKLMDHQWLTMRASYMDFNAVMKETRRQLEKELLIEDIARLEDLPSYKLLSR

SEQ ID NO: 161272 - protein, 132 aa, Glycine max
  Coding DNA Sequence Number=SeqID_44494
  Gene Ontology: Cellular component=cytoskeleton; Biological process =phagocytosis
  Homolog annotation: Hit_ID=O80516; Match level="QueryCoverage=99%, HitCoverage=47%, E-value=2e-46, Identity=71%"; Hit description =Expressed protein
MDDRGSSFVAVRRIPQGETCHPNSGIVWHVGPRPEVVAGSAAWLGRGLSCVCVQRRDSDVSNTFDLTLAQEECLQRIQRRIDVPYDSSIIEHQDALRALWNAAFPEEELHGLISEQWKEMGWQGKDPSTDFR

SEQ ID NO: 161273 - protein, 332 aa, Glycine max
  Coding DNA Sequence Number=SeqID_44495
  Gene Ontology: Mol. function=transferase activity, transferring groups other than amino-acyl groups; Cellular component=integral to membrane
  Homolog annotation: Hit_ID=P37669; Match level="QueryCoverage=80%, HitCoverage=96%, E-value=2e-68, Identity=45%"; Hit description=Inner membrane protein yiaH
RAPSDAPVSPASGYQRAGIPRAAAAGDCAPAPAAGGSGGESGAGRRLLLGTPAAPRPAALGRSAHQMMLVHAFQQHRQQQAAQQGYAKHPWQIQPRPRRIVVMMGAQIHIFKQRQQANRGDKHQRATVEIPGVIKRAVNFQHLSGAERDTDDAGDKTHPGQPADAAPVGIHHANRPSKQRIQQVVNRVAADIQIDRQPVERPQRLADGIRISNHREDQHQQRHIARRHIFHLNQRRQQRTAFADRRQPGDVGQRDGAVEQQAQHNAQQMTALRAAFAKEQITGNHEEQRHADARSRVKQIGDVPAGSGDCHRTGDVPGGGVNDDHHQTGDRA

SEQ ID NO: 161274 - protein, 113 aa, Glycine max
  Coding DNA Sequence Number=SeqID_44496
  Subcellular localization annotation: CTP_CleavageSite=52; ConfidenceScore=5.67e-01
MSDRSYDVAPTPSPSPIEARSSLTEVRPSSSPINARGSSPVPTSTPSSSPTVSNMYADENVPNLAMEDPPPNDRLTVAEKVITLSIRQQFANPWPTWGVIPKDHQELFFQCFK

SEQ ID NO: 161275 - protein, 92 aa, Glycine max
  Coding DNA Sequence Number=SeqID_44497
MHIGGSISLEVHIIRLRLCLNDKKILKLNYLKLGLMLHQIQLYFSSSHLKCRTLFININNLTNNNKTMTNQMTNNNKTITNQITSSNKTMTN

SEQ ID NO: 161276 - protein, 606 aa, Glycine max
  Coding DNA Sequence Number=SeqID_44498
  Gene Ontology: Mol. function=protein serine/threonine kinase activity; Cellular component=cytoplasm; Biological process=protein amino acid phosphorylation
  Homolog annotation: Hit_ID=Q336S1; Match level="QueryCoverage=63%, HitCoverage=37%, E-value=7e-98, Identity=49%"; Hit description =Protein kinase domain containing protein, expressed
  Pfam annotation: Domain name=Pkinase; Domain location=259-547; Score =11.7; E_value=2.9e-09; Accession=PF00069.15; Description=Protein kinase domain
  Pfam annotation: Domain name=Pkinase_Tyr; Domain location=259-463; Score=-158.5; E_value=0.0096; Accession=PF07714.7; Description =Protein tyrosine kinase
  Pfam module annotation: Pfam domain module=Pkinase::Pkinase_Tyr; Domain location=259-547::259-463
MSNGEVSKSIIEVLTKKISIIKTSYLNCPKLVDKNRFMECNLFVVDPPCKEGIVNNLGIGKKIDYFDTFTHDCAEQNSIHHVDEDGIGKSNTCKDQPREPNEDDEVESGSKKGLIDSGTNRVKEDVAQRVNAALCGEALTNGLEQKNHVHAMNLEKESERNTGTKSTNKISNSSSTPKRPLKSSSILKGGQKNDLHPKSQILKESLVSNKFGNVPKNVDQRKNEQNLTARKQNHKENMAGNIATTTKVEKRAYPSFEAFTIEEEEGSGGYGTVYRAQRTTDGKRVAIKCPHTNAHKNHVNNERSMLERFGGKNYIIRYEGSFKNGNSDCFVLEHVHHDRPEVLKKEIDIVQLQWYGYCMFRALYCLHKEGVVHRDIKPGNFLFSRKLSKGYLIDFNLAMDLKQKHNIGSKSKPSHDAASNIVSFSSGSAPLVRDKNLGGSKSLTSNKRALADYKNYSELNRHVKQKDCTGPLKNCPDKAGGSFLRAQGTDGSGVTSAKDPSTRTASAERLREPLPSHGRKELISFVNTMKCANNSSTIGPSSQRKRVTAPSSKVDGKIFNITPMPLHSSTVGGGLMRSKGDGKKKEGSCVGTKGFRAPEVLVEKEN

SEQ ID NO: 161277 - protein, 193 aa, Glycine max
  Coding DNA Sequence Number=SeqID_44499
  Homolog annotation: Hit_ID=Q8H6Q8; Match level="QueryCoverage=38%, HitCoverage=41%, E-value=1e-15, Identity=57%"; Hit description=CTV.20
AVKTNLNGKFITNDDDKEIPVAVNTLIFTIAQHFIGDPSLWKDKSAELLSNLRCRTLADFRWYRDTFLTRVYTREDSQQPFWKEKFLAGLPRSLGDKKLRNLNLEPAIEEQINNLLIETSEEETETSSSVLSDEDLNLIQQDDQLSSTDDDDGQINTLTREQDLLFEAINSIPDPQEKKVFLEKLKKTIRGKT

SEQ ID NO: 161278 - protein, 97 aa, Glycine max
  Coding DNA Sequence Number=SeqID_44500
MVPLTKKPQLHGSRLRKGLTTKLTGPNGSAFDGSAVARGLHMKKIARDKGGMWELLWRCDFQGWVAFFEAILTLVLPEKTNGDDGGQRRTEPALMPT

SEQ ID NO: 161279 - protein, 58 aa, Glycine max
  Coding DNA Sequence Number=SeqID_44501
  Subcellular localization annotation: CTP_CleavageSite=51; ConfidenceScore=5.12e-01
MSPPPLETSQSLKISSKASQDGFLVKLSSLLVSPQLKTLKKLNNLSKIEISALNRHSC

SEQ ID NO: 161280 - protein, 121 aa, Glycine max
  Coding DNA Sequence Number=SeqID_44502
MKNGRKPSRICLRKHLGSVTEAPQLGFSSRKQFFSPKTAEIHSQGEKGRGGCRPARPGEEATQLQKTFWKPYGKSYGNFTEALRVSRKPRNPIFQQNGGCGGHLARPGELSSPRRARLLQP

SEQ ID NO: 161281 - protein, 456 aa, Glycine max
  Coding DNA Sequence Number=SeqID_44503
  Gene Ontology: Mol. function=zinc ion binding
  Pfam annotation: Domain name=zf-C3HC4; Domain location=81-131; Score =2.1; E_value=0.095; Accession=PF00097.15; Description=Zinc finger, C3HC4 type (RING finger)
MKLLESKKRAEAWPESSENPSDTGPPHKKTRDLLNMTECHVCGFKVDVCTGKNRLRTLYSEWRVVLLCKKCFSSVESSQICSYCFSGASPESFRCNQCLHSVHKSCFLKYRNAAPWSYACLGSEFSVCVDCWIPKHLAISRRRNKIGVKNGKHVRVIPDKGSSRVFGGGNLVRSMEDLVEDAKRTVEVKVEAASRAREEAMKKALVARSSVEIANNALSLVAKNREESSCLNLPPKVDDAVKVLDGSEFTFELHPCFDRGLPRISKSCCLLNASYFDTSKRWTSSVDLSCKISKSRNASDRDKHEVVSNNSVGAALDSGSLTDLNLLYMGTSGMETGLGTAEFDSEGIGEEELLKEGEGSCSDRLINFSEDSGMELDHKQADSALHGEEQCNGQPDRYLFKYSRRCNGQPDSALHTEERCNGQPDRYFFKYSRRCNGQPDHYFFKYSRRSRSLNQI

SEQ ID NO: 161282 - protein, 593 aa, Glycine max
  Coding DNA Sequence Number=SeqID_44504
  Gene Ontology: Mol. function=phospholipid binding; Cellular component= coated pit; Biological process=endocytosis
  Homolog annotation: Hit_ID=Q9SA65; Match level="QueryCoverage=97%, HitCoverage=99%, E-value=1e-159, Identity=53%"; Hit description =Putative clathrin assembly protein At1g03050
  Pfam annotation: Domain name=ANTH; Domain location=31-320; Score =394.4; E_value=1.6e-115; Accession=PF07651.6; Description=ANTH domain
  Pfam annotation: Domain name=ENTH; Domain location=31-152; Score= -9.4; E_value=0.00018; Accession=PF01417.11; Description=ENTH domain
  Pfam module annotation: Pfam domain module=ANTH::ENTH; Domain location=31-320::31-152
MPPSSKFRRALGAVKDQTSISLAKVGSSTSLADLDVAIVKATRHDEYPAEEKHIREILSLTCYSRAFISACVNTLARRLNKTKSWTVALKTLILIQRLLLEGDPAYEQEIFFSTRRGTRLLNMSDFRDSLKSGSWDFSAFVRTYALYLDERLEYKMQSRRGKRSMYSFDEDEEEREREKEKEIIVRSTPVRDMKLEQIFSKMQHLQLLLERFLACRPTGGAKNHRIVIVALYPIVKESFQIYYDISEILGILIDRFPDMDVSDCVKVYDIFCRVGKQFDELDLFFGWSKSIGIARSSEYPEIERVTLKKLEVMEEFIKDKSALAQSNIPEAIEYKHQEEEKEAYESEPEEDVNATKALPPPPEEIIEEPVEEVKEEPKEEKVVQTEGDLLNLGDDMMTSEAHGEKLALALFDGAAPAAAGGATQALPWHAFDEGGDWETALVQSATNLGNQKPTYGGGFDTLLLDGMYKQGEMNAAMQGQGYGVSGSASSVALGSAGRPAMLALPAPPTSWSGSDSNNSDPFAASLAVAPPSYVQMSEMEKKQRLLLEEQMMWQQYAKEGMQGQAALAKLHSNNNNNNSYTGGYPQNYGNYYR

SEQ ID NO: 161283 - protein, 66 aa, Glycine max
  Coding DNA Sequence Number=SeqID_44505
MAMAMAMAMANWMIKCITIQGFTTIQPSTQYTIESRLFPQCTPRFHTCHPNRVGWLMLCKIRARNV

SEQ ID NO: 161284 - protein, 124 aa, Glycine max
  Coding DNA Sequence Number=SeqID_44506
  Gene Ontology: Mol. function=phosphatidylserine decarboxylase activity; Biological process=phospholipid biosynthetic process
  Homolog annotation: Hit_ID=Q9LU67; Match level="QueryCoverage=65%, HitCoverage=8%, E-value=2e-10, Identity=63%"; Hit description =Phosphatidylserine decarboxylase
MGHEHSKLSEGKGSRRARFKERLRLHFRRRRSGNGSSDHKLLHADNFAGIALLALLRAEMKFKDKWIACLSLGEQTFRTNTSDQLSSSSSYLCNTLHSFCCADFVLLMMVQHRQTSLELCEYYF

SEQ ID NO: 161285 - protein, 72 aa, Glycine max
  Coding DNA Sequence Number=SeqID_44507
MIINQQVKVPFSIGTYTDEVICDVVPMEVGHLLLEAKLHGESKVIQRCFDDNNNDDKGDDKKLKDQSKNNSK

SEQ ID NO: 161286 - protein, 127 aa, Glycine max
  Coding DNA Sequence Number=SeqID_44508
MAESEFEPNRVHDLEEKSWHLLALLFRIGHAVYPQRLAAQCRLFAASPDFVCYVSTLPGSPLSVTDNGLVTPSVSAVFALGSFFSLRFSPPQTHRFRKRKLLFDSAEDGRERKRLAIRHGLREFSFQ

SEQ ID NO: 161287 - protein, 914 aa, Glycine max
  Coding DNA Sequence Number=SeqID_44509
  Gene Ontology: Mol. function=nucleic acid binding; Cellular component= beta-galactosidase complex; Biological process=DNA integration
  Homolog annotation: Hit_ID=Q1T1K8; Match level="QueryCoverage=100%, HitCoverage=45%, E-value=0.0, Identity=62%"; Hit description =Integrase, catalytic region; Zinc finger, CCHC-type
  Pfam annotation: Domain name=rve; Domain location=272-433; Score =165.2; E_value=1.6e-46; Accession=PF00665.16; Description=Integrase core domain
  Pfam annotation: Domain name=zf-CCHC; Domain location=40-57; Score =12.8; E_value=0.0076; Accession=PF00098.13; Description=Zinc knuckle
  Pfam module annotation: Pfam domain module=RVT_2::rve::zf-CCHC; Domain location=661-912::272-433::40-57
  Subcellular localization annotation: CTP_CleavageSite=54; ConfidenceScore=5.58e-01
MNASANLASKTYSRGNKPGTRGNWRGSNFRGGRGRGRSKPTCQVCNKFGHTAVQCFYRYDKSYTGSNAENNTQENHSAFIASPYHGQDYEWYFDSGASNHVTHQNEKLQDLSESNGKNSLLVGNGKRLSILASGSTQLNNLNLHNVLYVPEITKNLLSVSKLTADNNALVEFDANCCYVKDKLTGKALLKGKLRDGLYQLSSVKSQVNKDPCTYMSVKENWHRKLGHPNNKVLEKVLKNCNVKASSNDQFSFCEACQFGKLHLLPFKPSSSHAKEPLDLIHSDVWGPAPILSPSNFKYYVHFIDDFSRFTWIFPLKQKSETITAFIQFKNMVENQFNRKIKVLQCDGGGEYKPVQKIAIESGIQFRMSCPYTSQQNGRAERKHRHVAELGLTLLAQAKMPLHYWWEAFSTSVYLINRLPSSVNPNESPYSLLFRKEPDYNALKPFGCACYPCLKPYNQHKLQFHTTRCVFLGYSNSHKGYKCLNSHGRIFVSRHVVFNENHFPFHDGFLDTRNPLKTLPEIVPIVFPSCLADTTTSHTIEPTISDVNHQEGDLAVNEDQPALSETAENEATTTVEPAEDTSVDTPEDNQQAQDNNLAEDTSADTPENNQQAQDNTHCMRTRSKAGIYKPKLPYIGLTVTHKEDKEPENVNEAQVRPRWKEAMDAEFKALTANHTWILVPFQGQNNIIDSKWVFKTKYKADGSIERRKARLVAKGFQQTAGLDYDETFSPVIKSSTVRIVLSIAVHLNWEVRQLDINNAFLNGNLKETVFMHQPEGYIDSTRPRHICKLTKAIYGLKQAPRAWFDRLKDTLLEWGFQNTKSDSSLFVLRGTDHITLLLIYVDDIIVTGSNKKFLETFITQLNIAFSLKDLGHLHYFLGVEVHRDTGGMYLKQTKYIRDLLKKFNMEKASSCPTAM

SEQ ID NO: 161288 - protein, 122 aa, Glycine max
  Coding DNA Sequence Number=SeqID_44510
MASRKRKSTASRPQAQYDTRRFQSLEAWNKYTDNILGQNILPERNVQIYHIEFDEFKVELERRNLHKRLTNLQEGSIDVAVVKEFYANLYNPEDQSPKQAGTPVDERKTSCARGGGDPTHLL

SEQ ID NO: 161289 - protein, 113 aa, Glycine max
  Coding DNA Sequence Number=SeqID_44511
MVEVSVEATASLTQYYDQPLRCFTFGDFQLVPTVEEFEEILGCPLGGRKPYLFSGFYPSMERVAKALLIFGVVLFPNVEGLVDLVAINAFLAYHHSKESPIIAILVDVYDTFD

SEQ ID NO: 161290 - protein, 47 aa, Glycine max
  Coding DNA Sequence Number=SeqID_44512
MDEGEGDLNRMVVKDLKAIEGDGRKKGKLGITGEAKNKQYRVLITYS

SEQ ID NO: 161291 - protein, 49 aa, Glycine max
  Coding DNA Sequence Number=SeqID_44513
MAKPHGKMSNLDAGYRRLIAGFCKDLTCSNSTGFGIVEHCRLPVKIGRE

SEQ ID NO: 161292 - protein, 151 aa, Glycine max
  Coding DNA Sequence Number=SeqID_44514
  Gene Ontology: Mol. function=nucleic acid binding
  Homolog annotation: Hit_ID=Q9LTX1; Match level="QueryCoverage=80%, HitCoverage=15%, E-value=1e-27, Identity=56%"; Hit description =Similarity to poly(A)-binding protein
  Pfam annotation: Domain name=RRM_1; Domain location=84-151; Score =43.0; E_value=1e-09; Accession=PF00076.12; Description=RNA recognition motif. (a.k.a. RRM, R
MRQITWLATLLNFKNLHLRLNNLTQLQANPALDVQKEFSKAHLTASGSNAAGRPSEDVDSRTIFVSNVRTLTPLFLVWEGRLQGLVHFAATKDGLSRHFNRFGEVLKVIIVTDAAIGQPKGAAYVEFMRKEAADNALSLDNTSFMSRILKM

SEQ ID NO: 161293 - protein, 248 aa, Glycine max
  Coding DNA Sequence Number=SeqID_44515
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-28, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTFLGLHALTFRGLHVLTFLGLHALTFRGLDFLAFRGLDFLAFRGLDVLAFRGLHALVFRGPHALAFRGLHAFTIRGLHVLAFVGLDALTFRGLYVLTFRGLHVLTFRGLHVLVFRGQHVLAFAFVGLHALTFKGLHVLTIRGLHALTFRGLHILHFRGLHVLDFRGLHVLAFRELHFLAFRGLHVLIFRGLHVLIFRGLHVFAFRGLHVLTFRGLHVLAFRGLRALTFTGIHIRTLREFKVLYP

SEQ ID NO: 161294 - protein, 57 aa, Glycine max
  Coding DNA Sequence Number=SeqID_44516
MKEICSNLQGKDNAPPPPPQWIEAKYFSDGTALDTDTMTTIRKKKWAAYLLEVGKWM

SEQ ID NO: 161295 - protein, 672 aa, Glycine max
  Coding DNA Sequence Number=SeqID_44517
  Pfam annotation: Domain name=Transposase_23; Domain location=88-159; Score=-13.6; E_value=0.035; Accession=PF03017.5; Description =TNP1ENSPM transposase
DEIRKEVQQEQKQQQEAWMRAVEEKQWQNLEMMKQELKKSLKVELSHIASHQSAPIEAPEIQALLARVSTKGSCAGPEGSGLLKELLSGGDDLMGLFVVVGENIVLAGLGKVFENSSTIHNVRYENDVVKVQVVRTYMPYAEVPIPTSEVHYLEQAVGTFVAWPTHLVREVTNEVVVGLDKPPSKSVGEPNRLTSVATDDPLGELVKKSYVVYTKPMELAWDGAKFGLPNASNGFFITHVDVTEIILGDKCLNISVLQLWMMFMNDWSTSIGFSPVYGFLEPQSIRCTKDTREECQKYIETWVKVSHREIYLGPYFNQAHWQLLVLCPRENIIVWFYSIRRKPDVHIKFAVNNAMKEICSNLQGKDNAPPPPPQWIEAKSHVQQGPYECGYYVMHWMWCIVSAGLKNELHNYFSDGTALDTDTMTTIRKKWAAYLLEVGKWMSAFDMFLLGSFSPPQPSHTLVQEIIEKATQEKQLRCLQVTLNSSADNYSLNGEVAVTCLKNAISYFSDHTDYLKNVAAMIFPLLLVLPHAEWETSMTAGDASLDEFKPEVLDWDCSAFFNELLYVKLRHLNVKRDDDKWVNKIRDLFVFFASSKLKHTFLEHLHYLAAQCKISPPRLLSKFFTDEGVTAAVQVESLQCYAFLCSLSQDKWKIELLAEFPSVLVPFASDNQ

SEQ ID NO: 161296 - protein, 78 aa, Glycine max
  Coding DNA Sequence Number=SeqID_44518
MAELCLVPDVVIPPKFKESLNGATITCYTNLEPSRVHSWKDLMAAFIRRYQYNSDMAPDTMQLRTICKKEHESFKKYA

SEQ ID NO: 161297 - protein, 52 aa, Glycine max
  Coding DNA Sequence Number=SeqID_44519
MVECDSILQGRGPITRSMARRLQEDWVKDEGEGPREKDLIELEEVHTILMGR

SEQ ID NO: 161298 - protein, 63 aa, Glycine max
  Coding DNA Sequence Number=SeqID_44520
MNCTIVDDDALSSERKVNGEFPSIKGILALGRTWNFHFSRQSKRIRSRNQVDGRTTTEGLEDK

SEQ ID NO: 161299 - protein, 149 aa, Glycine max
  Coding DNA Sequence Number=SeqID_44521
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=96%, HitCoverage=13%, E-value=2e-41, Identity=52%"; Hit description =Peptidase S8 and S53, subtilisin, kexin, sedolisin; Integrase, catalytic region; Zinc finger, CCHC-type
MKKGKEEKVYKLRKALYGLKQAPRAWYKGGKILILSVYVNDLIYTGNDGSMCNDFKSSMMSEFDMIDLGRIRYFLRVEILQNAHGIFICQRKYAREVLPRFGMKDCNAVKNPIVPRTQLSRNDAGTKVDATLFKQVVGSLMYLTAMESA

SEQ ID NO: 161300 - protein, 109 aa, Glycine max
  Coding DNA Sequence Number=SeqID_44522
  Subcellular localization annotation: CTP_CleavageSite=29; ConfidenceScore=5.09e-01
SLGALSARRDSVLAGRASWALGAQIYDLSSSRVSHPLSKLDASLSQIALLSMSSAAFTFSSLDEYFRIWAYSSSSNPETPVKDAEGDTPSLIVRPMGQNAAKRKSKGKG

SEQ ID NO: 161301 - protein, 122 aa, Glycine max
  Coding DNA Sequence Number=SeqID_44523
MRETHEVPHHNLADFEPRLGYATKGQAVGGVSLPNTLEGPQFCPQPQPLDFAVGRVPPAMRLRAIEGGKDYAFVDMVELCLVPDVVIPPKFKVSDFDKYKGTTCPQEPPKNVLSEDGGVRER

SEQ ID NO: 161302 - protein, 140 aa, Glycine max
  Coding DNA Sequence Number=SeqID_44524
MEREMVPLIVGTLLVFYYEKLVGYMPSSFANLVFTGKRIEVGLRRSKFDHPTLMNKKPRANRENEKEGGTHVVTVVPTWSNFPPAQQYHYSANIGPSHYPPPYQPRMLNHPQRPPLNQPQSTPAAHPIPNTTLNASQNTN

SEQ ID NO: 161303 - protein, 161 aa, Glycine max
  Coding DNA Sequence Number=SeqID_44525
MRLLWLLVMSLKWNVDDVGNALTSACCVCSWGAECTDLVGWPIRGGQAWLRNLSISEGMLKRFNWFMVFGTCFWPHSYVVCCVCPWGGCIDLVGRPLYGKLKWLKNLSISEGMLRNFNSSMVIVLDGAHGTPCGPRCRVDTLRAISLVLDMVRIALHLRVE

SEQ ID NO: 161304 - protein, 219 aa, Glycine max
  Coding DNA Sequence Number=SeqID_44526
  Gene Ontology: Cellular component=periplasmic space
  Homolog annotation: Hit_ID=UPI00005F9D56; Match level="QueryCoverage =91%, HitCoverage=88%, E-value=1e-63, Identity=61%"; Hit description =COG1261: Flagellar basal body P-ring biosynthesis protein
  Pfam annotation: Domain name=SAF; Domain location=95-157; Score=68.2; E_value=2.6e-17; Accession=PF08666.2; Description=SAF domain
MTMKGKMLLLIGLLCSLNARADDLATQIESFIQGKFSGEPVQVKVRVRTQPAQWPACELPQLSLPPNARIGGNVSISARCGQERRFIQTQVQVFGRYLVSARGISAGSRLTAADLTLKEGRLDTLPPRALTEAGKALGAVSLRNISPGQPLTLAMLRRAWIIKAGQSVQVNAQGEGFNISGAGKAMNNAAAEDSVRVRMASGQIVSGVVGDDGAIRITL

SEQ ID NO: 161305 - protein, 199 aa, Glycine max
  Coding DNA Sequence Number=SeqID_44527
  Homolog annotation: Hit_ID=Q6D6I1; Match level="QueryCoverage=42%, HitCoverage=85%, E-value=1e-21, Identity=67%"; Hit description =Negative regulator of flagellin synthesis
MVDLLIEQQAIVLILFAQRLAQQLNALPAIGQGRMAGATVASSWLLASVTRCSATPGNWPEHSKSCSSSSTPLSACSVSNSLSSSCASFSIVMTYPLPLLAAAPSVAPGDPLNVALRVLQQRVGDFAGVHLQFAAADRLLDGLDPAHIDILGARLHQARLRLAQLDLRAADGRFGHGGLTRLERVVGRGFTRLHSGNRL

SEQ ID NO: 161306 - protein, 101 aa, Glycine max
  Coding DNA Sequence Number=SeqID_44528
MQVVSGSGDFVYELHVASVGGRAKLVGDFKLPQWKRQSCWRHQPRVSFSGRYTMNSIITVLYFNERVYEDNDGVIFEGSKKAIQIKRGISFNALKKKLGDK

SEQ ID NO: 161307 - protein, 132 aa, Glycine max
  Coding DNA Sequence Number=SeqID_44529
MVAWPGTQPSLHREGEGPTAQVPQHVEDESSEATILELFVLGEEAGETQVRQVAAATPERSIEATSKPLAPVVDLPSSQHTTDPSTPILEIPEDPTTPVLTMDTSPPATPVLHLTDEEDVQTQDTQDQSQEF

SEQ ID NO: 161308 - protein, 81 aa, Glycine max
  Coding DNA Sequence Number=SeqID_44530
MGSKIYPKVHENPKAFFINSSPILLEPLAHGSGNWSFPREDCITKVLSSLRLCLNMVFSLCVPDFDIWGKTNSSVRASVLG

SEQ ID NO: 161309 - protein, 322 aa, Glycine max
  Coding DNA Sequence Number=SeqID_44531
  Gene Ontology: Mol. function=DNA binding
  Homolog annotation: Hit_ID=Q1S0F5; Match level="QueryCoverage=90%, HitCoverage=58%, E-value=2e-31, Identity=31%"; Hit description=IMP dehydrogenase/GMP reductase
MDQLQHQAFRKAYEKIWDLAMIEVSVEAIASLTQYYNQPLRCFTFRDFQLVPIVEEFEEILGCPLGGRKPYLFSGLYPSKARIAKVVRIWAQELDRVKQNRNGIVEIPRKHLEEKPKALADQGEWASFIDVLALLVFGFVLFTNVDGIVDLAAIDAFLAYHHSMESPIIAILADAYDTFDRRCEKSGARIVCCTPALYVWLVLHFFRHEGRPVCPIQGHRLCAEKGKENWEQLLASVVGGSINWFPQWKEGRATVLSSCEGFSNVPLMGTRACINYNPVLAIRQLGYPMRGAPSEESITPFIARGFRDPMGGYFKESARHGA

SEQ ID NO: 161310 - protein, 194 aa, Glycine max
  Coding DNA Sequence Number=SeqID_44532
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-20, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTSLPSEDYTFSPSEDNTSSPTEDYTFSPSEGCTPSPSEGYASSPSEGYMHALRGLHVLTFRGLHALAFRGLHGLTFRGLHILTFRGLHVLAIRGLHVLTFRGLHALTFRGLHAFTFRGLHVLAFRGLHTLSFSGMHALTFRGLDALAFKGSVPGPPPDPGGGSTVRAQLEEEAIVQPLCILGQDFTCAITKR

SEQ ID NO: 161311 - protein, 64 aa, Glycine max
  Coding DNA Sequence Number=SeqID_44533
MAKFDPEIVMEFYINARPIEEGIRDISSWVRGQWIPFDADALSQFLEHPLILMCKLTIKKGKIK

SEQ ID NO: 161312 - protein, 89 aa, Glycine max
  Coding DNA Sequence Number=SeqID_44534
MGNARFLEEVEFKKEENIRKVVYEEEPVIDKTTPVTENNVQTIVDDIVQEQDNNEVLPQIPIQQPQQPQKVSLRRFDRGRRSAIPFAKL

SEQ ID NO: 161313 - protein, 327 aa, Glycine max
  Coding DNA Sequence Number=SeqID_44535
  Gene Ontology: Mol. function=nucleic acid binding; Cellular component= intracellular
  Homolog annotation: Hit_ID=Q6ZAQ9; Match level="QueryCoverage=60%, HitCoverage=20%, E-value=3e-41, Identity=50%"; Hit description =Putative S-locus protein 4
  Pfam annotation: Domain name=DUF618; Domain location=137-197; Score =8.8; E_value=0.00076; Accession=PF04818.4; Description=Protein of unknown function, DUF618
MENSRRPFDRSREPGPKKPRLMEELDRASNSGARQFHQRQVASGITTLSSARFRTNDRDLESSDFGRRGGAGGGGGGYQPQPLPFQELVAQYKAALAELTFNSKPIITNLTIIAGENQAAEKAIAATVCANILEVPSDQKLPSLYLLDSIVKNIGRDYIKYFAARLPEVFIKAYRQVDPSVHQSMRHLFGTWKGVFPPQTLQVIEKELGFTPAVNGSSSASATLRSDSQSQRPPHSIHVNPKYLERQRLQQSSRTKGVVDDITGAISNTNDDPEMPGRTLGVGRPWVDPSVTVNIHSRENEQCAHRGAFNDSVLEKSIGASYGSNEY

SEQ ID NO: 161314 - protein, 557 aa, Glycine max
  Coding DNA Sequence Number=SeqID_44536
  Homolog annotation: Hit_ID=Q6ZAQ9; Match level="QueryCoverage=32%, HitCoverage=18%, E-value=3e-22, Identity=34%"; Hit description =Putative S-locus protein 4
  Pfam annotation: Domain name=zf-C2H2; Domain location=403-425; Score =19.0; E_value=0.018; Accession=PF00096.16; Description=Zinc finger, C2H2 type
MWKEKCPWNLKPRKRGNYIDEQQSIDELNRKAGHSDRFVSTHGAIPANANSSAARMVNQPFLSNATIGLPGIAGQFHSLGAENPSGQSPLQQRSPSPPVSVHPSHPLQNLAEQDLPQNHKASQFLGGLQSQYIKDSSPAPPPSIQVGNLQSSQLKNLQGPFSSTTFQARHQHQLGSSHNEVTVKTEKPPMSEVPLARETKSNLDTGNLPSRLGVRPSRSGGPSPATLISSVSKIASPSSLGPSSDNVSVLPKIPLRKAGPPRASTLPPASSNVSSASAQTSSDTNNTLNPIANLLSSLVAKGLISAETESPAKVPSELLTRLEEQSDSITTTSSLPVASVSGSATVPVPSTKDEVDDTARTPISLSESTSPGIRNLIGLEFKPDVIREFHSSVVSGLFDNFPHQCSICGHKLRFQEQFNRHLKWHATRESEENGLISASRWYLKSNDWILGKAEYPSENEFTDSVDTYGKEADKSQEDAMVLADEKQCLCVLCGELFEDFYCQETGEWMFKGAVYLANSDSKSEMGIRDVSTGRGPIIHASCLSDNSVSSVLETGQD

SEQ ID NO: 161315 - protein, 129 aa, Glycine max
  Coding DNA Sequence Number=SeqID_44537
MARLAATKDARSVRGRHVWHSMRGRCSRDNEGGAKGPHATIKEVVVTSREGGWHDLTRLKGGALEVGAKVDGDGWWRSEVGEEELGKVGLTDSPLRITNSYEGFLHIRRYRLQIHIKVSYELSILHTDL

SEQ ID NO: 161316 - protein, 152 aa, Glycine max
  Coding DNA Sequence Number=SeqID_44538
  Subcellular localization annotation: CTP_CleavageSite=36; ConfidenceScore=5.09e-01
MSISPCGSISWSVSFRRRGSAHKTPSGPGGAQQDPRVSSSSYEPLSVLQGAHPPQKGHAIVTQGSRPQDTQWTRRSPTGPWGFQLWLQASVSPTGCPSPPARGRARRTPCGPNEVQQGPRVSKHHNILGMASNRQQMHRHHLQSPSAHPQKG

SEQ ID NO: 161317 - protein, 49 aa, Glycine max
  Coding DNA Sequence Number=SeqID_44539
MGRQYRASPVKGWEGVNNAGATYQRAMVALFPDMMHKEIDIYVDDIIAK

SEQ ID NO: 161318 - protein, 259 aa, Glycine max
  Coding DNA Sequence Number=SeqID_44540
  Gene Ontology: Mol. function=RNA-directed DNA polymerase activity; Cellular component=chromatin; Biological process=chromatin assembly or disassembly
MLMERMNQEAHHGGSSHGSGSFHRDRSYMATRQAKIDFPQFDGSDLNDWLFRCCQFFEIDGTPTEMKMKLASINLEGHPEAGVIPWETYVAALEERFGEKHKYSMSKLLSLKQLGKVSDYYDQFDYWVGRVQISGEIALGIFLNDLKPAIQHHVRSFMPASVNQAYTLAVLQETSLRTLQQEFSSNSRRSPLLPTPRIQHMNSSSTLKPTPKPFVDSKGKAVIEFDDRRSKGLCFWCDENYVKGHKCKKKELFVIEVTK

SEQ ID NO: 161319 - protein, 127 aa, Glycine max
  Coding DNA Sequence Number=SeqID_44541
  Homolog annotation: Hit_ID=Q1SIN2; Match level="QueryCoverage=39%, HitCoverage=7%, E-value=9e-07, Identity=46%"; Hit description=Zinc finger, BED-type predicted
MSGVEKSMEMMKKLKELIHKLIQQYVLEHSISYSISNSANSSTLASNMASQRNDDNNDKDDEFRMKMKKKQGEVQKNELYRYLEDDVEDDHPEFDILNWWKLKLFDLILNSANIKTSSVGTAGVGTS

SEQ ID NO: 161320 - protein, 74 aa, Glycine max
  Coding DNA Sequence Number=SeqID_44542
MVFTSLHFPFPCETNKELLPCIKIPPLSSFKPKLCWVPDNSSPWRNILNNHRTRTKRLDKFQGMLPTEWQTSCL

SEQ ID NO: 161321 - protein, 181 aa, Glycine max
  Coding DNA Sequence Number=SeqID_44543
  Gene Ontology: Biological process=response to stress
  Pfam annotation: Domain name=Usp; Domain location=2-124; Score=44.2; E_value=4.5e-10; Accession=PF00582.16; Description=Universal stress protein family
MDVKKIVVVVEDVNAARTALEWALRNIIRYGDIITLLHVYNHSTRSRSRSKARLLRLNGFKLALSFQDMCNSYPNTKVEIIVIEGDQEGTKIAATVREIGASMLVVGLHDYSFLYNLKRFMQVSFKNWSRKAFANARAFFNGDKAFWDPLLILICFAFKRSTHVAFRDDYALTMYLCSNLM

SEQ ID NO: 161322 - protein, 180 aa, Glycine max
  Coding DNA Sequence Number=SeqID_44544
  Subcellular localization annotation: CTP_CleavageSite=98; ConfidenceScore=5.04e-01
MLFPPLTSNQSQKTRVSIRGNIRTTSILGNPPTTKDNLWAFHLRATAIVQHIVGSCNVIKLKSNLKNVKSSLNSALTAHVALAGDNVTLKEKVVSDPSLDMKGHSQLAIYFPSTESFLASPQTLQKRFPSLYFLDLSFDLKRQVIRHLHALVMIIAPSRTCSMRSKSICSASLFSASIKF

SEQ ID NO: 161323 - protein, 58 aa, Glycine max
  Coding DNA Sequence Number=SeqID_44545
MGSTKGHTKEFEEGVANNIVNSKRVKGDANDVAIAIGVEADESDHLVEVHPKRRQRVV

SEQ ID NO: 161324 - protein, 105 aa, Glycine max
  Coding DNA Sequence Number=SeqID_44546
GNTGSNKDRRKSLKVYQSHTVRGEKIASTQDFVGNQRERTTLGRGFLFLVYMVTILYCSDIVWSKDLSGWQGLTFSPWVKVYDKLGFWLKACRTAGHDICQGLAS

SEQ ID NO: 161325 - protein, 71 aa, Glycine max
  Coding DNA Sequence Number=SeqID_44547
MKSIGCCHTLISSGDYCLMACNLWLTASRYLAPFVSQYVKFRDMPERKHCYAIREIPLRAGNQEEVLLCNP

SEQ ID NO: 161326 - protein, 85 aa, Glycine max
  Coding DNA Sequence Number=SeqID_44548
MDMSSTTHLGHPKEEIQVEDQIDLSSNIEELTKYKIQVRFEVNTTKKNLGKLNFPKTREEKHRDQPPREPLYAQYTNLNANRSMI

SEQ ID NO: 161327 - protein, 122 aa, Glycine max
  Coding DNA Sequence Number=SeqID_44549
MNPVPSEVANCRNLPFCGRAKRGSQDACSKKGIRAESPPTFICGKRRKNQRKPVIKNIPSSGVVFTFEEEVDKSGALAPTYPPSKRKSDLHSSFLRVNQAILFTWKVVILRRWTLKMILFTW

SEQ ID NO: 161328 - protein, 230 aa, Glycine max
  Coding DNA Sequence Number=SeqID_44550
  Gene Ontology: Mol. function=kinase activity; Cellular component =intracellular; Biological process=proteolysis
  Homolog annotation: Hit_ID=Q8LAR3; Match level="QueryCoverage=68%, HitCoverage=37%, E-value=5e-46, Identity=53%"; Hit description =Phosphatidylinositol-4-phosphate 5-kinase, putative
  Pfam annotation: Domain name=MORN; Domain location=114-136; Score =15.9; E_value=0.047; Accession=PF02493.10; Description=MORN repeat
  Pfam annotation: Domain name=MORN; Domain location=137-159; Score =20.0; E_value=0.0086; Accession=PF02493.10; Description=MORN repeat
  Pfam annotation: Domain name=MORN; Domain location=160-182; Score =32.3; E_value=1.7e-06; Accession=PF02493.10; Description=MORN repeat
  Pfam annotation: Domain name=MORN; Domain location=183-205; Score =19.8; E_value=0.0098; Accession=PF02493.10; Description=MORN repeat
  Pfam annotation: Domain name=MORN; Domain location=206-228; Score =19.2; E_value=0.015; Accession=PF02493.10; Description=MORN repeat
  Pfam module annotation: Pfam domain module=MORN::MORN::MORN::MORN::MOR N; Domain location=114-136::137-159::160-182::183-205::206-228
MEKLKDLIKQVAPTGVPLMEFTDHNWLDDFFRQRGHSKYFENLIEYDITGLKNDEDVLKRLWEENVKRLGFSKAAAARPVQWFTREPAATTTRKAVAAKRVREGVEFYSNGDFYEGVFHKGRSNGSGVYHYFVNGRYEGDWVDGRYDGYEIESWARGSRYRGQYRQGLRHGYGVYRFYTGDSYSGEWCNDQSHGVGLQTCSDASCYIGQFKYGVKHGVGCYHFRVSLFSF

SEQ ID NO: 161329 - protein, 128 aa, Glycine max
  Coding DNA Sequence Number=SeqID_44551
  Subcellular localization annotation: CTP_CleavageSite=39; ConfidenceScore=5.34e-01
MSCLPYIAKGSSIDQVSSHDLNRLGQFATSRRRVPRRVHGQVRKCLNLEVALHSMLLTLCPDKLCERAKGYIQMEEMSKFWNEVRQAGQKCDKREAYTKADLHKSDKRHKPNKHQPLSKGPKYERYTP

SEQ ID NO: 161330 - protein, 178 aa, Glycine max
  Coding DNA Sequence Number=SeqID_44552
YILYGTSRGYIYLGCNTENKRGYISCGSVQVEGTSTWLFKENKGGYIPCGSLLVKDFTRLLEISRTGGCLGTGCIQVLVWVCCLIVPLEVKWFSLQGYVCLHNTVNKRMPTDSHARRCMCERLRSSTILYPPTGHGQPLALSTPPRGVSPSPRCGFGVVGDLTSEAKLSANHGWMSEN

SEQ ID NO: 161331 - protein, 178 aa, Glycine max
  Coding DNA Sequence Number=SeqID_44553
MVTKTLNFEHSNIQVKDFIMGSGDSYEGPFRTQFFRVFGLGRGPFSVKSQLYARAFSFCVVSLGSEKPSSLEFYDTPPPKPNQDGNTNSFIMVPLSDNSRYHFYNFVQFVGIAINGLNFVFFKLDNNQLIFSTKEGTICLSFAEGNSALNVIGSNNLQGTLLTYDLVNENIVFTYNEC

SEQ ID NO: 161332 - protein, 59 aa, Glycine max
  Coding DNA Sequence Number=SeqID_44554
MAFKKSSPACLRASFNAKFLLFDSALNPDKSRLAEHAARMIQIYTASHPGQVNASTELT

SEQ ID NO: 161333 - protein, 175 aa, Glycine max
  Coding DNA Sequence Number=SeqID_44555
MIIDQSLLFSLTKLPSQGAPFEGTIVDDWKFDYSSHDARRMIDWAYLVRYRMHKALRANAPLPYPQLVTLFLHHFQIPLDDEPFVQVKRSFAIGAGAVTSFGYRKDRNGQWLKKDALPPQDERTPSPPPQRDDSALMTEVLSELRGLRTYVGERFDSWIIALPEWISVSHSLKKM

SEQ ID NO: 161334 - protein, 314 aa, Glycine max
  Coding DNA Sequence Number=SeqID_44556
  Gene Ontology: Mol. function=transferase activity, transferring nitrogenous groups; Cellular component=intracellular; Biological process=regulation of transcription, DNA-dependent
  Homolog annotation: Hit_ID=UPI00005F8564; Match level="QueryCoverage =48%, HitCoverage=32%, E-value=1e-32, Identity=49%"; Hit description =COG1167: Transcriptional regulators containing a DNA-binding HTH domain and an ...
  Homolog annotation: Hit description=aminotransferase domain (MocR family) and their eukaryotic orthologs
KTLFPALRMAYLVVPVGLTETFACSSRLRGCGCPPLLQAGVADFIRQGHFYRHLKRMRPLYRQRREWLTQALERQLGAWLRVVPQQGGIQLLARLRDGVADTPLAAQAWQLGLAAQALSDWRIDHPAGQGLLLGFANFTRQEETERAVQGLAQLGVNAGPAARRARCRRRHRSLRPAKTGGAIEPRSRVAQHAFRLAVQLFQFLFGLVTGLAQHFIQRIGQQSDVLIDIAFCSFRFLKHSALHFDTCLLSVDHGAICVADHGKKTAVTQVFACAWALYIWLLGETNHSRKRQFDSTSICFNGSTGAYRNNTLRM

SEQ ID NO: 161335 - protein, 211 aa, Glycine max
  Coding DNA Sequence Number=SeqID_44557
  Homolog annotation: Hit_ID=Q74SV4; Match level="QueryCoverage=37%, HitCoverage=48%, E-value=1e-18, Identity=56%"; Hit description =Putative membrane protein
VDEQQVSRLVHLFGVAVVQHADKGLALAAAHLLDHRFNQHRLDPQQMGQRIDGFAGVGRQDAVTDDKYDDQGGEDDPGHLGFITLSIRQKRGGRRCATAPAINAVVIEGGRVFGQRVQMGAEHFDLLHQRMLLRHRTGGAQFARQLFILRPQRGFALFGFFQQLLQRLVALLPFAVLPFEAALQLIHRILKLDFQLAHCHGLDPLRHSMMA

SEQ ID NO: 161336 - protein, 222 aa, Glycine max
  Coding DNA Sequence Number=SeqID_44558
  Homolog annotation: Hit_ID=P76053; Match level="QueryCoverage=85%, HitCoverage=100%, E-value=4e-54, Identity=56%"; Hit description =Hypothetical protein ydaL
  Pfam annotation: Domain name=Smr; Domain location=123-204; Score =94.8; E_value=2.7e-25; Accession=PF01713.11; Description=Smr domain
MPLTIPGLQPWQGVLQSTPFPAVKAAVQERWKMSEQEKDFFEQAMADVVPLASGRQTLYLKPQETVDKSARREAQRLRQENFLSTDFLEVIPCEQPLEFKGEGIQQGVLDKLRNGRYPPQASLNLLRQSVEASRQALFRFIVQAEAQNLRSLLIVHGRGRQNESHPNIVRSYVAKWLAQFEQVQAFCRALPRDGGEGACYVTLRKSAQARAENFERHAKRSR

SEQ ID NO: 161337 - protein, 179 aa, Glycine max
  Coding DNA Sequence Number=SeqID_44559
TTKALEQETKRARREEHGRNKFRGALWGSNSELKLRREERDQSRVDNLLLKDELRICLRSKRSLSQRLCETETNMLAIISKYQEELNLATTHEHKVADEYARVYAEKEARGRVIDSLHQEATMWMDRFALTLNGSQELPRLLAKAKAMADAYSAPQEIHGLLSYCQHMIDLMAHIIRNR

SEQ ID NO: 161338 - protein, 457 aa, Glycine max
  Coding DNA Sequence Number=SeqID_44560
  Gene Ontology: Mol. function=protein binding; Cellular component =integral to membrane; Biological process=defense response to fungus
  Homolog annotation: Hit_ID=Q1T435; Match level="QueryCoverage=75%, HitCoverage=81%, E-value=1e-51, Identity=36%"; Hit description =Leucine-rich repeat; Leucine-rich repeat, cysteine-containing type
  Pfam annotation: Domain name=LRRNT_2; Domain location=38-80; Score =47.6; E_value=4.2e-11; Accession=PF08263.3; Description=Leucine rich repeat N-terminal domain
  Pfam annotation: Domain name=LRR_1; Domain location=113-135; Score =13.0; E_value=1; Accession=PF00560.23; Description=Leucine Rich Repeat
  Pfam annotation: Domain name=LRR_1; Domain location=138-160; Score =12.1; E_value=1.5; Accession=PF00560.23; Description=Leucine Rich Repeat
  Pfam annotation: Domain name=LRR_1; Domain location=162-185; Score =9.1; E_value=5.8; Accession=PF00560.23; Description=Leucine Rich Repeat
  Pfam annotation: Domain name=LRR_1; Domain location=187-209; Score =14.2; E_value=0.47; Accession=PF00560.23; Description=Leucine Rich Repeat
  Pfam annotation: Domain name=LRR_1; Domain location=211-233; Score =14.5; E_value=0.38; Accession=PF00560.23; Description=Leucine Rich Repeat
  Pfam annotation: Domain name=LRR_1; Domain location=260-285; Score =4.2; E_value=47; Accession=PF00560.23; Description=Leucine Rich Repeat
  Pfam annotation: Domain name=LRR_1; Domain location=288-311; Score =8.5; E_value=7.5; Accession=PF00560.23; Description=Leucine Rich Repeat
  Pfam annotation: Domain name=LRR_1; Domain location=317-339; Score =10.0; E_value=3.8; Accession=PF00560.23; Description=Leucine Rich Repeat
  Pfam annotation: Domain name=LRR_1; Domain location=342-363; Score =10.1; E_value=3.7; Accession=PF00560.23; Description=Leucine Rich Repeat
  Pfam annotation: Domain name=LRR_1; Domain location=365-388; Score =5.6; E_value=26; Accession=PF00560.23; Description=Leucine Rich Repeat
  Pfam annotation: Domain name=LRR_1; Domain location=390-415; Score =8.5; E_value=7.4; Accession=PF00560.23; Description=Leucine Rich Repeat
  Pfam annotation: Domain name=LRR_1; Domain location=419-442; Score =7.1; E_value=13; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=38-80::113-135::138-160::162-185::187-209::211 -233::260-285::...
  Pfam module annotation: Domain location=288-311::317-339::342 -363::365-388::390-415::419-442
MSCYSLKLFYALLLLLLHAAGSILGFNSLPNSTEIKCIQTERQALLNFTHGLKDDSGMLSTWRDDGNNRDCCKWKGIQCNNQTGHVEMLHLRGQDTQYLIGAINISSLIALENIEHLDLSYNDFQRSHIPELMGSFTNLRYLNLSASSFRGTIPSDIGKLTHLLSLDLGGNSYLHGQIPYQLGNLTHLQYLDLSYNYLDGELPYQLGNLSQLRYLDLGGNSFSGAVPFQAGNLPLLHTLGLGGNFDVKSKDAEWLTNLSSLTKLELSSLHNLSSSHHWLQMISKLIPNLRELRLFDCSLSDTNIQSLFYSPSNFSTALTILDLSSNKLTSSTFQLLSNFSLNLQELYLGDNNIVLSSPLCPNFPALVILDLSYNNMSSSVFQGGFNFSSKLQNLDLHNCSLTDESFLMSSSFIMSSSSSLVSLDLSSNLLKSSTIFYWLFNSTTNLHKLSLYHNMLE

SEQ ID NO: 161339 - protein, 87 aa, Glycine max
  Coding DNA Sequence Number=SeqID_44561
MTTGVPSHVRICSKDLKLSLLERSLKRYSVDMQELGSRGRTSFVLIGCERSDEYRCRKKEFIRRDTGTGKCGCPFKLRCKPVVGGED

SEQ ID NO: 161340 - protein, 75 aa, Glycine max
  Coding DNA Sequence Number=SeqID_44562
MGWDTGRHVEYYGSKMRITHSNLNFLMLLITKNVGITPLHGREKMPFIIFSFLLLCVYSSYALKHCYLCSDSPSV

SEQ ID NO: 161341 - protein, 153 aa, Glycine max
  Coding DNA Sequence Number=SeqID_44563
  Gene Ontology: Mol. function=protein binding; Cellular component =integral to membrane; Biological process=xylan catabolic process
  Homolog annotation: Hit_ID=Q949G8; Match level="QueryCoverage=95%, HitCoverage=43%, E-value=2e-30, Identity=40%"; Hit description =HcrVf2 protein
  Pfam annotation: Domain name=LRR_1; Domain location=103-125; Score =13.2; E_value=0.97; Accession=PF00560.23; Description=Leucine Rich Repeat
  Pfam annotation: Domain name=LRR_1; Domain location=127-146; Score =11.9; E_value=1.7; Accession=PF00560.23; Description=Leucine Rich Repeat
  Pfam annotation: Domain name=LRR_1; Domain location=54-76; Score =13.1; E_value=1; Accession=PF00560.23; Description=Leucine Rich Repeat
  Pfam annotation: Domain name=LRR_1; Domain location=78-100; Score =12.8; E_value=1.2; Accession=PF00560.23; Description=Leucine Rich Repeat
  Pfam module annotation: Pfam domain module=LRR_1::LRR_1::LRR_1::LRR _1; Domain location=103-125::127-146::54-76::78-100
  Subcellular localization annotation: CTP_CleavageSite=66; ConfidenceScore=5.31e-01
MGLLNMSSNYLIGAIPNISLKLPNRPSILLNSNQFEASNKLSGKIPMSMGALVNMEVLVLRNNGLMGELPSSLKNCSSLIMLDLSENMLSGPIPSWIGESMHQLIILNMRGNHLSGNLPIHLCYLNRIQLLDLSRNNLSSGIPSCLNVPIHLC

SEQ ID NO: 161342 - protein, 180 aa, Glycine max
  Coding DNA Sequence Number=SeqID_44564
  Gene Ontology: Mol. function=ATP-dependent helicase activity; Cellular component=nucleus; Biological process=rRNA processing
  Homolog annotation: Hit_ID=Q9LIH9; Match level="QueryCoverage=62%, HitCoverage=20%, E-value=3e-45, Identity=77%"; Hit description=DEAD -box ATP-dependent RNA helicase 51
MQGHPKFSRDWIVQYDPPDEPKEYIHRVGRTARGEGGKGNALLFLIPEELQFLHYLKAAKVPVKEYAFDHKKLANVQSQLEKLVAGIYHLNVMAKDAYRSYILAYNSHSMKDIFNVHRLDLQVELSHYILHYCYFHDLLNCLNIHAHQIEHTLSELPLEGVHAYTLTYLTYLALLEGVHA

SEQ ID NO: 161343 - protein, 382 aa, Glycine max
  Coding DNA Sequence Number=SeqID_44565
  Gene Ontology: Mol. function=ATP-dependent helicase activity; Cellular component=nucleus; Biological process=rRNA processing
  Homolog annotation: Hit_ID=Q6CXB7; Match level="QueryCoverage=79%, HitCoverage=63%, E-value=1e-101, Identity=64%"; Hit description=ATP -dependent RNA helicase HAS1
  Pfam annotation: Domain name=DEAD; Domain location=85-261; Score= -36.2; E_value=0.0064; Accession=PF00270.19; Description=DEADDEAH box helicase
  Pfam annotation: Domain name=Helicase_C; Domain location=331-382; Score=0.8; E_value=0.013; Accession=PF00271.21; Description=Helicase conserved C-terminal domain
  Pfam module annotation: Pfam domain module=DEAD::Helicase_C; Domain location=85-261::331-382
MAEAEHNDPTSPEREVQTKSNKKKLRKRKRPHKTEQKRDEDKNDANIDSAQTQTEDEEEEQKEEDTNNFSSGIMSTESFSSLGLSEPTSKAIADMGFHHSSEGNSAASDQEGRSGRGENGCGKNPSVFSSGGGVAVQHSVHASERDGCCCDMPDEGAGDSDARRGEGAAEVSLADAWVGDWGFREEGRGGAHCERGEPVGGDARKASRSPPEYEGCLMIDEADRILEANFEEEMKQIINILPKKRQTALFSATQTKKVEDLARLSFQATPIYIDVDDGRKKVTNEGLQQGYVVVPCAKRFVVLYSFLRRYQSKKVMVFFSSCNSVKFHADLLKCTGLDCLNIHGKQKQHARTTTFFNFCKAEKGILLCTDVAARGLDIPDVV

SEQ ID NO: 161344 - protein, 118 aa, Glycine max
  Coding DNA Sequence Number=SeqID_44566
MTKGEAVQRRGDDEGGDTTTIYKEAWREVVSHNMECENEGHTMMKEKRRSRSDCVLFRDKLLQVAYPNNTTTIYKEAWWEVVSHNMECENEGHTMMKEKRRSRSDCVLFRGSPIQNIH

SEQ ID NO: 161345 - protein, 135 aa, Glycine max
  Coding DNA Sequence Number=SeqID_44567
  Gene Ontology: Mol. function=nucleic acid binding
MHFGRDLKIDRNCKRRIMIICKPDYLWNSYYVKIRDKKTRQLRTCRDEHTCSRKYNTKLLKSSWLSTRLLQGLRENPNMSLLGIRNRVHEQWNADIIRTKAFRARATAKDMVQGSFNEQFTRKHDYCHELLRSNE

SEQ ID NO: 161346 - protein, 117 aa, Glycine max
  Coding DNA Sequence Number=SeqID_44568
MVDIAASQGIVHLYVENFVEEVEVLNFCQVVSMIIYKMQPLINIVVCFCLINSSSNVEQSIGDHIARLELDVEMHHQSKQNPQPEVHHQFEHNSQPPQPQVPILAPNIGSSKPLIAS

SEQ ID NO: 161347 - protein, 162 aa, Glycine max
  Coding DNA Sequence Number=SeqID_44569
MDVSLRIIMGGILAIVSRDPNDQKLHFAFVVVKGENTQSWEWFLDLLIKDLGGIEHFESTYAIISYQQKVLNENSLRHWNLKNLGGKRLEKPQAQQAECLGEECNKNVQGMDNQTTTKELVLYLHHPKPKPNLNPNKLLHPGPNNLHQPKNHLRQNSKQRGR

SEQ ID NO: 161348 - protein, 490 aa, Glycine max
  Coding DNA Sequence Number=SeqID_44570
  Gene Ontology: Mol. function=hydrolase activity, hydrolyzing O -glycosyl compounds; Biological process=carbohydrate metabolic process
  Homolog annotation: Hit_ID=Q3QM83; Match level="QueryCoverage=59%, HitCoverage=25%, E-value=3e-86, Identity=53%"; Hit description =Glycoside hydrolase, family 31:Coagulation factor 5/8 type, C -terminal precursor
CGQQHAGQAAGHGEGAVAAGRRHQQRAGIGTAGTTTGEFAIGVAGDVEEACLIHIGAHAVHRGHAFRTGTTAAKRDQQGGAVALQVQRRMGQQAGGVHHAHLGRPLRVDRIGHHLGDEAGAAGAGEQHALVGIVEAAAEEGLQAVAGTRQILGEGFPQRWLLGDFGSGIGSAKALPGGHIGKQVGPTAFETPGERVGSPCGNLRSSLAADAGSVAGIDGWDLQTDKGARLRIELPATDIIRVQAGRNGTLTGAGDKAAPIVLPQPKANVQAQLEEDAQEIRVRTDALVLHVQRQPLRMRLERLDNGQPTALWQELQPLDLDAAQSVQVLSSQADEGYFGGGQQNGRYQFKGRELEVSYSGGWEEGDRPSPAPMLLSSRGWGMLRNTWSDGSYDLRQSDQATLLHREDRFDAYYFVGADLPKLIERYTQLTGRPNMVARWALSYGDADCYNDGDNSKKPGTVPEGWSDGPTGTTPDVIDSVAKQYRAHDMP

SEQ ID NO: 161349 - protein, 82 aa, Glycine max
  Coding DNA Sequence Number=SeqID_44571
MTTEAAKEIAAKIDSFEDQATQGSFVPHGCQDVLAAAIGRPEHLGRVRAAGAGVTIKQYFGSAPWTSRSSSSLPPEELQQLT

SEQ ID NO: 161350 - protein, 52 aa, Glycine max
  Coding DNA Sequence Number=SeqID_44572
MELLKDVKRLGSSWVGQARCKGRTTKNKARVRVGLAVKVQRKKEERLARSEI

SEQ ID NO: 161351 - protein, 83 aa, Glycine max
  Coding DNA Sequence Number=SeqID_44573
MHAIVDLFEIPEQFHNLQATVSDATSLAIIHGFSFMDAFLRLNTSANCLRWTQITVECSPKALSIWLKAPKLFPVTWYLPPYG

SEQ ID NO: 161352 - protein, 165 aa, Glycine max
  Coding DNA Sequence Number=SeqID_44574
MTHSLNDVEAIHATPVSICNPTNYDIGCDDVVNNQKNENEIPPATQNSKPKRGRPFKTPPESIKNWYVIRKERKIANRFDTTYIHKETGFRCRSLKEIKNYEKYGSPPRRQKVKAQAKEESNDKTKNETEEMVVAQRKQKAEVMRTFVEEFLSEAYHNQLHMFDP

SEQ ID NO: 161353 - protein, 58 aa, Glycine max
  Coding DNA Sequence Number=SeqID_44575
MAMLVSTCYRTPESGIFFMTGFLRFFRRFPQINVGGDSAHFPPLEDAPVSLASLARKR

SEQ ID NO: 161354 - protein, 112 aa, Glycine max
  Coding DNA Sequence Number=SeqID_44576
  Homolog annotation: Hit_ID=Q9ZVF7; Match level="QueryCoverage=56%, HitCoverage=11%, E-value=9e-22, Identity=75%"; Hit description =Similar to axi 1 protein from Nicotiana tabacum
LCCGDAETLIPNAPVQPATKQRALDAVAAAVAAPLAEAPPRREVQGRAGVFLFAPLIYISGMLLYMGTASFDVVPVIKHRPAPGSVYRSPQLFAKLRLDMDSDNSSADAVIP

SEQ ID NO: 161355 - protein, 130 aa, Glycine max
  Coding DNA Sequence Number=SeqID_44577
MYPDGCRETQGTRTERRHANRGRILAFKMSNFSLLVAEYEVTSRGKEISAALLLPSTKLFLLPSSPPLFSIKAPKFLLISTPNCKEKPFLESWSTPLHCGASNFRKLVEMMGRVNLGLNESLGRANEKNE

SEQ ID NO: 161356 - protein, 317 aa, Glycine max
  Coding DNA Sequence Number=SeqID_44578
  Homolog annotation: Hit_ID=Q1SS26; Match level="QueryCoverage=64%, HitCoverage=24%, E-value=4e-11, Identity=22%"; Hit description =Unnamed protein product; no similarity, hypothetical start
MAWIILDPKYLDIAFFNDETFDCYQVFQNSGLVDFMSLKLPYYPELVRVFYSNLKIQDGTIHSEVHGISIIIDQSLFFLLTKLPSQGAPFEGTIVDDWKFDYFSNDAHHMVCNDQADMTGRLLAGSLTFDCRIMHYIIVRILLPRSSNLAQASEEDLILMWDFVTGRQIDWAHLVRYRMHKALRANAPLLYPQLVTLFLRHFQIPLDDEPFVQVKRYFAIGAGAVTSFGYRKDHDGQWLKKDVHPPQDERTPSPPPQRDDSSALMNKVLSEFRGLRTYVGEHFDSLDGRLGGMDTRITQLEEDVSYLRRCFDLPPPS

SEQ ID NO: 161357 - protein, 131 aa, Glycine max
  Coding DNA Sequence Number=SeqID_44579
  Gene Ontology: Mol. function=microtubule motor activity; Cellular component=microtubule associated complex; Biological process =microtubule-based movement
MPASTRSQTVPNESNSEHDALKEKMKSLLALYEQHKQKHGAAAAAPPPSKNPSLKTGTRILVFVRVRPLAKKEMEAGSRCCVRIVDRRDVYLTEFASEKDYLRLKRLRGRHFAFDASFPDSATQQDVYSTT

SEQ ID NO: 161358 - protein, 94 aa, Glycine max
  Coding DNA Sequence Number=SeqID_44580
  Gene Ontology: Mol. function=protein dimerization activity
  Homolog annotation: Hit_ID=Q9XIM5; Match level="QueryCoverage=67%, HitCoverage=13%, E-value=3e-11, Identity=46%"; Hit description=Ac -like transposase
MMVAKFEKYWEKYSVVLALGAVLDPHTKLSLLEYSYSKVDASTSESKLESIKNKLYKIFEYHSFKEQNTTTTQGTPTSNIVNEPKFSLSYCLMN

SEQ ID NO: 161359 - protein, 216 aa, Glycine max
  Coding DNA Sequence Number=SeqID_44581
  Gene Ontology: Mol. function=microtubule motor activity; Cellular component=microtubule associated complex; Biological process =microtubule-based movement
  Subcellular localization annotation: CTP_CleavageSite=58; ConfidenceScore=5.67e-01
MQLARQHQKIMTLQAHSSAPPTPPSATSLLSTPPTSAPPSEKRRTRPSLLAATHFTPEAKNKGDEVAVTIRTLQQRVKALEAELERVKKDYSLQLKQKDDVIRELSQKGGKKVVATRASLRPKEANTGELKSPSYRFWSPVQTAKKRSFWDITTANSPSVTTLNGRKTRSHLISEPTAHPSMLLQLLGLYYSARICSKKGRYLNVGSSWKELQEEV

SEQ ID NO: 161360 - protein, 85 aa, Glycine max
  Coding DNA Sequence Number=SeqID_44582
MTRTSSPTQQHDSDDEDHHDASSSAPKPNLNKAEAQKALHGGFHKLKTQNARELLGAPSIFAGTPNNFPKYQKCPYGYFWLQITY

SEQ ID NO: 161361 - protein, 37 aa, Glycine max
  Coding DNA Sequence Number=SeqID_44583
MDKGEAMVVKLGGGLVVGRVITAPEEGVRFVNPNGPG

SEQ ID NO: 161362 - protein, 104 aa, Glycine max
  Coding DNA Sequence Number=SeqID_44584
  Gene Ontology: Mol. function=DNA binding; Biological process=DNA integration
MDQNARARGIEVDKAKIDVIAKLPPLNSKRRLIQWILLLQEFDLEIKGKKGCENIVANHLPHLVDEDVTLKEDEIRKEFLDEALMLVNERPWNLLIHLMIVSCI

SEQ ID NO: 161363 - protein, 198 aa, Glycine max
  Coding DNA Sequence Number=SeqID_44585
  Gene Ontology: Mol. function=RNA-directed DNA polymerase activity; Cellular component=intracellular; Biological process=RNA-dependent DNA replication
  Homolog annotation: Hit_ID=Q1S3H4; Match level="QueryCoverage=98%, HitCoverage=78%, E-value=1e-25, Identity=48%"; Hit description =Integrase, catalytic region
MGCENLVATHLYRLVNENVTLKKSEIRKEFLDEALMLVKERPWFADTTNFKTVGIILEGVNNFLRRCVPMKKEAKSIMWHCHNSPYGDHYNGGRTATKVLQSGFYWTSIFKDAHAHAQERVKACHEKKLLKKESYVRQQVLLFNLRLKLFPGKLKFKWSRPFIIKKVKPFGAVELVEPSSFEPKRSWIVYGQRLKSYN

SEQ ID NO: 161364 - protein, 56 aa, Glycine max
  Coding DNA Sequence Number=SeqID_44586
MGKLECGSPFWMIDVVPQTCLSVTLHGLKLQFLEAAMFQPLSGLSVVLLSLKQQVS

SEQ ID NO: 161365 - protein, 138 aa, Glycine max
  Coding DNA Sequence Number=SeqID_44587
MEAIKEQMATMMKAMMSMKKIMEANAVVVAAISAVAKVNPMLPSGLKQMNHPTSNMAHISQTMEETHEIPHHNLADFEPWLGYTTEGQAVGGIPLQNPLEGPQYHPQLHLLHSTAVKNPHDYGRNGKVGSSRGKAQGH

SEQ ID NO: 161366 - protein, 564 aa, Glycine max
  Coding DNA Sequence Number=SeqID_44588
  Gene Ontology: Mol. function=protein binding; Cellular component =integral to membrane; Biological process=xylan catabolic process
  Homolog annotation: Hit_ID=Q949G8; Match level="QueryCoverage=89%, HitCoverage=83%, E-value=4e-89, Identity=30%"; Hit description =HcrVf2 protein
  Pfam annotation: Domain name=LRR_1; Domain location=119-141; Score =11.8; E_value=1.8; Accession=PF00560.23; Description=Leucine Rich Repeat
  Pfam annotation: Domain name=LRR_1; Domain location=148-170; Score =8.7; E_value=6.7; Accession=PF00560.23; Description=Leucine Rich Repeat
  Pfam annotation: Domain name=LRR_1; Domain location=15-41; Score=6.5; E_value=17; Accession=PF00560.23; Description=Leucine Rich Repeat
  Pfam annotation: Domain name=LRR_1; Domain location=172-195; Score =13.4; E_value=0.81; Accession=PF00560.23; Description=Leucine Rich Repeat
  Pfam annotation: Domain name=LRR_1; Domain location=197-220; Score =13.2; E_value=0.98; Accession=PF00560.23; Description=Leucine Rich Repeat
  Pfam annotation: Domain name=LRR_1; Domain location=221-243; Score =7.3; E_value=12; Accession=PF00560.23; Description=Leucine Rich Repeat
  Pfam annotation: Domain name=LRR_1; Domain location=245-268; Score =15.4; E_value=0.2; Accession=PF00560.23; Description=Leucine Rich Repeat
  Pfam annotation: Domain name=LRR_1; Domain location=270-293; Score =6.4; E_value=18; Accession=PF00560.23; Description=Leucine Rich Repeat
  Pfam annotation: Domain name=LRR_1; Domain location=315-333; Score =0.8; E_value=2e+02; Accession=PF00560.23; Description=Leucine Rich Repeat
  Pfam annotation: Domain name=LRR_1; Domain location=341-362; Score =11.6; E_value=1.9; Accession=PF00560.23; Description=Leucine Rich Repeat
  Pfam annotation: Domain name=LRR_1; Domain location=365-387; Score =12.8; E_value=1.1; Accession=PF00560.23; Description=Leucine Rich Repeat
  Pfam annotation: Domain name=LRR_1; Domain location=389-411; Score =11.2; E_value=2.3; Accession=PF00560.23; Description=Leucine Rich Repeat
  Pfam annotation: Domain name=LRR_1; Domain location=413-435; Score =11.2; E_value=2.3; Accession=PF00560.23; Description=Leucine Rich Repeat
  Pfam annotation: Domain name=LRR_1; Domain location=438-460; Score =13.2; E_value=0.97; Accession=PF00560.23; Description=Leucine Rich Repeat
  Pfam annotation: Domain name=LRR_1; Domain location=44-67; Score=7.1; E_value=13; Accession=PF00560.23; Description=Leucine Rich Repeat
  Pfam annotation: Domain name=LRR_1; Domain location=462-484; Score =12.9; E_value=1.1; Accession=PF00560.23; Description=Leucine Rich Repeat
  Pfam annotation: Domain name=LRR_1; Domain location=541-563; Score =15.0; E_value=0.27; Accession=PF00560.23; Description=Leucine Rich Repeat
  Pfam annotation: Domain name=LRR_1; Domain location=70-92; Score=3.6; E_value=59; Accession=PF00560.23; Description=Leucine Rich Repeat
  Pfam annotation: Domain name=LRR_1; Domain location=95-117; Score =17.6; E_value=0.046; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=119 -141::148-170::15-41::...
  Pfam module annotation: Domain location=172-195::197-220::221 -243::245-268::270-293::315-333::341-362::365-387::389-411::413 -435::438-460::44-67::462-484::541-563::70-92::95-117
  Subcellular localization annotation: CTP_CleavageSite=51; ConfidenceScore=5.66e-01
MTSSVFQGGFNFSSKLQNLDLQNCSLTDESFLMSSSFIMRSSSSLVSLDLSSNLLKSSTIFYWLFNSTTNLHDLLLYNKMLEGPIPDGFGKVMNSLEILHLSSNKLQGEIPSFFGNMCALQRLDLSNNKLNGEFSSFFRNSSWCNRHIFKSLDLSYNRLTGMLPKSIGLLSELEDLNLAGNSLEGDVTESHLSNFSKLEYLDLSGNSLSLKFVPSWVPPFQLEYLRIRSCKLGPTFPSWLKTQRSLSELDISDNGINDSVPDLFWNNLQYMVFLNMSHNYLIGSIPNISLKLPLRPSILLNSNQFEGKIPSFLLQASQLMLSENNFSDLFSFLCDQSTASNLATLDVSHNQIKGQLPDCWKSVKQLLFLDLSSNKLSGKIPMSMGALVNMEALVLRNNGLMGELPSSLKNCSSLFMLDLSENMLSGPIPSWIGESMQQLIILNMRGNHLSGNLPIHLCYLNCIQLLDLSRNNLSRGIPSCLKNFTAMSEQSINSSDTMSRIYWYNNTYFEIYGLYSFGGYTLDITWMWKGVEQGFKNPELKLKSIDFSSNNLTGEIPKEVGYLL

SEQ ID NO: 161367 - protein, 64 aa, Glycine max
  Coding DNA Sequence Number=SeqID_44589
MDRCRAATSLPSIKKELEHFQALAEAQFPKDIIIIENPRPIIRLITTYHQLELAWTKFPRPCET

SEQ ID NO: 161368 - protein, 134 aa, Glycine max
  Coding DNA Sequence Number=SeqID_44590
  Gene Ontology: Mol. function=kinase activity; Cellular component =nucleus; Biological process=regulation of progression through cell cycle
  Homolog annotation: Hit_ID=Q39877; Match level="QueryCoverage=80%, HitCoverage=31%, E-value=2e-35, Identity=68%"; Hit description =Mitotic cyclin a1-type
  Pfam annotation: Domain name=Cyclin_N; Domain location=15-130; Score =102.0; E_value=1.8e-27; Accession=PF00134.13; Description=Cyclin, N -terminal domain
MPRALTSRSTVSLTFRNDYLCAMERKRRPMFNYMDRVQHMVTVNMRGIFMDWLVEVVVEYKLLSKTLNLSMSYIHRFLSVNPMSKSRLQLLDVSSMLIASKYEEVNPPGVDKFYSITNNTYEKAERWKLKYLRP

SEQ ID NO: 161369 - protein, 279 aa, Glycine max
  Coding DNA Sequence Number=SeqID_44591
  Gene Ontology: Mol. function=nucleic acid binding
MMMYDAKHISNVLRSVNQDNNQYKCHSKESGILMTLFDNRRDKAATYQFTITPRVKSVLDKIVEDGRYCVVTHGGNDEYQITCLPCKHASTCIAYKRDKFEKYCHRMFSISMLIFAYAGIIHPMHELDVTNTGGYPNINAPALKRMTGRPTKAREKIHVERPSGTQEAKRSNTLRCSTCNEFAHNSWICQWAPVKKSKEKRLYSNFKLYDYWLKSTVEGATGGEAIPIDPNATLVAATQSVQAENTDPNSTSGQNIKTSRAMQEKKKPRARKKVNKVGK

SEQ ID NO: 161370 - protein, 125 aa, Glycine max
  Coding DNA Sequence Number=SeqID_44592
  Homolog annotation: Hit_ID=Q40983; Match level="QueryCoverage=47%, HitCoverage=4%, E-value=5e-15, Identity=65%"; Hit description =Metalloendopeptidase
EAGIHVKRLHSAEGAEILPRPAVVIVMVLGSHSYGAIKRLKLGWYVIFVTSTPSKVHKAVDACKNVLRRLHSKKITERELDRISTSVVLISDVECQNSTSVAQPSLCFNNTRLQRRVITDVERCR

SEQ ID NO: 161371 - protein, 157 aa, Glycine max
  Coding DNA Sequence Number=SeqID_44593
MLDVTNNVVQFHELPSQYIDPEAPEMLTASNLIPGAVYWTIRSIVSCASHVLDITGLGQGYLTSTTETWELSSLAHKLDNINTHLRMQLTLCPQYLDDNRERHLKHFGSFLRDPPKIIQRFSKLCFAARMIRCHCSMVLPNNGLTLKPFSLALTLNL

SEQ ID NO: 161372 - protein, 47 aa, Glycine max
  Coding DNA Sequence Number=SeqID_44594
MLQPCGIGASLKEHSNRMTPKAYPRKSPSGALPPKSALERPYSCMIT

SEQ ID NO: 161373 - protein, 117 aa, Glycine max
  Coding DNA Sequence Number=SeqID_44595
GHPKVVILKNLSDEHFEDSFINLNTSSQVKAFLSRLLHKVKVKQQLLFFSWTTSTFNLIAFSNVVSIHFLMCPHEYVPLSEAPACSVRHKNLEENLPCKHALSALSLAKRVIRYLPS

SEQ ID NO: 161374 - protein, 154 aa, Glycine max
  Coding DNA Sequence Number=SeqID_44596
  Gene Ontology: Mol. function=RNA-directed DNA polymerase activity; Cellular component=chromatin; Biological process=chromatin assembly or disassembly
MAEDDISKTAFWTHHGHYEFLVMPFGLCNVPSSFQQDLPETSRSFKYHLQSPQYQSVFSQIFEMFIHDFQSGVFGSYRVPTWGGAGLSGFYRRFIKGYATITTPLTALLAKDSFSWNSEAEQAFIKLKDALCQAPVLSLPDFSLPFFVETDASG

SEQ ID NO: 161375 - protein, 203 aa, Glycine max
  Coding DNA Sequence Number=SeqID_44597
  Gene Ontology: Mol. function=RNA-directed DNA polymerase activity; Cellular component=chromatin; Biological process=chromatin assembly or disassembly
  Pfam annotation: Domain name=zf-H2C2; Domain location=86-127; Score =16.8; E_value=0.0021; Accession=PF09337.1; Description=His(2)-Cys(2) zinc finger
MAQVIQMPEQQIYLARLLGYDYTIQYRASRMNELKVELLNNPEFFLQDSPYKHPECSLRQDFILQKGRIWLPKGLQSIPTILVEFHSTPTGGHMGIVKTLARVGENFVWLTMKKDVQQFVTTCVVCQQMKYDHRKQPGLLCPLPISARPWEDLSLDFIMGLPTFLGHSVILVVVDHFSKGVHLGLLPAHYTASSVARVFMDIA

SEQ ID NO: 161376 - protein, 148 aa, Glycine max
  Coding DNA Sequence Number=SeqID_44598
  Gene Ontology: Mol. function=chromatin binding; Cellular component =chromatin; Biological process=chromatin assembly or disassembly
MERLRLNGALFHIHSSGVVDFLGFADTPKNLIIFLDNASIGARVMSSAYHPQSDDQNEVMNRIIEQYLWAFIHQKPSTRGHFLIWVEWSYNTSTHSATGMSPYEVTFSKKLPNIPQYLVGTSNVEAVDDWLTHRDTILISLAKKLTKA

SEQ ID NO: 161377 - protein, 316 aa, Glycine max
  Coding DNA Sequence Number=SeqID_44599
  Homolog annotation: Hit_ID=Q9FN45; Match level="QueryCoverage=85%, HitCoverage=99%, E-value=3e-69, Identity=52%"; Hit description =Genomic DNA, chromosome 5, P1 clone:MYJ24
  Pfam annotation: Domain name=DUF617; Domain location=146-316; Score =333.3; E_value=4.3e-97; Accession=PF04759.4; Description=Protein of unknown function, DUF617
MPDVTTVNRLHYKTWDAEGELHVKIQQRNSDRYTALGFMNTVTARSSKEMSSKRHHFHWTNKVGTEDGEVPTSESFSTLFQDEKKDEHKVPVAAAPEANAPAPASHTAARKKLQAVAVSRIRSVLTVFNKNKNNNRSNSALGLGSRVVGTLFGYRLGHVHFAFQKDPTSQPAFLIELATPISVLVREMASGLVRIALECGKEKGAEKKQHVRLLEEPVWRTYCNGKKCGFATRRECGPKDWDILKAVEPISMGAGVLPGNNNNNNNSGAEAGSEGEIMYMRAKFERIVGSRDSEAFYMMNPDSNGAPELSVYLLRV

SEQ ID NO: 161378 - protein, 447 aa, Glycine max
  Coding DNA Sequence Number=SeqID_44600
  Gene Ontology: Mol. function=RNA-directed DNA polymerase activity; Cellular component=chromatin; Biological process=chromatin assembly or disassembly
  Pfam annotation: Domain name=RVP_2; Domain location=243-351; Score= -57.1; E_value=0.028; Accession=PF08284.2; Description=Retroviral aspartyl protease
MAESTRSKSNWDRLEEAIAKLASNQIHVTEKLDDLLHRVTTIENTSTPAASPSSSSVILAPPTHLTNPPKMKLDVPRFDGSNPSSWVFKITQFFEYHSLLLYGGSGLSLVSVDDAKPSTHHLDKLPTGNRDSCRAFPTLTFDARCRLFSLSPWFTSPVWPAFRKKNLQNIAGALAKTPPLPLKKLTPAKMASRREQGLCFNFDEKFTRGHQCAFRFFLLIADEEQEDDVADLKIEFPAPSLDDPPQAQISLYALSGSTHNFMQAHLVKHLGLISQPTQVLRVLVESSNEVEYHQLRLGATVHVEGCVFMMDLLVLLLYGADIVLGVQWLKSLGLVLTDYNELIMKFVHEGKLIKLKGDTNKDLQAISSSQLCHMIQTNGANKYFHIKGDQSGSRCFARMLQPYGISIGLKEHSNPVTPKAYTPKSPSGPLPPDSGPTRKIILAHRHC

SEQ ID NO: 161379 - protein, 132 aa, Glycine max
  Coding DNA Sequence Number=SeqID_44601
  Gene Ontology: Mol. function=sequence-specific DNA binding; Cellular component=intracellular; Biological process=transcription
  Homolog annotation: Hit_ID=Q8W0W5; Match level="QueryCoverage=57%, HitCoverage=48%, E-value=6e-34, Identity=94%"; Hit description =Repressor protein
MFALLTERDFAANGSSAVADPDMQEAFPWLHTVYLVHPKCCPVLSASQALKCINSLVLGFGEYIEEVYAAYEQHKLETMQDSLKGAKWSNRAEMTEEEALAEQQRMFAEARARMNGGAITSKQPDAHQSLES

SEQ ID NO: 161380 - protein, 93 aa, Glycine max
  Coding DNA Sequence Number=SeqID_44602
MPSFASGQTQKRVDANLPTRLEGAWEAACGTPQQTFCCHVQLETGHLSGSKVSHNRSGIIELVTNRLLNLFLNLAPSPAKGTSSGGVNLNDGG

SEQ ID NO: 161381 - protein, 85 aa, Glycine max
  Coding DNA Sequence Number=SeqID_44603
MAFERLRNGYLEKVNFIGDTNVIKFQVLMVLVGLKSPRCKDLYIEEGVALIEASKFIMTFVNLHSPMVDWRVKVSGSLHFYDMVG

SEQ ID NO: 161382 - protein, 1189 aa, Glycine max
  Coding DNA Sequence Number=SeqID_44604
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=99%, HitCoverage=98%, E-value=0.0, Identity=76%"; Hit description=ATPase, E1-E2 type
  Pfam annotation: Domain name=Hydrolase; Domain location=420-880; Score=35.9; E_value=1.4e-07; Accession=PF00702.16; Description =haloacid dehalogenase-like hydrolase
MGGNRRRRHHFSRIHAFSCGKASFKGEHSLIGGPGFSRIVYCNEAERGEGSLVSYGDNYVSTTKYTVATFLPKSLFEQFRRVANFYFLICAILSFFPVSPYSAVSNVVPLVVVVAATMGKEAVEDWKRKKQDIDMNNRKVKVHRGEGIFGYSKWKDLKVGDIVKVEKDEFFPADLILLSSSNDDAICYVETMNLDGETNLKVKQSLEETSKLQEDSSFQNFKAIIKCEDPNANLYSFVGSLELEDQLYPLSPQHLLLRDSKLRNTEFIYGVVIFTGHDTKVMQNSTEPPSKRSTVEKRMDKIIYFLFLVLLLISFIGSVFFGIATREDLENGVMKRWYLRPDDTTIYFDPKKAPVAAMLHFLTALMLYSYLIPISLYVSIEVVKVLQSIFINQDLHMYYEETDRPAHARTSNLNEELGQVDTILSDKTGTLTCNSMEFIKCSIAGIAYGQGVTEVERALARRKGVPTDQELTEDGNVPKSSIKGFNFMDERIMNGNWINEPHANVIQNFLRLLAVCHTAIPEVDDEIGKVSYEAESPDEAAFVVAARELGFEFYERTQTNISLHEFNPRSGKTTERSYKLLNILEFSSTRKRMSVIVRDEEGKLLLFSKGADSVMFERLARNGREFEEKTKQHIEEYADAGLRTLILAYRELDEEEYNLFNEEFMEAKNLVSADREQIVEEISEKIEKDLILLGVTAVEDKLQNGVPECIDKLAQAGIKLWVLTGDKMETAINIGFACSLLRQGMKQIIISSDTTETKSLEKMEDKSAAAVAIKASVIHQLAKGKELLAESDENSEALALIIDGKSLTYALEDDVKDLFLELAVGCASVICCRSSPKQKALVTRLVKIKTGSTTLAIGDGANDVGMLQEADIGIGISGVEGMQAVMSSDIAIAQFRFLERLLLVHGHWCYRRISSMICYFFYKNIAFGFTLFFYEIYASFSGQAAYNDWYLSLYNVFFTSLPVIALGVFDQDVSARLCLKFPLLYQEGVQNVLFSWKRILGWAFNGVLSATIIFFFCINAMENQAFRKAGEVADLEVLGATMYTCVVWVVNSQMALSISYFTYIQHLFIWGGILFWYIFLLVYGTMDPSLSTTAYKVLIEACAPAPSYWLITLLVLVASLLPYFAYASIQMRFFPTFHQMIQWIRNDGQTTDPEYVNIVRQRSIRHTTVGFTARFEASHSSGASKSIQV

SEQ ID NO: 161383 - protein, 184 aa, Glycine max
  Coding DNA Sequence Number=SeqID_44605
  Gene Ontology: Mol. function=calcium ion binding; Cellular component =flagellin-based flagellum; Biological process=ciliary or flagellar motility
  Homolog annotation: Hit_ID=Q9LI84; Match level="QueryCoverage=77%, HitCoverage=88%, E-value=5e-42, Identity=60%"; Hit description =Calmodulin-like protein
  Pfam annotation: Domain name=efhand; Domain location=11-39; Score =29.6; E_value=1.1e-05; Accession=PF00036.22; Description=EF hand
  Pfam annotation: Domain name=efhand; Domain location=122-150; Score =36.7; E_value=8.2e-08; Accession=PF00036.22; Description=EF hand
  Pfam annotation: Domain name=efhand; Domain location=47-75; Score =24.6; E_value=0.00036; Accession=PF00036.22; Description=EF hand
  Pfam annotation: Domain name=efhand; Domain location=86-114; Score =29.9; E_value=8.7e-06; Accession=PF00036.22; Description=EF hand
  Pfam module annotation: Pfam domain module=efhand::efhand::efhand::efh and; Domain location=11-39::122-150::47-75::86-114
MSKLQVNQLNQLREIFAKFDMDSDGSLTILELAALLRSLGLNPSGDEIHALLANMDSNGNGFVEFDELVEAILHDISAEILLNQEMLFGVFKCFDRDGNGYITAAELAGAMAKMGQPLTYRELTEMITEADTDGDGVISFNEFASVMAERFLIVNHDFAHWNMFLSLMLCFVDFTQKGEEGFLH

SEQ ID NO: 161384 - protein, 68 aa, Glycine max
  Coding DNA Sequence Number=SeqID_44606
MVPFHPMNHPTIIACMFRHFVVVLLHRFLGILKRIMRSKNDARDHMVIVVGRKVRKMWRRMYGVEVGG

SEQ ID NO: 161385 - protein, 64 aa, Glycine max
  Coding DNA Sequence Number=SeqID_44607
MAEKCKAILPLREVAERFSLLNYLSCTPHKTCWAINDRVNCSQMIAKLLETKYQADKMTEILTE

SEQ ID NO: 161386 - protein, 48 aa, Glycine max
  Coding DNA Sequence Number=SeqID_44608
MTTAGREVEGSMRKIEKVSKREAEDHGREKRNKEEEGVSDGDRGFAPK

SEQ ID NO: 161387 - protein, 137 aa, Glycine max
  Coding DNA Sequence Number=SeqID_44609
  Gene Ontology: Mol. function=phenylalanine-tRNA ligase activity; Cellular component=cytoplasm; Biological process=phenylalanyl-tRNA aminoacylation
  Homolog annotation: Hit_ID=Q1RSG6; Match level="QueryCoverage=98%, HitCoverage=21%, E-value=1e-36, Identity=54%"; Hit description=B3/4
MAVRTSLMPGILKIVAHNKDHPKPIKVIYGRWRNITEIPPYKHFIVAYCATLAGLSSQIAYGRGDIAVLDEQRDVGAKNLRQLAALYCGANAGFEIIHGLVDRVMEKNGVPFVSPGDKSGYYIERSDVLNNFDIPDP

SEQ ID NO: 161388 - protein, 487 aa, Glycine max
  Coding DNA Sequence Number=SeqID_44610
  Gene Ontology: Mol. function=protein binding; Cellular component =cortical actin cytoskeleton; Biological process=positive regulation of actin filament polymerization
  Homolog annotation: Hit_ID=Q6K908; Match level="QueryCoverage=90%, HitCoverage=95%, E-value=0.0, Identity=70%"; Hit description =Putative arp3
  Pfam annotation: Domain name=Actin; Domain location=2-435; Score =307.3; E_value=2.8e-89; Accession=PF00022.9; Description=Actin
MGFAGNVEPCFNVPTVVAINESFLNQSRNSSKGNWVAQHNAGVMADLDFFIGDEALSKSRSSSTYNLSYPIQHGQVENWDAMERFWQQCIFNYLRCDPEDHYFLLTESPLTSPESREYTGEIMFETFNVPGLYIGVNSVLALAAGYTTSKCEMTGVVVDVGDGAAHVVPVADGYVIGSSIKSIPISGKDITLFVQQLMRERGENVPPEDSFEVARKVKEMYCYTCSDIVKEFNKHDKEPAKYIKHWRGIKPKTGAPYSCDIGYERFLGPELNRGGLYRKVVKSKRGRSTSVGRGKGGLSTSNIFFNPEIYGSDFTTPLPVVIDKCIQSAPIDTRRSLYKNVVLSGGSTMFKDFHRRLQRDLKKIVDARVLLSEARLNGEIKSQPVEVNVLSNPIQRYAVWFGGSVLASTPDFFTACHTKAEYEEYGASICRTNPVFKGIYMIRLLNETAGYRYPQFTSWAFFPPIFRVAEVVSFTGLIQLSADPDDT

SEQ ID NO: 161389 - protein, 575 aa, Glycine max
  Coding DNA Sequence Number=SeqID_44611
  Gene Ontology: Mol. function=guanyl-nucleotide exchange factor activity; Cellular component=cellular_component; Biological process =intracellular protein transport
  Homolog annotation: Hit_ID=Q2QTS8; Match level="QueryCoverage=93%, HitCoverage=99%, E-value=0.0, Identity=71%"; Hit description =Regulator of chromosome condensation, putative, expressed
  Pfam annotation: Domain name=RCC1; Domain location=168-217; Score =10.3; E_value=0.054; Accession=PF00415.9; Description=Regulator of chromosome condensation (RCC1)
  Pfam annotation: Domain name=RCC1; Domain location=220-271; Score =13.3; E_value=0.026; Accession=PF00415.9; Description=Regulator of chromosome condensation (RCC1)
  Pfam annotation: Domain name=RCC1; Domain location=274-324; Score =2.0; E_value=0.43; Accession=PF00415.9; Description=Regulator of chromosome condensation (RCC1)
  Pfam annotation: Domain name=RCC1; Domain location=329-381; Score =8.4; E_value=0.086; Accession=PF00415.9; Description=Regulator of chromosome condensation (RCC1)
  Pfam annotation: Domain name=RCC1; Domain location=384-433; Score =31.2; E_value=3.6e-06; Accession=PF00415.9; Description=Regulator of chromosome condensation (RCC1)
  Pfam annotation: Domain name=RCC1; Domain location=436-500; Score =11.4; E_value=0.042; Accession=PF00415.9; Description=Regulator of chromosome condensation (RCC1)
  Pfam annotation: Domain name=RCC1; Domain location=503-560; Score =2.2; E_value=0.4; Accession=PF00415.9; Description=Regulator of chromosome condensation (RCC1)
  Pfam module annotation: Pfam domain module=RCC1::RCC1::RCC1::RCC1::RCC 1::RCC1::RCC1; Domain location=168-217::220-271::274-324::329 -381::384-433::436-500::503-560
MDATTSETPTIQYHNIPDQPITTIVATQLPTFQPQQRHCFKDSSPGEFPLSDNPSIVLHVLTTCNLYAQDLAKLEASAVLATCSFFKRPANFDPDFDLSLSELAALDMCQKRAIFNPMTTEQRQHLKQRCGGSWKLVLRFLLAGEACYRREKSQVIAGPGHSIAVTSKGVVYSFGSNSSGQLGHGTTEDGWQPRPIRALQGIRIIQATAATGRTMLISDSGQVYAFGKQYFCENEIGNEGSKMVTTPQLVESLKNIFVVQAAIGNYFTAVLSREGRVYTFSWGSDGKLCHQTDPNDVEPRPLLGALEHIPVVQIAAGFCYLLCLACQPSGMSVYSVGCGMGGKLGHGTETDEKYPRLIEQFQLLNLQPMVIAAGSWHAAVVGQDGRVCTWGWGRHGCLGHGNEECALVPKVVEELKNVKAVHVAAGDYTTFVVSDSGDAYSFGYGESGTLGHDPENPEQEHMHADVLTPKLVTSMKQNYERVIQISLTNSVYWIAHTFALTESGKLYAFGAGDKGQLGVELRPYQTERRKPQRVDIDLESKNASIRSKLGLTRASPSAICAVVDINLWLELAHHS

SEQ ID NO: 161390 - protein, 461 aa, Glycine max
  Coding DNA Sequence Number=SeqID_44612
MGCPEQLHRLLANVVQGHCNVFDKMPEGKQVPFLTVTLSFSTMGRKFWELLYGGNHFIRPNMSTAFYLNSMFYHSSREALNFQWYQNEFPKVKELTHSLANVDAVNGRLVDINSNSTVFDDDIEREMCTFKSLVREFVGSPLVQHRMKHFLASFLTNVKDESFTPFGTATERKPMVVDSLTKVSNFLSVSAQQRKLVRFRVCPQVTQHRIWTGALKEVLNGFAVDLDCLASRGLDNDALLGGQIVHSCLRFLTEIGVFSEPESSSWMKLSPSKTVDSSDSRRWEDVLVMLNDLTKCCRNERRLKMNVAKAEIMKEGLLHIRDVLVDSNVGYKEAQHQESLVKKKLSKMLGHSSCCLFTLLLYYLYGRVADIEVDMCGGVYANGSDGKFCLFMGRILTSDSEKMVGRGVKQLDRALGIFKFVWEMAEMKGHLDLQGHMWCVGADNRMLRYRGNTYFVHGICL

SEQ ID NO: 161391 - protein, 353 aa, Glycine max
  Coding DNA Sequence Number=SeqID_44613
  Gene Ontology: Mol. function=steroid binding; Biological process =transport
  Homolog annotation: Hit_ID=Q9LVM5; Match level="QueryCoverage=97%, HitCoverage=93%, E-value=1e-80, Identity=47%"; Hit description =Transthyretin-like protein
  Pfam annotation: Domain name=Transthyretin; Domain location=247-338; Score=23.0; E_value=2.8e-08; Accession=PF00576.11; Description =Transthyretin precursor (formerly prealbumin)
MEFSFDEKDFASCCGSTKFAKEMASASPFRSFQDAVSVAKGVWFNSVDVNGWLQAFSAHPQIGQTHAPSVASEASAQFTSAHPVQYFKFISFPHLGHSFLCFGVKELSCECKGWSKGEQSTALATATGSSLQELSEWNARYREKFGFVFLICAAGRSTDEILAELKRRYTNRPIVEFEIAAQEQMKITELRLAKLFSSRENISSSVDKYSAAKKAEEDRISIIGGHVTAASEISTAKLIHHPARTRPPITTHVLDVSQGSPAAGIEVLLEVWRGTQSRPTFGASGGGSWVFQGSSTTDLDGRSGQLLSIVDDVNPGIYRISFNTGKYIPNALTVEARIIGTVAKWMSLIFVGT

SEQ ID NO: 161392 - protein, 103 aa, Glycine max
  Coding DNA Sequence Number=SeqID_44614
MWVVVTLDFIETVKKAVGDGRRLRFGWSHGLGERLWRFIIDDFFHLTCLSDSKVVETRVRGDGDWCWNWWKRDLLRWAKDLLHDLEVEAGHEGFREGFGDSRR

SEQ ID NO: 161393 - protein, 183 aa, Glycine max
  Coding DNA Sequence Number=SeqID_44615
  Gene Ontology: Mol. function=protein binding; Cellular component =actin cortical patch; Biological process=establishment and/or maintenance of cell polarity (sensu Fungi)
  Homolog annotation: Hit_ID=Q6K908; Match level="QueryCoverage=81%, HitCoverage=35%, E-value=6e-67, Identity=78%"; Hit description =Putative arp3
  Pfam annotation: Domain name=Actin; Domain location=2-182; Score= -181.9; E_value=9.2e-05; Accession=PF00022.9; Description=Actin
MGFAGNVEPCFIAPTVVAVNESFLNQSRGSSKGNWVAQHNAGIMADLDFFIGDEALTKSRSSSSYNLSYPIQHGQVENWDAMERFWQQCIFNYLSCDPEDHYFLLTESPLTPPESREYTGEIMFETFNVPGLYIGVNSVLALAAGYTTSKYGLSSNKFGSYLNTKCTGCFISPCNLTHLDAFT

SEQ ID NO: 161394 - protein, 99 aa, Glycine max
  Coding DNA Sequence Number=SeqID_44616
  Homolog annotation: Hit_ID=Q1T3X3; Match level="QueryCoverage=28%, HitCoverage=27%, E-value=2e-09, Identity=96%"; Hit description =Nitrate-induced NOI
  Pfam annotation: Domain name=NOI; Domain location=58-99; Score=25.6; E_value=9.2e-05; Accession=PF05627.2; Description=Nitrate-induced NOI protein
MWHFELITGLVVLISSCRYLLLKTWPDFAESSEAAKQPISRSLAHFSLWIILLLHFCLYEQDGKPLPKFGEWDVNDPASAEGFTVIFKPSLQSLLKPSL

SEQ ID NO: 161395 - protein, 70 aa, Glycine max
  Coding DNA Sequence Number=SeqID_44617
  Subcellular localization annotation: CTP_CleavageSite=47; ConfidenceScore=5.34e-01
MGVYKMMPNDAQLKTALSSFSMSFSIFSDDSSVVLLRHVKPRRSGCRADLAGSSKYSNENFDGQEWKGSM

SEQ ID NO: 161396 - protein, 909 aa, Glycine max
  Coding DNA Sequence Number=SeqID_44618
  Gene Ontology: Mol. function=dopamine beta-monooxygenase activity; Biological process=histidine catabolic process
  Homolog annotation: Hit_ID=Q9FFU6; Match level="QueryCoverage=93%, HitCoverage=97%, E-value=0.0, Identity=62%"; Hit description=Genomic DNA, chromosome 5, P1 clone:MBG8
  Pfam annotation: Domain name=Cytochrom_B561; Domain location=661-864; Score=-62.0; E_value=0.0044; Accession=PF03188.6; Description =Cytochrome b561
  Pfam annotation: Domain name=DOMON; Domain location=189-333; Score =9.9; E_value=0.0066; Accession=PF03351.8; Description=DOMON domain
  Pfam annotation: Domain name=DOMON; Domain location=527-646; Score =45.5; E_value=1.8e-10; Accession=PF03351.8; Description=DOMON domain
  Pfam module annotation: Pfam domain module=Cytochrom_B561::DOMON::DOMO N; Domain location=661-864::189-333::527-646
MVIDYMPMVIDYMPMVSSSWILIHSATIAPVMLRRSLIIILHLSLLSFGYADPAPNCTRLSSVVNSESEFEMVQHQLRGSLKIRDDCSFRVSQFDMLPGSDVHWWGAQASDFDNLTAGFIVSNYGLNGTYNNSTFDVHLLSNVSWSMINVLAVWDRATASDFGHVVLRKDAPASPPPPTVFENCKVLSKNFRLRWSLNVSEDSLEIGLEAATGITNYMAFGWANSSAQDSDLMIGADVVVAGFKEDGMPFVDDFFITKYSECVRNSDGVAQGVCPDSFYEGPDGVGLVNNSMLVYGHRKDGVTFVRYRRHLTKVDGKYDHPVNHSANMKVIWALGRIKPPDSINPYYLPQNHGAVNYGHLVLNVSEHVNECTGPLDAEDKEDQGLITADANVPLVVSSAPAMHYPNPPNPEKVLYINKKEAPVLRVERGVPVKFSIQAGHDVALYITSDPLGGNATTRNLTETIYAGGPEAHGVQASPTELVWAPDRNTPDHVYYHSLFDQKMGWKVEVVDGGLSDMYNNSVILDDQQVTFFWTLSKDSISIAARGEKKSGYIAIGFGSGMVNSYVYVGWIDDTGVGHVNTYWIDGKDASSIHGTQENLTHVRCKTENGIITFEFTRPLDPSCRREKRVECKNIVDPTTPLKVVWAMGAKWTDDHLTDRNMHSSTSNRAILVHLMRGSAEAEQDLLPVLAVHGFMMFVAWGILFPGGILAARYLKHLKGDGWYRIHVYLQYSGLVIVLLALLFAVAELRGFYFSSTHVKFGFATILLACIQPANAFLRPPKPANGEQASSKRVIWECFHTIVGRCAIVVGIAALFTGMKHLGDRYDVENVHGLRWAMAIWFLIGALIVIYLEYHERQRIGRQISGRGNWVLGNLEEDDSVDLLRPTRTSADKELQPSARMEVQLEPLNR

SEQ ID NO: 161397 - protein, 66 aa, Glycine max
  Coding DNA Sequence Number=SeqID_44619
MEKSKEKAREARARESDQDSGACDGKNLEPGKEHARENYSTWKLESNISQKKRSISASPFTSNNTS

SEQ ID NO: 161398 - protein, 101 aa, Glycine max
  Coding DNA Sequence Number=SeqID_44620
MFFCLEVIEEIQKRGTREAPGDLLDDKFVQNDNLHSSLNPAAPNSNLLPSRSAVLQACIITSGLIAALGIVIRQVSHVVSVEGFPVLDCSSEVSCITLIFT

SEQ ID NO: 161399 - protein, 98 aa, Glycine max
  Coding DNA Sequence Number=SeqID_44621
MWKELVSYMPQHDELQIPSKLPFKWNQSLKGGVGNGDGRDIDTHDFLAITLIVNHDFTLFMRTFESLLSGDAHQPPSSSAFTSSAHMKQHHNIISYYN

SEQ ID NO: 161400 - protein, 151 aa, Glycine max
  Coding DNA Sequence Number=SeqID_44622
  Gene Ontology: Mol. function=dopamine beta-monooxygenase activity; Biological process=histidine catabolic process
  Homolog annotation: Hit_ID=Q9FFU6; Match level="QueryCoverage=90%, HitCoverage=15%, E-value=2e-35, Identity=54%"; Hit description =Genomic DNA, chromosome 5, P1 clone:MBG8
MGYPVSWRDIGSQPANAFLRPPKPANGEQASSKRVIWECFHTIVGRCAIVVGIAALFTGMKHLGDRYDVENVHGLRWAMAIWFLIGALIVIYLEYHERQRIGRQISGRGNWVLGNLEEDDSVDLLRSTRTTADKELQHSARMEVQLEPLNR

SEQ ID NO: 161401 - protein, 135 aa, Glycine max
  Coding DNA Sequence Number=SeqID_44623
  Gene Ontology: Mol. function=hydrolase activity; Cellular component =membrane; Biological process=carbohydrate metabolic process
  Homolog annotation: Hit_ID=Q6ZLQ2; Match level="QueryCoverage=63%, HitCoverage=66%, E-value=5e-33, Identity=72%"; Hit description =Putative glycosyl hydrolase
  Pfam annotation: Domain name=X8; Domain location=34-123; Score=154.0; E_value=3.9e-43; Accession=PF07983.3; Description=X8 domain
MARGIVVQQKSEAAIPVTTLSPPEGNTTFIDGTTWCVALAGVSQADLQNALDWACGLGMADCTAIQHGGPCFEPDTLVSHASFAFNSYYQINGNSDIACNFGGTAALTKHNPSELNINVTQILSQLGQTFRKTLK

SEQ ID NO: 161402 - protein, 124 aa, Glycine max
  Coding DNA Sequence Number=SeqID_44624
  Subcellular localization annotation: CTP_CleavageSite=56; ConfidenceScore=5.46e-01
VQNQPEKKNPFVTSTALASPNPSAPLKRRPLERHHLRRRLAEGRGGFAKRRRLTVSRSGGWRRRKLPSLIGDDSSDNWFGFGGPKSDLSFNFCIPWLMLSSPILTATWWRSVVFSRRGGGRSRR

SEQ ID NO: 161403 - protein, 92 aa, Glycine max
  Coding DNA Sequence Number=SeqID_44625
  Homolog annotation: Hit_ID=Q6QNU4; Match level="QueryCoverage=77%, HitCoverage=6%, E-value=4e-26, Identity=79%"; Hit description=DNA damage-binding protein 1
MGDVSDRIGRPTDNGQIGIIDPDCRLIGLHLYDGLFKVIPFDNKGQLKEAFNISASNYEPMTLIKDYQLPKPWLCKNELRTYVKLDVVGVFT

SEQ ID NO: 161404 - protein, 94 aa, Glycine max
  Coding DNA Sequence Number=SeqID_44626
MDSLLSGNSGLALGSVPEDEPRRERVYGRAVGDDADEFTSVTDRLGAEFRVQERALLVSADREQKIQSKPEWALALNLNLLAGTIDLNPITLPS

SEQ ID NO: 161405 - protein, 56 aa, Glycine max
  Coding DNA Sequence Number=SeqID_44627
MSTTVGGEVAFVPYQLIYLSRLSLLLFLLKNWVERAFLEAKCGFLITTSAKGIFLC

SEQ ID NO: 161406 - protein, 143 aa, Glycine max
  Coding DNA Sequence Number=SeqID_44628
  Subcellular localization annotation: CTP_CleavageSite=68; ConfidenceScore=5.44e-01
MESDSSSELSWLVFLAMQTSSLRPSTKLVSMLFLYTPLLLSNSPFFSRLVNSSPICTAGNHMWKDPITSEHKQFAQHNLEFQLILLKDVHFLVMELQGFWSQTETQNRRASTIKKRGLNKYIGISSDKGGEFEVTRKTKCPQW

SEQ ID NO: 161407 - protein, 85 aa, Glycine max
  Coding DNA Sequence Number=SeqID_44629
MASYGEAKDSIDEEDPRPTSSNGAYINKDYHHRDRHKDHGERRERTKNRDYDDYHKCRDFDSKRTSGFDMAPLMSVMLVDASTII

SEQ ID NO: 161408 - protein, 600 aa, Glycine max
  Coding DNA Sequence Number=SeqID_44630
  Gene Ontology: Mol. function=amino acid transporter activity; Cellular component=integral to membrane; Biological process=amino acid transport
  Homolog annotation: Hit_ID=Q2QM92; Match level="QueryCoverage=90%, HitCoverage=91%, E-value=1e-174, Identity=58%"; Hit description =Amino acid permease family protein
  Pfam annotation: Domain name=AA_permease; Domain location=79-511; Score=46.8; E_value=7.2e-11; Accession=PF00324.11; Description=Amino acid permease
  Pfam annotation: Domain name=Aa_trans; Domain location=73-475; Score=- 144.2; E_value=0.021; Accession=PF01490.8; Description=Transmembrane amino acid transporter protein
  Pfam module annotation: Pfam domain module=AA_permease::Aa_trans; Domain location=79-511::73-475
METEEGGSRGAKRRGCTFQKNDFFPEESFKSWGNYGKALRETPWRFKDRVMTRSKDETEVVEMKGRSGNEMKKTLNSWDLIWFGIGAVIGSGIFVITGLEAREVAGPAVVLSYVASGISALLSVFCYTEFAVEIPVAGGSFAYLRVELGDFVAFMAAGNILLEYVIGGATISRSWTSYFATLCNHHPDEFRIIVPNMNPDYGHLDPIAVVALIAIATLAMCSTKASSLFNNIATILHCLVIVFVIVAGLINANPQNLTPFAPFGARGVFKASAVLFFAYLGFDAVATMAEETKNPARDIPIGLVGSMTITTLVYCLLSLTLCLVQSYKEIDVDAPFSVAFNAVGWDWAKYIVALGALKGMTTVLLVTIVGESRYLTHISRTHMMPPWFGHVDDKTGTPVNATIAMLTATSVVAFFTNFRVLSNLLSISTLLIFMLVAVALLVRRYYSSGVTTKENQVKFVVCLVLIFGASCGVSAYWANSDGIIGYVICVPLWVLGTGGLWLGVPMAKKPKVWGVPLVPWLLALSIFINIFLLGSIDLDSYIRFGVWTLLLLLYYALVGLHASYDTAKDFESLSNITTNQVHDQDLNHVEQGLQTQKTTT

SEQ ID NO: 161409 - protein, 90 aa, Glycine max
  Coding DNA Sequence Number=SeqID_44631
MTGNVPALVVPLGLWTGIGSLPLFVYKTGKRSKSKETYIITFTDASNVKGHPSSNLLGWIPISDSQHEITQVIMLVKNKQDTDDTKPSNG

SEQ ID NO: 161410 - protein, 288 aa, Glycine max
  Coding DNA Sequence Number=SeqID_44632
  Homolog annotation: Hit_ID=Q39177; Match level="QueryCoverage=67%, HitCoverage=26%, E-value=8e-09, Identity=26%"; Hit description =PEARLI 4 protein
  Pfam annotation: Domain name=PEARLI-4; Domain location=33-286; Score=- 81.3; E_value=1.9e-05; Accession=PF05278.3; Description=Arabidopsis phospholipase-like protein (PEARLI 4)
MDSSDHSYPSNNQQQARLLELEETSVKTYYQISDSECSLIEVESLPTQVDHPSTFEPEITHEASEKTGDSVDVAEMEQEEPLAESTSKPKSSECPPEQKPLAVFGHPFSLFSLNRTEMDKEGDDVNSVGQSSSLDTVEVEGYQVRPELESIVRKFLVKHGDIFQNCMVSTMIFHSMLLEMICDIISDLQDNNLYEITEDKLHSMITVANDMKVNIECLHLKLKEILEAKQTLDQYAKLEEKKHISKKIVETVKRLLDKDDYSKISQTFTDARSKVRQFANCSLADGLL

SEQ ID NO: 161411 - protein, 179 aa, Glycine max
  Coding DNA Sequence Number=SeqID_44633
  Gene Ontology: Biological process=response to brassinosteroid stimulus
  Homolog annotation: Hit_ID=Q9FI10; Match level="QueryCoverage=86%, HitCoverage=78%, E-value=1e-43, Identity=51%"; Hit description =Arabidopsis thaliana genomic DNA, chromosome 5, P1 clone:MFC16
  Pfam annotation: Domain name=DUF588; Domain location=20-176; Score =147.5; E_value=3.6e-41; Accession=PF04535.3; Description=Domain of unknown function (DUF588)
  Subcellular localization annotation: CTP_CleavageSite=56; ConfidenceScore=5.17e-01
MASENGDKLELAFSAVPDPKPKKDWVILSLRVVAFFATASATLVMAFNKQTKGMVVATIGTNPVTITLTAMFQHTPAFIFFVIVNAIASFYNLLVIGVEILGPQYDYKGLRLGLIAILDVMTMALAATGDGAATFMAELGRNGNSHARWDKICDKFEAYCNRGGVALVASFVGLILLLV

SEQ ID NO: 161412 - protein, 99 aa, Glycine max
  Coding DNA Sequence Number=SeqID_44634
MFLRFLCGSHNHNVARTLVSHPYIGRLTRDEKTMLTDMIKSMLHMEPIGLGSSSSMESFASSISMAAEWRRKKNDWRCHFNEKMSQEEAHYHRKPWIRA

SEQ ID NO: 161413 - protein, 32 aa, Glycine max
  Coding DNA Sequence Number=SeqID_44635
MVLSAEAKDKCCKRQFVAECGGVGKPTNDMLS

SEQ ID NO: 161414 - protein, 256 aa, Glycine max
  Coding DNA Sequence Number=SeqID_44636
  Gene Ontology: Mol. function=hydrolase activity
  Homolog annotation: Hit_ID=Q1T4E5; Match level="QueryCoverage=70%, HitCoverage=34%, E-value=5e-19, Identity=28%"; Hit description =Transposase
MYKDKWAHTESMGPKSILRTMKILGPSPASLAQFSWSLLSNVLGGRIASCILPEPHMEDLSGLRIEMQHLMYLLERDMYIHWHVANDEEVARDIFWAHLDVVKLLNAFNILFFMDSTYKTNIYRLPLLEIVGVTCTALTFSVVFAYMEVEREKTLCGHLKVKIVFLDSHNLLCQFHIDKNVKAKCKQHVTPKKAWDQAIEVWIFVMDYPIECAYEDHLIRVESVHWALKRLQHNEIKASFEHSIHVGHIFSAQFYK

SEQ ID NO: 161415 - protein, 1180 aa, Glycine max
  Coding DNA Sequence Number=SeqID_44637
  Gene Ontology: Mol. function=DNA binding; Cellular component=nucleus; Biological process=regulation of transcription
  Homolog annotation: Hit_ID=UPI00000529F6; Match level="QueryCoverage =84%, HitCoverage=87%, E-value=1e-171, Identity=48%"; Hit description= transcription factor
  Pfam annotation: Domain name=FYRC; Domain location=988-1083; Score =92.2; E_value=1.6e-24; Accession=PF05965.4; Description=FY rich C -terminus
  Pfam annotation: Domain name=FYRN; Domain location=936-985; Score =66.3; E_value=1e-16; Accession=PF05964.4; Description=FY-rich N -terminus
  Pfam annotation: Domain name=JmjC; Domain location=396-535; Score =196.4; E_value=6.9e-56; Accession=PF02373.13; Description=JmjC domain
  Pfam annotation: Domain name=JmjN; Domain location=156-200; Score =84.9; E_value=2.5e-22; Accession=PF02375.7; Description=jmjN domain
  Pfam annotation: Domain name=zf-C5HC2; Domain location=642-695; Score= 82.7; E_value=1.1e-21; Accession=PF02928.6; Description=C5HC2 zinc finger
  Pfam module annotation: Pfam domain module=FYRC::FYRN::JmjC::JmjN::zf- C5HC2; Domain location=988-1083::936-985::396-535::156-200::642-695
FKIDKGETVLWNVSLANWDSDKLKLAAESHAKEAVLYMLCDFSFFGVWKDWKFLTLVVVADCILLSLNSESYLQPCINDESILLVEASIKLKSFSWHTLLIPYQHKQMKGINVDNPCRHKPEMENTLESSGSPRHRKISARWDPDEACQPIVDEAPVFYPTIEEFEDTLGYIAKIRPQAEPYGICRIVPPACWVPPCPLQEKDLWENAKFPTRIQQIDLLQNREPMRKKIRGRKRKRRKQSKMGMGMRTAKSGSEANVASEPEEKFGFQSGSDFTLKDFQQYANVFKDCYFGLNDANEYEKVSDSSHQQRWKPSVEEIEGEYWRIIEQPTDEVEVYYGADLETGSLGSGFPKTSSLTKNESDRYALSGWNLNNFPRLPGSALCFEGSDISGVVVPWLYVGMCFSSFCWHVEDHHLYSLNYLHWGDPKVWYGVAGSHAPGLEDAMRKHLPDLFEEQPNLLNELLLEELILGLPKNQSSLVQYRIYLVTQLSPSILKSEGVPVHRTIQHSGEFVVTFPRAYHCGFNCGFNCAEAVNVAPVDWLVHGQNAAELYSLQCRKTSLSHDKLLFGCAQEAMHALAELTLHGKENLKYIKWRSACGKDGVLTKAVKTRITMEKERLDCLPTHLKMLRMDSKFDLFEERECFSCFYDLHLSAIGCKCSPDCYSCLKHSNLFCSCEMDNRFILFRYTMNELSTLVEALEGESHAIEVWANRNSGMVSANAEDACIYKQDVESAICQTQSYKEGKNSTCAGTNDKSNSTILSSSYSHISAELVHSEFHHETFSAPYGTKDCHKDNLNEKDLVMDNKVMVEKGGSVDLNIDVMSGEPENYFLHAADYHHNKGVPYVEKVSFAEARKEQDNMEPGADCIAAKEFSSCSRDVQNSCTLDGYKLFGVDLQMHSDSGEQLNSVSKIGDAETSNTSISLTNQSFLMQKFGISVEPVNLGSVICGKLWCSKHAIYPKGFKSRVKFFSILDPPRICNYLSEVYDAGFLGPIFKVTMEELPNEAFTNTSADKCWESVLDRLNHEIKRQRSQGEIELPSLELLQSINGHKMFGFLSPSIIQAIEAEDPNHQCVEYWNHKEVVSESSGSAIDDCKFSHGSSNSLGDAKTKLFDAGLIRQEQDSIIGSYDSFEEMKLVLQGFLKKASSDELSAMHKLFSSDAQFTKCRAEFVSLIEEIQKACA

SEQ ID NO: 161416 - protein, 85 aa, Glycine max
  Coding DNA Sequence Number=SeqID_44638
MFFRLNEDIVEQIYSSIIFSNTLKSRTQGDSDSATKEFGFSAELAISLSLCWELLVTVWKCIWGGMGHTNRDETCLKDIIKRIFK

SEQ ID NO: 161417 - protein, 125 aa, Glycine max
  Coding DNA Sequence Number=SeqID_44639
  Homolog annotation: Hit_ID=UPI0000E4646B; Match level="QueryCoverage =77%, HitCoverage=27%, E-value=1e-09, Identity=37%"; Hit description =PREDICTED: hypothetical protein, partial
MVVVVLVSAHMWVGLYVNHYGLWGALDDEMNSVVDFGGALNEDMNSVVDFGGTLDDGMNSVVDFGGALDEGMNSVVIFGGSLDEGMNSVVDFGGALDDDMNSVVTLGGALDEGMNLVVVSGFSRS

SEQ ID NO: 161418 - protein, 69 aa, Glycine max
  Coding DNA Sequence Number=SeqID_44640
MVDSGHKVVDCRPVASPMVVAHKLEVCKWVASHEEIGKVVVVVERCEPPIWRRELRRAIGSDTMLDFIL

SEQ ID NO: 161419 - protein, 80 aa, Glycine max
  Coding DNA Sequence Number=SeqID_44641
  Subcellular localization annotation: CTP_CleavageSite=59; ConfidenceScore=5.42e-01
MSSHAQRIISLFSEKIVSSGLSARMALSQISLTCTKRKNSAKRPFVNKKPFLSLNFQLGAQETSSFGTCFHTNFQLKFQN

SEQ ID NO: 161420 - protein, 78 aa, Glycine max
  Coding DNA Sequence Number=SeqID_44642
MTKHKLHATKHRSPDEIRVKQQNVQEVENLRKENIVLREKYQKLREDNNMHLILVADTLRTNLPRTNMTWKEGTPSVT

SEQ ID NO: 161421 - protein, 132 aa, Glycine max
  Coding DNA Sequence Number=SeqID_44643
MASKKRKAPSTPSQAIYDRSKFTSQEAWERYTNITVPRKFLLERNVVVYYTEFDEFKEEPERRHWDKELTDFANNNINVAIVKEFYTNLYDTEDKSPKQVLVAKLCIPGRGFKLNANGQPLKILRKNMTTLA

SEQ ID NO: 161422 - protein, 123 aa, Glycine max
  Coding DNA Sequence Number=SeqID_44644
MKADMKALKEQMTIMMEAMMSMKRIMEANAVAVAATSAVAKVNPTPPSGLNQMNHPTSDMVGKYLGSTGSPHDVQIQNKYAFSPYGLPPNYTPPNVAYTPNEDVNNSTPILIESRRPHHAHVS

SEQ ID NO: 161423 - protein, 106 aa, Glycine max
  Coding DNA Sequence Number=SeqID_44645
MVTWFMELSEFGLKFRSQEPIKAQCLLDLMSKLPPKSSNRACNPKSNRAGMTLEGLGDISLEQSSRFDFKTYNNQVEYKALIVGLKLGKEVRCVGSSGLRIIKKGG

SEQ ID NO: 161424 - protein, 177 aa, Glycine max
  Coding DNA Sequence Number=SeqID_44646
LHKSAKPFRFKVLQNWDDIVDLCVKDRAIGHGAETAMDADEVMSRETNEVEFIGLGAAAIIDLEEPSSITKGKRQGSTSFGIHSHKRKIGEKEGITASASLDKMANSFDRMVEKMDGKIDDEDIQEVLREAALIPDLNRQQWAKAIKWLVDDPKQLAIVKVLPIHEKTNYVLTHLAK

SEQ ID NO: 161425 - protein, 186 aa, Glycine max
  Coding DNA Sequence Number=SeqID_44647
  Gene Ontology: Mol. function=N-acetyltransferase activity; Cellular component=intracellular; Biological process=metabolic process
  Homolog annotation: Hit_ID=Q2HRF3; Match level="QueryCoverage=72%, HitCoverage=26%, E-value=7e-55, Identity=76%"; Hit description=SDL-1 protein
MAGAHSHRQSQLHHQQPSSRLLLLLTVLPLTLATLAFVLQWRGGVTDPVTRWSPDHDQFPGMATTTTTTPSRHSSDCGKNPLYQSHNPSFPYFRDWTLDFSSNLSPKICITTSTSAGLEQTLPWIFYHKVIGVSSFILFVEGKAASPNVTRVLDTIPGVKIVYRTRELEEQQAKRSLVEVCVSVIQ

SEQ ID NO: 161426 - protein, 79 aa, Glycine max
  Coding DNA Sequence Number=SeqID_44648
  Subcellular localization annotation: CTP_CleavageSite=52; ConfidenceScore=5.26e-01
MTMSVMPRQSPTWPVLIPSCPIRISSSTIPPFIHFTSLGTFHGPLSGAFGVDSSLFWVNEGVPPEGGEDPNMPVILYPG

SEQ ID NO: 161427 - protein, 129 aa, Glycine max
  Coding DNA Sequence Number=SeqID_44649
MGSEIYPEVHENPRAFFSSSSPIFLEPLAHGSIDWSLPREDCITLAHGSSDGSFPREDCIRVSERILNRGGVKPFLHPNFFPKASENVSAHGLTNPTALSHHFHVLAFIFCTLVCLLQGMAIGLSWLLV

SEQ ID NO: 161428 - protein, 120 aa, Glycine max
  Coding DNA Sequence Number=SeqID_44650
MAGRWVRIMRTSMTTLTQIWMTLLLSNILPSDHNSDLPLPKCQLDYAILTQQPEKDQQQLATGVLPPPLQETQSLGFIPDHLRRLELQMHRGQVQLNETFYRYTMHQQSQDTSPFSWPTP

SEQ ID NO: 161429 - protein, 113 aa, Glycine max
  Coding DNA Sequence Number=SeqID_44651
MAVMMEAMMRVKKIMEANAVAIAATSVVAKVNPTSPSGINQMNHPTSDMGPQYHPQPHPSHSTAIKNPHAMAEMGKLDHLKERLKDIEGGEDCAFANLEELFLVPEHGHSQVQ

SEQ ID NO: 161430 - protein, 83 aa, Glycine max
  Coding DNA Sequence Number=SeqID_44652
MDSALEDETKIEKLEQRNKITATPPKDLPREWRTQKDLSLDNCRNMPFCGRARRGSRVDKSEALAPTYPPSKRKSDLRSSFKS

SEQ ID NO: 161431 - protein, 69 aa, Glycine max
  Coding DNA Sequence Number=SeqID_44653
MAFGGYLAPIAAQYVKFRNMPENKGSIVTQSVRFRNMPKIKRKHCYTICEGVQIETRLTWAFQDVPPEG

SEQ ID NO: 161432 - protein, 52 aa, Glycine max
  Coding DNA Sequence Number=SeqID_44654
MACTHIPYKLENPDESLETSNNSFQNCPMCGISCQCQDLHAILLKFQPARIN

SEQ ID NO: 161433 - protein, 144 aa, Glycine max
  Coding DNA Sequence Number=SeqID_44655
MPTTPFPFPLKAKNPSWGMHPLLSLQGKCVKSPEIMLWVISNHTLHMPLRDQRLVLCLVPDVVIPLKFKVPDFDKYKGTTCLKNHLMMYCRKMGAYSRDEKLLMHFFQESLAGAAITWYTNLEASRIRSWTDLMAAFLKQYQYN

SEQ ID NO: 161434 - protein, 82 aa, Glycine max
  Coding DNA Sequence Number=SeqID_44656
MELPNVASYPSAGRQGETRGCVFPKKKTHGVTTNVYSRKTLEKPKRGLQIFRIRVRELFTCRKGISTPHVCHKGWQPLIEFN

SEQ ID NO: 161435 - protein, 234 aa, Glycine max
  Coding DNA Sequence Number=SeqID_44657
MTALAVSVCSGLGAHAVIWGKIPGWTTRDYKCHFTCLPRPPCALIDAYHDNLSLIPSPLHKLFRQPLFIELQVYVKPDRQPQNLNKTLSTTLQLHHLQSKDYVHQSKAHEQQRFEGFVLSYFVQSLRLISLPFSSPHRKRYHTQIQCARSLPILGFNSSWVHFYKIAPMLEKGLAKRRGRRKEGVGGDSRGTTMVGCDWLSIKIEEPTEITPDSDVQDSVEVHKEENWMRNDRV

SEQ ID NO: 161436 - protein, 1073 aa, Glycine max
  Coding DNA Sequence Number=SeqID_44658
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=98%, HitCoverage=93%, E-value=0.0, Identity=48%"; Hit description =Receptor protein kinase-like protein
  Pfam annotation: Domain name=LRRNT_2; Domain location=25-67; Score =42.5; E_value=1.4e-09; Accession=PF08263.3; Description=Leucine rich repeat N-terminal domain
  Pfam annotation: Domain name=LRR_1; Domain location=120-142; Score =17.6; E_value=0.047; Accession=PF00560.23; Description=Leucine Rich Repeat
  Pfam annotation: Domain name=LRR_1; Domain location=144-166; Score =15.1; E_value=0.25; Accession=PF00560.23; Description=Leucine Rich Repeat
  Pfam annotation: Domain name=LRR_1; Domain location=168-190; Score =12.5; E_value=1.3; Accession=PF00560.23; Description=Leucine Rich Repeat
  Pfam annotation: Domain name=LRR_1; Domain location=192-215; Score =6.0; E_value=21; Accession=PF00560.23; Description=Leucine Rich Repeat
  Pfam annotation: Domain name=LRR_1; Domain location=217-239; Score =7.5; E_value=11; Accession=PF00560.23; Description=Leucine Rich Repeat
  Pfam annotation: Domain name=LRR_1; Domain location=241-263; Score =8.6; E_value=7; Accession=PF00560.23; Description=Leucine Rich Repeat
  Pfam annotation: Domain name=LRR_1; Domain location=265-287; Score =13.6; E_value=0.72; Accession=PF00560.23; Description=Leucine Rich Repeat
  Pfam annotation: Domain name=LRR_1; Domain location=289-311; Score =8.8; E_value=6.5; Accession=PF00560.23; Description=Leucine Rich Repeat
  Pfam annotation: Domain name=LRR_1; Domain location=313-335; Score =7.6; E_value=11; Accession=PF00560.23; Description=Leucine Rich Repeat
  Pfam annotation: Domain name=LRR_1; Domain location=337-359; Score =14.1; E_value=0.51; Accession=PF00560.23; Description=Leucine Rich Repeat
  Pfam annotation: Domain name=LRR_1; Domain location=361-383; Score =17.0; E_value=0.068; Accession=PF00560.23; Description=Leucine Rich Repeat
  Pfam annotation: Domain name=LRR_1; Domain location=385-407; Score =4.1; E_value=49; Accession=PF00560.23; Description=Leucine Rich Repeat
  Pfam annotation: Domain name=LRR_1; Domain location=409-431; Score =20.2; E_value=0.0073; Accession=PF00560.23; Description=Leucine Rich Repeat
  Pfam annotation: Domain name=LRR_1; Domain location=433-455; Score =9.3; E_value=5.2; Accession=PF00560.23; Description=Leucine Rich Repeat
  Pfam annotation: Domain name=LRR_1; Domain location=457-479; Score =14.2; E_value=0.48; Accession=PF00560.23; Description=Leucine Rich Repeat
  Pfam annotation: Domain name=LRR_1; Domain location=481-503; Score =17.4; E_value=0.05; Accession=PF00560.23; Description=Leucine Rich Repeat
  Pfam annotation: Domain name=LRR_1; Domain location=505-527; Score =16.5; E_value=0.097; Accession=PF00560.23; Description=Leucine Rich Repeat
  Pfam annotation: Domain name=LRR_1; Domain location=529-551; Score =16.8; E_value=0.079; Accession=PF00560.23; Description=Leucine Rich Repeat
  Pfam annotation: Domain name=LRR_1; Domain location=553-575; Score =14.7; E_value=0.33; Accession=PF00560.23; Description=Leucine Rich Repeat
  Pfam annotation: Domain name=LRR_1; Domain location=577-599; Score =18.6; E_value=0.023; Accession=PF00560.23; Description=Leucine Rich Repeat
  Pfam annotation: Domain name=LRR_1; Domain location=626-647; Score =13.9; E_value=0.57; Accession=PF00560.23; Description=Leucine Rich Repeat
  Pfam annotation: Domain name=LRR_1; Domain location=649-670; Score =12.7; E_value=1.2; Accession=PF00560.23; Description=Leucine Rich Repeat
  Pfam annotation: Domain name=LRR_1; Domain location=95-117; Score =14.3; E_value=0.43; Accession=PF00560.23; Description=Leucine Rich Repeat
  Pfam annotation: Domain name=Pkinase; Domain location=760-1035; Score= 125.2; E_value=1.8e-34; Accession=PF00069.15; Description=Protein kinase domain
  Pfam annotation: Domain name=Pkinase_Tyr; Domain location=760-1035; Score=82.9; E_value=9.8e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=25-67::120-142::144-166::168-190::192-215::217 -239::241-263::265-287::289-311::313-335::337-359::361-383::385 -407::409-431::433-455::...
  Pfam module annotation: Domain location=457-479::481-503::505 -527::529-551::553-575::577-599::626-647::649-670::95-117::760 -1035::760-1035
  Subcellular localization annotation: CTP_CleavageSite=46; ConfidenceScore=5.22e-01
MSSNALTLFILFLNISLFPAATSSLNQEGLSLLSWLSTFNSSDSATAFSSWDPTHHSPCRWDYIRCSKEGFVLEIIIESIDLHTTFPTQLLSFGNLTTLVISNANLTGKIPGSVGNLSSSLVTLDLSFNALSGTIPSEIGNLYKLQWLYLNSNSLQGGIPSQIGNCSRLRQLELFDNQISGLIPGEIGQLRDLEILRAGGNPAIHGEIPMQISNCKALVYLGLADTGISGEIPPTIGELKSLKTLQIYTAHLTGNIPPEIQNCSALEELFLYENQLSGNIPSELGSMTSLRKVLLWQNNFTGAIPESMGNCTGLRVIDFSMNSLVGELPVTLSSLILLEELLLSNNNFSGEIPSYIGNFTSLKQLELDNNRFSGEIPPFLGHLKELTLFYAWQNQLHGSIPTELSHCEKLQALDLSHNFLTGSIPSSLFHLENLTQLLLLSNRLSGPIPPDIGSCTSLVRLRLGSNNFTGQIPPEIGFLRSLSFLELSDNSLTGDIPFEIGNCAKLEMLDLHSNKLQGAIPSSLEFLVSLNVLDLSLNRITGSIPENLGKLASLNKLILSGNQISGLIPRSLGFCKALQLLDISNNRISGSIPDEIGHLQELDILLNLSWNYLTGPIPETFSNLSKLSNLDLSHNKLSGSLKILASLDNLVSLNVSYNSFSGSLPDTKFFRDLPPAAFAGNPDLCITKCPVSGHHHGIESIRNIIIYTFLGVIFTSGFVTFGVILALKIQGGTSFDSEMQWAFTPFQKLNFSINDIIPKLSDSNIVGKGCSGVVYRVETPMNQVVAVKKLWPPKHDETPERDLFAAEVHTLGSIRHKNIVRLLGCYNNGRTRLLLFDYICNGSLSGLLHENSVFLDWNARYKIILGAAHGLEYLHHDCIPPIIHRDIKANNILVGPQFEASLADFGLAKLVASSDYSGASAIVAGSYGYIAPEYGYSLRITEKSDVYSFGVVLIEVLTGMEPIDNRIPEGSHIVPWVIREIREKKTEFAPILDQKLALQCGTQIPEMLQVLGVALLCVNQSPEERPTMKDVTAMLKEIRHESVDFDFEKSDLLHKSVVTNPKAAVQCPNFSRS

SEQ ID NO: 161437 - protein, 138 aa, Glycine max
  Coding DNA Sequence Number=SeqID_44659
  Homolog annotation: Hit_ID=UPI000034F0B9; Match level="QueryCoverage =36%, HitCoverage=7%, E-value=1e-10, Identity=66%"; Hit description =electron carrier
MKQNCCLRLPQHVDPREGEVRCTNVVQGIRRRRIGSGGGVVAAVLANAGYKVLVLEKGSYSARNNVSLLEGPSMDQMYLSNGLVATNDMFVQILAASTVGDEGNSQYCYKKRVCSNGEAESLWNFGEQLQSGHQFSKF

SEQ ID NO: 161438 - protein, 303 aa, Glycine max
  Coding DNA Sequence Number=SeqID_44660
  Pfam annotation: Domain name=VQ; Domain location=48-78; Score=39.4; E_ value=1.2e-08; Accession=PF05678.4; Description=VQ motif
  Subcellular localization annotation: CTP_CleavageSite=16; ConfidenceScore=5.05e-01
RSPKRQLQGPRPPPLRINKDSHKIKKKPPVAPPSSQPQPPLRQPVIIYTVSPKVIHTTPSDFMSLVQRLTSSSSSSSSSSSNKVSIDPLNGNKGHGGGSGIVSPAGRYATIEMARTTTQSTKQHPIENSDDVGGVDLVGHGVLLKRPNMFHGILSPGPSSSLSPIPSNFFSPPSIDPNMGSFYHDLSPILRNNRNFMEGTTTTATFIMPSPSNFVSPQNGAAKAENTTEGGTLPVAPLVQGPAVRGRHGGGSVRVAMARRVNGDGDAPTLPWGLADGHGGATTEGGAVGYLMILLSSLTKFVK

SEQ ID NO: 161439 - protein, 609 aa, Glycine max
  Coding DNA Sequence Number=SeqID_44661
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=96%, HitCoverage=97%, E-value=1e-172, Identity=52%"; Hit description =Putative receptor kinase
  Pfam annotation: Domain name=LRR_1; Domain location=123-145; Score =17.6; E_value=0.044; Accession=PF00560.23; Description=Leucine Rich Repeat
  Pfam annotation: Domain name=LRR_1; Domain location=147-168; Score =10.7; E_value=2.9; Accession=PF00560.23; Description=Leucine Rich Repeat
  Pfam annotation: Domain name=LRR_1; Domain location=169-191; Score =13.1; E_value=0.99; Accession=PF00560.23; Description=Leucine Rich Repeat
  Pfam annotation: Domain name=LRR_1; Domain location=75-97; Score =13.8; E_value=0.63; Accession=PF00560.23; Description=Leucine Rich Repeat
  Pfam annotation: Domain name=LRR_1; Domain location=99-121; Score =17.0; E_value=0.067; Accession=PF00560.23; Description=Leucine Rich Repeat
  Pfam annotation: Domain name=Pkinase; Domain location=307-571; Score =56.4; E_value=9.3e-14; Accession=PF00069.15; Description=Protein kinase domain
  Pfam annotation: Domain name=Pkinase_Tyr; Domain location=306-571; Score=35.4; E_value=1.2e-14; Accession=PF07714.7; Description =Protein tyrosine kinase
  Pfam module annotation: Pfam domain module=LRR_1::LRR_1::LRR_1::LRR _1::LRR_1::Pkinase::Pkinase_Tyr; Domain location=123-145::147 -168::169-191::75-97::99-121::307-571::306-571
MAKMLGLLFMIGAMFFGVVAEPVEDKQALLDFLHNINHSHYLNWNKNTSVCKSSSLTRTGLSGPIPSNTLSRLSKLETVSLASNSISGSFPSGLSQLKNLTYLYLQSNNFSGSLPSEFSVWKNLRIVNLSNNSFNGSIPFSLSNLTHLTSLVLANNSLSGEIPDLYIPSLQDLNLANNNLSGVVPKFLERFPSGAFSGNNLVSSHPSLPPSYAVQTPNLHPTRKKSKGLREQALLGIIIGGCVLGIAVMAAFVIVCCYEKGGADEQQVKSQKRQVSRKKEGSESRDKNKIVFFEGCNLAFDLEDLLRASAEVLGKGTFGTVYKAALEDATTVVVKRLKDVTVGKHEFEQQMEMVGWIRHDNVAALRAYYYSKEEKLMVYDYYEQGSVSSMLHGKRRGGRISLDWDSRLKIAIGVARGIAHIHTQHGGKLVHGNIKASNIFLNSKGYGCLSDIGLAALMNPALRATGYRAPEATDTRKAIPASDVYSFGVLLLELLTGRSPLHAKGGDEVVHLVRWVNSVVREEWTAEVFDVDLLRYPNIEEEMVEMLQIGMACVVRVPDQRPQIGEVVRMVEEIGRVINTENRSPTESRSEGSTPTPHAIETPSSSFAH

SEQ ID NO: 161440 - protein, 138 aa, Glycine max
  Coding DNA Sequence Number=SeqID_44662
TYQGNPYGVYPDLSSFTGSGVYPDLSSFTESGVIQISVTCIKRSAPSQAKSPSGEGQSPRVEKDEGTSNPCGVYPDLSFFTGSGVYPDLSSFTRSGVIQISVACIKRSAPPMSPKSPLATENVLMSKEKELSLLETPA

SEQ ID NO: 161441 - protein, 418 aa, Glycine max
  Coding DNA Sequence Number=SeqID_44663
  Homolog annotation: Hit_ID=Q9FK19; Match level="QueryCoverage=71%, HitCoverage=60%, E-value=8e-36, Identity=34%"; Hit description =Arabidopsis thaliana genomic DNA, chromosome 5, TAC clone:K19E1
TPSDGIFHRSHILDVLPSRKTKQLTFQTEESHGKNMAPSTLIGAKSAPTSVIDIIDSDDEPNIIQNPVPDRQGSESISVSACFAADGKESNNSSAQNNQDSLDLDENLLFVATPKRKRTCNVVTSESESDDDNILICKLKRKHIQEPSSDQVRPDLSSSPPANISEDNKVTDSVMTRRRLWPLRKCARKSQDDKISSCRPRKAKNQQSIPTNDDADDESEEDLSYSEGENMSDFIVDDSDVSNCEDTSSTSQDVANSDVADSDSANSQDVQDSNMESYSQDVSDEDMDFGNILSKIQRSKTNMKWEFEADMLAAFGKDPELCMKAVCALYRQQTSEEQMSKGALLSNQRGFNKFDAYKGSILAEFLTDGDPYGGLKKSVKELQENDPEAVELCRSLATHYSKQLYEIYKNKEDPLFPG

SEQ ID NO: 161442 - protein, 376 aa, Glycine max
  Coding DNA Sequence Number=SeqID_44664
  Subcellular localization annotation: CTP_CleavageSite=20; ConfidenceScore=5.34e-01
MASASSPPPPLSSPAVMPSPASLLQSISMKLTNSNYILWCNQVQPVIKGHGLSHFLVAPIILPQFDTIADHEAGIVPGHVDIILERLPTEYESTVTFIYNMSKLMPVDDVESLLLAHESCIAKLTKKSLGLVNLTECNLNSTPNSSESQSQVTDSSNFNPQVHLTQASNNTSNDNGDYNNPYGHKATFFHHWYDDNYVPLQPMDYTNSSSTQNSQSQTQTPTQPSQWPSTTAQTHPQTYYNHYPSPFPYYSYPPQYMTPPTIIPHLQFSLTPPPPQDQNPKLRLSLQPAQTSKWYPNSSASHHVTNVSHNIQQVTPFEGPDQITIGNGQGLNIYPSSVSSFHSPFNSKVPLTLKNLLSIPSITKNLPSVSQLCKDN

SEQ ID NO: 161443 - protein, 158 aa, Glycine max
  Coding DNA Sequence Number=SeqID_44665
MGPKATKRKMKEKRGATSSSIMDSTGMEAKIREKKEAVSTKVSNAEAIVPSNCRAFVKDVNEIFEDKYLRSPNNNNCLLQNAKTHGFPDEQDTYNGSVDVDYDHVDEEISNVDVSHGASLDYTSTNKTLYAYKRSLSTTLSKLREHIWAYFSHNNVGI

SEQ ID NO: 161444 - protein, 94 aa, Glycine max
  Coding DNA Sequence Number=SeqID_44666
MKIKMQCQCTQLRAFPVPPVRSFFSKLDLRDIAYEIIVEACRSLGSKQLTFAAREIGSVRQCRHCIVVADFDGSEQDEDGGGGIRRATSVYMCH

SEQ ID NO: 161445 - protein, 67 aa, Glycine max
  Coding DNA Sequence Number=SeqID_44667
MVSALTIPMFHTSYCMEITIGEGGVACARQDDLDTCCLVFLSESVAWTCLGYFLKNGITLHLRDEVR

SEQ ID NO: 161446 - protein, 384 aa, Glycine max
  Coding DNA Sequence Number=SeqID_44668
  Gene Ontology: Mol. function=sulfuric ester hydrolase activity; Cellular component=endoplasmic reticulum; Biological process =metabolic process
  Homolog annotation: Hit_ID=Q9SGH9; Match level="QueryCoverage=65%, HitCoverage=26%, E-value=1e-81, Identity=59%"; Hit description =Putative phosphatidylinositolglycan class N short form
  Pfam annotation: Domain name=PigN; Domain location=68-379; Score= -24.2; E_value=2.7e-10; Accession=PF04987.4; Description =Phosphatidylinositolglycan class N (PIG-N)
MIKQKSSLPMLVSLTTSDIKQSNSLYFKHFKPLSHYSSILDKIEGLISARDYDAAMDLSQNLRSLALQGLHYFQTYDWLMLFSVITLGYVGWMIYLVLHVLQSYTSLPGNAFGMEQAVQKNNRGKIYLYGSMVTGMLCLLLLLEQSPPLYHAYIIMTSFLWVRIISEYQFIKTLWKHLSRRRMNYIIKLLAITAISVFILEFLVNSFTERKLYTWCFLIAGATASFYLFKSIPWRSGIPIYVCLACWFLSLFTLMPAEIPDNNQLVVSSGVIIIIIGIVARWLDLHAGGRKYWLSICNCKLKSSKFSSLFYLQALLVALSSVMVYLSTVHRTEKRELLASHQLINWSVAAAMAEWRRGILEKRHQIAVALRVAYGGRHSHGGIA

SEQ ID NO: 161447 - protein, 511 aa, Glycine max
  Coding DNA Sequence Number=SeqID_44669
  Gene Ontology: Mol. function=sulfuric ester hydrolase activity; Cellular component=endoplasmic reticulum; Biological process =metabolic process
  Homolog annotation: Hit_ID=Q9SGH9; Match level="QueryCoverage=84%, HitCoverage=38%, E-value=1e-126, Identity=79%"; Hit description =Putative phosphatidylinositolglycan class N short form
  Pfam annotation: Domain name=Phosphodiest; Domain location=65-397; Score=-82.9; E_value=0.0024; Accession=PF01663.12; Description=Type I phosphodiesterase  nucleotide pyrophosphatase
MHSDGILGNREGSGRKWLRRRERWLVVLGVILHAVYMLSIFDIYFKTPIVHGVDPVTPRFAAPAKRLVLLVADGLRADKFFELDAKGNQRAPFLRSIIETQGRWGVSHARPPTESRPGHVAIIAGFYEDPSAVTKGWKANPVEFDSVFNRSRHTISFGSPDIVPIFCGALQHTTWDTYPHEFEDFATDASFLDMWSLDKFQSLLNRSREDPKLKELLQQDNLVVFLHLLGCDSNGHAHRPFSSIYLNNVKVVDHVAESVYNLVQDYFKDNRTSYIFTADHGMSDKASTTGCALTGEAAGSGCAMLKPLVADLAHETGTVVTRPTMGREGEKERVSESDVMLFMEAGSGREEISAVYDCWESPQRHGDGHPSNTDTPLVAWGAGVKYPRPISSSNHSDCGFRFVDDHVHDTPTPVEWGLNEIERVDVNQADIAPLMVSTLLGLPCPVNSVGSLPLDYINMTKADRNHCQWMTNTIEKNSELWKLMWKCVLIKEKQIQRDQYPYCPGLSSSRG

SEQ ID NO: 161448 - protein, 664 aa, Glycine max
  Coding DNA Sequence Number=SeqID_44670
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=60%, HitCoverage=32%, E-value=8e-97, Identity=38%"; Hit description=Chromo
  Pfam annotation: Domain name=rve; Domain location=380-529; Score =46.8; E_value=7.3e-11; Accession=PF00665.16; Description=Integrase core domain
  Pfam annotation: Domain name=zf-H2C2; Domain location=321-362; Score =8.8; E_value=0.025; Accession=PF09337.1; Description=His(2)-Cys(2) zinc finger
  Pfam module annotation: Pfam domain module=rve::zf-H2C2; Domain location=380-529::321-362
MVMNGLNYMVRKMGLPGRWHFKAYSVISLTKWSKEHEVNNLLTQYQDIFKKPRGLPPPRKKEHAIILLEGQGPINVRPYRYPNHHKNEIEKQMKKWVLVFFDDILVFRPDWASHAAFDGGVGVEYLGHIISKDEVAMDPNKIKSVHQWSVPKHVKGVRGFLGVTGYYRKFIKDKGKIAQPLTVLTKEGFQWGPQAQETFEILKEKIIMALVLALPDFNLEFVIESDASGQGLGAILTQQGKPVAYFSKALSERNLAKSAYKKELMAVALAIKHWQPYLIAENSLFDIMYKPGLENTGADPLSRMYGKGKLIIILRPSEEFHSTPQGGHSGFYRTYRRIEANLYWIGMKKYVLQFVKECDVCQRQKYLATALGGLLQPLNIPNQIWEEISMDFITELPKSKGFAAILLVVDRSSKYSHFIPLKHRYTAKVIAEVFTKEIVRLHGIPASILSDRDPIFVSGFWRELFKLQGSRLKMSTAYHPQTDWQTKVEAVQRKLSDRDEDLRQLKHHLQRAQCRMKTQVLEKIGAVAYKLQLPESAPIHPVFHVSLLKKAIGDYRVEKDLPNNLEGDTATVQEPETVLAARTIEKWGDLGRLLRKPLGRNSSTFGVNFPCSDLRTSLFLKRGTMLGPHYWALILMGLVLYSWPGPPYGESTLRGIGRKTQNNC

SEQ ID NO: 161449 - protein, 175 aa, Glycine max
  Coding DNA Sequence Number=SeqID_44671
  Gene Ontology: Mol. function=transferase activity; Cellular component= endoplasmic reticulum; Biological process=metabolic process
  Homolog annotation: Hit_ID=Q9SGH9; Match level="QueryCoverage=78%, HitCoverage=14%, E-value=2e-46, Identity=71%"; Hit description =Putative phosphatidylinositolglycan class N short form
  Pfam annotation: Domain name=PigN; Domain location=1-144; Score= -173.1; E_value=0.0013; Accession=PF04987.4; Description =Phosphatidylinositolglycan class N (PIG-N)
  Subcellular localization annotation: CTP_CleavageSite=68; ConfidenceScore=5.02e-01
MAWILFENTILNLNIVNKSSDSTKSVTNHLIHGSDNRSLQLSDVRIPLVFMVLFNVAFFGTGNFASIASFEISSVYRFITIFSPFLMAALLIFKLFIPFLLVICVFSAITKLNQVPRLGCYFLVILFSDMMTIHFFFLPTVIGVQLVIPFGLNVLYLCTRCKSKNIHQISSIELS

SEQ ID NO: 161450 - protein, 109 aa, Glycine max
  Coding DNA Sequence Number=SeqID_44672
MQWHPAAFPIIDGGIQNLFLIPDGGRPLGHVASCIYFLSIFVLMAISWPPREEEWSIIPQVLRLLRPKHLSHEFIFLIHPYGYELAYQGGRTVHSPLSAKAVKVQALKS

SEQ ID NO: 161451 - protein, 110 aa, Glycine max
  Coding DNA Sequence Number=SeqID_44673
  Homolog annotation: Hit_ID=Q6EUN5; Match level="QueryCoverage=45%, HitCoverage=6%, E-value=4e-10, Identity=64%"; Hit description =Putative phosphatidylinositolglycan class N short form
MQRNGFRIQTHDQPVTKTQLVRNTGSWMEIGNSISHFGIMSAQVVFVLLLFALTNTYTKDIHCNSAVSSTRLRTGGSDLELRERRANIVPHHLICTGPGPGPGPGDGIFV

SEQ ID NO: 161452 - protein, 36 aa, Glycine max
  Coding DNA Sequence Number=SeqID_44674
MEKSMIGLNEDDTLMPHVQSKHLDEGTKATWCKWLR

SEQ ID NO: 161453 - protein, 58 aa, Glycine max
  Coding DNA Sequence Number=SeqID_44675
  Homolog annotation: Hit_ID=Q9LZ20; Match level="QueryCoverage=79%, HitCoverage=8%, E-value=5e-09, Identity=63%"; Hit description=Amino acid transport-like protein
MTATATKSISLKPLGRDGTVRRHLAEEIPIVVPRYAIKPLATMALENKGVCRYKAFFL

SEQ ID NO: 161454 - protein, 38 aa, Glycine max
  Coding DNA Sequence Number=SeqID_44676
MKLHSLASYLSQEILAEQEVDRVHGLPAQHPVKFNNMV

SEQ ID NO: 161455 - protein, 287 aa, Glycine max
  Coding DNA Sequence Number=SeqID_44677
FYANLYDPDDKSPKQVRVRGHLIKFDEDTLNTFLKTPIVLEEGENLCTYSRFALLRPDPQELAAKLCIPGRGFELNVDGRPLKILRKNMTTLAQTWSILSFSNLIPTSHTFDVTLDRAKLIYGIIMKMDINMGYLISHQISLIAQHDTSRLGFPALITALLTFRGPKKARGKRSEAPSTSAPSEAPTPSSSPVPPFSSTQILVIPPAPLHMPFPAPLSAGGGASTTQEPMTEEPPAPAPVPVATEEETTLDQTQPSSPVAKPEQLIQDSTVTPALDLNEDQPHEEQD

SEQ ID NO: 161456 - protein, 163 aa, Glycine max
  Coding DNA Sequence Number=SeqID_44678
  Gene Ontology: Mol. function=oxidoreductase activity; Biological process=electron transport
  Homolog annotation: Hit_ID=UPI0000E695EC; Match level="QueryCoverage =99%, HitCoverage=25%, E-value=4e-60, Identity=68%"; Hit description =twin-arginine translocation pathway signal
MGITRRDFLNGVAITIAAGLTPLQILRASPQTANQTLYYPPALTGLRGNHPGSFEHAHQLGRDGKTFDFGSVPAVEEFDLVVVGAGISGLAAACFWQQLKGEQQRILLIDNYDDFGGHAKCNEFNTNHGMLLGYGGSESLQSPRSNFSPVAMGLLRNLSVDID

SEQ ID NO: 161457 - protein, 110 aa, Glycine max
  Coding DNA Sequence Number=SeqID_44679
MAATISRVHLCSHAKDGAPDARIYAAYDRPSQDPSPFPWPTPKQFRATVALSGDRLNIQTGAGPVVMEACLWGFYGGWIFKLQWGPLMVIFHHGDAAEDKGKEVRGGTIH

SEQ ID NO: 161458 - protein, 66 aa, Glycine max
  Coding DNA Sequence Number=SeqID_44680
MCVQEEERLLMKMGESALLTTACGKKKTTKSQANKKRNGKIPPQVDNKKVAKCFFWYAKPKETSGK

SEQ ID NO: 161459 - protein, 933 aa, Glycine max
  Coding DNA Sequence Number=SeqID_44681
  Gene Ontology: Mol. function=RNA binding; Biological process =regulation of translation
  Homolog annotation: Hit_ID=Q9M6S0; Match level="QueryCoverage=93%, HitCoverage=100%, E-value=1e-174, Identity=37%"; Hit description =Pumilio domain-containing protein PPD1
  Pfam annotation: Domain name=PUF; Domain location=618-652; Score =43.2; E_value=9e-10; Accession=PF00806.9; Description=Pumilio-family RNA binding repeat
  Pfam annotation: Domain name=PUF; Domain location=654-688; Score =32.0; E_value=2e-06; Accession=PF00806.9; Description=Pumilio-family RNA binding repeat
  Pfam annotation: Domain name=PUF; Domain location=690-724; Score =35.3; E_value=2.1e-07; Accession=PF00806.9; Description=Pumilio -family RNA binding repeat
  Pfam annotation: Domain name=PUF; Domain location=726-761; Score =37.9; E_value=3.4e-08; Accession=PF00806.9; Description=Pumilio -family RNA binding repeat
  Pfam annotation: Domain name=PUF; Domain location=763-797; Score =38.5; E_value=2.3e-08; Accession=PF00806.9; Description=Pumilio -family RNA binding repeat
  Pfam annotation: Domain name=PUF; Domain location=799-833; Score =44.5; E_value=3.7e-10; Accession=PF00806.9; Description=Pumilio -family RNA binding repeat
  Pfam module annotation: Pfam domain module=PUF::PUF::PUF::PUF::PUF::PU F; Domain location=618-652::654-688::690-724::726-761::763-797::799 -833
MATESPIRISEAGSKWPSLKEAATFGSPSRHMATEDLGIFLNGHRFHGSGKDAVPNRSGSAPPSMEGSFLAIENLLSQNTTRNASLGSRNRAMQKYDSGKGSFHLSQGTLATHKEESEDDLTQKLYNNLLDKASGKWHRQDAASTSSQDTNLVLEDFPHIMSPVYNKSLGVVDELIDVDTGSSSSLGPPVTTVDAVKPTIGADDVRLSSTVDSRAPVTSSSSLNSTGSMGFNVLDVTIVESQLRALNVSNLPNSESQSYEDKWKNSCQNNLMQHQQQNYPCVVPNTNSQSEKCTYVGMEQFLHNPSKFSSDVQPVLQSSGYTPPLYATAAAAYMTSANPFYTNLQASGIYSPQYIGAYPFSPTAVPPYIAAYPPHGSVPLVDGATGSSFTPQAPGISSTAGNISHGAEMMHANKFFGQFGFPLQPSFSDPIYMQYHQQPFVEGYGVSAHLLAPRASVGGQIGPFDSQKRPNSGAYLDDKKLHNQKTGANLNSNRDGLIHPGYFGHPSNLGFVPQYPSSPLCRPVLSGYPESSPGLLGGRNEMKRSPASGRNGGLLSGWQGQRAFDSAHDPKIAIFLEELKSGKGRRFELSDIIGHIVEFRQQKLESCGVEEKELVFKEVLPHTSKLMTDVFGNYVIQKFFEYGSPEQRKELANRLLGQILPLSLQMYGCRVIQKALEVIDLEQKAQLVHELDGNVMRCVRDQNGNHVIQKCIESIPTKNIDFIISAFRGQIALLSMHPYGCRVIQRVLEHCSNEVQCQFIVDEILESVFTLAQDQYGNYVTQHVLERGKPQERSQIIHKLSGHIFQLSQHKFASNVVEKCLEYGDATDRQLLIAEIVGHDKQNDNLLSTEKWSLVFLSNQIIQLTSKMTNRSQILASLFLLLKCVLSYPGFMENPRHTASQEEEGSWVTMQISGLLVSELHLHMTMKAYLLVS

SEQ ID NO: 161460 - protein, 258 aa, Glycine max
  Coding DNA Sequence Number=SeqID_44682
  Gene Ontology: Mol. function=transferase activity
  Homolog annotation: Hit_ID=Q1T1H8; Match level="QueryCoverage=82%, HitCoverage=62%, E-value=3e-74, Identity=66%"; Hit description =Glutathione S-transferase, C-terminal-like
MAEVNTLVVRKPCFGLPTGCPQCLSAYIYLKFAQFPFQLDFHLNNPHSDQIPYFEVGDYVAYNNEKEGIIECLKKDVGVVDLDSGVSSLPEWISTKAILTTWLADALTYELWLGCEGSSAYSIYYPDLPWPLGKILSWKKAHWVKLKHGITNDNAEVKKEEIYERAKSAYDALSSCLGEQNYLFENRAIIDFNLLVMYSYALFGLCRPSSLDAIFLAHGLVVLHALPLVAVVVFLTLMTSFDDAEVELDDDGGYDFDE

SEQ ID NO: 161461 - protein, 37 aa, Glycine max
  Coding DNA Sequence Number=SeqID_44683
MKRDEILSQQIYAYQMLTANPFMGKDNNHIRLCRNLI

SEQ ID NO: 161462 - protein, 88 aa, Glycine max
  Coding DNA Sequence Number=SeqID_44684
MPLEKDPVRPHKWIWSLTNIGFEVRNTNAILKQSRVGLSSRRDRDHAFQTPSGPREVQQSTEVFSLDHGPLPVLWGASYSLKAYPAPH

SEQ ID NO: 161463 - protein, 75 aa, Glycine max
  Coding DNA Sequence Number=SeqID_44685
MASSLPFLNFCVRHACPSVIVFNFYLNAYSTPLIEPNGSGFSGQDRECEGNSSSSMLASNNAPPEKAFFTTKGPS

SEQ ID NO: 161464 - protein, 107 aa, Glycine max
  Coding DNA Sequence Number=SeqID_44686
GVLVEALIQLHLTPMISRLLVGHMLHICVHLELHPLQVSREGLQRWWLPAAVEVAAMHLQLAGPPPAATVPNPIDNWQRPVIKAENLSALLDFSRSTRCLEGVIPEN

SEQ ID NO: 161465 - protein, 148 aa, Glycine max
  Coding DNA Sequence Number=SeqID_44687
  Homolog annotation: Hit_ID=Q1SWQ8; Match level="QueryCoverage=97%, HitCoverage=53%, E-value=2e-17, Identity=30%"; Hit description =Nucleic acid-binding, OB-fold; TonB box, N-terminal
MDLKENCTYVMHNFKVLKNNGQYRVCDHQFKLVFIGVTVVRECVLEDIPFRKYRFAGFADVVAGQFEPRLLVDVIGVVEEVVFRQVSGKGRRVVFKLKDLSQQLLSCTLWDDYCLQFLKFLDDYEGDGPIRVLLTHGRIKEAQGISLS

SEQ ID NO: 161466 - protein, 171 aa, Glycine max
  Coding DNA Sequence Number=SeqID_44688
  Gene Ontology: Mol. function=nucleic acid binding; Cellular component= intracellular; Biological process=DNA integration
  Homolog annotation: Hit_ID=Q1RSN0; Match level="QueryCoverage=95%, HitCoverage=30%, E-value=3e-29, Identity=34%"; Hit description=Zinc finger, CCHC-type
MEEGFNVNKPPMLEGANYDDWKEGIIAFFESTHIDMWDVVEKGSQIPLEEYSKVDGYRSAKQMWDTFAITYEGSCETKHKRLSLLMRKYELFSLEEGIDVQTMFGCFQNILNELYSLGRHYDNYDHIDKILQSLSRKWRPHVTALIANKNLDSMTLEELVGILKLHQQKLA

SEQ ID NO: 161467 - protein, 113 aa, Glycine max
  Coding DNA Sequence Number=SeqID_44689
MGEVEEVQKQMKADMEAMMSMKKIMEANAVAVAATSTVAKVNPMPPSGLNQMNHPTSNMVGKDLGSTDDPYYVQIQNKNAFPPYGFPPNYTPPNVAYTPSENVNNSTPILTES

SEQ ID NO: 161468 - protein, 76 aa, Glycine max
  Coding DNA Sequence Number=SeqID_44690
MWGYRMVIRTFCHPKMASLMTCGGYRMVICTFRHPGANKPVDAQGLTSSSAPFVNQGGSEPVDAQRLTSSSTPFVI

SEQ ID NO: 161469 - protein, 83 aa, Glycine max
  Coding DNA Sequence Number=SeqID_44691
MHGVATNVYSRKMLEKPERCGLRTLIVKGSGVVFMHGEGCFPRSYVSSIAMRKSYLRSSFRTKRWLSCFDLFRKIDFNRTKVV

SEQ ID NO: 161470 - protein, 237 aa, Glycine max
  Coding DNA Sequence Number=SeqID_44692
  Homolog annotation: Hit_ID=O24097; Match level="QueryCoverage=96%, HitCoverage=56%, E-value=9e-68, Identity=51%"; Hit description=MtN19 protein precursor
  Pfam annotation: Domain name=SURNod19; Domain location=2-236; Score =122.1; E_value=1.6e-33; Accession=PF07712.3; Description=Stress up -regulated Nod 19
MVIDTRGAYSRKGCTECRCDLLNLPKDFYNVTRDINDQPLSLNYKGGLFCCKDNLQCKLRKGFHGPTRKLSLRYKIRWVDWDEHQVPLKFYILDTTDRVRTNGSSTIHDCQAEYTIPRIGHGDSPHVKKANIPMKKGGYLIYGTSHMHTGVVNATLYGQDGRVLCTSTPKYGTGKEAGNERGYLVGMSGCYPKPGSVEIKDGEILTLETTYQNKFRTGAMGFFYIHLAEQLPNILKI

SEQ ID NO: 161471 - protein, 415 aa, Glycine max
  Coding DNA Sequence Number=SeqID_44693
  Homolog annotation: Hit_ID=Q64EX4; Match level="QueryCoverage=97%, HitCoverage=94%, E-value=1e-115, Identity=48%"; Hit description =MtN19-like protein
  Pfam annotation: Domain name=SURNod19; Domain location=30-414; Score =528.3; E_value=8.5e-156; Accession=PF07712.3; Description=Stress up -regulated Nod 19
MTLQIFFIANFLIPNDLCTVVLSGTTYSIFLESENHIKSATFVSKSFEVGPGKIASKALYDIEFPKGHIGVKSFDAELVDEDGKSVPLYETYLHHWFAIKYNENITMSRYIEQSHDISKGINYTRNDGACRGFLLPHYWGLGGESRGTSSNLPDPFAVEFGNPTNIPHGFKEKWLFDIMVIDTRGAYSRKGCTECRCDLLNLPKDFYNVTRDINDQPLSLNYKGGLFCCKDNLQCKLRKGFHGPTRKLSLRYKIRWVDWDEHQVPLKFYILDTTDRVRTNGSSTIHDCQAEYTIPRIGHGDSPHVKKANIPMKKGGYLIYGTSHMHTGVVNATLYGQDGRVLCTSTPKYGTGKEAGNEKGYLVGMSGCYPKPGSVEIKDGEILTLETRYQNKFRTGAMGFFYIHLAEQLPNILKI

SEQ ID NO: 161472 - protein, 76 aa, Glycine max
  Coding DNA Sequence Number=SeqID_44694
MEEGFNVNKPPMFKGANYDDWKEGIIAFFESTHFHMWDVVEKGSQIPLEEYSKVDSYRSAKQMWDTFAITYKGLVL

SEQ ID NO: 161473 - protein, 92 aa, Glycine max
  Coding DNA Sequence Number=SeqID_44695
  Gene Ontology: Mol. function=transporter activity; Cellular component= membrane; Biological process=oligopeptide transport
  Homolog annotation: Hit_ID=Q1SIG4; Match level="QueryCoverage=89%, HitCoverage=15%, E-value=5e-30, Identity=77%"; Hit description=TGF -beta receptor, type I/II extracellular region
MEKYLVSKTIEFSERLSYFGIATSLVIYLTKVLHQDLKTAVKNVNYWSGVTTLIPLLGGFLADAYLGRYTAVIASCIVYLMVINLKSQSPFN

SEQ ID NO: 161474 - protein, 487 aa, Glycine max
  Coding DNA Sequence Number=SeqID_44696
  Gene Ontology: Mol. function=transferase activity, transferring glycosyl groups; Cellular component=nucleus; Biological process =nicotinate nucleotide biosynthetic process
  Homolog annotation: Hit_ID=Q6D454; Match level="QueryCoverage=72%, HitCoverage=87%, E-value=1e-150, Identity=74%"; Hit description =Nicotinate phosphoribosyltransferase
  Pfam annotation: Domain name=NAPRTase; Domain location=126-353; Score= 406.0; E_value=5.5e-119; Accession=PF04095.6; Description=Nicotinate phosphoribosyltransferase (NAPRTase) family
DEQLGQYADAIRTHITAMQSLALSDDEYRYLSSLPFFQQDYLDWLRQFRFDASQVEVREDHGHLRIQIRGPWREVILWEVPLLALISEVVHRHRTPESGAEQAVAHLQQKLVHFREQVGDLDMSRFQLMDFGTRRRYSRAVQEAIVSTLKNEFPWLLGTSNYDLARRLQLNPVGTQAHEWFQAHQQISPVLANSQRAALQSWLDEYDNQLGIALTDCITMDAFLRDFGPGFAHRYQGLRHDSGDPVEWGEKAIAHYQRLNIDPLSKTLVFSDNLNLDKALALYRHFGQRANVVFGIGTRLTCDIPGVTPLNIVIKLVSCNGKPVAKLSDSPGKTICQDKAFVRALRKAFDLPLRMYCTAVSRLTVKSPYVVGYVPEEIPKPDEVLRLTTGCSVIVTGKVVESPGEGQAFELQATQVEVTGWVDDPDTYPMAAKRHSIEYLREVAHLRPRTNIVGAVARVRHTLAQALHRFFHENGLFLGLHAADHCL

SEQ ID NO: 161475 - protein, 187 aa, Glycine max
  Coding DNA Sequence Number=SeqID_44697
  Gene Ontology: Mol. function=methyltransferase activity; Cellular component=integral to membrane; Biological process=peptidoglycan metabolic process
  Homolog annotation: Hit_ID=P22525; Match level="QueryCoverage=68%, HitCoverage=20%, E-value=3e-42, Identity=62%"; Hit description =Hypothetical protein ycbB
MLLNKKSRVNRAAIALSLSLMAAPLVISQAADVGALPHSTLSVAASQQQIQQAFSPSERPFYLPGLAGIYAARNMAPLWQDRDAVQAFQQQLAEVALSGVQPQFTRWVELLTNPDIKGFARDVVLSDAMLGYLQFVANVPTQGETWLYSNVPYKLTMPSLSAINQWQNAVNGGGSRAFVVSLQPQHP

SEQ ID NO: 161476 - protein, 331 aa, Glycine max
  Coding DNA Sequence Number=SeqID_44698
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=23%, E-value=1e-111, Identity=53%"; Hit description =Chromo
  Pfam annotation: Domain name=RnaseH; Domain location=22-143; Score= -28.4; E_value=0.025; Accession=PF00075.14; Description=RNase H
  Pfam annotation: Domain name=rve; Domain location=228-331; Score= -1.7; E_value=0.0083; Accession=PF00665.16; Description=Integrase core domain
  Pfam annotation: Domain name=zf-H2C2; Domain location=176-210; Score =17.7; E_value=0.0016; Accession=PF09337.1; Description=His(2)-Cys(2) zinc finger
  Pfam module annotation: Pfam domain module=RnaseH::rve::zf-H2C2; Domain location=22-143::228-331::176-210
MAFDILKAAITKAPVLALPDFSKAFTLEIDAFGIGIGAVLSQEQHPIAFFSKKLTPRMQRQSAYIREFYAIREAVAKFRHYLLGHRFVIKTDQRSLKSLTEQAIQTPEQQKWLHKLLGYDFSIEYKPDKENLAADSLSRSFFMAWSKPKLKLVIPSNHELVKRILHEFNTSLIGGHAGVARTLSRIALQFYWKGMHKDVKEFVQQCLTCQQAKSDTMLPLGLLQPLPIPMQIWEDLAMDFITGLPPSNGFTVILVVIDRLSKYAHFFTLKFDYNSKQVAEVFVKNIVKLHDFPKSIVSDRDKAFTSQFWQQMFKLNGTTINLTTTYHPQLD

SEQ ID NO: 161477 - protein, 131 aa, Glycine max
  Coding DNA Sequence Number=SeqID_44699
  Gene Ontology: Mol. function=zinc ion binding
  Homolog annotation: Hit_ID=Q5YLY5; Match level="QueryCoverage=61%, HitCoverage=18%, E-value=5e-10, Identity=46%"; Hit description=Zinc finger protein-like
LLLRRATATKTKTTSPRAKQDPPPSNPPYSVPVYGRQNEDVYGERVLAYDGGKVELYGARGSVPKSSSTWSSFDDYGRAIGGGGGAPPPATATSKVVKAMPKVDAEGDTKSGVQKFRVKLLAESGGQITID

SEQ ID NO: 161478 - protein, 53 aa, Glycine max
  Coding DNA Sequence Number=SeqID_44700
MELQNNWRCCQRENVDDTAGAAQLQMVCMMLVRFPAFELRKSTGLMYLQNKFK

SEQ ID NO: 161479 - protein, 171 aa, Glycine max
  Coding DNA Sequence Number=SeqID_44701
  Gene Ontology: Mol. function=transporter activity; Cellular component= membrane; Biological process=response to nematode
  Homolog annotation: Hit_ID=Q9LXV3; Match level="QueryCoverage=68%, HitCoverage=21%, E-value=3e-38, Identity=68%"; Hit description=2 -oxoglutarate/malate translocator-like protein
MKAELKCSSEFSRDFHCNFNIIFNIKTLRSNRQSLRSLHHSIASAILGLGVFVLTKTLPFAASFSGFGDPIPWLIALAFFFAKGFIKTDLGNCVVYQFIKLLGSSSLGLGYSLVFSKALLALAIPSVSMRAGGIFLPLVKAPCVVCGSNTSDGMEHRLGNVHHELAEVTVG

SEQ ID NO: 161480 - protein, 250 aa, Glycine max
  Coding DNA Sequence Number=SeqID_44702
  Gene Ontology: Mol. function=nucleic acid binding; Biological process= DNA integration
  Homolog annotation: Hit_ID=Q1SAK3; Match level="QueryCoverage=71%, HitCoverage=12%, E-value=2e-10, Identity=29%"; Hit description =Integrase, catalytic region; Zinc finger, CCHC-type
MVDASTGKTEPALDTSSDDQDSQPDDTVNSDGEELIFESREDLIKGHNHLLFISPHVSKSYSKLNKHFQHLEREHKDHKKERVKSLTTALDDSEEERKELPPKIEKLYKEIETFRDNLGKFICGHEALKKIIKVQRNPKDKSSHGFKGKKVVNAKEVNVSYFYGKVGHKAHKCKDLPKEGNPSKDLLDSRKETPIMVPRQWLLTTHDRQKVYFSIPCRSKLHDDESSSFDDDKKLKRMISRLSQQVQDQD

SEQ ID NO: 161481 - protein, 122 aa, Glycine max
  Coding DNA Sequence Number=SeqID_44703
MVSPFTMACCRAWTRQSNWRVEGADFLGCRQQQQQQRLFPRLQSATLQEVAIFNGVLLGQRRQHQQRFALPELLKSPLFVDHFTREKKKEKRRLVLCLRKNEGVLLCCLYLSKPLLLFFILS

SEQ ID NO: 161482 - protein, 69 aa, Glycine max
  Coding DNA Sequence Number=SeqID_44704
MVTSILQLDSMNLFVKARAWFNPITQGMAILIANTSSTIHRDERLGNMHAMHGKCNYEIEMPEETSFLN

SEQ ID NO: 161483 - protein, 106 aa, Glycine max
  Coding DNA Sequence Number=SeqID_44705
MKDWGNFLHRILEEDSEDSTPITTFFLVWRFGGKQRRLMVATGGRGWWRRSAIPSQVGIALSAALALIETSKVDIFKIPTVKLWRVVFGTSSQSLKTIQWLIDLGS

SEQ ID NO: 161484 - protein, 42 aa, Glycine max
  Coding DNA Sequence Number=SeqID_44706
MGVVYVVSLDFRMCDAAMITAFGKYVADSLDDGESDDVESEK

SEQ ID NO: 161485 - protein, 162 aa, Glycine max
  Coding DNA Sequence Number=SeqID_44707
MRMVKKKSPVAWETVCRPKCQGGLDIINLTVWNQVDSRRHWSWMFNNILDQREKVRLKQEWNNQMQRDKFSMKTMYNLLMDKSDRESEESIAHLFFDCKITKFIWEQILKWIEVTHEPKTWGVELKWAIRETGKKWWKAKLLKLALTETLYEDVGCGSHEIA

SEQ ID NO: 161486 - protein, 113 aa, Glycine max
  Coding DNA Sequence Number=SeqID_44708
  Homolog annotation: Hit_ID=Q8RVF8; Match level="QueryCoverage=37%, HitCoverage=15%, E-value=5e-13, Identity=83%"; Hit description =Thioredoxin peroxidase
YLKALGPLTKQIDAIKDVSLIKDVYVFYAKGSSTKHRCLSKEEHEALVCLCGSQVCWGSYLNLSGEEAFQKFLHLAWIQTDRKLGGLGDLNYPLISDATKFILKSYGVLIPDQ

SEQ ID NO: 161487 - protein, 953 aa, Glycine max
  Coding DNA Sequence Number=SeqID_44709
  Gene Ontology: Mol. function=protein binding; Cellular component =cytoplasm; Biological process=ubiquitin cycle
  Homolog annotation: Hit_ID=Q338L7; Match level="QueryCoverage=93%, HitCoverage=86%, E-value=0.0, Identity=49%"; Hit description=F-box family protein, putative, expressed
  Pfam annotation: Domain name=F-box; Domain location=67-114; Score =32.0; E_value=2.1e-06; Accession=PF00646.23; Description=F-box domain
  Pfam annotation: Domain name=LRR_1; Domain location=157-179; Score =2.3; E_value=1e+02; Accession=PF00560.23; Description=Leucine Rich Repeat
  Pfam annotation: Domain name=LRR_1; Domain location=181-209; Score =2.8; E_value=86; Accession=PF00560.23; Description=Leucine Rich Repeat
  Pfam annotation: Domain name=LRR_1; Domain location=271-296; Score =4.2; E_value=48; Accession=PF00560.23; Description=Leucine Rich Repeat
  Pfam annotation: Domain name=LRR_1; Domain location=297-322; Score =6.8; E_value=15; Accession=PF00560.23; Description=Leucine Rich Repeat
  Pfam annotation: Domain name=LRR_1; Domain location=343-365; Score =9.3; E_value=5.1; Accession=PF00560.23; Description=Leucine Rich Repeat
  Pfam annotation: Domain name=LRR_1; Domain location=385-410; Score =1.2; E_value=1.7e+02; Accession=PF00560.23; Description=Leucine Rich Repeat
  Pfam annotation: Domain name=LRR_1; Domain location=427-447; Score =5.5; E_value=27; Accession=PF00560.23; Description=Leucine Rich Repeat
  Pfam annotation: Domain name=LRR_1; Domain location=476-498; Score =8.3; E_value=8; Accession=PF00560.23; Description=Leucine Rich Repeat
  Pfam annotation: Domain name=LRR_1; Domain location=518-540; Score =3.2; E_value=72; Accession=PF00560.23; Description=Leucine Rich Repeat
  Pfam annotation: Domain name=LRR_1; Domain location=560-584; Score =0.2; E_value=2.7e+02; Accession=PF00560.23; Description=Leucine Rich Repeat
  Pfam annotation: Domain name=LRR_1; Domain location=611-632; Score =10.9; E_value=2.6; Accession=PF00560.23; Description=Leucine Rich Repeat
  Pfam annotation: Domain name=LRR_1; Domain location=747-770; Score =3.4; E_value=65; Accession=PF00560.23; Description=Leucine Rich Repeat
  Pfam annotation: Domain name=LRR_1; Domain location=824-847; Score =1.0; E_value=1.9e+02; Accession=PF00560.23; Description=Leucine Rich Repeat
  Pfam annotation: Domain name=LRR_1; Domain location=870-887; Score =6.2; E_value=20; Accession=PF00560.23; Description=Leucine Rich Repeat
  Pfam annotation: Domain name=LRR_1; Domain location=891-914; Score =4.8; E_value=37; Accession=PF00560.23; Description=Leucine Rich Repeat
  Pfam annotation: Domain name=LRR_1; Domain location=916-939; Score =5.2; E_value=31; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1; Domain location=67-114::157-179::181 -209::271-296::...
  Pfam module annotation: Domain location=297-322::343-365::385 -410::427-447::476-498::518-540::560-584::611-632::747-770::824 -847::870-887::891-914::916-939
MPESTVHLMNTVIMTDIKGTLRPNGETCYDASALMGAVEESSSGFDSSIVKEGEGDDSDISKVEDVEVRMDLTDDLLHMVFSFLDHPNLCKAARICKQWRGASAHEDFWKSLNFEDRNISVEQFEDMCRRYPNATAVSISGSAIYLLVMKAICSLRNLEVLTLGRGQIADTFFHALADCSMLRRLNINDSTLGNGIQEITINHDRLCHLQLTKCRVMRIAVRCPQLETMSLKRSNMAQVVLNCPLLHELDIGSCHKLPDAAIRAAATSCPQLVSLDMSNCSCVSDETLREIALSCANLSFLDASYCSNISLESVRLPMLTVLKLHSCEGITSASMAAIAHSYMLEVLELDNCSLLTSVSLDLPRLQTIRLVHCRKFADLNLRTMMLSSILVSNCPALHRINITSNSLQKLALQKQDSLTTLALQCQSLQEVDLSECESLTNSICDVFSDGGGCPMLKSLVLDNCESLESVRFISTTLVSLSLGGCRAITALELTCPNLEKVILDGCDHLEKASFCPVGLRSLNLGICPKLNILSIEAMFMVSLELKGCGVLSEASLNCPLLTSLDASFCSQLTDECLSATTASCPLIESLILMSCPSIGLDGLCSLRRLPNLTLLDLSYTFLVNLQPVFESCSQLKSATTPPARSRIVLPILVRQIILIAPNEIVILICYDVASPGAAVKLCLGDLLVMGSNPETASLHIQGNVTSILLLYDMCNPPPLSQLLGVSQACKYLTDSSLEPLYKGALPALQELDLSYGTLCQSAIEELLSCCRHLTRVSLNGCANMHDLNWGCSRGHIAELPGVNVLSIATSHENVHKLSEQPTRLLQNLNCVGCPNIRKVFIPSTAHCSRLLFLNLSLSANLKEVDVACLNLSWLNLSNCSSLEVLKLECPRLTSLFLQSCNIDEEAVEAAISKCTMLETLDVRFCPKICSMSMGRLRAACSSLKRIFSSLSSS

SEQ ID NO: 161488 - protein, 67 aa, Glycine max
  Coding DNA Sequence Number=SeqID_44710
MTPDFMGQDDKGAEDDVSLCLSTGLLAPDCQRVQKTTLVSACYRTLSLTDSEIVFIRITTWVSPSAT

SEQ ID NO: 161489 - protein, 84 aa, Glycine max
  Coding DNA Sequence Number=SeqID_44711
GKEENVKVADDSLSEADPLSEMHPFSEASSSLSGWETLEEDKPKICTPSAQPAHLARTLSLLALSVPMLAKQKFTNSCSARHAH

SEQ ID NO: 161490 - protein, 87 aa, Glycine max
  Coding DNA Sequence Number=SeqID_44712
SHEDLAKKLQDELERNRRISGTYYNRSPNLEPGLQNLLYSLDELSKNLSSLHSDTHHNEGLFVELLQMKVSIQGFHVRLFYCSISCT

SEQ ID NO: 161491 - protein, 173 aa, Glycine max
  Coding DNA Sequence Number=SeqID_44713
DLPKVQEELVSAVMRDRDQHVSHHQQVPRRIKSSHSPRAQSGRRICPSVRGKGGKRKVKNFPDCWPGPKQWQTPTPPPRRSTDSSAIGDQEEVQEQMKADMSALKEQMASMMDAMLGMRQLMENNAATAVAVSSAVEADPSLAATAHHPTPNVVDEKEEHWGTLATPIRGTTK

SEQ ID NO: 161492 - protein, 263 aa, Glycine max
  Coding DNA Sequence Number=SeqID_44714
  Gene Ontology: Biological process=isoprenoid biosynthetic process
  Homolog annotation: Hit_ID=Q093H2; Match level="QueryCoverage=40%, HitCoverage=55%, E-value=9e-17, Identity=46%"; Hit description =Purine catabolism protein PucB
  Subcellular localization annotation: CTP_CleavageSite=44; ConfidenceScore=5.52e-01
GVAAGSDAWCAALWRGRMAFAVAPSSAGSGVGGRSRNALPGSVAAEPGVAGQRGRTESALGLSRAVRGCASSDQPGRGPSWRPVRRGTGDASRFRTGPGGAGPVQAADTGSAPPPVPETSITGRPEHRRPRARGDFAQHRRAAAAMAKRARQHPARPAQAASDPAGRDPGTSRGAVGLGVRASAGPGRGGRERTGRDIQHCRAGGHSGNQPPLGTRPGEQPAGCRRALAAHGDRGDGRGMRPARNRALPSAGAAFGCPRLGIR

SEQ ID NO: 161493 - protein, 1023 aa, Glycine max
  Coding DNA Sequence Number=SeqID_44715
  Gene Ontology: Mol. function=protein serine/threonine kinase activity; Cellular component=integral to membrane; Biological process=protein amino acid phosphorylation
  Homolog annotation: Hit_ID=Q84NG8; Match level="QueryCoverage=95%, HitCoverage=96%, E-value=0.0, Identity=38%"; Hit description =Putative receptor kinase
  Pfam annotation: Domain name=LRRNT_2; Domain location=36-76; Score =62.0; E_value=1.9e-15; Accession=PF08263.3; Description=Leucine rich repeat N-terminal domain
  Pfam annotation: Domain name=LRR_1; Domain location=105-127; Score =17.6; E_value=0.046; Accession=PF00560.23; Description=Leucine Rich Repeat
  Pfam annotation: Domain name=LRR_1; Domain location=129-151; Score =11.2; E_value=2.3; Accession=PF00560.23; Description=Leucine Rich Repeat
  Pfam annotation: Domain name=LRR_1; Domain location=153-175; Score =14.2; E_value=0.47; Accession=PF00560.23; Description=Leucine Rich Repeat
  Pfam annotation: Domain name=LRR_1; Domain location=177-199; Score =8.4; E_value=7.5; Accession=PF00560.23; Description=Leucine Rich Repeat
  Pfam annotation: Domain name=LRR_1; Domain location=201-223; Score =5.9; E_value=23; Accession=PF00560.23; Description=Leucine Rich Repeat
  Pfam annotation: Domain name=LRR_1; Domain location=225-247; Score =14.5; E_value=0.37; Accession=PF00560.23; Description=Leucine Rich Repeat
  Pfam annotation: Domain name=LRR_1; Domain location=249-272; Score =3.9; E_value=54; Accession=PF00560.23; Description=Leucine Rich Repeat
  Pfam annotation: Domain name=LRR_1; Domain location=274-296; Score =8.0; E_value=9.1; Accession=PF00560.23; Description=Leucine Rich Repeat
  Pfam annotation: Domain name=LRR_1; Domain location=298-320; Score =12.5; E_value=1.3; Accession=PF00560.23; Description=Leucine Rich Repeat
  Pfam annotation: Domain name=LRR_1; Domain location=352-374; Score =10.0; E_value=3.9; Accession=PF00560.23; Description=Leucine Rich Repeat
  Pfam annotation: Domain name=LRR_1; Domain location=377-399; Score =11.8; E_value=1.8; Accession=PF00560.23; Description=Leucine Rich Repeat
  Pfam annotation: Domain name=LRR_1; Domain location=401-423; Score =15.6; E_value=0.18; Accession=PF00560.23; Description=Leucine Rich Repeat
  Pfam annotation: Domain name=LRR_1; Domain location=425-447; Score =17.2; E_value=0.059; Accession=PF00560.23; Description=Leucine Rich Repeat
  Pfam annotation: Domain name=LRR_1; Domain location=449-471; Score =13.4; E_value=0.83; Accession=PF00560.23; Description=Leucine Rich Repeat
  Pfam annotation: Domain name=LRR_1; Domain location=473-495; Score =9.1; E_value=5.6; Accession=PF00560.23; Description=Leucine Rich Repeat
  Pfam annotation: Domain name=LRR_1; Domain location=521-543; Score =9.7; E_value=4.4; Accession=PF00560.23; Description=Leucine Rich Repeat
  Pfam annotation: Domain name=LRR_1; Domain location=545-567; Score =13.2; E_value=0.95; Accession=PF00560.23; Description=Leucine Rich Repeat
  Pfam annotation: Domain name=LRR_1; Domain location=569-591; Score =17.5; E_value=0.047; Accession=PF00560.23; Description=Leucine Rich Repeat
  Pfam annotation: Domain name=LRR_1; Domain location=593-616; Score =9.6; E_value=4.6; Accession=PF00560.23; Description=Leucine Rich Repeat
  Pfam annotation: Domain name=LRR_1; Domain location=81-103; Score =7.5; E_value=11; Accession=PF00560.23; Description=Leucine Rich Repeat
  Pfam annotation: Domain name=Pkinase; Domain location=703-995; Score =137.2; E_value=4.5e-38; Accession=PF00069.15; Description=Protein kinase domain
  Pfam annotation: Domain name=Pkinase_Tyr; Domain location=703-995; Score=84.3; E_value=3.7e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=36-76::105- 127::129-151::153-175::177-199::201-223::225-247::249-272::274 -296::298-320::352-374::377-399::401-423::425-447::449-471::473 -495::521-543::545-567::...
  Pfam module annotation: =569-591::593-616::81-103::703-995::703-995
MALFSELPVHFALLLLFLFLELHNLLIGVSSATLSISSDREALISFKSELSNDTLNPLSSWNHNSSPCNWTGVLCDKHGQRVTGLDLSGLGLSGHLSPYIGNLSSLQSLQLQNNQLTGVIPDQIGNLFNLRLLNMSTNMLEGKLPSNTTHLKQLQILDLSSNKIASKIPEDISSLQKLQALKLGRNSLYGAIPASIGNISSLKNISFGTNFLTGWIPSDLGRLHNLIELDLTLNNLTGTVPPVIYNLSSLVNLALAANSLWGEIPQDVGQKLPKLLVFNFCFNKFTGGIPGSLHNLTNIRVIRMASNLLEGTVPPGLGNLPFLRMYNIGYNRIVSSGVRGLDFITSLTNSTHLNFLAIDGNMLEGVIPESIGNLSKDLTKLYMGQNRFNGSIPSSIGRLSGLKLLNLSYNSIFGDIPNELGQLEGLQELSLAGNEISGGIPNSLGNLLKLNQIDLSKNKLVGRIPTSFGNLQNLLYMDLSSNKLDGSIPMEILNLPTLSNVLNLSMNFLSGPIPQIGRLITVASIDFSSNQLFGGIPSSFSNCLSLENLFLARNQLSGPIPKALGDVKGLETLDLSSNQLFGAIPIELQNLHVLKFLNLSYNDLEGVIPSGGVFQNLSAIHLEGNRKLCLYFPCMPHGHGRNARLYIIIAIVLTLILCLTIGLLLYIKNKRVKVTATAATSEQLKPHVPMVSYDELRLATEEFSQENLLGVGSFGSVYKGHLSHGATVAVKVLDTLRTGSLKSFFAECEAMKNSRHRNLVKLITSCSSVDFKNNDFLALVYEYLCNGSLEDWIKGRRNHANGNGLNLMERLNIAIDVACALDYLHNDSEIPVVHCDLKPSNILLDEDMTAKVGDFGLARSLIQNSTNQVSISSTHVLRGSIGYIPPEYGWGEKPSAAGDVYSFGIVLLELFSGKSPTDECFTGGLSIRRWVQSAMKNKTVQVIDPQLLSLTFHDDPSEGPNLQLNYLDATVGVGISCTADNPDERIGIRDAVRQLKAARDSLLKLSDESPRRDTERYFHVSIK

SEQ ID NO: 161494 - protein, 211 aa, Glycine max
  Coding DNA Sequence Number=SeqID_44716
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=96%, HitCoverage=24%, E-value=3e-36, Identity=40%"; Hit description =Receptor protein kinase-like protein
  Pfam annotation: Domain name=Pkinase; Domain location=1-201; Score= -21.8; E_value=2.9e-07; Accession=PF00069.15; Description=Protein kinase domain
  Pfam annotation: Domain name=Pkinase_Tyr; Domain location=1-201; Score=-83.2; E_value=2.3e-07; Accession=PF07714.7; Description =Protein tyrosine kinase
  Pfam module annotation: Pfam domain module=Pkinase::Pkinase_Tyr; Domain location=1-201::1-201
MKNSRHRNLVKLITSCCRIHFKNNDSLEDWTKGRRKHAKGSGLNLMERLTIATDVASALNYQHNDSEIPVVHCDLKLGNILLDEDMTAKVGDFGLARLLIQRSTNQVSINSTHVLRGSIGYIPPEYGWGEKPSAAGDVYSFGTVLLELFSRWVQSALKKQDSAKRPNVQLNCVDATVGVGISCTAENPEERIGIREAVSQLKAARDSFESV

SEQ ID NO: 161495 - protein, 1821 aa, Glycine max
  Coding DNA Sequence Number=SeqID_44717
  Gene Ontology: Mol. function=RNA-directed DNA polymerase activity; Cellular component=chromatin; Biological process=chromatin assembly or disassembly
  Pfam annotation: Domain name=Chromo; Domain location=1330-1381; Score= 28.5; E_value=2.3e-05; Accession=PF00385.14; Description='chromo' (CHRromatin Organisation MOdifier
  Pfam annotation: Domain name=RVP_2; Domain location=264-388; Score= -30.9; E_value=0.00026; Accession=PF08284.2; Description=Retroviral aspartyl protease
  Pfam annotation: Domain name=RnaseH; Domain location=773-891; Score= -31.5; E_value=0.049; Accession=PF00075.14; Description=RNase H
  Pfam annotation: Domain name=p450; Domain location=1384-1818; Score =7.7; E_value=2.5e-11; Accession=PF00067.12; Description=Cytochrome P450
  Pfam annotation: Domain name=rve; Domain location=1027-1183; Score =123.0; E_value=8.2e-34; Accession=PF00665.16; Description=Integrase core domain
  Pfam annotation: Domain name=zf-H2C2; Domain location=968-1009; Score= 13.1; E_value=0.0067; Accession=PF09337.1; Description=His(2)-Cys(2) zinc finger
  Pfam module annotation: Pfam domain module=Chromo::RVP_2::RVT _1::Retrotrans_gag::RnaseH::p450::rve::zf-H2C2; Domain location=1330 -1381::264-388::513-682::65-155::773-891::1384-1818::1027-1183::968 -1009
MAEHGTRRTTTDRLEEAISTLTTKHSELANKLDVPCFDGHDPLGWIFKISQFFEYQGTPEEERITVASFYLDGAALSWFQWMHQNGFITSWPALLQAIETRFAPSFYDDPRGALFKLTQRASVTEYLTEFERLANRIVGLSPPMLLSCFVSGLNTEIRREVQAFQPVSLPHAMALARLQEDKLNDRRKHSRTSLPPPQTPSPSLTTQHQPPRTKPPFGRVLLFIADSDEASSMDNPSMEDPAPPTQATLPPFDPTPLLPHISLHAMAGVPATDTFRLYGVINHTRVTILVDSGSTHNFVQPRIAKFLGLPMEDTTSLQVMVGNGSVLECKQSCPATTLLLQQHSFTVTLRVLPISGADVVLGVEWLRTLGPIITDYTSFTMQFTHLGQPIILRADVTTCTDTASAHQVKRLLHTHSLSGLFHLSLLPTHIPETAPDPPHPISAINELLLRFHTIFQQPSSLPPPRQHDHYINLIPSAHPVNVRPYKYPHFQKNEIEKQVSALLESGFIQPSRSPFSSPVLLVKKKDGTWRMCVDYRALNSITIRDRFPIPTIDELLDELGHASWFSKLDLRQGFHQILMADADVPKTAFRTHHGHYEYRVMPFGLCNAPSTFQAAMNALLSPFLRKFAAVFFDDILIYSKSLPDHLQHLECIFHALSQAKYYLKRSKCLIGQRKLDYLGHVVSGSGVQPDPSKIQAITDWPIPLTPKDLRAFLGLTGFYRKFVKGYATLAAPLTKLLCRDAFNWTSESQVAFEALKEAMVTTPVLALLDFTHPFALETDASGIAMGAVLQQHNHPIAYFSKPFCPRLQHASAYVRELHAITAAVRRWRQYLLGHRFTIFTDHRSLQELMSQVVQTPEQQFYLAKLLGFDYDIQYKAGSSNVVADSLSRIENLPQGQCLILSIPHEDFLVQLKASLLTSPEYHQQLEAIHSHPDQHRDFTLSNDLIFFKGAIWINPQNPFIPSLLHEYHATPIGGHFGVKKTLHRLRSNFHWSSMSNDVKAFIRKCSICQQVKHLTRKPAGLLQPIPIPSNIWEDLSIDFITHLPSSHGFTVILVVVDRFSKGVHLGALPTQFSAFKVATLFVDTVCKLHGFPRSIISDRDPIFLSSFWRELFRLSGTTLRMTTAYHPQSDGQTEAMNRTIEKYLRSFVRQQPSNWYKFLAMAEWSYNSSPHSGTGITPYEAVYGKPPPSIPRYLLGSSSNEAVEDVLRTREEIHTLLKHKLIKAQLAMKEFADRKRRDVQYHEGQLVYVKLRPYRQNSVRPNKHHKLSKRYFRPFRVLECIGKVAYRLQLPPGSKIHPVFHSSLLRPHHGSLDLPTSSLPPETLHNQPVLEPLTILNTRIDTTTSPPTRWVLVQWVDLPPEDSTWEKWDLIRDAHHLEGKVSFPGEDIVSTDPIARPRREISRPKHLEDYVVQKHSSEIFHTHILGESTVVLCGPGANKFVSTNETKLVKVSYMKTQRRFFIIPDQRHAPMPKPTQEAASAAPVKILGILKPEGISRYMGNKIESTMNQHFITHWEGKKEVKVYPLVKAFSLTLGCQFFLGIDGPKFASEFENLYFGIYSVPVNFPGSTYHRALKAAAAIRKEIQILIKEKIDALSKGQVVDDLIAHVVGAEQDGKYVPRLEISNIIMGLMNSSHMPIAITLAFMIKHIGQRPDIYQKILSEHADITISKGSGTALDWNSIQKLKYTWAVAQETMRLYPTAPGAFREAITDITYEGFTIPKGWKIFWAFIGTNKNPKYFHEPESFDPSRFEGNAPVPYTWLPFGAGPRTCPGKDYVRFVVLNFIHILITKFKWEAILPDEKVSGSSIPIPAEGIPIRLHHY

SEQ ID NO: 161496 - protein, 573 aa, Glycine max
  Coding DNA Sequence Number=SeqID_44718
  Gene Ontology: Mol. function=ATP binding; Cellular component=nucleus; Biological process=transport
  Homolog annotation: Hit_ID=Q9AWQ3; Match level="QueryCoverage=99%, HitCoverage=99%, E-value=0.0, Identity=69%"; Hit description =Putative WD-40 repeat protein
  Pfam annotation: Domain name=WD40; Domain location=204-242; Score =28.5; E_value=2.3e-05; Accession=PF00400.22; Description=WD domain, G-beta repeat
  Pfam annotation: Domain name=WD40; Domain location=254-290; Score =26.8; E_value=7.7e-05; Accession=PF00400.22; Description=WD domain, G-beta repeat
  Pfam annotation: Domain name=WD40; Domain location=356-395; Score =30.4; E_value=6.5e-06; Accession=PF00400.22; Description=WD domain, G-beta repeat
  Pfam annotation: Domain name=WD40; Domain location=399-437; Score =46.1; E_value=1.2e-10; Accession=PF00400.22; Description=WD domain, G-beta repeat
  Pfam annotation: Domain name=WD40; Domain location=447-530; Score =1.1; E_value=27; Accession=PF00400.22; Description=WD domain, G-beta repeat
  Pfam annotation: Domain name=WD40; Domain location=534-572; Score =22.3; E_value=0.0018; Accession=PF00400.22; Description=WD domain, G- beta repeat
  Pfam module annotation: Pfam domain module=WD40::WD40::WD40::WD40::WD4 0::WD40; Domain location=204-242::254-290::356-395::399-437::447 -530::534-572
MSTLEIEARDVIKIVLQFCKENSLHQTFQMLQNECQVSLNTVDSIETFVADINSGRWDAILPQVSQLKLPRNKLEDLYEQIVLEMIELRELDTARAILRQTQVMGVMKQEQPERYLRLDHLLVRTYFDPNEAYQDSTKEKRRAQIAQAIAAEVTVVPPSRLMALIGQALKWQQHQGLLPPGTQFDLFRGTAAMKQDVDDMYPTTLSHTIKFGTKSHAECACFSPDGQFLVSCSVDGFIEVWDYISGKLKKDLQYQADEVFMMHDDAVLCVDFSRDSEMLASGSQDGKIKDFRIRIPSSIQITQPPHPVFVPPYSSLIFSGYQVPPSNPSVFWPLAKPVLFFGSQNFCTLVWRIRTGQCLRRLERAHSQGVTSVSFSRDGSQLLSTSFDSTARIHGLKSGKMLKEFRGHTSYVNDAIFTNDGSRVITASSDCTIKVWDVKTTDCIQTFKPPPPLRGGDASVNSVHIFPKNTDHIVVCNKTSSIYIMTLQGQVVKSFSSGKREGGDFVAACVSPKGEWIYCVGEDRNMYCFSYQSGKLEHLMKVHEKEVIGVTHHPHRNLVATFSEDCTMKSWKP

SEQ ID NO: 161497 - protein, 83 aa, Glycine max
  Coding DNA Sequence Number=SeqID_44719
MKRERVAKTSVCAVRVVETLEGERRETDPTLNQRNNNTMKHDTSLPCRALSDTDTTQHSTTLFYILDIRDVQVSVWCFIATIS

SEQ ID NO: 161498 - protein, 219 aa, Glycine max
  Coding DNA Sequence Number=SeqID_44720
MRGERKDRERNSGWERVRTRRERRESNKERELERVNVCILPATREDINKATLEFKGVEDLEQLEKKLDNIVFGGLKMFVKIPKFGRDVKGKPQPVTWGCPYTKSNEEESRDTNLRVQQRGYLGKKSGSYAEAVKRENTGADQRRPAGKRELSGHWSQSEVHLDISLTEHKWLTEARVGRLKNLSLFDKVEDDILWDLGANVSPRYIGDDMILLLGLTDD

SEQ ID NO: 161499 - protein, 823 aa, Glycine max
  Coding DNA Sequence Number=SeqID_44721
  Gene Ontology: Mol. function=RNA-directed DNA polymerase activity; Biological process=RNA-dependent DNA replication
MGICTSNGRGKNLHEKGKMRVERTIGVVGKDVLNTDKPCDQEAENTNGLISSIHTPTKLIDKNINSPSTSQKGPNTSSKVYYRKRGCNKQSVSVLEDDMGQQITPTTPKMQGNVHKLDRNHEQTAHQLSTQIAAIDKAKIIQVGKEDQWGWLYNVGGEVEAEDTNTLHHQHLFTVNNSREFNDWIAELEVKEASWVGRKFTWVRPNGTTWSKLDRFLVSAEWLTKWPGTSQYTLDRNFSDHCPLLLRSKYVDWGPKPFRILDCWLFDNSFKKIVHESWSSNQHRGWGGYVLKQKIKSLKNRLKVWNRDQFRDTLRKYKRIEEDLNKMKRSRWIKEGDCNSGYFHLLINASRRNNGLQGVMIDGAWSDDPKIVKEELKRRMRSKGLCGVVGVIKVVEEAKRCHMPCIVFKVDYEKAYDSVSWEFLTYMMSRMGFCRKWIKWIEGCLKSAYVSVLVNEALNGLMSQAQAQRLYKGFLVGSNKVEISTLQYVDDTIFFREATMENVRAIKAMLRAFELVSGLKINFAKSHFGAFGVSDQWKIMAANYLNCSLMSFPFTYLGVPIGHQGELWARVLESKYGGWRNLDDALRVSRESIWWRDLKLVTQHPQHGHILNNSTLWKVNCGDKFEFWEDNWLGGAGSLLDKYLRLYTISSQQNQIIQHMGTVKDSGWEWEFRWRRTMFDNELDMAISFLKDVESHNIQQQERDQWVWMADSNGQYSIRSAYNVLRDDIAEEIHDGAYEELWKLKIWVHGCAEHDCMVGGVHFVEVRYGVWVVGVDLGSWRLVVRGDAFFGFVWRLVMSRGRRLKKAKRTRVEGQRKLKEHVD

SEQ ID NO: 161500 - protein, 50 aa, Glycine max
  Coding DNA Sequence Number=SeqID_44722
MTNIRLTEALEQKSTEQNLKPEQLEKLAKLEDWHRELKLLEDEKGETTVS

SEQ ID NO: 161501 - protein, 283 aa, Glycine max
  Coding DNA Sequence Number=SeqID_44723
  Gene Ontology: Mol. function=nucleic acid binding; Biological process= DNA integration
  Homolog annotation: Hit_ID=Q1SRN1; Match level="QueryCoverage=53%, HitCoverage=13%, E-value=7e-15, Identity=26%"; Hit description =Integrase, catalytic region
MASASIVFAPQTFSSAISCKLTDDKFLTWMQLVESTIKGHRLKQHIVGDYAIPSRFLTKEDEATNSVNPAYENFEQQDNLLKSWLLESMDNQFRVGVVGCIVETLGAIGSPLTDEEHIDAIFDGLPEEYDGLITSCLTRSETFTVPQIEASLMHQEERLECRSGTHGRGRGGRSTSTFSTQGRGPKLQCQLCGRVGYYAFHYWYRFDENLIEPTPYATHNPNDNSNNHSAQAMLATASNQVDDSRYPDTGATHYLTHDLGNLMIKNAYNGGNPAGSSSRSSQG

SEQ ID NO: 161502 - protein, 414 aa, Glycine max
  Coding DNA Sequence Number=SeqID_44724
  Gene Ontology: Mol. function=nucleic acid binding; Cellular component= mitochondrion; Biological process=DNA integration
  Homolog annotation: Hit_ID=Q1SRN1; Match level="QueryCoverage=99%, HitCoverage=29%, E-value=1e-127, Identity=52%"; Hit description =Integrase, catalytic region
MVAQGFSQRPGLDYNETFSLVIKPATIRIVLSIAVTKKWDIRQVDINNAFLNGTIQEEVYMQQPEGFTSANSHLVCKLKKSIYGLKQAPRAWFSKFASSLISFGFKPTRCDTSLFVHATPKFITYILVYVDDIIITSSFTFAVQSVISKLHSLYPLKDLGTLHFFLGIEAKYTTTGALLLSQSKYITDLLAKVNMHNAKPIKTPLAPGSKLHMDGTNAFSDPTLYRFVVGALQYATITRPDIAYAVNKLCQFMHNPLESHWKATKRVLRYLNGTVDHGNNLVSWLAKKQQSVSRSSTEAEFKSLATLVAEIKWLQSLLTELHIVQAKPPLLWCDNQGAVMITVNPVLHSKSKHFELDLWFVREKAANGEIIVKHIPSQFQVVDLLTKAPSSNTFLSLRLKLNVHQLPTLSLQGV

SEQ ID NO: 161503 - protein, 123 aa, Glycine max
  Coding DNA Sequence Number=SeqID_44725
MKFFHNGHIIELKGDDASTLHLLSSTQLRRLVRTESSSAYFHITMNPIKLPSSQHPSSSLLLEIQSLITKFTPMFQPHQAPPPSQPISHHIHLVPNSEPVNVCPYHYPHFQKAEIEAQVDSML

SEQ ID NO: 161504 - protein, 316 aa, Glycine max
  Coding DNA Sequence Number=SeqID_44726
  Subcellular localization annotation: CTP_CleavageSite=75; ConfidenceScore=5.31e-01
MGPNDCNHWTQRTRHWSFPTMTFKGVVSRVRRPKPETNDSWIKLSSVSGGSGARPKSIYSSKQLKQRPCSHREASSSGVKRLRGTGGRGLDKVGNNGGGESGTNGGMVVEVVDEKETPRPRNISGLRPEMKQLRGNGGGKPMTLLAKSLNSESELTITGHPLKPGQSATVYVEGCNGQLLVVRGVVIFKELSYLEYPAQRIDFVKTWNIQLHVVGRGFWCGEVGDELVKFESHCLKVFAQRQLVSDKIKEAIPPSNQLNKNDYTKSLSHPSDDSVVPTVTLPFRPPRTKTLAIVLTTTTYPISCPLEWCRDLACVK

SEQ ID NO: 161505 - protein, 169 aa, Glycine max
  Coding DNA Sequence Number=SeqID_44727
  Gene Ontology: Mol. function=sequence-specific DNA binding; Cellular component=nucleus; Biological process=regulation of transcription, DNA-dependent
  Homolog annotation: Hit_ID=Q8W4H1; Match level="QueryCoverage=94%, HitCoverage=41%, E-value=8e-16, Identity=29%"; Hit description=GATA transcription factor 28
  Pfam annotation: Domain name=GATA; Domain location=8-43; Score=51.6; E_value=2.6e-12; Accession=PF00320.17; Description=GATA zinc finger
MGRKHGPCFHCKIHITPLWRNGPEDKPVLCNACGSRYRKCGSLENYLPNHFQPEYPDNLKMLKRRKTLKGRKHLKGRKNLLVSSYVTGGKGRYLCSPKIPTRKRSPLVRKKITPMKRFYMQLQNMWEDYGNSNESSSEEVLIFNNVNNFIPSNEIGLGCIPLKLDDASA

SEQ ID NO: 161506 - protein, 154 aa, Glycine max
  Coding DNA Sequence Number=SeqID_44728
  Pfam annotation: Domain name=GATA; Domain location=3-33; Score=24.4; E_value=0.00026; Accession=PF00320.17; Description=GATA zinc finger
MVSSASPHWRSGPEDKSVLCNACGLRYTKWGSIGLQNYFPNHFKPEYLDNLKNLEGRNNVLQGSSYATDSSGKIHVMWNPYVPSRKRSRVVRMTTSIQRFHEQLLMMWKNEENSNDQSSQESEEVLLIDNVNNFIPCNEIGLGCILLKPEDASA

SEQ ID NO: 161507 - protein, 144 aa, Glycine max
  Coding DNA Sequence Number=SeqID_44729
  Gene Ontology: Mol. function=RNA-directed DNA polymerase activity; Biological process=RNA-dependent DNA replication
  Homolog annotation: Hit_ID=Q1T5Q8; Match level="QueryCoverage=60%, HitCoverage=12%, E-value=6e-11, Identity=43%"; Hit description=RNA -directed DNA polymerase
MAGLPTLACPPPVPMTGLSPPSLSRQHQWRPLKEICRSFDTFPLHILYYNLPPPPGLELSISLLSKWKWRTLNDKEFLWYPLLCYKYGKADVMSLSRRSWPNASQWWRDIQDTSYRFEGVYGWFEDLVQRKVGSGNQTAFWSHK

SEQ ID NO: 161508 - protein, 94 aa, Glycine max
  Coding DNA Sequence Number=SeqID_44730
  Homolog annotation: Hit_ID=Q0ZCE8; Match level="QueryCoverage=54%, HitCoverage=7%, E-value=2e-07, Identity=53%"; Hit description=ATP -binding protein
MKLMEKGNENRNREEGFGNDSAKEMKLVEAESVEVGAGKHQSALALVLELLGELDGGGGGFANGGGDCGGGRHGEAEGVIGMGGRVGVDGLEEA

SEQ ID NO: 161509 - protein, 455 aa, Glycine max
  Coding DNA Sequence Number=SeqID_44731
  Gene Ontology: Mol. function=ATP binding; Cellular component =membrane; Biological process=translational initiation
  Homolog annotation: Hit_ID=Q0ZCE8; Match level="QueryCoverage=97%, HitCoverage=55%, E-value=1e-118, Identity=55%"; Hit description=ATP -binding protein
  Pfam annotation: Domain name=HATPase_c; Domain location=320-443; Score=9.8; E_value=0.0074; Accession=PF02518.16; Description =Histidine kinase-, DNA gyrase B-, and HSP90-like ATPase
MWLRSYVVCFVQVYVRPAGSYVMDRLELRRVALYPGDAEAEGIVILVGHFNIPAGLRAAEATLSNSQVNVVPECKAVVLPMVKHPFVVGFLVAELPLVEQEQCQKSQSDGPENLMSVEEPYSFPPFLDLDKKSREIQNLQVKNEAVGMHNFTSEQRSNAVNISQSLAMAYVMDQISHDIVEDLLVQGDRLRDVLQQLQDAVYLTKTNIVRYNEEAIKKMNGSTHILAESSRSQLLDSSPGDVSANKMKKSSESLSLSAAVQDIEMPLPPLALAPLQHGIRSCNVSEVLADLVDSVRPLAQGQKRVVELSELSSSPLLAAVEEPALRQAFSNLIEGALLRTHVGGKVEIVSTAAPAGGTLVLIDDDGPDMHYMTQMHSLTPYGQELLSDNMIEDNMTWNFVAGLTVAREILESYGCVVRIVSPRIKDAPLGAGGTRVELWLPSSIVQSDLSSHAQE

SEQ ID NO: 161510 - protein, 140 aa, Glycine max
  Coding DNA Sequence Number=SeqID_44732
METSSMVISGAMSVLNDGQKAMTVLEGNSEWHISEPRKGKALALLYASQWCAERGVQQIIFKTDSKKEGSKVVHHHEQHWALGEECHQSNIYHLILPPSALKDSIFWKALNAKLKHLGAVGTVHSFFHYLPSLDNTFKSV

SEQ ID NO: 161511 - protein, 381 aa, Glycine max
  Coding DNA Sequence Number=SeqID_44733
  Gene Ontology: Mol. function=translation initiation factor activity
  Homolog annotation: Hit_ID=Q9LIN5; Match level="QueryCoverage=99%, HitCoverage=71%, E-value=2e-64, Identity=41%"; Hit description =Eukaryotic initiation factor 4B
  Pfam annotation: Domain name=eIF-4B; Domain location=1-381; Score =403.2; E_value=3.9e-118; Accession=PF06273.2; Description=Plant specific eukaryotic initiation factor
MSKPWGNIGAWAADSERAEAEEAEAQAAAAAVEPQSFPSLKEAVNSKPKKKKGTTITLSEFNRGGFDQGLTRDEMLALPTGPKERSADEMPFNRLGGGFSSYDRSGGRSRDRDGGNNEGSWGGGGRRSYGGFDEERRGPNPRVSELDQPSRADEVDNWASVKKSLPAFDSGRQNRFGGGGYGGSGGGGFGGGGGGGGFGGASRADDVDSWAAGKKPVPVRSSNFGSGFRDSGVEPDRWTRGGPPREVDRTERPRLVLDPPRGDGVVNESPVKASNKANPFGAARPREQVLAEKGLDWKKMDSEIETKKTSRPPSSHSSRPSSAQSNRSEGPGLQGTDAVVKSRPKVNPFGDAKPREAVLGERGMDWRKIDLELEHRSVDSG

SEQ ID NO: 161512 - protein, 497 aa, Glycine max
  Coding DNA Sequence Number=SeqID_44734
  Gene Ontology: Mol. function=cytokinin dehydrogenase activity; Cellular component=vacuole; Biological process=electron transport
  Homolog annotation: Hit_ID=Q9FUJ1; Match level="QueryCoverage=93%, HitCoverage=89%, E-value=1e-180, Identity=64%"; Hit description =Cytokinin dehydrogenase 7
  Pfam annotation: Domain name=Cytokin-bind; Domain location=207-487; Score=490.8; E_value=1.7e-144; Accession=PF09265.1; Description =Cytokinin dehydrogenase 1, FAD and cyto
  Pfam annotation: Domain name=FAD_binding_4; Domain location=33-175; Score=110.1; E_value=6.6e-30; Accession=PF01565.13; Description=FAD binding domain
  Pfam module annotation: Pfam domain module=Cytokin-bind::FAD_binding _4; Domain location=207-487::33-175
  Subcellular localization annotation: CTP_CleavageSite=50; ConfidenceScore=5.10e-01
MPNDDVSALDGAFHFGATAGAGKDFGGMKSAKPLAVIRPAVAGDVARAVKAATRKANLTVAARGNGHSINGQAMAENGLVLDMRAMEDHFTLLSLDDGSLYVDVSGGALWEEVLKRCVSEFRLAPRSWTDYLGLTVGGTLSNAGVSGQSFRYGPQTANVTELEVVTGKGETLVCSESQNSELFFATLGGLGQFGIITRARLPVQQAPDMVRWIRVLYSEFAHFTRDAEWLVTLPEGDGFDYVEGFVLVNSDDPCNGWPTVPMGPNQYFDPLRIPSAAGPLLYCLELALHYRNQDHPSAVDMEVDRLLGRLRFVEGLKFCVDVTYMEFLLRVKRVEEDAKANGIWDAPHPWLNMFVSKSNIAEFDREVFKKILKHGVGGPILVYPLLRSKWDSRHSVVVPDSNIFYIIALLRFIPPPPKGPPTELLVEQNHEIIQLCYNRGFDFKLYLPHYQSQENWMRHYGDKWTRFVERKANFDPLAILAPGQKIFSRIPQTLSIT

SEQ ID NO: 161513 - protein, 400 aa, Glycine max
  Coding DNA Sequence Number=SeqID_44735
  Gene Ontology: Mol. function=protein tyrosine/serine/threonine phosphatase activity; Biological process=protein amino acid dephosphorylation
  Homolog annotation: Hit_ID=Q762M8; Match level="QueryCoverage=85%, HitCoverage=43%, E-value=7e-60, Identity=41%"; Hit description=MAP kinase phosphatase
LVDHPSPRALDSRGAFVVHVPSAIYVWIGKECGSAMCCNARSAAAQVVRYERATGEIVSVVEDEEPKEFWIALSTKEVVVEIMEIDVGIRPRRVEEYDLDYGIFHKALAGGVVPPFSLSNAGSENCLPARENGWGRLTRKLASGIMKGLFTSSKCCESSVNIIEEGNQHMNVDPLPPSSNNVGGSRGSFECFGSERGKDNVQVRDQFVVPSVVGSSMPLPPSPHHRASDSFACFLRSSPKFSSNSPTLSPTSSDYASSFTFSPSSTDLSIVSSRQLSPSGLESAEPAHVKDASSSEFRSLVKKEGETFLANHTLVGAKSSLRRKGTSLSIAERRGNNPPPRMLLPSASESSRASKVRVRSRSFSLPVLDDTLMKDLLRVRLMAEDHCNMVLCHVKVGCYA

SEQ ID NO: 161514 - protein, 226 aa, Glycine max
  Coding DNA Sequence Number=SeqID_44736
  Homolog annotation: Hit_ID=Q5JMS6; Match level="QueryCoverage=77%, HitCoverage=68%, E-value=3e-57, Identity=52%"; Hit description =Membrane protein-like
MRKCTVQALGLAIAFFLLLILLTPSIPQPQRYHDFAEKREFFGLPNAPNVVANFPFMVIGLIGLVLCHRRNYFNISISLQGELWGWTCFYVAVTSVAFGSSYYHLGPDDAGLVWDRFPMSVAFVSLLAILIIERFFGDIRLYVLAQGASCIAIPLMATLLPPMYTHSTYWLWTSGFYLLATLQEAADRVIYILTFHIIGKVCLTRKAFPRHYDQRRHLSCGMISAM

SEQ ID NO: 161515 - protein, 253 aa, Glycine max
  Coding DNA Sequence Number=SeqID_44737
  Gene Ontology: Mol. function=RNA binding; Cellular component =mitochondrion; Biological process=metabolic process
  Homolog annotation: Hit_ID=Q7XIR4; Match level="QueryCoverage=97%, HitCoverage=61%, E-value=4e-46, Identity=31%"; Hit description =Membrane-associated salt-inducible protein-like
  Pfam annotation: Domain name=PPR; Domain location=11-45; Score=14.0; E_value=0.16; Accession=PF01535.11; Description=PPR repeat
  Pfam annotation: Domain name=PPR; Domain location=120-154; Score =31.7; E_value=2.6e-06; Accession=PF01535.11; Description=PPR repeat
  Pfam annotation: Domain name=PPR; Domain location=155-189; Score =39.0; E_value=1.6e-08; Accession=PF01535.11; Description=PPR repeat
  Pfam annotation: Domain name=PPR; Domain location=190-224; Score =10.3; E_value=0.45; Accession=PF01535.11; Description=PPR repeat
  Pfam module annotation: Pfam domain module=PPR::PPR::PPR::PPR; Domain location=11-45::120-154::155-189::190-224
MYQSCIGSHRLAYRSQISNLVKAGLINQAIHLFDQMTQSNCRVFSVDYNRFIGVLLRHSRLHLAHHFYRRHVIPRGFSLLPFTYSRFISALCSAPNNINLPLIHRLLLDMDALGFVPDIWAFNTYLNLLCRQNRLETALELFHSMPSKGRDPDVVSYTIIIDALCRAKRFDEAARVWRRLIDRGLNPDYKACVALVVGLCGGGRVDLAYELVVGVIKGGVKVNSLVYNALIDGFCRMGRVDKAMKIKAFMSRN

SEQ ID NO: 161516 - protein, 114 aa, Glycine max
  Coding DNA Sequence Number=SeqID_44738
  Subcellular localization annotation: CTP_CleavageSite=44; ConfidenceScore=5.19e-01
MLPPMNVQINWKYSSDYSGEFRQTREFVTSPRLSYSFTRESRLRAVLKLSYSSSLFCFESPQSHRHCWPSIAVLVVASPSSSVIVAASLVLTRAPNFASCHDTKVISPLSPLLS

SEQ ID NO: 161517 - protein, 46 aa, Glycine max
  Coding DNA Sequence Number=SeqID_44739
MVEFVGVQVFGTLSGGWCHNEVGQCGGEEMAKWWQWRLTKGFEIMA

SEQ ID NO: 161518 - protein, 967 aa, Glycine max
  Coding DNA Sequence Number=SeqID_44740
  Gene Ontology: Mol. function=DNA binding; Cellular component =membrane; Biological process=DNA integration
  Homolog annotation: Hit_ID=Q1SLU3; Match level="QueryCoverage=81%, HitCoverage=91%, E-value=1e-143, Identity=43%"; Hit description =Integrase, catalytic region
  Pfam annotation: Domain name=zf-CCHC; Domain location=392-409; Score =13.5; E_value=0.006; Accession=PF00098.13; Description=Zinc knuckle
  Pfam module annotation: Pfam domain module=RVT_2::zf-CCHC; Domain location=573-828::392-409
MALVAHYDLELHQMDVKIVFLNGNLEDNVYMDQPSVEGKEHMGNTINRCIYLKTALEYATDSWKHHCPSPSRVDDEERIAARKPHAPVKASSTKSSTPSGFTWMRGEEDHQISIKKIETRLVTDGRLIKEGMIGALELTKKMFTTTCVGKRNKNEDQREKPTRATMVGEVCQKRDLVMSERDSQTPGVGSFLYLHPSENPAVSLVSPVLDSSNYHSWSRSMMTALSAKNKLEFIDGGAPEPLKADQTYGAWRRCNNTVVSWIVHSVSMTIRQSILWMDKAEEIWKDLKSRYAQSDLLRISDLQQEAASIRQAQRKLKDRAIQFLRGLNEQYGNVQSHVLLMDPLPEISRIFSYVAQQERQIRSNLIAANNIDMTVPSNNSERNKSSSHRSRKICTYCGKMGHTIDVCYKKHGFPPRYKFSNPRSSANSLVAGDDAATNDQTQLLESKEIRFSPEQYKAYFALIQQPTDGNSTNMSSNLKQIASCSVDTTPAHDRRPPTYLHDYHAFLTSTANINSASVSHTLDYSTSVRHPLNSVLSYSRLSSSHRHFVLSITTSTEPKTYAEASQHGCWLKAMQAELQALQTNNTWTLTDLPANKKAIGCRWIYKIKYHAYGSVERYKARLVAKGYTQMEGLDFLDTLSPVAKLTTVRLLLALAAIHGWHLRQLDVNNAFLHEELTEEVYMQLPPGMQVSHPNQVCQLQRSLYGLKQASRQWFHRLSSFLLTHGFTQASADHSLFLCFNDTSFTALLVYVDDIVLTGNDIMAINRITIFLDQTFKIKDLGTLKFFLGMEVARSQQGIHLCQRKYVLDILSDSRMLACRPASTPMDSSTHLQAGIEDPLSAEDSSSYRRLVGRLIYLTNTRPDISYVVQKLSQFMANPTTDHSKAASRVLRYLKSLPGCGIFFPTTGSTRLQAFSDSDWADCRDTRRSITCFSIFLGNSLISWHSKKQSTVSRSSSEAEYHPLATTT

SEQ ID NO: 161519 - protein, 105 aa, Glycine max
  Coding DNA Sequence Number=SeqID_44741
MWMYDLDLAILEEKPAIIIDASSNEEKSYYKVLKKSNRLNLMFMRMTIADSINTTLLKSDNAKVFMGLVEERSQTTDKSLAGTLMSSVTTMKFMVHVLCMSMSLR

SEQ ID NO: 161520 - protein, 44 aa, Glycine max
  Coding DNA Sequence Number=SeqID_44742
MAKTMSKVAAPPDVILNTVSAKDQIYGEVSMSFAVKWEDVLDGL

SEQ ID NO: 161521 - protein, 92 aa, Glycine max
  Coding DNA Sequence Number=SeqID_44743
  Gene Ontology: Mol. function=nucleic acid binding
MSKGITNAKDFVDELEKRFAKSDKAKPNTLLQHLISMKYNGKGNIKEYIMEMSHIVSKLKGLKLELSEDLLVHLVLMSLLVQYSQFKDYLNY

SEQ ID NO: 161522 - protein, 257 aa, Glycine max
  Coding DNA Sequence Number=SeqID_44744
MGWPASAPAGAGGAMDMQAGGGFDPPAKTDSQELTFHWLYQRVQGLVEHSIYPKAGRVETWAFRIGVGAAIIGILMGQLPDRWLPLGVVLQVVVACLAIEIGGFIVGGVLAARRGIRQFSQPRLSHAREMDEDFAHWQAVVTELRGFPRVQRERRLKFVSTLRTNMMERMGMMYGGLQRLGPFPLLIALYLQFRGWKWGDWAGAFDVGPLGALLIFAMVLLYLLGWMLIGLRTRLDTYVALLEGSIHEPEPSQQTPL

SEQ ID NO: 161523 - protein, 172 aa, Glycine max
  Coding DNA Sequence Number=SeqID_44745
  Homolog annotation: Hit_ID=P00722; Match level="QueryCoverage=58%, HitCoverage=9%, E-value=3e-22, Identity=53%"; Hit description=Beta -galactosidase
MVKVGTSYVPINVSFRQKVGPGLPGINRDTRIYFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIESVAYRSFSPSEFEARGVRKVTTGITGLWQPSVHSDVAF

SEQ ID NO: 161524 - protein, 43 aa, Glycine max
  Coding DNA Sequence Number=SeqID_44746
MKGRAGSYKEHRLHGVFTADHSKKLDKDIAGIFPFPIEHCYCS

SEQ ID NO: 161525 - protein, 65 aa, Glycine max
  Coding DNA Sequence Number=SeqID_44747
MVINLQIGMMCKVIRPVVKMVTVRTVLVVAATQAWKLHQMDVHNAFLHGDLEEVVYMKPPPGFLP

SEQ ID NO: 161526 - protein, 347 aa, Glycine max
  Coding DNA Sequence Number=SeqID_44748
  Homolog annotation: Hit_ID=Q9FKU2; Match level="QueryCoverage=55%, HitCoverage=67%, E-value=6e-28, Identity=34%"; Hit description =Genomic DNA, chromosome 5, P1 clone:MDA7
  Pfam annotation: Domain name=Hin1; Domain location=189-326; Score =120.9; E_value=3.5e-33; Accession=PF07320.4; Description=Harpin -induced protein 1 (Hin1)
MSRRETNPHFSRSSQPEYIDDRDTEPYPLVPRRKRRDQPSTQVAPPIPVALPAEHEDRVPLRTRPQHEDHVPLQPQVEDHPHPPPPILQEPRRGKQRSPRRQPTNQGFRPVKSKVNFQEPPPSADVPPLLPPLNYPPEHRHQPRRDPRLSGIKLPKEQKSQPLTWLGACLCVIFWLIIIIGGLIVLIVYFVFRPQSPHFDVSSVTLNAAYLDLGYLLNADLTMLANFTNPNKKVHVDFSSVIIYLYYGSTLIATQYVEPFYAARLQSRFAYIHMVSSQVQLPLRESQRLVKQMEGNGVMLEVRGVFRARSKLGTILRYSYNLYGRCSVMLTRPPDGILLKKKCRTKR

SEQ ID NO: 161527 - protein, 258 aa, Glycine max
  Coding DNA Sequence Number=SeqID_44749
  Gene Ontology: Mol. function=RNA binding; Cellular component =mitochondrion; Biological process=protein amino acid phosphorylation
  Homolog annotation: Hit_ID=Q7XIR4; Match level="QueryCoverage=88%, HitCoverage=74%, E-value=4e-45, Identity=29%"; Hit description =Membrane-associated salt-inducible protein-like
  Pfam annotation: Domain name=PPR; Domain location=11-45; Score=11.3; E_value=0.35; Accession=PF01535.11; Description=PPR repeat
  Pfam annotation: Domain name=PPR; Domain location=116-150; Score =39.6; E_value=1.1e-08; Accession=PF01535.11; Description=PPR repeat
  Pfam annotation: Domain name=PPR; Domain location=151-185; Score =41.6; E_value=2.7e-09; Accession=PF01535.11; Description=PPR repeat
  Pfam annotation: Domain name=PPR; Domain location=186-220; Score =11.2; E_value=0.35; Accession=PF01535.11; Description=PPR repeat
  Pfam annotation: Domain name=PPR; Domain location=46-80; Score=46.2; E_value=1.1e-10; Accession=PF01535.11; Description=PPR repeat
  Pfam annotation: Domain name=PPR; Domain location=81-115; Score=33.8; E_value=5.9e-07; Accession=PF01535.11; Description=PPR repeat
  Pfam module annotation: Pfam domain module=PPR::PPR::PPR::PPR::PPR::PP R; Domain location=11-45::116-150::151-185::186-220::46-80::81-115
MERSGVEPDLYSYNELLKGFCKANMVDRAYLMMVERMQTKGMCDVVSYNTVITAFCKARQTRRGYELFEEMCGKGIRPDMVTFNVLIDAFLREGSTHVVKKLLDEMTRMCVLPDCIFYTAVVDHLCKNGKVDVAHSVFCDMVENGVNPDVISYNALVNGFCKASRVMDAMCLFDELQSKGLYPDGVTYKLIVGGLIRGKKISLACRVWDQMMERDQLLVKDSYRGLCSNGFLLPMEVMLPIQIPVVVSSDFILRVALS

SEQ ID NO: 161528 - protein, 187 aa, Glycine max
  Coding DNA Sequence Number=SeqID_44750
  Gene Ontology: Mol. function=zinc ion binding; Cellular component =cytoplasm; Biological process=vesicle-mediated transport
  Homolog annotation: Hit_ID=Q08ET6; Match level="QueryCoverage=94%, HitCoverage=36%, E-value=9e-79, Identity=81%"; Hit description=RING -finger protein
  Pfam annotation: Domain name=Copine; Domain location=50-182; Score =216.1; E_value=8.1e-62; Accession=PF07002.6; Description=Copine
MSKLVQECNAIRLVTTALSHAGLESSNLIVGIDFTKSNEWTGKRSFNRKSLHHIGSGQNPYEQAISIIGKTLSVFDEDNLIPCFGFGDASTHDQDVFSFHSDERFCHGFEEVLSRYRDIVPRLRLAGPTSFAPIIEMAMTIVEQSGGQYHVLLIIADGQVTRSVDTQHGQLSPQEEKDEIDANCKSQ

SEQ ID NO: 161529 - protein, 49 aa, Glycine max
  Coding DNA Sequence Number=SeqID_44751
MTYECDNSLPMCCLCLDPVMISNFVFVGVDDKVNCFKEPHAEERRDIML

SEQ ID NO: 161530 - protein, 60 aa, Glycine max
  Coding DNA Sequence Number=SeqID_44752
MDESEKRRRSWSAVAHTSTCLLPIAFYDASLAGKMRMKYLRRLAVGGGGLLEALECCHKR

SEQ ID NO: 161531 - protein, 70 aa, Glycine max
  Coding DNA Sequence Number=SeqID_44753
MVQLWFGIRVKEPGGPFGPKIKSYLEPHEWIVIHASSTIESGVPRIDCLALFVHSPPSKKGLATLNASNV

SEQ ID NO: 161532 - protein, 112 aa, Glycine max
  Coding DNA Sequence Number=SeqID_44754
MKLAKYRLKAQVEKDKAPEWRRMKAQVEKDEGPEAETLSRLLITYQGNPCGVYPNLSSFTGSGVYPDLSSFTGSGVNQKLYSLYQAIRSYSGSHHLVSELRLLIQWASNGQP

SEQ ID NO: 161533 - protein, 45 aa, Glycine max
  Coding DNA Sequence Number=SeqID_44755
MDDFSEDGDQKFFDHINEDSDDQSNNEGVGRPTTPPSPPLQYHQP

SEQ ID NO: 161534 - protein, 431 aa, Glycine max
  Coding DNA Sequence Number=SeqID_44756
MQEEEERPLIRKRKLPTTSTKFAEQTEAGNSQAQMPKKKKKVKQVEPEPSVAVEGGEPAKKKKKKTKSSKEQGDHQPVDVQPPSTDIDGTEVKAAPSIAEMGNPVEQPNSPREQPTVEVQQNVSAEEIPSCARTSPAPEADAVNVEEWGEGQGIGSSSPHGWAEVDDPHEPNQSDNTIPHESSQKSSSEENFFDEDAIKEAEAGGSDIYPVSSTSKLSASIGIAEDTFIQMQNEDPAAALRLLLNTSQANTSSDKIPGASSSSDAEINSSVRQDSLLLKLSMEYARKDVLESIEENPSAAFGHLNFLKKLHNPLTSDETLGKVIQIEAIIDQFASAVQKKRENGTRLDAQKQAHTLLLEKARAAQHEVERLTKEAKEGSSEIKDCDDNISSWEATITDLLLHIDDLRQKIVTEQAKRKELQEKAANSIQKL

SEQ ID NO: 161535 - protein, 66 aa, Glycine max
  Coding DNA Sequence Number=SeqID_44757
MKRSSRHIADIRECLGMRGYKGLGAKPEMRGLAYIKLQLTVSDSGLAPLPVLSALPMTSKQNDVGA

SEQ ID NO: 161536 - protein, 50 aa, Glycine max
  Coding DNA Sequence Number=SeqID_44758
MWLKRGENPCVSSGIHDECAKRAYCAQPVHRNYTKRACALSVNGILRYPV

SEQ ID NO: 161537 - protein, 294 aa, Glycine max
  Coding DNA Sequence Number=SeqID_44759
MTQRHLLAVLISAALLLPGQAASAADDDMLRAFSEAARTLPPAPAAKPQPPAKPAAKPAAKTVSKAEKKAATVPDHNAELTRLRARVAELEKLSAAPAVKADDALKAQLAASDKKLAALSAEKQQQEKNIATLQQALKEAQQQQSAGSAQLTKQLSDARAAATQSADALKALKAENEKTLAALQADSKKQLSAQQAGNDRKLAALSAEKQQQEKNIATLQQALKEAQQQQSAGSAQLTKQLSDARAAATQSADALKALKAENEKTLAALQAESKQQLSAQQAASDKKLAALQAE

SEQ ID NO: 161538 - protein, 307 aa, Glycine max
  Coding DNA Sequence Number=SeqID_44760
  Homolog annotation: Hit_ID=Q10NZ3; Match level="QueryCoverage=67%, HitCoverage=63%, E-value=8e-47, Identity=45%"; Hit description =Expressed protein
MATNEMPPSNIASSLLATSNANDKKENNEECWGSAYPTFQPGWDLDDEIHATFFKCISWQVEETLDTINCPYHYFCDKTYPSNYPLVVDILVLLFTAASYLVTLVILVMDMSSGRGRIFLGQSKRFLLPSGPISLPLIILAFAKGPQINTIFPLNCIGPAILLMVLISALSFDNAADKDFKYTFFVASTVSGILHASLYLDSVVLPYYTGFDALMSSTFSGECASCVCRKEALVVGGKLVRIMCKISGENYAGKFLFIKALMERHFSFDFPSSPQRGMQPNLLNGLCGRKIGMGIGIIAHNMKKRQL

SEQ ID NO: 161539 - protein, 88 aa, Glycine max
  Coding DNA Sequence Number=SeqID_44761
MGSNVVRCDLDGNRNDVDLKLQNGHQEQFVVESHGGGPKLLNIVSGQSYKEIGKEPVFVCKELGEYVREQWKLLNFEGWSTFVLKEKL

SEQ ID NO: 161540 - protein, 146 aa, Glycine max
  Coding DNA Sequence Number=SeqID_44762
  Gene Ontology: Mol. function=sequence-specific DNA binding; Cellular component=nucleus; Biological process=regulation of transcription, DNA-dependent
  Homolog annotation: Hit_ID=Q8RVL4; Match level="QueryCoverage=96%, HitCoverage=58%, E-value=3e-36, Identity=51%"; Hit description=MADS -box protein defh21
  Pfam annotation: Domain name=SRF-TF; Domain location=9-59; Score =101.9; E_value=1.8e-27; Accession=PF00319.9; Description=SRF-type transcription factor (DNA-binding and dimerisation domain)
MGRGKIEIKRIENKTTRQVTFSKRRCGLLKKTKELSVLCDAKIGIIIFSSTGKMREWCTEPFRMEQIIEQYQISKGTCIAERGRDHPREEFVHNMAMLRQKTIRLELEIQRYLGEDTRGLQYEDLTKLEQELENSVARVRNRHASW

SEQ ID NO: 161541 - protein, 80 aa, Glycine max
  Coding DNA Sequence Number=SeqID_44763
MFWVKHPHHYMKVLRAFRVLQRDIILKFRSRQCDRGSVKVTKIAPISEKDNFYKVSLLWGVFFKGSLKHAMAVSKLRMMQ

SEQ ID NO: 161542 - protein, 55 aa, Glycine max
  Coding DNA Sequence Number=SeqID_44764
MPTSPERAQMTILASAYQSHSSSWVMVTESSVVDKSEAFAPMYPPMRNSDLRSSG

SEQ ID NO: 161543 - protein, 133 aa, Glycine max
  Coding DNA Sequence Number=SeqID_44765
  Gene Ontology: Mol. function=monooxygenase activity; Cellular component=integral to membrane; Biological process=electron transport
  Homolog annotation: Hit_ID=Q1S8Q5; Match level="QueryCoverage=97%, HitCoverage=22%, E-value=3e-60, Identity=83%"; Hit description=E -class P450, group I
VVEDVTFPDGTVLLKGTKVIYSIYTMGRMESIWGKDCKEFKPERWLRENGHFMSESAYKFTAFNGGPRLCLGKDFAYYQMKYAAASIIFRYRVKVLENHPVVPKLALTLYMKHGLKVNLQRRDAAEIDKYFKV

SEQ ID NO: 161544 - protein, 416 aa, Glycine max
  Coding DNA Sequence Number=SeqID_44766
  Gene Ontology: Mol. function=monooxygenase activity; Cellular component=membrane; Biological process=electron transport
  Homolog annotation: Hit_ID=Q1S8Q5; Match level="QueryCoverage=93%, HitCoverage=68%, E-value=1e-153, Identity=68%"; Hit description=E -class P450, group I
  Pfam annotation: Domain name=p450; Domain location=63-415; Score= -84.2; E_value=3.9e-07; Accession=PF00067.12; Description=Cytochrome P450
  Subcellular localization annotation: CTP_CleavageSite=13; ConfidenceScore=5.04e-01
MHHNISNNHSFIVTKLATNNITTTNMNFFSLIFFLLQHVHIFELTIATAMFIALRAWRSKRHHGLPIWPILGMLPSLLYGITTNLYEWLSEVLIRQNGTFTFQGPWFASLDCVLTSDPRNLEYLLKTKFSSFPKGRFFRYTLRDLLGNGIFNADKEAWQRQRKTVSLEFHSTMFRNLTAESLLELVHKRLLPLLESCVNKSRVIDLQDVLLRLTFDNVCMIAFGVDPGCSQPHLPDIPFATAFEDATETSMRRFITPVWMWKFMRHLNVGVEKRLKESIEKVDEFAESVIMTRKKELALQHDKSDLLTVFMRLKDENGMAYSDKFLRDICVNFILAGRDTSSVALSWFFWLLHMNPQVEEKILAEICRVVLSQREGLKKEEVVVGSCLAFRPEEIKKMDYLHAALSEALRLYPSVP

SEQ ID NO: 161545 - protein, 409 aa, Glycine max
  Coding DNA Sequence Number=SeqID_44767
  Gene Ontology: Cellular component=nucleus
  Homolog annotation: Hit_ID=Q9FMY0; Match level="QueryCoverage=89%, HitCoverage=91%, E-value=1e-117, Identity=54%"; Hit description =Arabidopsis thaliana genomic DNA, chromosome 5, P1 clone:MKD15
  Subcellular localization annotation: CTP_CleavageSite=57; ConfidenceScore=5.28e-01
MSVYDDLAAASLYPSKNISSLKTLHFASKAHFIVNSSVSFIQLLMALLFQKFQEAVKTLAKRPSFTKDPRQLQFEADINRLFLYLSYNHLGKNADEAHAEEIIEMASKASFADQQMQVQENVHSQIKTFCTFMDEILLPNEKMPLAFGAASPKTRPLSQAVVSQNLKDQLGYTVNVTPSQIPHKDAGQGLFLDGTVDVGAVVAFYPGIVYSPAYYRYIPGYPKVDTLNPYLITRYDGNVINAQPWGSGGDNRELWNGRKTGEIKPDVKGAEPEKVQKGYQGGNNEVIERRNPLALAHFANHPPKGVQPNVMICPYDFPLTESNMRVYIPNVLFGNAEVNMRRFGSFWFKSGGGSRNSGSNVPTLKTLVLIATRPLQDEELFLNYRLSNTKRRPEWYNPVDEEEDRRRWS

SEQ ID NO: 161546 - protein, 734 aa, Glycine max
  Coding DNA Sequence Number=SeqID_44768
  Gene Ontology: Mol. function=binding; Cellular component=nucleus; Biological process=mRNA editing
  Homolog annotation: Hit_ID=Q6K2P5; Match level="QueryCoverage=67%, HitCoverage=76%, E-value=1e-120, Identity=33%"; Hit description =Putative pentatricopeptide (PPR) repeat-containing protein
  Pfam annotation: Domain name=DUF241; Domain location=4-185; Score =62.6; E_value=1.3e-15; Accession=PF03087.5; Description=Arabidopsis protein of unknown function
  Pfam annotation: Domain name=PPR; Domain location=265-299; Score =34.2; E_value=4.4e-07; Accession=PF01535.11; Description=PPR repeat
  Pfam annotation: Domain name=PPR; Domain location=327-361; Score =34.0; E_value=5.3e-07; Accession=PF01535.11; Description=PPR repeat
  Pfam annotation: Domain name=PPR; Domain location=389-422; Score =41.5; E_value=3e-09; Accession=PF01535.11; Description=PPR repeat
  Pfam annotation: Domain name=PPR; Domain location=451-485; Score =28.2; E_value=2.9e-05; Accession=PF01535.11; Description=PPR repeat
  Pfam annotation: Domain name=PPR; Domain location=555-589; Score =43.7; E_value=6.1e-10; Accession=PF01535.11; Description=PPR repeat
  Pfam annotation: Domain name=PPR; Domain location=590-624; Score =12.8; E_value=0.23; Accession=PF01535.11; Description=PPR repeat
  Pfam annotation: Domain name=PPR; Domain location=626-659; Score=1.8; E_value=4.6; Accession=PF01535.11; Description=PPR repeat
  Pfam module annotation: Pfam domain module=DUF241::PPR::PPR::PPR::PPR: :PPR::PPR::PPR; Domain location=4-185::265-299::327-361::389-422::451- 485::555-589::590-624::626-659
MAPLDFVALKDLHNSANNLLHSPMVQQALVHQREEKWFDDVSESSLRMLEVCGISKDVLLLVKEHLQELQFTLHRASIGDPGIEEKIEAYNCYRKKLKKETLKWLKGMKSQTATMHPPINEQKLVLVVDVLRELVRVSLHYCSDDMIYYDAMVLQSANKRLAGVRMAIEGLEDEDADVSTEVVPMYSQAIAIDEEAATPFIIHFVAPSQITKQQCEIDYARKVFEEMPERDIGLWTTMITGYLKCGMIREARKLFDRWDAKKNVVTWTAMVNGYIKFNQVKEAERLFYEMPLRNVVSWNTMVDGYARNGLTQQALDLFRRMPERNVVSWNTIITALVQCGRIEDAQRLFDQMKDRDVVSWTTMVAGLAKNGRVEDARALFDQMPVRNVVSWNAMITGYAQNRRLDEALQLFQRMPERDMPSWNTMITGFIQNGELNRAEKLFGEMQEKNVITWTAMMTGYVQHGLSEEALRVFIKMLATNELKPNTGTFVTVLGACSDLAGLTEGQQIHQMISKTVFQDSTCVVSALINMYSKCGELHTARKMFDDGLLSQRDLISWNGMIAAYAHHGYGKEAINLFNEMQELGVCANDVTFVGLLTACSHTGLVEEGFKYFDEILKNRSIQLREDHYACLVDLCGRAGRLKEASNIIEGLGEEVPLTVWGALLAGCNVHGNADIGKLVAEKILKIEPQNAGTYSLLSNMYASVGKWKEAANLVINHTLNMSPWGIYFMIYIQK

SEQ ID NO: 161547 - protein, 409 aa, Glycine max
  Coding DNA Sequence Number=SeqID_44769
  Gene Ontology: Mol. function=oxidoreductase activity; Cellular component=membrane; Biological process=electron transport
  Homolog annotation: Hit_ID=O81077; Match level="QueryCoverage=98%, HitCoverage=83%, E-value=1e-144, Identity=62%"; Hit description =Putative cytochrome P450
  Pfam annotation: Domain name=p450; Domain location=1-403; Score =118.4; E_value=2e-32; Accession=PF00067.12; Description=Cytochrome P450
YGDIFKTNILGCPCVMISSPEAARIVLVTQAHLFKPTYPPSKEKLIGPEAVFFQQGAYHSMLKRLVQASFLPSTIKHSVSEVERIVIKMVPTWTYKTINTLQEMKKYAFEVAAISAFGEIKELEMEEIRELYRCLEKGYNSYPLNVPGTSYWKAMKARRHLNESIRRIIERRKESSNYGGGLLGVLLQARGEKNNKYYQQLTDSQVADNLIGVIFAAHDTTASALTWVLKYLHDNANLLEAVTKEQEGIKNKLAMENRGLSWDDTRQMPFTSRVIQETLRSASILSFTFREAVTDVELEGYTIPKGWKVLPLFRSIHHSADFFPQPEKFDPSRFEVPPRPNTYMPFGNGVHSCPGSELAKLELLVLLHHLTLSYRWQVVGNEDGIQYGPFPVPKHGLPVKITPRNKIFT

SEQ ID NO: 161548 - protein, 50 aa, Glycine max
  Coding DNA Sequence Number=SeqID_44770
  Gene Ontology: Mol. function=RNA splicing factor activity, transesterification mechanism; Cellular component=spliceosome; Biological process=mitosis
  Homolog annotation: Hit_ID=Q1SM40; Match level="QueryCoverage=80%, HitCoverage=28%, E-value=4e-17, Identity=95%"; Hit description =Thioredoxin domain 2
MSYLLPHLHSGWAVDQAILAEEERLVVIRFGHDWDETCMQVIVELMVAGR

SEQ ID NO: 161549 - protein, 189 aa, Glycine max
  Coding DNA Sequence Number=SeqID_44771
MTLLLSNILPSDRNANLPLQKYQLVCVVPTWGSHPQRHPVDLKKSNRALGFPALVTGLCRPYRAPVPPSKFMSSWHRHLVDPEEGQQGLGVASSKYGSLSVLGSACRPQQGHQVPPTNRAFIKKFCVSRQAQGETPQQPGDGRQRATDAPPSPLEFASAHPQKGLSIAYTTWPTNRRPSPKPKDAPSCS

SEQ ID NO: 161550 - protein, 69 aa, Glycine max
  Coding DNA Sequence Number=SeqID_44772
MPADVGQEKMTDRGLKKKHDRMTPIEHFQIDIVQPTLRNFFHKRWPIIFLYGKGNGCFRCTVSPIQFSM

SEQ ID NO: 161551 - protein, 90 aa, Glycine max
  Coding DNA Sequence Number=SeqID_44773
  Homolog annotation: Hit_ID=Q9FNL5; Match level="QueryCoverage=61%, HitCoverage=5%, E-value=2e-23, Identity=96%"; Hit description =Similarity to guanylate binding protein
  Subcellular localization annotation: CTP_CleavageSite=47; ConfidenceScore=5.44e-01
MLKYFNRGRDSPAADASPSSHAPATPSSSLPSASPVTGPARPIRLVYCDEKGKFQMDPEAVATLQLVKEPIGVVSVCGRARQGKSFILNQ

SEQ ID NO: 161552 - protein, 188 aa, Glycine max
  Coding DNA Sequence Number=SeqID_44774
  Gene Ontology: Mol. function=nucleoside-triphosphatase activity; Cellular component=membrane; Biological process=anion transport
  Homolog annotation: Hit_ID=O50593; Match level="QueryCoverage=48%, HitCoverage=15%, E-value=4e-34, Identity=79%"; Hit description =Arsenical pump-driving ATPase
MQLQDPERTKVLLVTLPETTPVLEAANLQADLERAGIHPWGWIINNSLSIADTHSPLLCQRARQELPQIEAVKHQHADRIALVPLLASEPAGRQTRPVRRFYVTGRRYFCPDPCFGYLAAEGGVVHLGDIPVVWNIVWNATATFIAVIIISLLLDESGFFEWAALHVSRWETVGAVCSLAIWFCSAQQ

SEQ ID NO: 161553 - protein, 58 aa, Glycine max
  Coding DNA Sequence Number=SeqID_44775
  Homolog annotation: Hit_ID=P52145; Match level="QueryCoverage=98%, HitCoverage=9%, E-value=4e-26, Identity=98%"; Hit description =Arsenical pump-driving ATPase
MAFVAHFFGNFAVISPGCIQQQQRMPRGSRIHHHKPLTCFADHARKCLEDGDLFSTGG

SEQ ID NO: 161554 - protein, 371 aa, Glycine max
  Coding DNA Sequence Number=SeqID_44776
  Gene Ontology: Mol. function=mannonate dehydratase activity; Biological process=glucuronate catabolic process
  Homolog annotation: Hit_ID=Q8UAW0; Match level="QueryCoverage=99%, HitCoverage=100%, E-value=1e-179, Identity=78%"; Hit description =Mannonate dehydratase 1
  Pfam annotation: Domain name=UxuA; Domain location=1-361; Score =418.7; E_value=8e-123; Accession=PF03786.4; Description=D-mannonate dehydratase (UxuA)
MRHTWRWFGPVDKVTVQDAAQAGAEGIVSALHHIATGDVWPVDEITRRHEAIKAGGLYWDVVESVPVSEDIKTQTGDWKTHIANWQETLRRLSASGIRTVCYNFMPVLDWTRTDLRWETKHGAKAMRFDLTDFAAFDIHILKRPDATRDYPDWLLEDAAKRFTEMPDTKIVALSRNIGAGLPGSADGYTLPELIEKLRSYHGVNRERLQQNLIDFLSEVTPVAENVGINICAHGDDPPWPLLGLPAYSLNGGGLRPYAVADRIHFVHLRNVTRDTDTVPCSFFEDEHLEGGTDMVAVIAALITEEARRRAEGREDHTIPMRPDHGQEILDDLTRGAQPGYPAIGRLKGLAELRGIERTLSHSHFGLANGNG

SEQ ID NO: 161555 - protein, 282 aa, Glycine max
  Coding DNA Sequence Number=SeqID_44777
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=27%, E-value=1e-73, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
METVRIITAIASQKEWHMHHMDVKSAFLNGPLEEEVYAPRAWNRRIDGFLMKLGFLKCTTERGVYIKGNNTTNLTVVCLYADDLLVIGNNETEIANFKGEMMREFEMTDLDLISYFLGIEFKRTDEEVIMHKGRHTHCTGVNLVKDPNEEEVDVTLYRQMVGSVSRYMGNPKLSHLCATKRIMSNCAAKKYNALGYSDSDWCGDKSDRKSTTGYVFFYGDAPILWSSKKEQVIALSSCEVEYIAAAMAMKVKGAITLMVDNKSAVNLAKHPVAHGRSKHIET

SEQ ID NO: 161556 - protein, 69 aa, Glycine max
  Coding DNA Sequence Number=SeqID_44778
MARTSLSSLSIPFLILLIITFTFFAQLAPVSADLQMRKLGPMRSPPPPPKFLLGPGPGRSGNDAPPPPR

SEQ ID NO: 161557 - protein, 70 aa, Glycine max
  Coding DNA Sequence Number=SeqID_44779
MIIKKDFMVGQKVLLYNSKLGLMSVEVKSDSTNKSFKFNGHRLKPFLTNPSLVDVVVEETSLLHPTLPPP

SEQ ID NO: 161558 - protein, 168 aa, Glycine max
  Coding DNA Sequence Number=SeqID_44780
  Gene Ontology: Mol. function=RNA splicing factor activity, transesterification mechanism; Cellular component=spliceosome; Biological process=mitosis
  Homolog annotation: Hit_ID=Q1EP80; Match level="QueryCoverage=58%, HitCoverage=51%, E-value=5e-51, Identity=100%"; Hit description =Spliceosomal U5 snRNP-specific 15 kDa protein, putative
  Pfam annotation: Domain name=DIM1; Domain location=1-96; Score=189.9; E_value=6e-54; Accession=PF02966.7; Description=Mitosis protein DIM1
MDEVLASVAETIKNFAVIYLVDITEVPDFNTMYELYDPSTVMFFFRNKHIMIDLGTGNNNKINWALKDKQEFIDIVETVYRGARKGRGLVIAPKDYSTKIIGDQDALITTISLGSTPYPYTAGPLGFGLARKVWSLIPSLRHGVTTGDITLSKKWTYPVGGGVTPPGY

SEQ ID NO: 161559 - protein, 173 aa, Glycine max
  Coding DNA Sequence Number=SeqID_44781
  Homolog annotation: Hit_ID=Q9C801; Match level="QueryCoverage=24%, HitCoverage=9%, E-value=3e-08, Identity=61%"; Hit description =Protein MOS2
  Pfam annotation: Domain name=G-patch; Domain location=105-149; Score =18.1; E_value=0.0012; Accession=PF01585.13; Description=G-patch domain
MKKLSFSIPTAKPQSVDTSTTRKDDDSDGTKQYITEFDPSKPANPKITIPPIQNQWNPQQDNEHSTTRWRRTPEETELLRKLKLEEDLQRLPEDQGLEEFKDVPVEVFGEALLAGYGWTEGMGIGKKAKEDVKVVQRYAVQNQGSIGYNSIILSFSNHSSPSSLFFGSIPMEA

SEQ ID NO: 161560 - protein, 446 aa, Glycine max
  Coding DNA Sequence Number=SeqID_44782
  Gene Ontology: Mol. function=DNA binding; Cellular component =intracellular; Biological process=regulation of transcription
  Homolog annotation: Hit_ID=Q9FJS0; Match level="QueryCoverage=77%, HitCoverage=53%, E-value=1e-107, Identity=51%"; Hit description =Arabidopsis thaliana genomic DNA, chromosome 5, P1 clone:MQD22
  Pfam annotation: Domain name=JmjC; Domain location=101-224; Score =167.7; E_value=2.9e-47; Accession=PF02373.13; Description=JmjC domain
MRGRKYTYHDFEVLANKAFFSRFHSSRDLPSSYVEKEFWHEMAQGEKGTVEYGVNVEGSAFSCDPNDRLGTSKWNLKNFSQLPQSLIRLVDREIPGITDPMLYIGMLFSMFAWHVEDHYLYSINYHHSGANKTWYGVPGYAASQFEKTVLQHVYCNKIITKHGEDGAFKFLAQKTTMFPPNVMLQHDVAVYKAVQKPGEFIITFPRAYHAGFSHGFNCGEAVNFANGDWFPLGAAASRRYTHLKMMPLIPYEELLCKEAMLVFKSSRVRSSKNKPEDTTSYQAIMLPFMHLMQSYKTSLLRLNSSRKLHSSSNTTDIAPQTCLCGRDYTIFKRNDIFALEEAAKSFQQGKECVDKFSLSSIFSCNINDCIKVPENNPWQREKSVRGTSFLGVASKPKTKVADSTKHSDERNKSTTKHWRNNGLPSVRGAERPGIIYNLRKRKSKLI

SEQ ID NO: 161561 - protein, 698 aa, Glycine max
  Coding DNA Sequence Number=SeqID_44783
  Gene Ontology: Mol. function=translation elongation factor activity; Cellular component=cytosol; Biological process=translation
  Homolog annotation: Hit_ID=Q1SCD5; Match level="QueryCoverage=99%, HitCoverage=69%, E-value=0.0, Identity=79%"; Hit description =Elongation factor Tu, domain 2; Translation elongation factor G
  Pfam annotation: Domain name=EFG_C; Domain location=556-644; Score =94.1; E_value=4.1e-25; Accession=PF00679.14; Description=Elongation factor G C-terminus
  Pfam annotation: Domain name=GTP_EFTU_D2; Domain location=116-197; Score=29.6; E_value=1.1e-05; Accession=PF03144.15; Description =Elongation factor Tu domain 2
  Pfam module annotation: Pfam domain module=EFG_C::GTP_EFTU_D2; Domain location=556-644::116-197
RELQNKDVNVVLQAVMSRWLPLSEAVLSMVVRCLPDPVTAQAFRISRLIPKREVVGDVEEAELVRKSVEECDCRDEAPCVAFVSKMFAAPVKMLPGHRVEVGNGYGDEGESESDECFLAFARIFSGVLHAGQRIFVLSALYDPVKGESMLKHIQEAELKSLYLMMGQGLKVVTSARAGNIVAIAGLGQHILKSATLSSTKNCWPFSSMAFQVAPTLRVAIEPSDPADVGALLKGLRLLNRADPFVEVTVSGRGEHVLAAAGEVHLERCIKDLKERFAKVSLEVSPPLVSYKETIEGDALNVMENLKVLSRRSSDYVEKTTPNGRCVVRVQVMKLLPSLTKVLNESSDLLGDIIGVKSRQRPSILENDNPVEVLKKRILDAVGGDILSRNENDKDHAEKCKLKWLKILRRIWALGPRQIGPNLLFTPDIKAQSTDSSVLIRGSPGISERFGFVADSSINDSVTETSSNANSALYMDAEHLESSVISGFQLATSAGPLCDEPMWGLAFVVEARLSPFPGQHDESETHQQSEQYGIFAGQVIATVKDACRAAVVQNKPRLVEAMYFCELNTPTEYLGPMYAVLSRRRARVLKEEMQEGSPFFTVHAYLPVSESFGFADELRRWTSGAASALLVLSHWEALPEDPFFVPKTEEEIEEFGDGSSVLPNTARKLINAVRRCKGLPVEEKVVQHGTKQRTLARKV

SEQ ID NO: 161562 - protein, 153 aa, Glycine max
  Coding DNA Sequence Number=SeqID_44784
  Pfam annotation: Domain name=zf-CCHC; Domain location=91-108; Score =32.1; E_value=2e-06; Accession=PF00098.13; Description=Zinc knuckle
MSLATLFGKLQEHEMELQRLNQNEENDKKKRSIALKASSSMQEENEEEDSDDEEDFSFFVKKFQKFIKKKRIDRRQNFNNGRKSQEDSQVLRCYKCNQIGHMKANCPSNEEWPEKSDKKRYDERRTKKAYIAWDDNDSSDGLEKGDQSSNQGL

SEQ ID NO: 161563 - protein, 78 aa, Glycine max; identical to SEQ ID NO: 123501
  Coding DNA Sequence Number=SeqID_44785

SEQ ID NO: 161564 - protein, 254 aa, Glycine max
  Coding DNA Sequence Number=SeqID_44786
  Pfam annotation: Domain name=UBX; Domain location=185-247; Score =17.5; E_value=0.0017; Accession=PF00789.11; Description=UBX domain
MEKTKATPAAIATYMKATGAPWSVAIRQLEKYGGNLTEAINAHFFGEDTHESLDEEQQNLAASASQHDNPGASNQDPLAESSASHVPDVGKEEEMVEAAMEDSKTDTAVASSSQQMDILQDSSDHELPQSHSQQDYQYDLERAILLSLKDLDDPASPVAEEANMLSSLSEAEKIELTRKILRECRERAQAITIAVHMPDGRLICRHFIKTDKLEVQHFPRRAYGIEDFSSTFDEVGLSNNETLYVEKISAPRKL

SEQ ID NO: 161565 - protein, 463 aa, Glycine max
  Coding DNA Sequence Number=SeqID_44787
  Homolog annotation: Hit_ID=Q9CB00; Match level="QueryCoverage=56%, HitCoverage=53%, E-value=5e-17, Identity=30%"; Hit description=Ara4 -interacting protein
  Pfam annotation: Domain name=UIM; Domain location=198-215; Score =10.7; E_value=1.1; Accession=PF02809.10; Description=Ubiquitin interaction motif
  Pfam annotation: Domain name=UIM; Domain location=241-258; Score =16.1; E_value=0.13; Accession=PF02809.10; Description=Ubiquitin interaction motif
  Pfam module annotation: Pfam domain module=UIM::UIM; Domain location =198-215::241-258
MATPDAVAAFMRITGAPEFVAVRKLEEYGGNLNEAINAHFLEVDRHIVCMILVTRLSGQGQNFAAAPQYDNFGASSQNRGGGSNGILPFLNAARRFRPSLLLDPNYRKELRDLYNGIGGSTSFTSRPPPLTSHPAEVTEVPAGINSAFNPQYQSGLSTTGADMTGHLSSHGLGVRGTDGYQNQYPLAQSNASHVPDSEIEEAMLQAAIEASKTERRGGSLWEQIDVLNDSSDGGHPQGHFQQEDDDLVHALSLSLETAEHEKAKRDLLVAEEKEGLGVHNLLDKGKKTSTNRSQIEWGGISSEELNEALLAETALFGEISNHSSQNFSSLPNLQHHPEQNVDPKTQCLSTSMSQLLNDSRLLKQQQDAEYLESLRADKQKELNSLNKTESHSSKEEESCKKMLEEKGLGKMLDKKEVGLPKEPPLSDEVITIVVRMPDGGRCERRFLKTDKLEVKLALEYDEN

SEQ ID NO: 161566 - protein, 393 aa, Glycine max
  Coding DNA Sequence Number=SeqID_44788
  Gene Ontology: Mol. function=methyltransferase activity; Cellular component=cellulose and pectin-containing cell wall
  Homolog annotation: Hit_ID=Q1S1Q1; Match level="QueryCoverage=99%, HitCoverage=60%, E-value=0.0, Identity=80%"; Hit description=Generic methyltransferase
  Pfam annotation: Domain name=DUF248; Domain location=1-379; Score =631.4; E_value=7.7e-187; Accession=PF03141.7; Description=Putative methyltransferase
MSFAPRDTHISQVQFALERGIPALIGILATIRLPYPSRAFDMAHCSRCLIPWGQYDGVYMTEIDRVLRPGGYWILSGPPINYEKHWRGWERTHESLKEEQDGIEDVAKSLCWKKLVQKDDLAVWQKPTNHAHCKLKRKIFKSGSRPLCGEAQDPDTAWYTKLDTCLTPLPEVKNIKEVSGGGGLANWPNRLTSIPPRIRSESLEGITAEMFTENTKLWKKRLAYYKKLDHQLAERGRYRNLLDMNAYLGGFAAALVDDPVWVMNIVPVEAEINTLGVVYERGLIGTYQNWCEAMSTYPRTYDFIHGDSVFSLYQNRCDMVDILLEMDRILRPQGSVILRDDVDVLTKVKIIADEMQWDARITDHEEGPYERQKILVAVKEYWTSPPPERNQHS

SEQ ID NO: 161567 - protein, 723 aa, Glycine max
  Coding DNA Sequence Number=SeqID_44789
  Gene Ontology: Mol. function=methyltransferase activity; Cellular component=cellulose and pectin-containing cell wall
  Homolog annotation: Hit_ID=Q8H636; Match level="QueryCoverage=90%, HitCoverage=87%, E-value=1e-112, Identity=44%"; Hit description =Dehydration-responsive protein-like
  Pfam annotation: Domain name=DUF248; Domain location=89-718; Score =913.5; E_value=9.4e-272; Accession=PF03141.7; Description=Putative methyltransferase
  Pfam annotation: Domain name=Methyltransf_11; Domain location=323 -430; Score=20.0; E_value=0.00059; Accession=PF08241.2; Description =Methyltransferase domain
  Pfam module annotation: Pfam domain module=DUF248::Methyltransf_11; Domain location=89-718::323-430
  Subcellular localization annotation: CTP_CleavageSite=7; ConfidenceScore=5.12e-01
MPHLNLPASKRVRQWRVLDLISAAFFGLVFLFFMLVFTPAGDSLAASGRQTLLLSASADPRQRLHVAAAIEAGQQSRVIDACPADTAADHMPCEDPRLNSQLSREMNYYRERHCPPLETSPLCLVPPPKGYKVPVQWPESLHKMFSQSTFLRGTTTTTTPYPTRWGRLHGSTSAIIFYQNDKAKVESFYEKVLLRLQAVIFNITKLSSALVEVGSSTGWTPLSGITSHSGGAVDSAISSLHLSGVSSILGSINFITTISNIWHSNMPYNKIADRKGHQGWMKLDGPHFIFPGGGTMFPDGAEQYIEKLGQYIPMNGGILRTALDMGCGVASFGGYLLAQNILTMSFAPRDSHKSQIQFALERGVPAFVAMLGTRRLPFPAFGFDLVHCSRCLIPFTAYNITALMQKPCLADASYFIEVDRLLRPGGYLVISGPPVQWPKQDKEWSDLQAVARALCYELIAVDGNTVIWKKPAVEMCLPNQNEFGLDLCDDSDDPSFAWYFKLKKCITRMSSVKGEYAIGTIPKWPERLTASPPRSTVLKNGADVYEADTKRWVRRVAHYKNSLKIKLGTPAVRNVMDMNAFFGGFAAALNSDPVWVMNVVPSHKPITLDAIFDRGLIGVYHDWCEPFSTYPRTYDLIHATSIESLIKDPASGRNRCSLLDLMVELDRILRPEGTVVVRDTPEVIEKVARVVRAVRWKPTIYNKEPESHGREKILVATKTFWKS

SEQ ID NO: 161568 - protein, 75 aa, Glycine max
  Coding DNA Sequence Number=SeqID_44790
MRINPSGYPYKRFMLILTREVRGKQKTNVVICTLCQSGASKPVGTRRLTSSSAPLSSRDSESDDMRIYPSGYPYK

SEQ ID NO: 161569 - protein, 400 aa, Glycine max
  Coding DNA Sequence Number=SeqID_44791
  Gene Ontology: Mol. function=RNA-directed DNA polymerase activity; Biological process=RNA-dependent DNA replication
MGEIEEMQERMKADMEAMKEKMATMMEAMMSMKKIMEVNAAAVAATSAIAEVDLTPLSGLNQINHPTSDRVGQGSKELGSMGGPHCVQIQKKYAFPPYGLPLNYTPPNVARAPDGNVDKSAPILIESQQPQSDHAPVSQPMGETHEVPHHNLADLEPRLGYSIEGQAVERVPPAMVEREKLDHIEERLRAIEGGRDHAFTDMAELYLVPNVIIPPKFKVPNFDKYKGTACPKNHLKLYCRKMGAYAKDEKLLMHFFQESLTGAVVTWMQLYSMCKKGHESFKEYVQRWRDLAAQVVPPMMEWEMITMIVDTLPVFYYEKMVGYTPSSFAYLVFASERIEVGLKRGKFDYPALMNEKPGANGENEEEGGTHAVTVIPTWPNQACQYSTNIDPSHYPPPNQP

SEQ ID NO: 161570 - protein, 110 aa, Glycine max
  Coding DNA Sequence Number=SeqID_44792
  Gene Ontology: Mol. function=transferase activity, transferring glycosyl groups; Biological process=metabolic process
  Homolog annotation: Hit_ID=Q8S997; Match level="QueryCoverage=62%, HitCoverage=14%, E-value=5e-09, Identity=53%"; Hit description =Glucosyltransferase-12
MASEKAVGWSMSSDIGDHQPHDPTYLQVGLDMKDVVCDRNLIENMVNDLMGHRKKEFLNLAREVAMLANHSVRIGIGKVMTDLLSPQIKEVRRSNGVKVPIWYFYLWKSN

SEQ ID NO: 161571 - protein, 70 aa, Glycine max
  Coding DNA Sequence Number=SeqID_44793
MTHRLCFEALDKNLRDIMRVDNNPSLIFGGKVVFGGDFRQVMKENIYHQTQLTSHIKLKAKSLRQLHLNF

SEQ ID NO: 161572 - protein, 225 aa, Glycine max
  Coding DNA Sequence Number=SeqID_44794
MGSFTDSAWEWNLSWRRPLFDNEVASTVGFLEDISHTALQQHAADNWVWKPESNGYYSSRSAYILLQGNSEEGNMDDIFKDLWKLKIPAKASIFAGRRKLHLIFSLTAAKHNILVGIPIMDRHLGGLSYKSKAPLSAAQQWDERCTVFGMDKFRTMEKIFTMHFNYWSSNLAADFQEQCRGFCGFKRGECGFSGSVGGSVGLSKDNVGVEGAVSGSFQAGGEREE

SEQ ID NO: 161573 - protein, 127 aa, Glycine max
  Coding DNA Sequence Number=SeqID_44795
MQLKYFNQVLIQEEGSIEEVIDEIKHYLDCSEQPIYFNDHQDNVLGKPSMNVSMFTSWMDANKMYNEDLQLSNTDLQNLTLMEIEKILDANRKSLRNYPTMPYPNAYVTSQLGNRLIYFELDYDIDE

SEQ ID NO: 161574 - protein, 50 aa, Glycine max
  Coding DNA Sequence Number=SeqID_44796
MDNINRTTICPDNLGSTVADCLRKRWFGSGLVSMVQIENKVLGYCGGIDW

SEQ ID NO: 161575 - protein, 144 aa, Glycine max
  Coding DNA Sequence Number=SeqID_44797
MDPNPWLPILKGEKGSPGPPPQQQEEPIDISSQKEHMGHYEESIIVANQPGVDDSNLWTFKVQQDFKTLSKFWADEVEDSMEETTNVGMEIFTIVISKNNKKKLKGSKMLLLARLKRTVLQLERKNHPHESSILEHLGSLDPNF

SEQ ID NO: 161576 - protein, 82 aa, Glycine max
  Coding DNA Sequence Number=SeqID_44798
MGVLTPPTISKSSLGHQYSRGRSEIHIQHWAWDTCMLLGLTSRVHNELQIIAEDGVWVKEIGGIPLVDRVRFAHGRPGVRHY

SEQ ID NO: 161577 - protein, 120 aa, Glycine max
  Coding DNA Sequence Number=SeqID_44799
  Subcellular localization annotation: CTP_CleavageSite=45; ConfidenceScore=5.01e-01
MKNYLKKSWYVDSGCSKNMMFGHNPCLRSVPKQPPVLEISNNLVKSFTSKDPQGMYPPLFSLNNQVDVRSTRDVPSLVLSITTQVDVRSTCTTKDVRSTCTTKDVRSNVSRQRILRRLVP

SEQ ID NO: 161578 - protein, 96 aa, Glycine max
  Coding DNA Sequence Number=SeqID_44800
MEKDEDRSGKGRSPKWRRMKTQVEKDEGPSGEGQKTQEVASSKSPQPVSSDPLLVRITSSGIRASALDTGAGDGGGDYHQLDGSQRLLLDAMTTQM

SEQ ID NO: 161579 - protein, 461 aa, Glycine max
  Coding DNA Sequence Number=SeqID_44801
  Gene Ontology: Mol. function=sequence-specific DNA binding; Cellular component=nucleus; Biological process=regulation of transcription, DNA-dependent
  Homolog annotation: Hit_ID=Q1S1R1; Match level="QueryCoverage=91%, HitCoverage=55%, E-value=1e-162, Identity=70%"; Hit description =START domain, putative
  Pfam annotation: Domain name=HALZ; Domain location=172-203; Score =6.3; E_value=0.084; Accession=PF02183.8; Description=Homeobox associated leucine zipper
  Pfam annotation: Domain name=Homeobox; Domain location=129-177; Score= 29.8; E_value=3.9e-06; Accession=PF00046.19; Description=Homeobox domain
  Pfam annotation: Domain name=START; Domain location=322-461; Score =34.1; E_value=3.9e-07; Accession=PF01852.10; Description=START domain
  Pfam module annotation: Pfam domain module=HALZ::Homeobox::START; Domain location=172-203::129-177::322-461
  Subcellular localization annotation: CTP_CleavageSite=83; ConfidenceScore=5.63e-01
MSFGGLLDNKSGSGGARNNVSDIPYNNNNVTNTTTTNNDRMPFGAISQPRLVTTTPTLAKSMFNSSGLSLALQTNIDGQEDVNRMAENTSEPNGLRRSREDEHESRSGSDNMDGASGDEHDAADNPPRKKRYHRHTPQQIQELEALFKECPHPDEKQRLELSRRLCLETRQTQLERHENTLLRQENDKLRAENMSIRDAMRNPMCSNCGGPAIIGEISLEEQHLRIENARLKDELDRVCVLAGKFLGRPVSSLPSSSLELGMRGNGFAGIPAATTLPLGQDFDMGMSVSMNNNALAMVSPPTSARAAAAGFDRSVERSMFLELALAAMDELVKIAQTGEPLWMRNVEGGREILNNEEYVRTFTPCIGLRPNGFVSEASRENGMVIINSLALVETLMDSNRWAEMFPCIIARTSTTEVISSGINGTRNGALQLMHAELQVLSPLVPVREVNFLRFCKQHAEG

SEQ ID NO: 161580 - protein, 187 aa, Glycine max
  Coding DNA Sequence Number=SeqID_44802
MSGHTHGGGHGFEVECVTDGGGGEMMKVVGEMMKKDKRGIFENYGVHQAKNKIFVVRTLECRSVIEPRKPRKQPNQYPNLNLNCSHHNSSTSKSKRGLKIMTPSYHSQPPNHSLTPVLSSVELRCSDGATNWRDQGGSRRGDRAPAHGAAVPALAVQQRRAPEARAAGFRRNPTESRCRERRAQQEA

SEQ ID NO: 161581 - protein, 176 aa, Glycine max
  Coding DNA Sequence Number=SeqID_44803
MVTSVTLAGDVSRILTAHVDGVAVFSDGRQWSKMSFDEKASGSLATMGRTGMRVIRKKNALIDAKLQGWGHVGGRPQHCKTQSEKAAGAISPMTSPMVVVLAGKLAGYAAVAIRRSHRKTENKLLERGTRRKGPPGQWGATKVSSTGKGQRVVGKRKQVARISATTIKIHWNVETE

SEQ ID NO: 161582 - protein, 655 aa, Glycine max
  Coding DNA Sequence Number=SeqID_44804
  Gene Ontology: Mol. function=methyltransferase activity; Cellular component=cellulose and pectin-containing cell wall
  Homolog annotation: Hit_ID=Q653G1; Match level="QueryCoverage=84%, HitCoverage=79%, E-value=1e-78, Identity=33%"; Hit description =Dehydration-responsive protein-like
  Pfam annotation: Domain name=DUF248; Domain location=96-655; Score =681.6; E_value=5.9e-202; Accession=PF03141.7; Description=Putative methyltransferase
  Pfam annotation: Domain name=Methyltransf_11; Domain location=222 -323; Score=-0.6; E_value=0.062; Accession=PF08241.2; Description =Methyltransferase domain
  Pfam module annotation: Pfam domain module=DUF248::Methyltransf_11; Domain location=96-655::222-323
  Subcellular localization annotation: CTP_CleavageSite=71; ConfidenceScore=5.30e-01
MGGFAMGYTFDSKSGLTMAALLLMIVSFYAGILFGNNAPLYVSQLVSHSSSSSSPPNNVSSNGTTKFTNKVALTYWKTPLVIPETGMDVCPLTFNEYIPCHDVSYVATLAPSLDFSRKEELERHCPPLEKRLFCLVPPPKDYKLPIKWPLSRDYVWRSNVNHTHLAEVKGGQNWVHEKDQLWWFPGGGTHFKHGASDYIERLGHMITNEAGDLRSAGVVQVLDVGCGVASFSAYLLPLDIRTMSFAPKDGHENQIQFALERGIGAMISALSTKQLPYPSESFEMIHCSRCRIDFHENVLMEVRCIYKDILMLRLAKGLQMFIIERGYGRIITLGRTNHRTNAQSVCMDAGVVKRGEMLGSTCKRERNRLIERDIGRNFSNGILLKELNRLLRFNGYFVYSAPPAYRKDKDYPVIWDKLMNLTTAMCWRLIARQVQTAIWIKENNQSCLLHNVEKKHINLCDAVDDSKPSWNIQLKNCVLVRNSKTDSYKLLPTHERHSVFSENLNMIGINQNEFTSDTLFWQEQIGHYWKLMNVSKTEICNVMDMNAYCGGFAVALNKFPVWIMNVVPASMKNTLSGIYARGLIGAFHDWCEPFSSYPRTYDLLHANYLFSHYKRKGEGCLLEDIMLEMDRLIRPLVITFRNCHLSWLSAYMRPK

SEQ ID NO: 161583 - protein, 314 aa, Glycine max
  Coding DNA Sequence Number=SeqID_44805
  Gene Ontology: Mol. function=sequence-specific DNA binding; Cellular component=nucleus; Biological process=regulation of transcription, DNA-dependent
  Homolog annotation: Hit_ID=Q1SSH7; Match level="QueryCoverage=95%, HitCoverage=99%, E-value=3e-76, Identity=55%"; Hit description =Leucine zipper, homeobox-associated; Homeodomain-related
  Pfam annotation: Domain name=HALZ; Domain location=165-209; Score =60.8; E_value=4.6e-15; Accession=PF02183.8; Description=Homeobox associated leucine zipper
  Pfam annotation: Domain name=Homeobox; Domain location=110-164; Score= 76.4; E_value=9.1e-20; Accession=PF00046.19; Description=Homeobox domain
  Pfam module annotation: Pfam domain module=HALZ::Homeobox; Domain location=165-209::110-164
MAFPPSHTFMFQTHEDHDPHQLHLRSTSTSLNAFPSFPPHHFQVEELSKSLVACIPNRNYTIEYAGAGGLMMKRSMSFSGIDNNNNNNKCDESHGDDELSDEGSQLLGEKKKRLSLEQVKALEKSFELGNKLEPERKMQLAKALGLQPRQIAIWFQNRRARWKTKQLEKEYEVLKKQFEAVKADNDSLKSQNQKLHTELQTLKRRDCNETGTVISLKKETDQGSWSNGSNNSSEINLDLSRTPVMNTSPVSSQNGKSLLPTTSSKPTSITQLLQCSSRPDLQDESFCNMFHIIDEQQNFWPWPDHQQQQQHQFH

SEQ ID NO: 161584 - protein, 69 aa, Glycine max
  Coding DNA Sequence Number=SeqID_44806
MTPTHDALLYYNGRWNMPHQNEFVGYSFIGKNPKKFDIPSKCTMDELKDLIKQVVLHGIPPYGIHETQT

SEQ ID NO: 161585 - protein, 86 aa, Glycine max
  Coding DNA Sequence Number=SeqID_44807
MGRVGSRFGSLHPGRSYKMRDGLEVEFLKGKDKKIKPNLIPSSFIGFEESRKKHVSIKYCKYVFNTDMCEPISILNNNMVKRGNRR

SEQ ID NO: 161586 - protein, 88 aa, Glycine max
  Coding DNA Sequence Number=SeqID_44808
MRTISGVSSLFSFCIPLPFIFQEAKESIDEEDPRPTSSNGAYISSSTPSFSVNYNDLYFIVVGGKNAKGNVYELGALSKMCLTFCHLA

SEQ ID NO: 161587 - protein, 91 aa, Glycine max
  Coding DNA Sequence Number=SeqID_44809
MSMEALFRKLIGYEHELIQKSQIYVGGKGVTPLTKQHQPIPQHLRHKTTQWNRDFVEKKYIEKIREEVLGEEKGTSKGEGFWATEMEGEGK

SEQ ID NO: 161588 - protein, 147 aa, Glycine max
  Coding DNA Sequence Number=SeqID_44810
MKTIVCEGLVRKSLNPCALLVPKIGIIRHQIPMIGGMMNVLSGATLFCKITHAPNIFMICVHRDSLGRNNQHENKEKVMFYSITFLNFLNNDQGLPMDPKRIKVIPEWPTPPSVEERIHEFHEPLDLRSNPFQVRGDDAILPPKGIG

SEQ ID NO: 161589 - protein, 167 aa, Glycine max
  Coding DNA Sequence Number=SeqID_44811
  Gene Ontology: Mol. function=protein serine/threonine kinase activity; Cellular component=plasma membrane; Biological process =protein amino acid phosphorylation
  Homolog annotation: Hit_ID=Q9LFP7; Match level="QueryCoverage=96%, HitCoverage=34%, E-value=6e-26, Identity=40%"; Hit description =Serine/threonine specific protein kinase-like
MGSITTRKSKGERNNKNVVQGITQTYSRLRIKLRILLGCMLPNSKREQSSADKSNEGREVIKDNVRQQPVTPRSSSTIRLRSRGRSYTPNQELIAASSLLRRFSFNDLKLATSNFKYDNLLGEGGFGSVFKGWVDQDENYATKPGIGIPIAVKTLNLNGLQGHKEWL

SEQ ID NO: 161590 - protein, 50 aa, Glycine max
  Coding DNA Sequence Number=SeqID_44812
HDGVTLPLKLMMPEETEEAVFCIEKEIWIWPILPSIDKTTKEEEANTELE

SEQ ID NO: 161591 - protein, 131 aa, Glycine max
  Coding DNA Sequence Number=SeqID_44813
MEPTRHPLDPDKSNRALGFPALITGLCQSYGVPVTPNAPPPPRQADPPGSLGMERYLQHLVRQQAANHYGKGSAPFACPTPEQFGAEVAWPGDWPDAWAVEEPAGSPDEPDESHMDEDMTDLLGFLGGSRA

SEQ ID NO: 161592 - protein, 164 aa, Glycine max
  Coding DNA Sequence Number=SeqID_44814
MASGNRLPMVSMCRSCVTRVWALIAMAAQLIHDRVVMECLEGVWETLEGNERCRFRGTIRLTATSLVHPKEPAHTLQQTVEWVLPTPTPELVQVIEVSSSEEDPEEDLEELPLELAVDALDFPEDDEDPIPDVDSPEDIMSASEADSTEENGSGGTTSSEDSSS

SEQ ID NO: 161593 - protein, 172 aa, Glycine max
  Coding DNA Sequence Number=SeqID_44815
  Homolog annotation: Hit_ID=Q1S6W0; Match level="QueryCoverage=37%, HitCoverage=14%, E-value=3e-08, Identity=44%"; Hit description =Nucleoside phosphatase GDA1/CD39
MRKDLRINYSCPFIHKQESGHSQSLSKTFQNLLRFLGAQPLELLSGVQPHHGVSPFHHGHPPLGELDELHDGAAEGIGGGLEAGGGGGGVGGGEEGSGGAKEVEDGETEGVGAGAEGEGKGVGAGVGEFGGGVELEGGGEEVEEEGGGEEEEGEEEQEAFGVVGFVVGIWIF

SEQ ID NO: 161594 - protein, 66 aa, Glycine max
  Coding DNA Sequence Number=SeqID_44816
MGLKKGLPVREDALSAILVLSAKETTISLSELHTRWARIEDKPEESSSALSSVAKPLPSRLAVWSR

SEQ ID NO: 161595 - protein, 98 aa, Glycine max
  Coding DNA Sequence Number=SeqID_44817
  Gene Ontology: Mol. function=nucleic acid binding; Biological process= DNA integration
  Homolog annotation: Hit_ID=Q1SDG1; Match level="QueryCoverage=97%, HitCoverage=8%, E-value=6e-16, Identity=43%"; Hit description =Integrase, catalytic region; Zinc finger, CCHC-type
MVEEGFVVNKAPIFKGTNYDYWKEMMIAFFESTHTDMWDVVEKGNHIPLDAQKNEIPMDKWMDGHKSRFLLNSHARNALLCALSQEEYSKVHSFRSAK

SEQ ID NO: 161596 - protein, 305 aa, Glycine max
  Coding DNA Sequence Number=SeqID_44818
  Pfam annotation: Domain name=zf-CCHC; Domain location=74-91; Score =12.5; E_value=0.0084; Accession=PF00098.13; Description=Zinc knuckle
MTHEDLVRILKVHEQELAQDEGTKKGKSLALTTQRPKCNSASKESSSIALAENKNSFKFDGSSRRSFHKEKIPIISYKYKKPGHFKSECPNLGKSKDKKNKFFKSKKKSLMSTWEDLDDSSLDENNEEEVNMCLMTNASTSKVKPTLDASSDDESPQPDGTINYDGEEVIFESREDLIKGYNQLLFGSARVSKAYRKLNKHFQHLERKHEDLKKIHQAHLVDFVLETTLPSDVQDNFVCEKVKALLDKNVSSGQKILLKDFQDSKKRVKSLTTSFEDSEEEPKEMLKQKLLLQKECTLLIMSLMS

SEQ ID NO: 161597 - protein, 112 aa, Glycine max
  Coding DNA Sequence Number=SeqID_44819
ALRANAPLPYPQLITLFLRHFQIPLDDEPFVQVKHSFAIGVGAVTSYGYCKDQNALMTEVLSELRGLRSYVGERFDSLDTHFAGMDICLTQLEEDVGYIRQSFDLPPPPPPS

SEQ ID NO: 161598 - protein, 99 aa, Glycine max
  Coding DNA Sequence Number=SeqID_44820
  Subcellular localization annotation: CTP_CleavageSite=42; ConfidenceScore=5.16e-01
MGNAIVDGAFSRSLARGYGNAIVDGAFSRSLARGNGNAIPSSASTFADVALEAPAVLASWEAPVALASLEAPMALASLEAPLVPAICMKTPMVMAFEAV

SEQ ID NO: 161599 - protein, 135 aa, Glycine max
  Coding DNA Sequence Number=SeqID_44821
MSCFYLWHHQNLYTYAITNGIKQTWIVTCSGVTTEGELHGASLFIFTLFMREKPPCNATVVFVYVTTQRCCITTRNGDNEAEKSIGSKGESQKEHSLEVPLPTNMGSLRVEKDKVVVRDLFGVTTLDDVVATIKV

SEQ ID NO: 161600 - protein, 128 aa, Glycine max
  Coding DNA Sequence Number=SeqID_44822
MLKAMCNLVKQDYNQLAKDVAEDAAMNGARNSSTYDETLRCGNPNKAMSKATARCGTKEAYRKCRVDLKNIETIFILGGDDDDFPMLKNNAVKAKFLGQENNNKYSYPEIVNLSRPNEVKTIDDSSPQ

SEQ ID NO: 161601 - protein, 70 aa, Glycine max
  Coding DNA Sequence Number=SeqID_44823
  Subcellular localization annotation: CTP_CleavageSite=43; ConfidenceScore=5.35e-01
MAPRKLPFPHHNSVSQTSKKPKIEKQPHISNAPKFKYTKGASSGNMNKASQIFERPRTNSRNALQLQANN

SEQ ID NO: 161602 - protein, 70 aa, Glycine max
  Coding DNA Sequence Number=SeqID_44824
EGLGGAGGSPEVSWRRCPTVVVVEVEPFLFLDGSAIWAPSRRRRKKGFCAGREKEQNLWTGMSCNRLQLM

SEQ ID NO: 161603 - protein, 125 aa, Glycine max
  Coding DNA Sequence Number=SeqID_44825
  Homolog annotation: Hit_ID=Q1SME3; Match level="QueryCoverage=67%, HitCoverage=88%, E-value=1e-19, Identity=54%"; Hit description =Retrovirus capsid, C-terminal
MAPDRMQLQSMCKKENESFKEYAQRWRDLAAQVAPPTTEKEMITMIVDMLPVFYYQKMVGYTPSSFADLVFTGERIEVGRRRGKIDYPALMNGKPGENGENKKEGGTHAIIAIPTQPNFPPAQQC

SEQ ID NO: 161604 - protein, 102 aa, Glycine max
  Coding DNA Sequence Number=SeqID_44826
  Homolog annotation: Hit_ID=Q1RZY7; Match level="QueryCoverage=37%, HitCoverage=6%, E-value=5e-09, Identity=64%"; Hit description =Protein kinase
  Subcellular localization annotation: CTP_CleavageSite=40; ConfidenceScore=5.07e-01
MGYASSKKTVTRAGSSTPEGPCMACLSSQRWSKNESGFVVAEQNAAGWPPWLTFVAREAIQGWVSLITDSFERLDKLLELQSLLASSFFLAIVIDFIYLTTF

SEQ ID NO: 161605 - protein, 142 aa, Glycine max
  Coding DNA Sequence Number=SeqID_44827
  Homolog annotation: Hit_ID=Q4S8K4; Match level="QueryCoverage=37%, HitCoverage=22%, E-value=1e-12, Identity=81%"; Hit description =Chromosome 2 SCAF14705, whole genome shotgun sequence
MQLRALGRSTSHRSGPTTADPSSFPAIPPSDEKNEIENEAIDDNVDLQEVISKGSLDFDKWTLLISEIEKGVSLIPVTENGMVLMLLVRPLSSTRSSLERSLLQFLLLGSMLRLEYKNTSVTVWDVGGQDKVKILILMHPLK

SEQ ID NO: 161606 - protein, 201 aa, Glycine max
  Coding DNA Sequence Number=SeqID_44828
MDNRSEREEEKCAPVGCLLLDLEKIGGDTGIAINFRVLCRGVKQKDGDGEMRLRSFLAQRRDLKSPLTSRSHFPLSPLQLALTTFVLFKPQPLASIEILPLPERHQMLVVGAVEESQENFEPEPKAELALKLKKAMTERKEKLKDENLLSRVAHEINEIEWPRLGRYWVPPLFSPTLFFGSSVILLTVNGVLAKLSNRVHY

SEQ ID NO: 161607 - protein, 129 aa, Glycine max
  Coding DNA Sequence Number=SeqID_44829
MAHFIPCKKVDDAFYVADLFFKEIVRLHDLPRSIVSDRDSVTSWKFLSGILFLEAFSSSPTLLFFSLSPPPLLPIKAPNFAHHFYSKLQREAIFGVVKRTSTLWDFEFQKAGRDDGESNLGLNVRMVVM

SEQ ID NO: 161608 - protein, 360 aa, Glycine max
  Coding DNA Sequence Number=SeqID_44830
  Gene Ontology: Mol. function=structural constituent of cell wall; Cellular component=extracellular region; Biological process =multicellular organismal development
  Homolog annotation: Hit_ID=P08012; Match level="QueryCoverage=92%, HitCoverage=89%, E-value=3e-51, Identity=38%"; Hit description =Repetitive proline-rich cell wall protein 1 precursor
  Pfam annotation: Domain name=Extensin_1; Domain location=100-109; Score=3.6; E_value=18; Accession=PF02095.6; Description=Extensin -like protein repeat
  Pfam annotation: Domain name=Extensin_1; Domain location=110-119; Score=3.9; E_value=14; Accession=PF02095.6; Description=Extensin -like protein repeat
  Pfam annotation: Domain name=Extensin_1; Domain location=150-159; Score=1.4; E_value=88; Accession=PF02095.6; Description=Extensin -like protein repeat
  Pfam annotation: Domain name=Extensin_1; Domain location=190-199; Score=1.4; E_value=88; Accession=PF02095.6; Description=Extensin -like protein repeat
  Pfam annotation: Domain name=Extensin_1; Domain location=220-229; Score=2.9; E_value=29; Accession=PF02095.6; Description=Extensin -like protein repeat
  Pfam annotation: Domain name=Extensin_1; Domain location=230-239; Score=2.2; E_value=47; Accession=PF02095.6; Description=Extensin -like protein repeat
  Pfam annotation: Domain name=Extensin_1; Domain location=240-249; Score=3.5; E_value=18; Accession=PF02095.6; Description=Extensin -like protein repeat
  Pfam annotation: Domain name=Extensin_1; Domain location=250-259; Score=2.9; E_value=29; Accession=PF02095.6; Description=Extensin -like protein repeat
  Pfam annotation: Domain name=Extensin_1; Domain location=260-269; Score=0.7; E_value=1.5e+02; Accession=PF02095.6; Description =Extensin-like protein repeat
  Pfam annotation: Domain name=Extensin_1; Domain location=275-284; Score=7.0; E_value=1.5; Accession=PF02095.6; Description=Extensin -like protein repeat
  Pfam annotation: Domain name=Extensin_1; Domain location=300-309; Score=6.1; E_value=2.9; Accession=PF02095.6; Description=Extensin -like protein repeat
  Pfam annotation: Domain name=Extensin_1; Domain location=315-324; Score=6.8; E_value=1.7; Accession=PF02095.6; Description=Extensin -like protein repeat
  Pfam annotation: Domain name=Extensin_1; Domain location=340-349; Score=4.0; E_value=13; Accession=PF02095.6; Description=Extensin -like protein repeat
  Pfam annotation: Domain name=Extensin_1; Domain location=40-49; Score= 0.2; E_value=2.1e+02; Accession=PF02095.6; Description=Extensin-like protein repeat
  Pfam annotation: Domain name=Extensin_1; Domain location=55-64; Score= 0.4; E_value=1.7e+02; Accession=PF02095.6; Description=Extensin-like protein repeat
  Pfam annotation: Domain name=Extensin_1; Domain location=65-74; Score= 6.8; E_value=1.7; Accession=PF02095.6; Description=Extensin-like protein repeat
  Pfam annotation: Domain name=Extensin_1; Domain location=90-99; Score= 7.1; E_value=1.4; Accession=PF02095.6; Description=Extensin-like protein repeat
  Pfam module annotation: Pfam domain module=Extensin_1::Extensin _1::Extensin_1::Extensin_1::Extensin_1::Extensin_1::Extensin _1::Extensin_1::Extensin_1::Extensin_1::Extensin_1::Extensin _1::Extensin_1::Extensin_1::...
  Pfam module annotation: Pfam domain module=Extensin_1::Extensin _1::Extensin_1; Domain location=100-109::110-119::150-159::190 -199::220-229::230-239::240-249::250-259::260-269::275-284::300 -309::315-324::340-349::40-49::55-64::65-74::90-99
LLLAALILSPQVLADDSKFPGEEQPVYKFPLDEKIPDYKPSSYNPPDYKSPSYNPPGYKSPSYKPPSYNPPVYKAPSYNSPDYKSPCYNPPSYKPPVYNPPSYNPPSYKTPSYNPPVYKSPSYNPPGYKAPSYNPPAYESPSYNPSGYKAPSYNPPAYKSPSYNPPGYKAPSYNPPAYESPSYNPPGYKAPSYNPPAYKSPSYNPPGYKAPSYNPPGYQPPSYNPPGYKAPTYNPPAYKSPSYNPPIYKPPSYNPPGYKAPSYNPPSYKSPSYNPPVYKAPVYKSPSYNPPGYKAPSYNPPVYKPPSYNSPDYKPPSYNPPVYKSPSYNSPDYKTPDYKPPSYNPPYGKSPYPKYPPGSN

SEQ ID NO: 161609 - protein, 199 aa, Glycine max
  Coding DNA Sequence Number=SeqID_44831
  Gene Ontology: Mol. function=protein serine/threonine kinase activity; Biological process=protein amino acid phosphorylation
  Homolog annotation: Hit_ID=Q1S3K9; Match level="QueryCoverage=30%, HitCoverage=9%, E-value=6e-21, Identity=83%"; Hit description=IQ calmodulin-binding region
MAPEMIKKKSYGEKVGVYSFGLMIREMLTGRIPYEDMNPTQAAFGVVNKTFLNGQHGRVVQTKLLRISHSFGLKLVMAMTKSNRRFRTYNSDLGKITIDYDTFVSFDSKDINKEKNMTMLRINERSKKLLHFAELKHNSISFFNIEKHETVISSWSRATTRAAKVGNGLSKDDKAQKLALQHWLEAVSHTPFPLKNQSR

SEQ ID NO: 161610 - protein, 57 aa, Glycine max
  Coding DNA Sequence Number=SeqID_44832
MEEKIGKNDKKKGEEEFSGFSYRSGLGPSNARLVRLASLSVYCALSATASSRAASSA

SEQ ID NO: 161611 - protein, 102 aa, Glycine max
  Coding DNA Sequence Number=SeqID_44833
  Gene Ontology: Mol. function=DNA binding; Biological process=DNA integration
MLKKFEMYSCKPIGTPMDCKMKLSKFDEAEKVDATNFKSLLGMSQEKPTKIFVDNKPAVILAKNPVFHDQSKHINTRYHYIRECIARKDVHCRICEVSRPSS

SEQ ID NO: 161612 - protein, 155 aa, Glycine max
  Coding DNA Sequence Number=SeqID_44834
MQSNIYTGLDETYLREVAKEKKYRLVTMLEWRTDSFKVDGEQREQESLDGEEDREKEKTARRRRSIPRYGGEGEEAETCDDARVRRTRCSTLDKTMVRWRTDSFKVHGEQREQESLDGEEDNEKEKTARRRRNIPRYGGEGEEAETCDDARVRRT

SEQ ID NO: 161613 - protein, 234 aa, Glycine max
  Coding DNA Sequence Number=SeqID_44835
  Gene Ontology: Mol. function=galactosyltransferase activity; Cellular component=Golgi stack; Biological process=lipid biosynthetic process
  Homolog annotation: Hit_ID=Q2HUE1; Match level="QueryCoverage=84%, HitCoverage=78%, E-value=2e-50, Identity=47%"; Hit description =Glycosyltransferase sugar-binding region containing DXD motif; Alpha 1,4-glycosyltransferase conserved region
  Pfam annotation: Domain name=Gb3_synth; Domain location=138-232; Score=56.0; E_value=1.2e-13; Accession=PF04572.3; Description=Alpha 1,4-glycosyltransferase conserved region
  Pfam annotation: Domain name=Gly_transf_sug; Domain location=61-145; Score=49.6; E_value=1.1e-11; Accession=PF04488.5; Description =Glycosyltransferase sugar-binding region containing DXD motif
  Pfam module annotation: Pfam domain module=Gb3_synth::Gly_transf_sug; Domain location=138-232::61-145
MQGSVFHDLDFPPASLFGGRELLPVESIFKNHPKACLTILSRTLDTKHGYRILKPLLDRRFKVQAMAPDLPFLVKGTPVEAWFRELRKGRKDPSEIPLSQNLSNLIRLAVLYKYGGVYIDTYFILYSSKTLSNRVKEFYWGAEHEFRFINEFALTFNGNKWGNNGPYLVSRVIKRLFKRHDFNFTILPPMAFYPVDWNKISGFFTKLKTQGRIKTGRSQPASAQWEDLWDSSME

SEQ ID NO: 161614 - protein, 59 aa, Glycine max
  Coding DNA Sequence Number=SeqID_44836
  Homolog annotation: Hit_ID=Q9LZ20; Match level="QueryCoverage=78%, HitCoverage=8%, E-value=6e-07, Identity=59%"; Hit description=Amino acid transport-like protein
MTATTTKTISLKPLGRDGTVRRHLVEEILIVVPRYAVKHMVTVALESTDQSFHLDMAEV

SEQ ID NO: 161615 - protein, 341 aa, Glycine max
  Coding DNA Sequence Number=SeqID_44837
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-47, Identity=34%"; Hit description= UPI00006A17C9 related cluster
MPSPLEDYTSSPSEDCTSSPSEGYTPSPLEDYTGLHVLPFRGLHALAFRGLYILTFRGLHVLTFRGLHVLAFRGLHILAFSGLHVLAIRGLHALAIRGLHALTFRGLHALTFRGLRILLAFRGLHALAIRGLHVLAFRGLHVLAFRGLHVLAFIGLHVLNFGGLHVLAIRGLHILTFRGLHALAIIGLHVLPFRGLHTLAFRRLHVLTFRELHVLAFRGLHILTFRGLDVLAFRGLHALVFKGLHALAFIGLHTLTFRGLRVLAFRGLHALAIRGLHVLAFRGLHVLAFVGLHTLTFGGLHVLTFRGLHVLAIRGLYVLTFRGLHALVFRGLYVLPLRGLH

SEQ ID NO: 161616 - protein, 610 aa, Glycine max
  Coding DNA Sequence Number=SeqID_44838
  Gene Ontology: Mol. function=protein binding; Cellular component =membrane; Biological process=defense response
  Homolog annotation: Hit_ID=Q6SQJ2; Match level="QueryCoverage=99%, HitCoverage=43%, E-value=0.0, Identity=85%"; Hit description=NBS-LRR type disease resistance protein RPG1-B
  Pfam annotation: Domain name=LRR_1; Domain location=196-218; Score =9.6; E_value=4.7; Accession=PF00560.23; Description=Leucine Rich Repeat
  Pfam annotation: Domain name=LRR_1; Domain location=220-241; Score =14.3; E_value=0.43; Accession=PF00560.23; Description=Leucine Rich Repeat
  Pfam annotation: Domain name=LRR_1; Domain location=243-265; Score =14.3; E_value=0.44; Accession=PF00560.23; Description=Leucine Rich Repeat
  Pfam annotation: Domain name=LRR_1; Domain location=267-288; Score =5.3; E_value=30; Accession=PF00560.23; Description=Leucine Rich Repeat
  Pfam annotation: Domain name=LRR_1; Domain location=403-424; Score =6.1; E_value=21; Accession=PF00560.23; Description=Leucine Rich Repeat
  Pfam annotation: Domain name=LRR_1; Domain location=481-502; Score =10.5; E_value=3.1; Accession=PF00560.23; Description=Leucine Rich Repeat
  Pfam annotation: Domain name=LRR_1; Domain location=504-527; Score =1.6; E_value=1.5e+02; Accession=PF00560.23; Description=Leucine Rich Repeat
  Pfam annotation: Domain name=LRR_1; Domain location=559-579; Score =6.5; E_value=17; Accession=PF00560.23; Description=Leucine Rich Repeat
  Pfam annotation: Domain name=LRR_1; Domain location=581-606; Score =4.4; E_value=42; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=196-218::220 -241::243-265::267-288::403-424::481-502::504-527::559-579::581-606
MGSLLHNKSSVTEWKSILQSEIWEFSIERSDIVPALALSYHHLPSHLKRCFAYCALFPKDYEFDKECLIQLWMAEKFLQCSQQGKSPEEVGEQYFNDLLSRCFFQQSSNTERTDFVMHDLLNDLARFICGDICFRLDGNQTKGTPKATRHFLIDVKCFDGFGTLCDTKKLRTYMPTSDKYWDCEMSIHELFSKFNYLRVLSLSVCHDLREVPDSVGNLKYLRSLDLSNTGIEKLPESICSLYNLQILKLNGCEHLKELPSNLHKLTDLHRLELMYTGVRKVPAHLGKLEYLQVLMSSFNVGKSREFSIQQLGELNLHGSLSIENLQNVENPSDALAVDLKNKTHLVELELEWDSDWNPNDSMKKRDEIVIENLQPSKHLEKLKIRNYGGKQFPRWLFNNSLLNVVSLTLENCRSCQRLPPLRLFPFLKELSIGGFDGIVSINADFYGSSSCSFTSLESLNFFDMKEREEWECKGVTGAFPRLQRLSIVDCPKLKGLPPLGLLPFLKELSIKGLDGIVSINADFFGSSSCSFTSLESLEFSDMKEWEEWECKGVTGAFPRLQRLSMERCPKLKGHLPEQLCHLNYLKISGCEQLVPSALSAPDIHQLTLGD

SEQ ID NO: 161617 - protein, 82 aa, Glycine max
  Coding DNA Sequence Number=SeqID_44839
MVPNALLTRKGGCRSIDNQNFYSLEHGVEPSSLLRKGFIKSRSKYGSRQLLKVGAEDGSGLHSLFDYCQHMIELVTFIIKNH

SEQ ID NO: 161618 - protein, 129 aa, Glycine max
  Coding DNA Sequence Number=SeqID_44840
  Homolog annotation: Hit_ID=Q8H6R2; Match level="QueryCoverage=31%, HitCoverage=19%, E-value=3e-11, Identity=87%"; Hit description=CTV.15
  Subcellular localization annotation: CTP_CleavageSite=56; ConfidenceScore=5.77e-01
CSAAAENRRGGAVGATTAGSAPPRLASPIRLRRRGFSRASSSSPTAARSAGPLLVVAMPAGTRDGDGRVRELERFWKKAVERAEKVEVEDAKAVVAGDGRELRNLPAGESVRRTGPLDLLEAAAILERE

SEQ ID NO: 161619 - protein, 67 aa, Glycine max
  Coding DNA Sequence Number=SeqID_44841
GIVVLGTWWHSSMKFVLDTYNYVGTKSYKCDYKSQIEDKFHSWPKGLKAYKDISGFYWGAKDPNYSG

SEQ ID NO: 161620 - protein, 74 aa, Glycine max
  Coding DNA Sequence Number=SeqID_44842
  Subcellular localization annotation: CTP_CleavageSite=10; ConfidenceScore=5.16e-01
MTNSTPRIQPCQHLVTRPVIGVEPFKPTPIQFGTVQMVRCPPNVSGVIRLPPLLSMASIPVYYPSQGYIGGGQT

SEQ ID NO: 161621 - protein, 111 aa, Glycine max
  Coding DNA Sequence Number=SeqID_44843
MAEKMLTKFDKYWDVIHDIMGVVTALDPRKIRQLCYDLVSDYQVKMNNESFGSSPIPGGGNVGGDELCSLKSKIIEQSSTLVNEMASDDEGETSIYASEMMGSGLTTHLEQ

SEQ ID NO: 161622 - protein, 96 aa, Glycine max
  Coding DNA Sequence Number=SeqID_44844
MENSDGLWWLIVAVGDGESAWDKCSRERKLRAHSKHLLKDPNGQIVYNCLMKLQTKFREEPTINEGWAAFLLRQLHVASSRSFIKRLPQETSLWLL

SEQ ID NO: 161623 - protein, 256 aa, Glycine max
  Coding DNA Sequence Number=SeqID_44845
  Homolog annotation: Hit_ID=UPI0000E6905E; Match level="QueryCoverage =42%, HitCoverage=59%, E-value=6e-47, Identity=80%"; Hit description =conserved hypothetical protein
ALRKGHVAVGHLAHEVVEDDIRRFVDGRGAGFPFFNAVVAFGCRDTLAGVAEFDVALQVEPAGGGIGIAFHHHRTVAVGGKIKMDIAVHILFFHVFKTHDRFGGATHHAIVGIRQQTPGAKAGGGDKREGGEGEKVGEKYPAQAVSLQPVAVEENETLPRFATEFQPLTHLIKILTVGRGGDRTQHFIAGQQFALAVAHQRQIDWPGGRSGGRRWRRSGGGFIRRSACENGIGGRRFGVEQFDAEILIQLQHAVRH

SEQ ID NO: 161624 - protein, 361 aa, Glycine max
  Coding DNA Sequence Number=SeqID_44846
  Gene Ontology: Mol. function=L-seryl-tRNASec selenium transferase activity; Cellular component=cytoplasm; Biological process =selenocysteine incorporation
  Homolog annotation: Hit_ID=Q5PC49; Match level="QueryCoverage=58%, HitCoverage=57%, E-value=1e-85, Identity=76%"; Hit description =Putative transferase
  Pfam annotation: Domain name=DUF1341; Domain location=220-361; Score =209.4; E_value=8.1e-60; Accession=PF07071.2; Description=Protein of unknown function (DUF1341)
  Pfam annotation: Domain name=SelA; Domain location=2-205; Score= -209.2; E_value=0.00012; Accession=PF03841.4; Description=L-seryl -tRNA selenium transferase
  Pfam module annotation: Pfam domain module=DUF1341::SelA; Domain location=220-361::2-205
LERAVNARTAALLYVKSHHCVQKGMLDIDDFVQVARQHNLPLIVDAAAEEDLRQWVASGADMVIYSGAKAFNAPTSGFISGKRTWIAACKAQHHGIARAMKIGKENMVGLVYALDRYRTAAPAPDAAALRPFAEAISALPGLCADIEQDEAGRAIWRIRVSVDANELGLSAREVEAQLRGGDIAIYARRYYLHEGHFSLDPRTVGEGEMRLRSMQRINFYRQRVAINVLAKDIANAREIYDAAEGHAVIGVLSAQFTSVEQGVAEVRRWMAEVPSISVGLGAGDPAQFYKAAMIAAQVHPAHVNQTFTGSGFAAGALAATGGQQTFINALVSPSGTPGEVRISTGVRSAKGIPAQVSCDAA

SEQ ID NO: 161625 - protein, 137 aa, Glycine max
  Coding DNA Sequence Number=SeqID_44847
MKVLPFRRPPRHSRILAVEDKGGSFPMTSNVLSLLLFDSHSGGLHFRPLYRTVRMSSEITLILHRNSKLIQNANVALEYVSGEFCVRGDFGIDLVNVWTTHELCKACCNCMKFASVYYLVPGSGLQRLENDRDVLPM

SEQ ID NO: 161626 - protein, 71 aa, Glycine max
  Coding DNA Sequence Number=SeqID_44848
MAKEIAPTIPIGSFELVSGLKINFHKIKLATIGGDGDFISRATTYLNYGLVEGPYVYLGIPISANPRNEAM

SEQ ID NO: 161627 - protein, 118 aa, Glycine max
  Coding DNA Sequence Number=SeqID_44849
MNLLSSNCFPDRLASLGRKLTSRQHSKLQPQDQLISVSATLLQSLHRTKTAKKMGPNSHKDTPTTTTGSANSLPVLMKPLIPDEVLSEYFQSPMTSPLIPQDGSPFLKNKKYVQDTLV

SEQ ID NO: 161628 - protein, 208 aa, Glycine max
  Coding DNA Sequence Number=SeqID_44850
  Subcellular localization annotation: CTP_CleavageSite=31; ConfidenceScore=5.40e-01
TVHVSSTFECGAPRIDCLGLFTNSPFSNFIRSPMNSLPSVVHVSFTFESGAPRIDCLALFANSPFSTFIRSPMNSLPSAVHVSSTFESGAPRIDCLALFANSPFSTFIRSPMNSLPSAVHVSSTFKSGAPRIDCLALFTNSPFSTFIRSPMNSLPSVVHVSSTIESGAPRIDCLALFANSPFSNLIRRPMNSLPSAVHVSSVIKRGAS

SEQ ID NO: 161629 - protein, 639 aa, Glycine max
  Coding DNA Sequence Number=SeqID_44851
  Gene Ontology: Mol. function=protein binding; Cellular component =membrane; Biological process=defense response
  Homolog annotation: Hit_ID=Q8GZF0; Match level="QueryCoverage=97%, HitCoverage=50%, E-value=0.0, Identity=88%"; Hit description =Resistance protein KR4
  Pfam annotation: Domain name=LRR_1; Domain location=590-612; Score =11.8; E_value=1.8; Accession=PF00560.23; Description=Leucine Rich Repeat
  Pfam annotation: Domain name=LRR_1; Domain location=614-635; Score =7.7; E_value=10; Accession=PF00560.23; Description=Leucine Rich Repeat
  Pfam annotation: Domain name=NB-ARC; Domain location=160-456; Score =319.1; E_value=8.1e-93; Accession=PF00931.13; Description=NB-ARC domain
  Pfam module annotation: Pfam domain module=LRR_1::LRR_1::NB-ARC; Domain location=590-612::614-635::160-456
MALECVGGAVLSSILGALFQKLASPQVLDFFRGTKIDQKLRKDLENKLLSIQAVLDDAEKKQFGNMQVRDWLIKLKVAMLDVEDVLDEIQHSRLQVQPQSESQTCTCKVPNFFKSSPVTSFNKEINSSMKNVLDDLDDLASRMDNLGLKKPSDLVVGSGSGGKVPQSTSLVVESDICGRDGDKEIIINWLTSNTDNKLSILTIVGMGGLGKTTLAQLVYNDPRIVSKFDVKAWICVSEEFDVFNVSRAILDTITDSTDHGRELEIVQRRLKENLADKKFLLVLDDVWNESRPKWEAVQNALVCGAQGSRILVTTRSEEVASTMRSEKHRLGQLQEDYCWQLFAKHAFRDDNLPRDPVCSDIGMKILKKCKRLPLALKSMGSLLHNKPAWEWESVLKSEIWELKDSDIVPALALSYHHLPPHLKTCFAYCALFPKDYVFDKECLIQLWMAENFLNCHQCSTSPEEVGQQYFNDLLSRSFFQQSSIYKERFVFAEQKKKEGFVMHDLLNDLAKYVCGDIYFRLRVDQAKCTQKTTRHFSVSMITERYFDEFGTSCDTKKLRTFMPTRRRMNEDHWSWNCNMLIHELFSKFKFLRVLSLSHCLDLKELPDSVCNFKHLRSLDLSHTGIKNYLNPMFTLQLQY

SEQ ID NO: 161630 - protein, 195 aa, Glycine max
  Coding DNA Sequence Number=SeqID_44852
  Gene Ontology: Mol. function=RNA-directed DNA polymerase activity; Biological process=RNA-dependent DNA replication
MGPKSTIRLMRTLGPSLASLAQSSWSVISNALVGKDCIRKDLMVSFIRKYQYNSDMALDRMQLQNMCKKEHESFKEYAQRWRDLAAQVAPPMMEREMITMIVDTLPVFYYEKMVGYTPLSFADFVFVDERIKVGLKRGKFDYTALMNGKPRANGENKKEGGTHAMTAIPTWPNFPLAQQCQYSANINPSHYPPSY

SEQ ID NO: 161631 - protein, 156 aa, Glycine max
  Coding DNA Sequence Number=SeqID_44853
MALMVDSLLLADWCNNSTISVSDILVAEPTVSDFITMLGFRGGKRRNVTEPGVATCTQHYCWGTQQTVKWRNCPSAIILPEEDNFRKNVIRNVSGRSFFRKNSIVFRKKLLPEAVFYCAFFLSSSVCFVSSSVCFVSSSVCCCFGGGPFSSLLVVP

SEQ ID NO: 161632 - protein, 102 aa, Glycine max
  Coding DNA Sequence Number=SeqID_44854
MAFGTMAARPGELMLHPKVSWHAQARWFLHPKQFGGPGEPEASLGELGSIKLPEMTLLPLTFGIFRILDQNNEGSSVLHCNWHSTPIEAEDVESYEAQRPGH

SEQ ID NO: 161633 - protein, 243 aa, Glycine max
  Coding DNA Sequence Number=SeqID_44855
DQDGVDDTVYEKYDISKEKWAQFCQTRRDPSWEDVRKKAQTIQKQNTAPHVLSRGGYEYLEQKLLAEKTKKKLEEAAQSGIVDGVIDPSSPVKQHMKWKMARTKKIGEMTTEAAKEITEKIISHFQLTIRIIFFYFVNAMYKCVIFGQDSFEEQAPQGSFIPYGRQDVLTATIGHPEHPGRVRAAGAGVTIKQYFGSAPRTSLLPYEELQLLTQQIRDQLEESITEKVTRQLMASFSQMQTQF

SEQ ID NO: 161634 - protein, 181 aa, Glycine max
  Coding DNA Sequence Number=SeqID_44856
  Pfam annotation: Domain name=zf-CCHC; Domain location=81-98; Score =23.3; E_value=0.00014; Accession=PF00098.13; Description=Zinc knuckle
MELMRLHQHEENDNKRKGISLKASSFSIQEESDKEDLNEIKEDDDFRFFMKRFNMFLRNKRNQRKSNINPKKKGEDSSLAPKCYKCDQHGHLRFDCRVFKRRVEKFDKRNFKEKKAYITWEDNDMDSSSDSENEIINLGLMVKDYESEEEVMSSNYDLSISFDELQDTFNDLHKESVIQEL

SEQ ID NO: 161635 - protein, 145 aa, Glycine max
  Coding DNA Sequence Number=SeqID_44857
MIEKSSWKVFTFHDDDFKDDFRIVVECAKELTWKTLFLVVLENPFKQLLVGRGGEKENSLGEWSKDKEAKVGCMKHWLDVVPLWPWRWRRQLLEWEKDLVQELELLLGQVTLKENVKDKWIWEGDPISIVLAMDILQRMLNKWPQ

SEQ ID NO: 161636 - protein, 53 aa, Glycine max
  Coding DNA Sequence Number=SeqID_44858
  Gene Ontology: Mol. function=DNA binding; Cellular component=nucleus; Biological process=regulation of transcription, DNA-dependent
  Homolog annotation: Hit_ID=Q1SGY6; Match level="QueryCoverage=92%, HitCoverage=5%, E-value=5e-21, Identity=90%"; Hit description =Transcriptional factor B3; Auxin response factor; Aux/IAA_ARF _dimerisation
  Pfam annotation: Domain name=B3; Domain location=3-53; Score=2.7; E _value=0.039; Accession=PF02362.12; Description=B3 DNA binding domain
MDFSQQPPCQELISRDLHGNEWKFRHIFRGQPERHLLTAGWSVFVSAKRLSNY

SEQ ID NO: 161637 - protein, 191 aa, Glycine max
  Coding DNA Sequence Number=SeqID_44859
  Homolog annotation: Hit_ID=Q1SPF8; Match level="QueryCoverage=40%, HitCoverage=10%, E-value=7e-16, Identity=55%"; Hit description =Proteinase inhibitor I4, serpin; Protein kinase
MAEGNKQRKPMEEEPNGGEAGDNESQHGGEEARREETNGAEEEEAKREANLKWKIAGCTGNGGKQRKKKVGAEEKERLFFKYIIFYFLNEGDGQSIDIFIYILVAVAQREYDPSCLWEFMLEILGRSSPYGNAGLQILDRNWGAGWHLLLLLLATKPSLRISFLHPADSKNPKLHQWLCKEEVSVIQNIKH

SEQ ID NO: 161638 - protein, 333 aa, Glycine max
  Coding DNA Sequence Number=SeqID_44860
  Homolog annotation: Hit_ID=Q1T1Y0; Match level="QueryCoverage=43%, HitCoverage=38%, E-value=9e-15, Identity=36%"; Hit description =Ankyrin
  Pfam annotation: Domain name=DUF1723; Domain location=256-305; Score =60.4; E_value=5.8e-15; Accession=PF08330.1; Description=Protein of unknown function (DUF1723)
MWCLRLKTKVLPWRRTFFRACESGLLVFERKKVFFRGIQRKKVLQVLPRDPAEERCLPQMPAPSRGRTCGTFFRRLPLLLVEEPAEPYSAGYLSFSRKNLQSLLPRTITRGLGRALGTGRGRGISEDVHHADVPRRCMPTASARRQRVHVREDVTERPEDVPQLHEDVPHVSDATPEMTGAVDVVHTEGVTTDGSLGSPAADEGFPGGPRDPSERPDLKLVSHGRKVDKIGRPAPEIEGMIAATGLSPLIRCSVITTDPGLIFAFVERWHRETSTFHLPVGELTITLDDVASLLHVPITGALHKFEPLITSYAIGLLTKLLKVSHEEATAKTR

SEQ ID NO: 161639 - protein, 66 aa, Glycine max
  Coding DNA Sequence Number=SeqID_44861
MAHDGHRSSWVVEKEFIATPLKLTFVLSMTFCAERNSSLVRITLSTLVSLSEMSKSVILQISTVTT

SEQ ID NO: 161640 - protein, 174 aa, Glycine max
  Coding DNA Sequence Number=SeqID_44862
  Gene Ontology: Mol. function=nucleic acid binding
MDVDGANGVAEVVGVETQVNKGADADEVKEHDEDFDFSNHSESDPNYAYVSREDDGKSRDTIVREYAIFHDRDLKWSKIDTIQARARFKQIKCPWEIFCSWFEVTRSSQIKTFLEEYIWGRVFKNKQATMKWVANKLRVHPNLNHVEAHEHLTQQYGVHIDERKMVEGSILLEN

SEQ ID NO: 161641 - protein, 280 aa, Glycine max
  Coding DNA Sequence Number=SeqID_44863
MVIDQSLFYDLTQLSREGVPFEGTLNDDWKFDFSVHDVRRLVCTNQADMTGRLLAGRQIDWAHLVRYRMHKALRLNAPLPYPHLVKLLLQHFNIPLDSEPYVPIKRSFLISAVVIASFGYRKEHDGSWVKKGLMVFKLMLVKGLMLWNYKWTCDLTRWTQGSLRVVIIKKGEMVEASFMMMNQVDSSIFDDDKKLKKMISRLSQQGTSFVVQVEGTSTWVVVTENKRGYFSCGSVQVEGISIWLFKENKGGYIPCESLLIKVFTRMKINLKDRRLLGDWM

SEQ ID NO: 161642 - protein, 127 aa, Glycine max
  Coding DNA Sequence Number=SeqID_44864
MSRGSGDLGDVRRAPGSQQIKGTKTTKQGGLWWLASCGFCVICGVWPLRDGSLVIDYQIGMAAQLIRDRVEMECLEGAWETLEGNTRCRFRGTIRFMATSLVHPDEPARTLQRTVEWTAPWISFVYF

SEQ ID NO: 161643 - protein, 165 aa, Glycine max
  Coding DNA Sequence Number=SeqID_44865
MAPKKLPAKMVRKDAAGEGSSAVPQVDVKFDGHWFRSEEHQRRFEAIKGWSFLKERWVQFREEEYAEFQEEITRRQWTQLAAPMAKYDPEIVMEFYANAWATEGAKKPKQWAKAFVATNVYLRKILEKPKGEGLRILKMRVRELFTYRKGISTPRARHKGWQPFN

SEQ ID NO: 161644 - protein, 79 aa, Glycine max
  Coding DNA Sequence Number=SeqID_44866
MQCKGEHLVPILIGRIINYNLHGQPILSNYLLFYEPNHHMMKSYTARALDRRLQEDWASDARKGPRVLMSLRVDFRPMG

SEQ ID NO: 161645 - protein, 346 aa, Glycine max
  Coding DNA Sequence Number=SeqID_44867
  Gene Ontology: Mol. function=oxidoreductase activity; Cellular component=mitochondrion; Biological process=lysine biosynthetic process via diaminopimelate
  Homolog annotation: Hit_ID=Q4IV21; Match level="QueryCoverage=97%, HitCoverage=98%, E-value=1e-142, Identity=71%"; Hit description=Zinc- containing alcohol dehydrogenase superfamily
  Pfam annotation: Domain name=ADH_N; Domain location=33-142; Score =179.7; E_value=7.1e-51; Accession=PF08240.2; Description=Alcohol dehydrogenase GroES-like domain
  Pfam annotation: Domain name=ADH_zinc_N; Domain location=172-309; Score=144.7; E_value=2.5e-40; Accession=PF00107.16; Description=Zinc- binding dehydrogenase
  Pfam module annotation: Pfam domain module=ADH_N::ADH_zinc_N; Domain location=33-142::172-309
MNMQIETTMKAAIVKAFGEPLVIEQEPVPSVGPGQILVKIAATGVCHTDLHAAEGDWPIKPNPPFIPGHEGVGQVVAVGEGVKHLKLGDRVGVPWLYSACGHCEHCLDSWETLCLSQQNAGYSVNGSFAEYCLADANYVGIIPDNVEFNEVAPILCAGVTVYKGLKMTDTKPGDWVVVSGIGGLGHMAIQYAVAMGLNVAAVDIDDDKLAFAKRLGASVVANAKQVDPAKVFQESFGGAHGVLVTAVSPKAFEQAIGTLRRGGTMVLNGLPPGKFDLSIFDMVLDGITVRGSIVGTRKDLQEALDFAGRHKVKANVAVEPLTNINDIFARMHAGKIEGRIVVDMSL

SEQ ID NO: 161646 - protein, 91 aa, Glycine max
  Coding DNA Sequence Number=SeqID_44868
MALRDILWSFCAFPSWVDRVRWHAETNYGHSAPLCHLEAASPMTCGDKLWSFRTPFHHSEAIVSDETIMLDDMQRQIMVIRTLLLSVRLDA

SEQ ID NO: 161647 - protein, 53 aa, Glycine max
  Coding DNA Sequence Number=SeqID_44869
MEMKGSERGTSGCMWFIGVQNPDDVKSREVDPRRQKDEEMKKREEWSQKSEIR

SEQ ID NO: 161648 - protein, 43 aa, Glycine max
  Coding DNA Sequence Number=SeqID_44870
MLRRQYVLVNGFKDGSRDPRPVGHAPFDLLRSGSQEFKRGQVL

SEQ ID NO: 161649 - protein, 68 aa, Glycine max
  Coding DNA Sequence Number=SeqID_44871
  Gene Ontology: Mol. function=tagatose-bisphosphate aldolase activity; Biological process=lactose catabolic process via tagatose-6-phosphate
  Homolog annotation: Hit_ID=Q2C9I0; Match level="QueryCoverage=98%, HitCoverage=23%, E-value=1e-24, Identity=76%"; Hit description =Tagatose 1,6-diphosphate aldolase
MVKRAISLGVCKVNVATELKIAFADAVKSYFSQHPDANDPRKYIVPGKLAMKEVVAEKIRICGSSGML

SEQ ID NO: 161650 - protein, 59 aa, Glycine max
  Coding DNA Sequence Number=SeqID_44872
  Subcellular localization annotation: CTP_CleavageSite=20; ConfidenceScore=5.00e-01
MADFGHADGQPQGCPNSRLRAGVVMAPVKRTTPEATWLPESGFACRAKGRMTNALNTAK

SEQ ID NO: 161651 - protein, 681 aa, Glycine max
  Coding DNA Sequence Number=SeqID_44873
  Gene Ontology: Mol. function=transcription regulator activity; Biological process=regulation of transcription, DNA-dependent
  Homolog annotation: Hit_ID=P27278; Match level="QueryCoverage=54%, HitCoverage=90%, E-value=0.0, Identity=87%"; Hit description =Transcriptional regulator nadR
  Pfam annotation: Domain name=HTH_3; Domain location=316-371; Score =39.3; E_value=1.3e-08; Accession=PF01381.12; Description=Helix-turn -helix
  Pfam annotation: Domain name=Lon_C; Domain location=66-194; Score= -147.5; E_value=0.0076; Accession=PF05362.3; Description=Lon protease (S16) C-terminal proteolytic domain
  Pfam module annotation: Pfam domain module=HTH_3::Lon_C; Domain location=316-371::66-194
LGVFAMTEQGMREVSNPSAIFLSRGDEITSGSSVMVVWEGTRPLLVEIQALVDHSMMGNPRRVAVGLEQNRLAILLAVLHRHGGLQMADQDVFVNVVGGVKVTETSADLALLLAMVSSLRDRPLPQDLVIFGEVGLAGEIRPVPSGQERISEAAKHGFKRAIVPAGNAPKKAIDGMKVYSAKKLADALAILDELGFGLWLHLFPHPNPLPLAGEGTDRRGGKYGVVLPFTALFRIFLLSRWAGEGTDRSGGKYGVNLLFIALFRIFLLARLREREPIGAAGSTALICHLSLCSGFSPSPAGGRGPGRHHMSSFDYLKTAIRQQGHTLQQVADASGMTKGYLSQLLNAKIKSPSAQKLEALHRFLGLEFPRRDKTVGVVFGKFYPLHTGHIYLIQRACSQVDELHIIMGHDDPRDRQLFENSAMSQQPTISDRLRWLLQTFKYQKNIRIHSFNEEGIEPYPHGWDVWSAGVKTFLAEQGIEPDCVYTSEEPDAPMYQQHLGIPAVVIDPHRSFMNISGSQIRQDPFRYWEYIPTEVKPFFVRTVAVLGGESSGKSTLVNKLANIFNTTSAWEYGRDYVFSHLGGDEMALQYSDYDKIALGQAQYIDFAVKYANKVAFIDTDFITTQAFCLKYEGREHPFVQALIDEYRFDLVILLENNVPWVADGLRSLGSSMDRREFQSML

SEQ ID NO: 161652 - protein, 81 aa, Glycine max
  Coding DNA Sequence Number=SeqID_44874
  Subcellular localization annotation: CTP_CleavageSite=52; ConfidenceScore=5.37e-01
MAIFLRLKIKISIQRTIIKPSYRGYLKRQGMTPGSARTQATKKPNHTTSNSRGMTAGTHDRRRDTRHKPRGKIESFSGAVQ

SEQ ID NO: 161653 - protein, 68 aa, Glycine max
  Coding DNA Sequence Number=SeqID_44875
MALESGNPRSSFATCRMGKAPNRVLFLVPKGVQISVKGPYSAQSHPATILRTCKCRINFYPNSREDYG

SEQ ID NO: 161654 - protein, 52 aa, Glycine max
  Coding DNA Sequence Number=SeqID_44876
MVEELEQLAQRINNRSMRGANLEVRIMESRNAKFLENDLISGNDQLRDLIRF

SEQ ID NO: 161655 - protein, 254 aa, Glycine max
  Coding DNA Sequence Number=SeqID_44877
  Homolog annotation: Hit_ID=Q1RTB4; Match level="QueryCoverage=72%, HitCoverage=46%, E-value=2e-11, Identity=27%"; Hit description=IMP dehydrogenase/GMP reductase
STLEDPTLYTGKLIWLVSHLFPPRGETRLPARRPLLMHREEGGKLGPTLSKQRRTVCQLVPRWKEGRIGILILCGGFPNVPLMGTRGCINYNPVLTIRQLGYPMRGAPLEEGLTPFIAQGFNSTNTGVLQGVRKAWEMVQKKDKELRGSSNGPISGYHKWLKAYAQGLDWLPNLRATKEVEGEAPKEDKELQALKIKLEKAQAVKEKFKSAAVRIRKENAELRDVNIATTKALEQKTKRARKEEHGWNKFQGAL

SEQ ID NO: 161656 - protein, 328 aa, Glycine max
  Coding DNA Sequence Number=SeqID_44878
  Gene Ontology: Mol. function=ATPase activity, coupled to transmembrane movement of substances; Cellular component=integral to membrane; Biological process=proteolysis
  Homolog annotation: Hit_ID=Q8ZMV8; Match level="QueryCoverage=99%, HitCoverage=45%, E-value=1e-120, Identity=66%"; Hit description =Putative ABC transporter transmembrane region
  Pfam annotation: Domain name=ABC_membrane; Domain location=68-328; Score=49.1; E_value=1.5e-11; Accession=PF00664.13; Description=ABC transporter transmembrane region
DGDDTVRVHLAGDEQPAPIALNTLLPQIRYAAALRPVTAAKDSRVDRYLATVRPDWLRRLVLHDMRPYGYVMLGSFLINLLALVGIIFSMQVYDRVIPAQSYPTLYVLYIGVILSVVFTYILRVGRDHVTDLLGKRADMRVSDRVFGHALRLRNSAVPRSTGTFISQLRELEAVREMVTSTTVTAIVDMPFFLLFMLVMAIIAPQLAWIAPVAVLLMILPGVLSQKKLAKLAQQNLKESTLRNAVLVESVQGLEDIKLMQAEDRFLQQWNSYIRITAQSGVEMRKVMHALISWGVTIQGLVYASVIVVGAPMVINGDITTGAIVAASL

SEQ ID NO: 161657 - protein, 70 aa, Glycine max
  Coding DNA Sequence Number=SeqID_44879
MWWKERSLARLHRLEAGNLIWRKFFLFGIGFSGGYEVSPEGVESVEITLGKCHACVCVKGWECLHIRGVI

SEQ ID NO: 161658 - protein, 106 aa, Glycine max
  Coding DNA Sequence Number=SeqID_44880
  Gene Ontology: Mol. function=protein binding; Cellular component =spindle pole body; Biological process=protein modification process
  Homolog annotation: Hit_ID=Q9FLP6; Match level="QueryCoverage=63%, HitCoverage=66%, E-value=9e-33, Identity=100%"; Hit description =Ubiquitin-like protein SMT3-like
  Pfam annotation: Domain name=ubiquitin; Domain location=30-101; Score= 32.7; E_value=1.3e-06; Accession=PF00240.13; Description=Ubiquitin family
MDTGHDTVTWTPVKHIKLNPVRVSVSVSVTLQGAGDGNEVFFRIKRSTQLKKLMNAYCDRQSVDFNSIAFLFDGRRLRAEQTPDELEMEDGDEIDAMLHQTGGSVV

SEQ ID NO: 161659 - protein, 75 aa, Glycine max
  Coding DNA Sequence Number=SeqID_44881
MSWNFTDYLTIGVKYLEVVKRRSHPNKQTVPDEIRVQNDHNLSLRAIGHDRIWMTKGVQNDHNLSLHIIGLAASG

SEQ ID NO: 161660 - protein, 241 aa, Glycine max
  Coding DNA Sequence Number=SeqID_44882
  Homolog annotation: Hit_ID=Q664H8; Match level="QueryCoverage=43%, HitCoverage=53%, E-value=1e-44, Identity=89%"; Hit description =Possible MarC family transporter
GQQLRAVRRRRAVPGAAGDPAGGRAVDSGGADAAVAPVSASAAPSGGGAVDRLGPLCGHFADVEPVPAPAGQQRRQRAGTVDGADSGDAVDPDVPGRREGLHEAVGAWRRRRRPALSGRGNAGCDCLRAGGHDSFFSAPNTPAATPDWCVAWRRWRRSRPPATRRDRCRPARARRPFVDVGARMQVIAVQHGGIGLAGDGAGYGGFAAAGYAHQDKYVILRITHCVMPLWELARARQMRPD

SEQ ID NO: 161661 - protein, 80 aa, Glycine max
  Coding DNA Sequence Number=SeqID_44883
HGPKIYPKAHENLRAFSCISGLIFLESYIQCSWGVGLHQPAPEETQPSKPVMEPEQPIQDSSAASALDLNEDQPQDEQDI

SEQ ID NO: 161662 - protein, 267 aa, Glycine max
  Coding DNA Sequence Number=SeqID_44884
  Gene Ontology: Mol. function=transporter activity; Cellular component= integral to membrane; Biological process=transport
  Homolog annotation: Hit_ID=Q8ZPP0; Match level="QueryCoverage=99%, HitCoverage=66%, E-value=1e-100, Identity=70%"; Hit description =Putative MFS family transport protein
  Pfam annotation: Domain name=MFS_1; Domain location=12-264; Score =83.6; E_value=5.9e-22; Accession=PF07690.6; Description=Major Facilitator Superfamily
MQQPGKGFLVWLGGLSVLGFLATDMYLPAFAAIQQDLNTSAASVSASLSLFLAGFALGQLFWGPLSDRYGRKPILLAGLAIFALGCLGMLWVRDATLMLVLRFVQAIGVCAAAVTWQAMVTDYYPAQRTNRIFATIMPLVGLSPALAPLLGSWLLVHLEWQAIFATLFAITLLLMLPAFRLKAVVKPAGETQQKLTFMALLRSREYSGNVLIYAACSASFFAWLTGSPFILHEMGYGPTVIGLSYVPQTIAFLIGGYGCRAALQKWQ

SEQ ID NO: 161663 - protein, 731 aa, Glycine max
  Coding DNA Sequence Number=SeqID_44885
  Gene Ontology: Mol. function=solute:hydrogen antiporter activity; Cellular component=integral to membrane; Biological process =potassium ion transport
  Homolog annotation: Hit_ID=Q8XUT9; Match level="QueryCoverage=77%, HitCoverage=97%, E-value=1e-111, Identity=37%"; Hit description =Probable glutathione-regulated potassium-efflux system transmembrane protein
  Pfam annotation: Domain name=Asp-Al_Ex; Domain location=105-270; Score=-65.9; E_value=0.045; Accession=PF06826.3; Description =Predicted Permease Membrane Region
  Pfam annotation: Domain name=DUF340; Domain location=128-328; Score= -88.4; E_value=0.032; Accession=PF03956.4; Description=Membrane protein of unknown function (DUF340)
  Pfam annotation: Domain name=Na_H_Exchanger; Domain location=109-429; Score=77.2; E_value=5.2e-20; Accession=PF00999.11; Description =Sodiumhydrogen exchanger family
  Pfam annotation: Domain name=TrkA_N; Domain location=453-564; Score =81.2; E_value=3.3e-21; Accession=PF02254.8; Description=TrkA-N domain
  Pfam annotation: Domain name=YibE_F; Domain location=105-298; Score= -140.9; E_value=0.022; Accession=PF07907.2; Description=YibEF-like protein
  Pfam module annotation: Pfam domain module=Asp-Al_Ex::DUF340::Na_H _Exchanger::TrkA_N::YibE_F; Domain location=105-270::128-328::109 -429::453-564::105-298
NAVETSVCVKPKAKASRLTLDQFCSQQAKSIENREYSVGGVRLGQHGQNSDFLVRLIWQAATNKGAKPPFAGLDLLAALCLNQPNVTNNTQHPHLKASMNNSDFLVQAAIYLASAIILVPIFKRLGLGSVLGYLIAGILIGPFALKLIADPEHMLHFAEFGVVLMLFLIGLELESQKVWELRKLLFGLGGMQVTLTIALVTVIAHGLTFSWPEALIIGMGVAMSSTAIGLTALIEKKQLHTQGGQAAFATLLFQDLSVIPLFMVLAFIAPHKTASGFDLWAVTQSIAVIAAIVLASKTILRPIMRIVAQTGIREVFVAFSLLLVIGVSLAMASVGLSMALGPAVGVVLYFGRHDRRPGLGRQPAHADFWLCLAGGGYQTVGADWPGLIGEFAFVIFGVALTQDSISRETYNILNAIVAVSMLVTPILLLLYDRFLMLQCGERPQDAIPENNSVIIAGFGRFGQIVGRVLIAKGITPTLIDNDPNQVDLTREFGWRCYYGDASRLDVLEEAGIAEAKLLVIAVNDAAATLEMAKLVKERWPQVKMVIRARSRTDAFDLRDLDLNPVRETFYSSLEAARQALVMIGETSSAAAKIIKQFEKHDIEQLETTRKIRHDRKALSSQMEQGRQDLKTLLEMESTSPETKHARQSLVRVGRAGDERASAEASLYANLDVVTINDAIVGEFITDVSNQSFLFVPAKGDRILLSRVTYEEACKLVGEELTQLYAHRCAMA

SEQ ID NO: 161664 - protein, 248 aa, Glycine max
  Coding DNA Sequence Number=SeqID_44886
  Gene Ontology: Mol. function=Type I site-specific deoxyribonuclease activity
  Homolog annotation: Hit_ID=Q2DQC7; Match level="QueryCoverage=30%, HitCoverage=7%, E-value=8e-30, Identity=81%"; Hit description =DEAD/DEAH box helicase, N-terminal
  Pfam annotation: Domain name=Thioredoxin; Domain location=154-243; Score=-12.9; E_value=0.0019; Accession=PF00085.10; Description =Thioredoxin
ILELLEPVEAQLQRKINPTIYTPSEFAERLAQGQNFLSKGLSEDSQFALAYGAAHAFSLAALRWHGYRSDNQGYNRELALYAEDVLGFVQDTQDEQWQKFKALYPTDTEQRFLERVATQLNKADPNAANKEMRTFGTLGVLRHELRDREPTREEINTLTGATMLEFGASWCGYCKAAQPTITSELSHFPNIRHIKIEDGKGRRLGRSFQVKLWPTLILMKDGVELKRLVREIDAGELKAGLALISAHQ

SEQ ID NO: 161665 - protein, 364 aa, Glycine max
  Coding DNA Sequence Number=SeqID_44887
  Gene Ontology: Mol. function=sequence-specific DNA binding
  Homolog annotation: Hit_ID=Q8ZN53; Match level="QueryCoverage=39%, HitCoverage=42%, E-value=4e-59, Identity=77%"; Hit description =Putative membrane protein
  Pfam annotation: Domain name=HTH_3; Domain location=135-187; Score =25.0; E_value=0.00026; Accession=PF01381.12; Description=Helix-turn -helix
  Pfam annotation: Domain name=TPR_2; Domain location=43-76; Score =13.4; E_value=0.81; Accession=PF07719.7; Description=Tetratricopeptid e repeat
  Pfam annotation: Domain name=TPR_2; Domain location=7-40; Score=9.9; E_value=2.3; Accession=PF07719.7; Description=Tetratricopeptide repeat
  Pfam module annotation: Pfam domain module=HTH_3::TPR_2::TPR_2; Domain location=135-187::43-76::7-40
QLAPLNGYVANNYGAFLCGLRQYDEAHQQFKLATEAQHSDAAQDALLFSGYCYLQAGEDRAARQQFDLALDAAPEQGSMLLTEVERRLEQQQWASVPLLLEVYHQHLPATAESLGLQIRFAAQQGNAADVTRERLRLAREQMGLTQQNVAERLCLKLSTVRDIEEDKSPADLASTFLRGYIRSYARLVHVPEDDLLPMMAKQAPVRAAKIEPMQSFSLGKRRKKRDGWLMIFTWLVIFVVVGLTGAWWWQNHKASQADLVSMADQNGSSSDNSQSIPLGDNSTDSTTDSDTNAAGTPIDTGAGAVSTPDNAGSTNSAPAATSSNTATSSDNAVVSPSQAPIDNAPPAATSPAPANSVPAGSMPT

SEQ ID NO: 161666 - protein, 243 aa, Glycine max
  Coding DNA Sequence Number=SeqID_44888
  Gene Ontology: Mol. function=protein serine/threonine kinase activity; Cellular component=membrane; Biological process=protein amino acid phosphorylation
  Homolog annotation: Hit_ID=Q5XWQ1; Match level="QueryCoverage=98%, HitCoverage=37%, E-value=1e-64, Identity=57%"; Hit description =Serine/threonine protein kinase-like
  Pfam annotation: Domain name=Pkinase; Domain location=1-179; Score= -55.3; E_value=2.9e-05; Accession=PF00069.15; Description=Protein kinase domain
  Pfam annotation: Domain name=Pkinase_Tyr; Domain location=1-173; Score=-102.6; E_value=3.5e-06; Accession=PF07714.7; Description =Protein tyrosine kinase
  Pfam module annotation: Pfam domain module=Pkinase::Pkinase_Tyr; Domain location=1-179::1-173
MKIAIDAANGLAFLHEEASRRVIFRDFKTSNILLDENYNAKLSDFGLAKDAPVGDKSHVSTKVMGTKGYVAPEYMLTGHLTSKSDVYSFGVVLLEMLTGRRAVEERMPRKEQNLVEWLRPRLRGKDDFRYLMDPRLEGQYPMRSARRAMWLATHCIRHNPESRPLMSEVVRELKSLPLFDDDDDMASHQPGPLASSIPSTSLQRLHVGPSNHAGSNKYGLKTGQAPNVPRHYQASPRSTSSKS

SEQ ID NO: 161667 - protein, 95 aa, Glycine max
  Coding DNA Sequence Number=SeqID_44889
  Gene Ontology: Mol. function=nucleic acid binding
MVRVRVKHLIFPADFVVMDIEEDADIPLILGRPFMSIASCVVDMGKKKLEIGIEDQQINFDLFNEERKLMDQNVCLQMKEFDEKVLKERTKIDLG

SEQ ID NO: 161668 - protein, 287 aa, Glycine max
  Coding DNA Sequence Number=SeqID_44890
  Gene Ontology: Mol. function=protein serine/threonine kinase activity; Cellular component=membrane; Biological process=protein amino acid phosphorylation
  Homolog annotation: Hit_ID=Q84SA6; Match level="QueryCoverage=87%, HitCoverage=56%, E-value=7e-71, Identity=57%"; Hit description =Serine/threonine protein kinase
  Pfam annotation: Domain name=Pkinase; Domain location=1-200; Score= -27.8; E_value=6.6e-07; Accession=PF00069.15; Description=Protein kinase domain
  Pfam annotation: Domain name=Pkinase_Tyr; Domain location=1-194; Score=-71.9; E_value=4.6e-08; Accession=PF07714.7; Description =Protein tyrosine kinase
  Pfam module annotation: Pfam domain module=Pkinase::Pkinase_Tyr; Domain location=1-200::1-194
MVKVFHLDCAAATKHLTWPVRIKIAIGAANALAFLHEEASRPVIFRDFKTSNVLLDEDYNAKLSDFGLAQDAPMGDKTHVSTEVMGTQGYAAPEYVMTGHLTSKSDVYSFGVVLLEMLTGRKAMDQRRPRKEQNLVEWLRPRLREKDNFHYLMDPKLEGQYPMKSARRVMWLATHCIRHNPKSRPLMSEVVRELKSLPLFHDDNDMVSDHPCPTTSSVSSISISSSSLKRLHVGPSNHGGANKYGPRTGQSPNVPRHFQAYPLPLPNPGVGSSSNPTVASSSSNPRF

SEQ ID NO: 161669 - protein, 442 aa, Glycine max
  Coding DNA Sequence Number=SeqID_44891
  Gene Ontology: Mol. function=3-dehydroquinate synthase activity
  Homolog annotation: Hit_ID=Q9LH99; Match level="QueryCoverage=81%, HitCoverage=79%, E-value=1e-126, Identity=65%"; Hit description =Arabidopsis thaliana genomic DNA, chromosome 3, BAC clone: T19N8
  Pfam annotation: Domain name=DHQS; Domain location=93-442; Score =686.6; E_value=1.8e-203; Accession=PF01959.7; Description=3 -dehydroquinate synthase (EC 4.6.1.3)
  Subcellular localization annotation: CTP_CleavageSite=53; ConfidenceScore=5.86e-01
MAVLSHVCSCISHSTLFTSTAPSSSLSVSPTTFLQLSSFSTESTWNNIRRTNLCSNVNSLRYSGKTLLRHRHKYYNPCSSMASSLDESGKRSKRVWIWTSNKQVMTAAVERGWNTFVFPSHHRQLAHDWSSIAVICPLFVNEGEVLDGQNKRVATIFDVSTPEELEELRPENEQAENIVVNLLDWQVIPAENIIAAFQRSQNTVFAISNNTSEAQVFLEALEHGLDGIIMKVEDVEPVLELKEYFDRRMEESNLLSLTKATVTHIQAAGMGDRVCVDLCSLMRPGEGLLVGSFARGLFLVHSECLESNYIASRPFRVNAGPVHAYVAVPGGRTCYLSELKSGKEVIIVDHQGRQRIAIVGRVKIESRPLILVEAKIESDNQSISILLQNAETVALVCTPQGNTLLKTSIPVTSLKVGDEILLRVQGGARHTGIEIQEFIVEK

SEQ ID NO: 161670 - protein, 120 aa, Glycine max
  Coding DNA Sequence Number=SeqID_44892
MVETEATRNVILEELEGKGEEGDTVGEREVAASVPMVMLRIGEVAEASLVVLLPVFAVEEREILEACKICRQISLWNRPPPYSLLYGSMSQPTLRREGDAGLVGASSMGGKCAESPPTFI

SEQ ID NO: 161671 - protein, 229 aa, Glycine max
  Coding DNA Sequence Number=SeqID_44893
  Gene Ontology: Mol. function=receptor activity; Cellular component =outer membrane-bounded periplasmic space; Biological process =glycolysis
  Homolog annotation: Hit_ID=Q1MC23; Match level="QueryCoverage=62%, HitCoverage=43%, E-value=3e-37, Identity=50%"; Hit description =Hypothetical protein precursor
GVMSGAAGLRGRATGIVIAGADQVRTAVPQAVAHQVLPAAPQQPFGARIEISDAPVAVQRQETVGQGIERGAVDAGRQARRRAGFLDHALPLVDLGAAEGVQLGRRGADRLGADAFELFGDLRVLQHLGQRLRHFVDDFRRRAGGREHRVPFVGFIAGHAGFGDGGQVRRGLGALRAADGHRAQLAVLHVLPGRAHAREHHRHLAGHHVDHGRAAALVGDVLQLGLGQQ

SEQ ID NO: 161672 - protein, 79 aa, Glycine max
  Coding DNA Sequence Number=SeqID_44894
MVKSRDELTAEINQGKIMTRSRLAAHCLLPTCSNRRCRNMPFCGRVKARLTGALSKGGKMRGVATNVYLWKTFGKTEGN

SEQ ID NO: 161673 - protein, 335 aa, Glycine max
  Coding DNA Sequence Number=SeqID_44895
  Gene Ontology: Mol. function=transcription factor activity; Cellular component=phosphopyruvate hydratase complex; Biological process =regulation of transcription, DNA-dependent
  Homolog annotation: Hit_ID=UPI00005FA75C; Match level="QueryCoverage =69%, HitCoverage=85%, E-value=5e-83, Identity=71%"; Hit description =COG1737: Transcriptional regulators
  Pfam annotation: Domain name=DUF1294; Domain location=33-87; Score =111.3; E_value=2.8e-30; Accession=PF06961.3; Description=Protein of unknown function (DUF1294)
MKLNVICYALLGLALVASLFSLHPVWMWLLLANLLTFLIYGGDKLAARKGWRRVPEATLLLFGALGGWLGALAAQQLFRHKTQKQPFKTWFILSVALNLVAQQRQGGAGGGLHRLSVGGIAPSQFGDHQLHQQHGADLGRQGAGGQRPFRFGRHQQRIRQLGQRAALGVADGDHACAAPFGQCHRMQHVLGGAGAGDDDQQIPLTQRGGVHRRPVHVAEQLRRFAEAQQLVVQEIADDGAGGDAVNLHRSATLQAVRRLLQRLRIQQCAGIPQRLNALFQQIFRRALPRRRLRLALLQAEGQRHFKFGIAFAAQMAAQPRDAGFAGGAFTRQFGD

SEQ ID NO: 161674 - protein, 164 aa, Glycine max
  Coding DNA Sequence Number=SeqID_44896
  Gene Ontology: Mol. function=ion channel inhibitor activity; Cellular component=extracellular region; Biological process=pathogenesis
  Homolog annotation: Hit_ID=Q7CHH6; Match level="QueryCoverage=90%, HitCoverage=82%, E-value=1e-41, Identity=58%"; Hit description =Putative enzyme
MADAANPRRPGDRGLLVFQHLAHAAVGGMRWNIQVANIINHPAGAFAHHQHFVLPVHGAVGVFLVAQVDAQRDVFRIGVRNGRGAGDGRAAWPLRIAGEQVAGDPMLARVLGGADQILIQHFAQVRLQLRQAVTVRQASALLDAQVIELLRDRIRAAFHTAAAA

SEQ ID NO: 161675 - protein, 327 aa, Glycine max
  Coding DNA Sequence Number=SeqID_44897
  Gene Ontology: Mol. function=transporter activity; Cellular component= integral to membrane; Biological process=transport
  Homolog annotation: Hit_ID=Q2KWS6; Match level="QueryCoverage=60%, HitCoverage=44%, E-value=8e-59, Identity=61%"; Hit description =Putative transporter
RAPGSGLPARRGAVDRHAGDAGEAAQVQRRRHAVDPPGPQPVADAAQRRAGDLRDLAAGGRQRGGARQPLARHDGGDQRGQRGRLEGARRTHDDEGGIDQRLAADAMQRGDGQQQRGQGLDRHADGDDLAAVVAVGHVAHHQRQRRHRQELRQPDQAQVERAARQRIDLPAHRHRDDLEGQRRADAREQEVQEGGAGIPADGKLRVDSRQAAGARARTLGLWPVGAEIPEIALGVAAGEVAAAVRRVIGLGHDGRAACLQPGVQGVGIVHRQIQRVGAAALRIADLFAVVVVAMLSQHQDGTATGHFGVLHDGAVAVDGQFREAQHG

SEQ ID NO: 161676 - protein, 134 aa, Glycine max
  Coding DNA Sequence Number=SeqID_44898
  Gene Ontology: Mol. function=catalytic activity; Biological process =metabolic process
  Homolog annotation: Hit_ID=Q46UE4; Match level="QueryCoverage=99%, HitCoverage=19%, E-value=8e-32, Identity=56%"; Hit description=CoA -binding
  Subcellular localization annotation: CTP_CleavageSite=77; ConfidenceScore=5.36e-01
MAHMPPLWLMTATGPSPGATSRNMVEKLAMAPLPKLARPCELGPMMRMPAARARAVIASCRARPASPVSEKPAEMTMAAATPSAAQSSTARTACSPATATIARSGAAGNAARLGQARSPWTSARCGLIGYSVPA

SEQ ID NO: 161677 - protein, 360 aa, Glycine max
  Coding DNA Sequence Number=SeqID_44899
  Gene Ontology: Mol. function=catalytic activity; Biological process =metabolic process
  Homolog annotation: Hit_ID=Q46UE4; Match level="QueryCoverage=99%, HitCoverage=51%, E-value=2e-72, Identity=48%"; Hit description=CoA -binding
  Pfam annotation: Domain name=Collagen; Domain location=286-345; Score= -46.8; E_value=0.087; Accession=PF01391.8; Description=Collagen triple helix repeat (20 copies)
MPPATRPTCRSPNWPARRCAIRKSGCVLLYLESLREAGPLAEAAALARARGVPLIVVKSGRSEAGARAAASHTGALANEDRAVDAFLRTPRHPARARPAGTGALRRAGPAQPLAARAARGGGQQLRRQLRAGLRRGRRARPGDRAAGRRHPAGAGRASARLCHHRQPRGHHRRAAVEQRPVRASAARNRRRPGGRHVPARYSSGGARLRRGFVRNGRGRLCAGGIQAGGGGGVAGQRRRHVPRARPARLRRRDPGDGCLVGAVAPAAVARTRPHGVAASIARHCGGGAGPERRRGLPVRSGQPGAAGRQRTGGDRTRRLPHGRRGHCRVAPHRRAGGAEGLLGKIAAQVRTWTGRAGPGR

SEQ ID NO: 161678 - protein, 86 aa, Glycine max
  Coding DNA Sequence Number=SeqID_44900
MPNPAKFITETSVSRLAGVTSTNWGNEARVDGGVGFVCELLVQDVVEYRSEPDHEMWRDSYLIRVHDIERRMRQVILKNENSPIIN

SEQ ID NO: 161679 - protein, 52 aa, Glycine max
  Coding DNA Sequence Number=SeqID_44901
MNGNCDIIITVWEDYAIQLHDAIDKNLLLQEPLVVMLTLGKIKDAIGVSGVG

SEQ ID NO: 161680 - protein, 284 aa, Glycine max
  Coding DNA Sequence Number=SeqID_44902
  Gene Ontology: Mol. function=drug transporter activity; Cellular component=membrane; Biological process=multidrug transport
  Homolog annotation: Hit_ID=Q851N6; Match level="QueryCoverage=85%, HitCoverage=57%, E-value=2e-48, Identity=41%"; Hit description =Putative MATE efflux membrane protein
  Pfam annotation: Domain name=MatE; Domain location=33-194; Score =97.9; E_value=3.1e-26; Accession=PF01554.9; Description=MatE
MGDNKDHDFFSHKFPTTSQVMEEMKELWGMALPITAMNMLVFVRAVVSVLFLGRLGSLELAGGALSIGFTNITGYSVLVGLAAGLEPVCSQAFGSKNWDLLSLSLQRMVLILLMAIVPISLLWLNLERIMLFMGQDSAITGMASLYCFYSLPDLLTNTLLQPLRVFLRSQKVTKPMMKREVVLKWRCGGGGVVCSGLGQLMGFAVPSCLMICLEWWWYEIVTVLAGYLPRPTLAVAATGILIQTTSMMYTVPMALAGCVSARLGWLRQGKIGTREWCAECRWLG

SEQ ID NO: 161681 - protein, 211 aa, Glycine max
  Coding DNA Sequence Number=SeqID_44903
  Gene Ontology: Mol. function=drug transporter activity; Cellular component=membrane; Biological process=multidrug transport
  Homolog annotation: Hit_ID=Q851N6; Match level="QueryCoverage=83%, HitCoverage=34%, E-value=1e-56, Identity=60%"; Hit description =Putative MATE efflux membrane protein
  Pfam annotation: Domain name=MatE; Domain location=3-126; Score=15.9; E_value=0.00026; Accession=PF01554.9; Description=MatE
MDSTLLVGPIKLVGVLDNLVGNELGAGKPYKAKLAATVALGCAFVIGFINVTWTVILGQRWAGLFTNDEPVKALVASVMPIMGLCELGNCPQTTGCGILRGTARPGIGAHINLGSFYFVGTPVAVGLAFWFKVGFSGLWFGLLSAQVACAVSILYVVLVRTDWEAEALKAEKLTRIEMGSCNGLRNKENERDEESKGLLVNGNGNNKDDTC

SEQ ID NO: 161682 - protein, 249 aa, Glycine max
  Coding DNA Sequence Number=SeqID_44904
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-31, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYTSSAIRGLHVLAIRGLHALTFRWLHALAFVGLHALTFRGLHVFIFRGLHVLTFRGLHVLAFRGLHVLSFRGLHVLAIRGLHVFSFRGLHVLTFRGLHVLTFRGLHALAFVGLHALTFRGLHILTFKGLHVLTFRGQHVLALTFGGLHVLTFRGLHVLAFRGQQVLTLAFVGLRALTFRGLQVLTFRGLHVLAFRGQHVLALTFRGLHVLTFRGLHVLAFRGQHVLTLAFVGLPALTFRGPH

SEQ ID NO: 161683 - protein, 215 aa, Glycine max
  Coding DNA Sequence Number=SeqID_44905
  Gene Ontology: Mol. function=ligase activity, forming carbon-nitrogen bonds; Cellular component=cytoplasm; Biological process=tRNA processing
  Homolog annotation: Hit_ID=P52097; Match level="QueryCoverage=99%, HitCoverage=49%, E-value=2e-74, Identity=64%"; Hit description =tRNA(Ile)-lysidine synthase (EC 6.3.4.-) (tRNA(Ile)-lysidine synthetase) (tRNA(Ile)-2-lysyl-cytidine synthase)
  Pfam annotation: Domain name=ATP_bind_3; Domain location=15-194; Score=294.7; E_value=1.7e-85; Accession=PF01171.11; Description=PP -loop family
MTLPAIAQAVSPYRQLLVGFSGGLDSTVLLHLLKRWRDREPDIQFRAMHIHHGLSPHAEEWVAHCEALCAAWAIPFIVERVTLIDEGKGIEAQARKARYAAFSAALLPGEALVTAQHLDDQCETFLLALKRGSGPAGLSAMPARSEFAGTQLLRPLLGETRASLEAWAREYQLTRIEDESNQDDSYDRNFLRLRILPLLSERWPHFADATARSAM

SEQ ID NO: 161684 - protein, 46 aa, Glycine max
  Coding DNA Sequence Number=SeqID_44906
MATTQELKTIFHKDDEQLYWDELITTTNAKGKAMFVAQAYPLHLVR

SEQ ID NO: 161685 - protein, 498 aa, Glycine max
  Coding DNA Sequence Number=SeqID_44907
  Homolog annotation: Hit_ID=Q10G25; Match level="QueryCoverage=43%, HitCoverage=51%, E-value=4e-48, Identity=47%"; Hit description =Expressed protein
  Pfam annotation: Domain name=DUF860; Domain location=1-212; Score =141.7; E_value=1.9e-39; Accession=PF05898.4; Description=Plant specific of unknown function (DUF860)
MIARIHKIPLPLVEHLQWDLGLPEDFGETVVPDFPDYFRIADGFLELVCWDHDLAVSVIQGRNVSVNYEPLFPVQFSNGLEMDKKYEKWLREWQKKSYESPYENLSHLPSTSDESDVWVVGVLHEVLHLFVGKKIEKEMLLEFGEWLGLRSRFKRALLQHPGMFYLSSKIGTYTVVLREGYKRGALIEDHPVMNLRNQYVHLMNSVREEGKSSKIVQGKGGVDEVEGKGVEGGEGEGEGDGECVEDGEEEACEVEDASETDFDDDEEESRRCSWKNATVRRGREFGKVKLDIDKPLRGSSRERLPLRDSWRERSPLRGSRRERSIGKTEFCDDEEESQRGSRKIDTGRRSREFGKVKLDADKPLRDSRRERSPLRGSRRERSIGKTGFCHDEEESQRGSRKIDTGRRGREFGKVKLDVDKPLRDSSRERSPLRDYRRERSPLRGSQSERSIGKIGKKNSFEASKRRQVRGAHIDVENTQDRSRFSNRSSLTSKKTPVL

SEQ ID NO: 161686 - protein, 129 aa, Glycine max
  Coding DNA Sequence Number=SeqID_44908
  Homolog annotation: Hit_ID=P37340; Match level="QueryCoverage=21%, HitCoverage=6%, E-value=7e-07, Identity=89%"; Hit description =Multidrug resistance protein mdtK
  Subcellular localization annotation: CTP_CleavageSite=57; ConfidenceScore=5.38e-01
MVRPSGLEPPTPTMSRWCSNQLSYGRRMVRSIGLEPTTPTMSRWCSNQLSYERNVLSVTTGTNISGTASRWQEGKCIFLSDFTRLLHYRAKKRMRIIIMIAADVRPMIKPIQNPAGPMRSTTRSVRARM

SEQ ID NO: 161687 - protein, 76 aa, Glycine max
  Coding DNA Sequence Number=SeqID_44909
MEVCSVHSEGRSKEGFWGFWNWSTQIDQVLFRPNFLGPSLTRPNRLMGQFVGLSLFYSSNYEQMKEKEETEIHIGG

SEQ ID NO: 161688 - protein, 61 aa, Glycine max
  Coding DNA Sequence Number=SeqID_44910
MVMMVEVEGGDGEIMRVMLERTKLKEDLNNKLQRLTQGSRNVDDYYKEMEVSMIKANVMED

SEQ ID NO: 161689 - protein, 69 aa, Glycine max
  Coding DNA Sequence Number=SeqID_44911
MAENVDPIANNVIINNATLTNLLNPYYAHPNENPGVAIVAQVLNGGNYHSWSRDMLLALKTKKNVQFVY

SEQ ID NO: 161690 - protein, 484 aa, Glycine max
  Coding DNA Sequence Number=SeqID_44912
  Gene Ontology: Mol. function=DNA binding; Cellular component=beta -galactosidase complex; Biological process=DNA integration
  Homolog annotation: Hit_ID=Q1SDN3; Match level="QueryCoverage=86%, HitCoverage=34%, E-value=1e-87, Identity=42%"; Hit description =Polynucleotidyl transferase, Ribonuclease H fold
MVLMAEAEVVEAIHLVEEVEAEAQKCALIVTYQVSANASSVAFTPEQHKALLSLLQQTSQASPSHTTNQLVSSHKNGNSGIICATLHAYSFNINSWVLDSGATDHEAICHESWKRAIQYELSSLIKTNTWQLTPLPPNKKPIGCKWVFKVKFKADGSIDKHKARLVTKDFTQIVGLDYIETFSPVVKMTIVRLVLSLATSQGLTVDNPALVCKLQRSLYGLKQASRQWNAKLTSTLLDSRFQQSKADYSLFTKRSPIGLIVILVYVDDLLLTGTDLAEIQQLKHSVDAKFNIKDLGMLKYFLGFEVARSNSGIVLYQRKYCLDLLQDTGLLVAKTCSTLMDPTLKLHKSSGVLLFDPTVYRRLVGRLLYLTHTRPGICYVVGRLSQYLQSPTDIHMQAAQHTLKYLKGNAGKDLFFSSSFSTSLTGFSDLNRGACPNTQRSITCLCFFLGTSLISWKSKKQSIVSRSSSEVEYRALAQASCEAQ

SEQ ID NO: 161691 - protein, 58 aa, Glycine max
  Coding DNA Sequence Number=SeqID_44913
GPCGAGGMVPASSPNLLRGGGGVHPHPRGEFFPDCRALNGAVPTGIPELRGELSCLDC

SEQ ID NO: 161692 - protein, 78 aa, Glycine max
  Coding DNA Sequence Number=SeqID_44914
MQFCYDRGVCSGGCAQRHNDGGEELRLRSLKGGDHTRVKIMHEQGLYAIVMVGTGDNARREGDGIGWRSCASRGSMQH

SEQ ID NO: 161693 - protein, 157 aa, Glycine max
  Coding DNA Sequence Number=SeqID_44915
  Gene Ontology: Mol. function=transcription factor activity; Cellular component=intracellular; Biological process=regulation of transcription, DNA-dependent
  Homolog annotation: Hit_ID=Q5PHW9; Match level="QueryCoverage=77%, HitCoverage=55%, E-value=7e-28, Identity=56%"; Hit description =Putative regulatory protein
  Pfam annotation: Domain name=GntR; Domain location=42-104; Score =51.6; E_value=2.7e-12; Accession=PF00392.11; Description=Bacterial regulatory proteins, gntR f
VPAGLENAPDALIGLLEGKNFGKVELNMLDLDHLEKAQRVSLTMQVELSLKGALITGSLKPGARLITKEIADKLGTSITPVREALLRLVSSGALHATPAQAFLVPEVTLERYNEINAIRKQLEPMAVAAACLVVCVDKLETLRKMSDAFHEAMRNGH

SEQ ID NO: 161694 - protein, 66 aa, Glycine max
  Coding DNA Sequence Number=SeqID_44916
MAKKVSEMTIICLRVPSGPLPLDDKRHKMTIICLCVPSDTIVSEWRKGERNDHNLSPHVIGPAASG

SEQ ID NO: 161695 - protein, 187 aa, Glycine max
  Coding DNA Sequence Number=SeqID_44917
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=2e-22, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSFPSEDCTPSPLEDYMSSPSEDYTGLHVLAFIGLHALTFRGLHIPTFRRQHALAFIGQHALTFRGLHALTIRGLHALTFKGLHILTFRELHALAFRGLHILTFRGLHALPIRGLHALAFIRLHALTFRGLDFLAFRGLHVLTFRGLHVLAFKGLHVLHFRGLHILAYRGLHALAFSGLHIHTLREF

SEQ ID NO: 161696 - protein, 86 aa, Glycine max
  Coding DNA Sequence Number=SeqID_44918
MTLLLNNILPSDRNADLLAKVSVGLCHPDIGVTPTRHPVDPEEPNRALGFPALVTGLYQSYRVLVPPSKGLRPQDTQWTRRSPIGS

SEQ ID NO: 161697 - protein, 282 aa, Glycine max
  Coding DNA Sequence Number=SeqID_44919
  Gene Ontology: Mol. function=binding; Cellular component=integral to membrane; Biological process=transport
  Homolog annotation: Hit_ID=O80412; Match level="QueryCoverage=87%, HitCoverage=78%, E-value=4e-84, Identity=57%"; Hit description =Mitochondrial phosphate transporter
  Pfam annotation: Domain name=Mito_carr; Domain location=24-105; Score= 66.1; E_value=1.1e-16; Accession=PF00153.17; Description =Mitochondrial carrier protein
MEASSFAIHSPSENQNIEMFSPSFYAACTFGGSLSCGLTHTGITPLDVVKCNKQNTSTGFGVMFKEQGLRGFFRGWAPTLVGYSAQGAFKYGFYEFFKKYYSDIAGPEYATKYKTLIYLAGSASAELIAGVALCPFEAVKVRVQTQPGFARGLVDGLPKLHAIPKPKHECSNSLQLGVSIVGGYMAGILCAIISHPADNLVSFLNNSKGATVGCEEAWIMGSVYPWSSSLYSYGWNSLTGAQWGIYDSFKFLWGCKFFAQFASWPTTGGVAPAAVPTPASAA

SEQ ID NO: 161698 - protein, 84 aa, Glycine max
  Coding DNA Sequence Number=SeqID_44920
  Homolog annotation: Hit_ID=Q8LGL4; Match level="QueryCoverage=78%, HitCoverage=17%, E-value=8e-26, Identity=79%"; Hit description=XY4 protein
MGFAQQAPACILKEKVCFSPTVSCIGLFTHSVPIKCLLTGLLGCSPLMSHKFCIEDSSVTVLQHSLRTGWQIKRLNDTAHLRLL

SEQ ID NO: 161699 - protein, 106 aa, Glycine max
  Coding DNA Sequence Number=SeqID_44921
  Subcellular localization annotation: CTP_CleavageSite=32; ConfidenceScore=5.16e-01
MATSSKLSSFVFLFVLLADSLALRSSTEPTISASPKPYVVAPAPPEEEASLPPLAPSSSEFVGKKSSSSSRLDYAAAIVGILLFSFLISIAYLFEHLPITIDDIFL

SEQ ID NO: 161700 - protein, 132 aa, Glycine max
  Coding DNA Sequence Number=SeqID_44922
SQTELSRKLCLTRDLLSLMDPSAHHSSSGDLFLHSSKFFGFLTGHRRNLSDFPSDHPPFLALLSLSTEPQNDFLGMPNSFMQDVFLVFEIDVQATLLAWWLPISVHLSPESRLNPCTFAGTRYPDLISVADI

SEQ ID NO: 161701 - protein, 328 aa, Glycine max
  Coding DNA Sequence Number=SeqID_44923
  Gene Ontology: Mol. function=DNA-directed DNA polymerase activity; Cellular component=intracellular; Biological process=DNA replication
  Homolog annotation: Hit_ID=Q9FNY4; Match level="QueryCoverage=98%, HitCoverage=66%, E-value=1e-75, Identity=48%"; Hit description=DNA polymerase lambda
  Subcellular localization annotation: CTP_CleavageSite=55; ConfidenceScore=5.04e-01
MAPKKKPESDPHGMFSGMVVFLVPKGVQSRRFQERLVQMGAVIEERFSKRVTHVFAMHSDALLQQLDRERLSRFKGDCLKSGEILSEDMYLLKLDSQGEHIPEKSLDPGLTNQRTSSDLQQLLNKKSKLSTEDTKIVKNESHDDDGKEKAVFSSTSTISSHGEVDSLSYGNTRQQHLDAENEASSLSYHPPDLNKNITEIFGKLVNIYRALGDDRRSFSYHKAIAVIEKLPFKIESTDQINNLPSIGKSMKDHVQEIMTTGKLSKLEHFETDEKGHRSLDDLRNDDSLTNAQKLGLKYFDDIGQRIPRHEAQEMEHILQKVGEDVLPG

SEQ ID NO: 161702 - protein, 63 aa, Glycine max
  Coding DNA Sequence Number=SeqID_44924
  Homolog annotation: Hit_ID=Q8LGL4; Match level="QueryCoverage=90%, HitCoverage=15%, E-value=3e-18, Identity=73%"; Hit description=XY4 protein
MEKVEMEVNFSEEQIQSSDALAEISQGNWEGCLRSEIYTPEIQGLIDRFQPDFTAPSGESLRQ

SEQ ID NO: 161703 - protein, 88 aa, Glycine max
  Coding DNA Sequence Number=SeqID_44925
MSKQHNGSSKIKFLIPSSYFLHGFLPLPLTVWWRWEEFWKKCYPTKIEELDCDKEEEEHDLEECESREIDIDVGGGGFHALNRELKPR

SEQ ID NO: 161704 - protein, 350 aa, Glycine max
  Coding DNA Sequence Number=SeqID_44926
  Gene Ontology: Mol. function=protein binding; Cellular component =intracellular; Biological process=small GTPase mediated signal transduction
  Homolog annotation: Hit_ID=O64566; Match level="QueryCoverage=92%, HitCoverage=84%, E-value=1e-115, Identity=66%"; Hit description =Putative leucine-rich-repeat protein
  Pfam annotation: Domain name=LRR_1; Domain location=100-121; Score =15.4; E_value=0.2; Accession=PF00560.23; Description=Leucine Rich Repeat
  Pfam annotation: Domain name=LRR_1; Domain location=123-143; Score =7.2; E_value=13; Accession=PF00560.23; Description=Leucine Rich Repeat
  Pfam annotation: Domain name=LRR_1; Domain location=147-168; Score =10.9; E_value=2.6; Accession=PF00560.23; Description=Leucine Rich Repeat
  Pfam annotation: Domain name=LRR_1; Domain location=170-191; Score =9.2; E_value=5.3; Accession=PF00560.23; Description=Leucine Rich Repeat
  Pfam annotation: Domain name=LRR_1; Domain location=193-216; Score =5.2; E_value=31; Accession=PF00560.23; Description=Leucine Rich Repeat
  Pfam annotation: Domain name=LRR_1; Domain location=218-239; Score =16.4; E_value=0.11; Accession=PF00560.23; Description=Leucine Rich Repeat
  Pfam annotation: Domain name=LRR_1; Domain location=241-267; Score =6.2; E_value=20; Accession=PF00560.23; Description=Leucine Rich Repeat
  Pfam annotation: Domain name=LRR_1; Domain location=30-52; Score=7.3; E_value=13; Accession=PF00560.23; Description=Leucine Rich Repeat
  Pfam annotation: Domain name=LRR_1; Domain location=53-75; Score =12.6; E_value=1.2; Accession=PF00560.23; Description=Leucine Rich Repeat
  Pfam annotation: Domain name=LRR_1; Domain location=77-98; Score =14.2; E_value=0.48; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=100 -121::123-143::147-168::170-191::193-216::218-239::241-267::30-52::53- 75::77-98
MMQQFHIQPMMKMDNTMRKRERSKAMEKERLQVMDLSGMSLEFLPKPSLDLATICKLDLSNNNLQEIPESLTARLLNVEVLDVRSNQLNSLPNSIGCLSKLKVLNVSGNFIESLPKTIENCRALEELNANFNKLSKLPDTIGFELINLKKLSVNSNKLVFLPSSTSHLTALKVLDARLNCLRALPEDLENLINLETLNVSQNFQYLETIPYSIGLLWSLVELDVSYNNIKTLPESIGCLKNLQKLSVEGNPLTCPPMEVVEQGLHVVMEYMHHKINSSDQNKTKKRWWMGKIVKCGTFNKQFRNGKRPEHVGYNMLKHQNINGLASPGFMGMLSPLRLFSPHRSPRHFFS

SEQ ID NO: 161705 - protein, 243 aa, Glycine max
  Coding DNA Sequence Number=SeqID_44927
  Homolog annotation: Hit_ID=Q6Z6Q1; Match level="QueryCoverage=39%, HitCoverage=54%, E-value=5e-19, Identity=54%"; Hit description =Putative dentritic cell 2 protein<DC2 protein
MAMPEFDTRTKQSPEGLSAKRRQGSESTHSSKIRGDLDADEEHAHDVGENHGGNSGGGVGHLDGFRAVAIEGEVEENDADAAEDEHEAGGEALDNVLAVDTAGHEDDGANGAGVGVLRGANAGGLDDDVGGKLQAEARGTEEAEGEDAEEVEDWIDGCAGGGIEAAGGGGNNGDNDDGSNGMAMAIIAVEWWRRQIDSSDNVVVEVAKVRCDDNENGDQMMEAIILVTMWWWWQDNGDGGMAA

SEQ ID NO: 161706 - protein, 86 aa, Glycine max
  Coding DNA Sequence Number=SeqID_44928
  Subcellular localization annotation: CTP_CleavageSite=49; ConfidenceScore=5.50e-01
MSAASRSAGAANLAAGARPRLARSPFRLPKQTSISNRVTDLPVEASFCVESMLPYHSATASALLNSMLSVSRHSYGWTPEGQEKAR

SEQ ID NO: 161707 - protein, 128 aa, Glycine max
  Coding DNA Sequence Number=SeqID_44929
MGTHSKSDFLYHLIFHLQNHNNQQTIKEEVQIGVAQNRETKLSKEKHGSLHGSHVKIWLRGTQMFVYDPGEVNANFGGNGQVGLVIMLQLVRCSGNLFSAEPQVVRLEVEDKVKLIPLRPLLKVSWAT

SEQ ID NO: 161708 - protein, 352 aa, Glycine max
  Coding DNA Sequence Number=SeqID_44930
  Gene Ontology: Mol. function=nucleic acid binding
  Homolog annotation: Hit_ID=Q8S7V6; Match level="QueryCoverage=86%, HitCoverage=72%, E-value=9e-16, Identity=24%"; Hit description =Putative auxin independent growth-related protein
  Pfam annotation: Domain name=DUF246; Domain location=39-346; Score= -51.5; E_value=1.2e-11; Accession=PF03138.5; Description=Plant protein family
MENGKGLKPCRNPLALEEAPQSEGFITFSLTNGPEYHISQIADAVVVARILGATLVLPDIRSSKSGYSMSLGDIYDVQKIINRLDGLVRVTRTLPVTNGNPPIVKVPNRVSQDYIVRTVKPIYKAKGIVKIESHFSSVNPTMAGNKKSLDTFACQTMFGTLQLQPEMHEVVDSMVQKLQSWSQNSNGQFIAVDLRTEMVAKECHKKDVSGRKLCYQPHEIGEFLKKIGFSPETTVVYVTQSKWNSDLDALKDIFPKTYTKETVMAEDKKGKSLSSQSSEFEKVIDFYICSQSEVFVPSIPGLFYANVAGMRIVSGKNQILVPAEISSPSASASDYISPYVSQKNHFAYACFC

SEQ ID NO: 161709 - protein, 608 aa, Glycine max
  Coding DNA Sequence Number=SeqID_44931
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LF79; Match level="QueryCoverage=97%, HitCoverage=54%, E-value=0.0, Identity=71%"; Hit description=Calcium- transporting ATPase 8, plasma membrane-type (EC 3.6.3.8) (Ca(2+) -ATPase isoform 8)
  Pfam annotation: Domain name=Cation_ATPase_N; Domain location=26-100; Score=37.8; E_value=3.8e-08; Accession=PF00690.16; Description=Cation transporterATPase, N-terminus
  Pfam annotation: Domain name=E1-E2_ATPase; Domain location=114-362; Score=199.7; E_value=7.1e-57; Accession=PF00122.10; Description=E1 -E2 ATPase
  Pfam module annotation: Pfam domain module=Cation_ATPase_N::E1-E2 _ATPase; Domain location=26-100::114-362
MEQLASISREHDTAALQQYGGVLLLNHYQVVGLSNLLKTNSEKGIHGDDADLLKRRNAFGSNNYPRKKGRNFLMFMWDACKDLTLVILMVAAAASLALGIKSEGIKEGWYDGGSIAFAVILVIVVTAISDYKQSLQFRDLNEEKRNIHLEVVRGGRRVEISIYDIVVGDVIPLNIGNQVPADGILITGHSLAIDESSMTGESKIVHKDSKDPFLMSGCKVADGSGTMLVTGVGINTEWGLLMASISEDTGEETPLQVRLNGVATFIGIVGLTVAVIVLIVLLARYFSGHTKNPDGSVQFIAGKTKVGDAIDGAIKIITVAVTIVVVAVPEGLPLAVTLTLAYSMRKMMADKALVRRLSACETMGSATTICSDKTGTLTMNQMTVVEAYAGGKKIDPPHKLESYPMLRSLLIEGVAQNTNGSVYAPEGANDVEVSGSPTEKAILQWGIQIGMNFMAARSESSIIHVFPFNSEKKRGGVAIQTADCNIHIHWKGAAEIVLACCTGYVDVNDQLVGMDEEKMTFFKKAIEDMAADSLRCVAIAYRSYEKEKVPTNEELLSHWSLPEDDLILLAIVGLKDPCRPGVKQAVELCQKAGVKGHLFQLESNMTKA

SEQ ID NO: 161710 - protein, 190 aa, Glycine max
  Coding DNA Sequence Number=SeqID_44932
  Homolog annotation: Hit_ID=Q8LGL4; Match level="QueryCoverage=67%, HitCoverage=36%, E-value=1e-36, Identity=58%"; Hit description=XY4 protein
  Pfam annotation: Domain name=PGAM; Domain location=116-190; Score =5.1; E_value=0.0013; Accession=PF00300.12; Description =Phosphoglycerate mutase family
MGASQSVQSLEDSEEEEQEEEEEDDERNLNGPLMGRAQLGNHMVKKVLEQEPEMLPCHASASPLSPQLSSLGTPRLGPSIKVWDPYNVLGPPPPALSRSFSGNGIVTVPDDEALTEVFLISHGECELNLAPDLVGGRCPAAALTVNGKRQARALAVFLKSQGVRFSAVYSSPLNRARSMAVSVCKVVSSV

SEQ ID NO: 161711 - protein, 108 aa, Glycine max
  Coding DNA Sequence Number=SeqID_44933
MPVVGNKRDHMPFPAIKQCVELNSEVLTFLHTSRMLNPHAYNGSNFESAKSNSGNAEKTLIPSSSQLLWKTTLKSQKASTFSSGSIRQGGVTLPSSFKRRHLVLDIVF

SEQ ID NO: 161712 - protein, 173 aa, Glycine max
  Coding DNA Sequence Number=SeqID_44934
  Gene Ontology: Mol. function=metal ion binding; Biological process =metal ion transport
  Homolog annotation: Hit_ID=Q94CS5; Match level="QueryCoverage=36%, HitCoverage=30%, E-value=2e-18, Identity=60%"; Hit description=Heavy- metal-associated domain-containing protein-like
  Pfam annotation: Domain name=HMA; Domain location=110-170; Score =48.3; E_value=2.7e-11; Accession=PF00403.16; Description=Heavy-metal- associated domain
MRNGFMCHSEASTTVCMRSCDTITGSVVVPRTRSRRHQRSVSLDDTRLIKYAKYSKLVDSSTSSRLFNSAHKKGDSVSVPNIKHQENESRELQKKPTDYVFQSCLASMVVVMRVAIHCQGCASKVKRHLSKMEGVTSFSVDVESKRVTVKGHISPVGVLESISKVKRAEFWNC

SEQ ID NO: 161713 - protein, 365 aa, Glycine max
  Coding DNA Sequence Number=SeqID_44935
  Gene Ontology: Mol. function=transferase activity, transferring nitrogenous groups; Cellular component=membrane; Biological process =biosynthetic process
  Homolog annotation: Hit_ID=Q9ZQI7; Match level="QueryCoverage=97%, HitCoverage=75%, E-value=1e-144, Identity=70%"; Hit description =Putative aspartate aminotransferase
  Pfam annotation: Domain name=Aminotran_1_2; Domain location=1-356; Score=56.3; E_value=1e-13; Accession=PF00155.11; Description =Aminotransferase class I and II
FVHGLSTATGYKGYGPEQGEKALRKAISVTFYKDLGIKPSEVFVSDGAQCDITRLQLLMGPNLKIAVQDPSFPMLAISNFQMCSKDKQAYIDSSVIIGQAGKFVDKAGKYKNIEYMTCGPQSDFFPDLPTISRTELIFFNSPNNPTGHAATRKQLEQLVDFAKVNGSIIIFDSAYSAYITDDSPKSIYEIPGAREVAIEVSSFSKFAGFTGVRLGWTVVPEELLYSNGFPVVHDFNRIMCTCFNGASNIAQAGGLACLSPEGLRAMQTLVDYYMENARILVDALTSLGLTVYGGKNAPYVWVHFPGSKSWNVFAEILEKTHIITVPGSGFGPGGEEYIRISAFGQRDSIIEASKRLKYLIYQEQN

SEQ ID NO: 161714 - protein, 41 aa, Glycine max
  Coding DNA Sequence Number=SeqID_44936
MYPNDNSQAVMHIEDSSKRENRRTYHHDYHAQDTAQRCPGM

SEQ ID NO: 161715 - protein, 193 aa, Glycine max
  Coding DNA Sequence Number=SeqID_44937
  Pfam annotation: Domain name=Chromo; Domain location=26-81; Score =9.0; E_value=0.082; Accession=PF00385.14; Description='chromo' (CHRromatin Organisation MOdifier
DDTTPDPSHVLALDEVQVKDNLTYKAQPQKITDRRRKSLRGKQIAFVKVQWGPDEGDSTWELEDRKISEAFPPSTLLFSLLLLLHCASIEAPKFLFISTPNCKEKPFSESWITPPLRGASNFRKLVEMMGRVNLGLNVRMVMFKSCQVVQQILPNMQKNGCAALVTGEGSFMTNGIELFGYFESLEGLMGTRC

SEQ ID NO: 161716 - protein, 77 aa, Glycine max
  Coding DNA Sequence Number=SeqID_44938
LQIRGERDDLIYTLKDGGEMSFEIVSILEFETQIDLVDNYEDSRFWPKAHMTEYVRCDKILNNISEAFNGRIWEAKD

SEQ ID NO: 161717 - protein, 41 aa, Glycine max
  Coding DNA Sequence Number=SeqID_44939
MPIMDVAPTTNSLLGLESGSANHVKCTLFHQAGMLEPTLIA

SEQ ID NO: 161718 - protein, 358 aa, Glycine max
  Coding DNA Sequence Number=SeqID_44940
  Gene Ontology: Mol. function=microtubule binding; Cellular component =nuclear outer membrane; Biological process=mitotic spindle assembly
  Homolog annotation: Hit_ID=Q153I4; Match level="QueryCoverage=97%, HitCoverage=97%, E-value=1e-173, Identity=81%"; Hit description=RNA export 1
  Pfam annotation: Domain name=WD40; Domain location=113-151; Score =35.2; E_value=2.3e-07; Accession=PF00400.22; Description=WD domain, G-beta repeat
  Pfam annotation: Domain name=WD40; Domain location=13-51; Score=28.3; E_value=2.7e-05; Accession=PF00400.22; Description=WD domain, G-beta repeat
  Pfam annotation: Domain name=WD40; Domain location=155-190; Score =0.3; E_value=34; Accession=PF00400.22; Description=WD domain, G-beta repeat
  Pfam annotation: Domain name=WD40; Domain location=246-283; Score =17.1; E_value=0.066; Accession=PF00400.22; Description=WD domain, G -beta repeat
  Pfam annotation: Domain name=WD40; Domain location=71-109; Score=7.4; E_value=5; Accession=PF00400.22; Description=WD domain, G-beta repeat
  Pfam module annotation: Pfam domain module=WD40::WD40::WD40::WD40::WD4 0; Domain location=113-151::13-51::155-190::246-283::71-109
  Subcellular localization annotation: CTP_CleavageSite=48; ConfidenceScore=5.66e-01
MSNFLSNTNPNPNKSFEVNQPPTDSVSSLSFSPKANFLVATSWDNQVRCWEVAQNGVNVATVPKASITHDHPMWFLLTTAALRVLCSTWKDDGTTVFSGGCDKQVKMWPLLSGGQPMTVAMHDAPIKEVAWIPEMNLLVTGSWDKTLKYWDTRQSNPVHTQQLPERCYAMTVRHPLMVVGTADRNLIVYNLQNPQVEFKRIVSPLKYQTRCLAAFPDQQGFLVGSIEGRVGVHHLDDSQQGKNFTFKCHREGNEIYSVNSLNFHPVHHTFATSGSDGAFNFWDKDSKQRLKAMLRCSLPIPCSTFNNDGSIFAYSVCYDWSKGAENSNPATAKTYIFLHLPQESEVRGKPRIGATGRK

SEQ ID NO: 161719 - protein, 75 aa, Glycine max
  Coding DNA Sequence Number=SeqID_44941
MYNIAGLPNEGLILTILRSRGMRKNVHALKEVQLIYFGAYWNEEGCARSKRRATYLFWGIGMRKGVFAHAQGCGN

SEQ ID NO: 161720 - protein, 437 aa, Glycine max
  Coding DNA Sequence Number=SeqID_44942
  Gene Ontology: Mol. function=protein serine/threonine kinase activity; Cellular component=integral to membrane; Biological process=protein amino acid phosphorylation
  Homolog annotation: Hit_ID=Q94F62; Match level="QueryCoverage=94%, HitCoverage=67%, E-value=0.0, Identity=81%"; Hit description =BRASSINOSTEROID INSENSITIVE 1-associated receptor kinase 1 precursor
  Pfam annotation: Domain name=Pkinase; Domain location=167-434; Score =130.0; E_value=6.8e-36; Accession=PF00069.15; Description=Protein kinase domain
  Pfam annotation: Domain name=Pkinase_Tyr; Domain location=167-437; Score=107.0; E_value=5.5e-29; Accession=PF07714.7; Description =Protein tyrosine kinase
  Pfam module annotation: Pfam domain module=Pkinase::Pkinase_Tyr; Domain location=167-434::167-437
  Subcellular localization annotation: CTP_CleavageSite=37; ConfidenceScore=5.09e-01
MSYYSTLSVTYYCKLINFALQNRRLNNNSLTGGIPMSLTNVSSLQVLDLSNNKLKGEVPVNGSFSLFTPISYQNNPDLIQPKNTPSPVSPTPPAASSGNSNTGAIAGGVAAGAALLFAAPAIALAYWRRRKPQDHFFDVPAEEDPEVHLGQLKRFSLRELQVATDNFSNKHILGRGGFGKVYKGRLADGSLVAVKRLKEERTQGGELQFQTEVEMISMAVHRNLLRLRGFCMTPTERLLVYPYMANGSVASCLRERQESQPPLGWPERKRIALGSARGLAYLHDHCDPKIIHRDVKAANILLDEEFEAVVGDFGLAKLMDYKDTHVTTAVRGTIGHIAPEYLSTGKSSEKTDVFGYGVMLLELITGQRAFDLARLANDDDVMLLDWVKGLLKDRKLETLVDADLHGNYNDEEVEQLIQVALLCTQGSPVERPKMSEV

SEQ ID NO: 161721 - protein, 47 aa, Glycine max
  Coding DNA Sequence Number=SeqID_44943
MAYKRLYPQMRCFQLIATSKYLIDLGAFGRVPSMSIPDAILPRKGIG

SEQ ID NO: 161722 - protein, 75 aa, Glycine max
  Coding DNA Sequence Number=SeqID_44944
MGLRKRDREWRIALSNHYAWLQTRGWRMDEQKRNSWGSEKGVENGELHQAITTHGSKLVGGECMNENATHGAPKK

SEQ ID NO: 161723 - protein, 183 aa, Glycine max
  Coding DNA Sequence Number=SeqID_44945
  Gene Ontology: Mol. function=transporter activity; Cellular component= integral to membrane; Biological process=protein transport
  Homolog annotation: Hit_ID=P54702; Match level="QueryCoverage=85%, HitCoverage=59%, E-value=5e-69, Identity=75%"; Hit description =Flagellar biosynthetic protein fliR
  Pfam annotation: Domain name=Bac_export_1; Domain location=27-183; Score=64.7; E_value=3.1e-16; Accession=PF01311.11; Description =Bacterial export proteins, family 1
  Pfam annotation: Domain name=Bac_export_3; Domain location=1-31; Score=-21.2; E_value=0.02; Accession=PF01313.10; Description =Bacterial export proteins, family 3
  Pfam module annotation: Pfam domain module=Bac_export_1::Bac_export _3; Domain location=27-183::1-31
MTLSFIPKIIAVFVAIIVAGPWMLNLDQWVQWLGVYFWPMLRIMALVSTAPILSEKSIPKRVKVGLGIIISIIVAPSLPPVEIPIFSANAVWVALQQVMIGVAVGFTMQLAFAAVRTAGELIGLQMGLSFATFVDPGSHLNMPVLARIIDLLAMLLFLSFNGHLWLISMLVDTFHTLPIGENP

SEQ ID NO: 161724 - protein, 133 aa, Glycine max
  Coding DNA Sequence Number=SeqID_44946
  Subcellular localization annotation: CTP_CleavageSite=27; ConfidenceScore=5.16e-01
MSSDSDSSISSDSLSFLQFFPLTAPIEFSNVRETRKELKPLLVLSWCVSETRIVVLLRPSWVSVGKEKVTMRKAKVGSYMEVTKTSINGWKLHGSYKNFHQRLEVTWKLLKLPSTAVFKIEKTSINRQKPPVL

SEQ ID NO: 161725 - protein, 90 aa, Glycine max
  Coding DNA Sequence Number=SeqID_44947
MCLQPGSAHDWRYARIPLPALSARVVLSATIRVTRPRAQNSIDTIVPISGKELWRQQEDDLLQRYLGFLGDFSIGKCTVALELDGSKIKT

SEQ ID NO: 161726 - protein, 69 aa, Glycine max
  Coding DNA Sequence Number=SeqID_44948
  Gene Ontology: Mol. function=hydroxymethylglutaryl-CoA synthase activity; Cellular component=soluble fraction; Biological process =acetyl-CoA metabolic process
  Homolog annotation: Hit_ID=Q6ZBH5; Match level="QueryCoverage=87%, HitCoverage=13%, E-value=2e-22, Identity=80%"; Hit description =Putative hydroxymethylglutaryl coenzyme A synthase
MASLRPANVGILAMDIYFPPTCVTQEALEGHDGVSKGKYTIGLGQDCMAFCSEVEDVISMRLITILHDQ

SEQ ID NO: 161727 - protein, 551 aa, Glycine max
  Coding DNA Sequence Number=SeqID_44949
  Gene Ontology: Mol. function=pyridoxal phosphate binding; Biological process=metabolic process
  Homolog annotation: Hit_ID=Q9FGL6; Match level="QueryCoverage=97%, HitCoverage=87%, E-value=1e-139, Identity=50%"; Hit description =Arabidopsis thaliana genomic DNA, chromosome 5, P1 clone:MJM18
TQFTNHESLPSLHESFNEFTKAYTQYSETEQVDHVRAKDYSHLSLSNQTCLDYIGIGLFSYSQLQHHETSKGQVPSSSIPQTPPNYSDIPFFSLSCKTGSLKTLLLHGGQDTEFEAAMRKRIMSFLNVSENDYFMVFTANRTSAFKLVADSYQFQTSRRLLTVYDYESEAVEVMISSSEKRGARAMSAEFSWPRLRIQTTKLRKMIESKRKKKKKRKGLFVLPLSSRVTGAKYPYLWMSIAQEIGWHVLVDACALGPKDMDCFGLSLFQPDFLICSFYKVFGENPSGFGCLFIKKSAISSLESYPSAGIVNLVPEKQPHQLSDDSSGTDLELKNKPSPACLHEEKLFPLSYFSGPMQTKQSEIVEEGEPPDSKLKAPQCSEIEEVQQEAVQNLKKSSKVEETDIQCRCLDQVDSLGLILITNRSRYLINWLVNSMRKLKHPNTQGVHLVKIYGPKVKFDRGPALAFNIYDWKEEKGKVLQTKVVGGQEGVMTTTNKKDSVGISVVTAALGFLANFEDVYKLWAFVARFLDADFVEKERWRYIAINQKIVEV

SEQ ID NO: 161728 - protein, 387 aa, Glycine max
  Coding DNA Sequence Number=SeqID_44950
  Gene Ontology: Mol. function=hydroxymethylglutaryl-CoA synthase activity; Cellular component=soluble fraction; Biological process =acetyl-CoA metabolic process
  Homolog annotation: Hit_ID=Q6QLW8; Match level="QueryCoverage=99%, HitCoverage=84%, E-value=1e-166, Identity=73%"; Hit description=HMG -CoA synthase 2
  Pfam annotation: Domain name=ACP_syn_III; Domain location=54-128; Score=-17.2; E_value=0.041; Accession=PF08545.1; Description=3 -Oxoacyl-[acyl-carrier-protein (ACP)
  Pfam annotation: Domain name=ACP_syn_III_C; Domain location=235-305; Score=-33.1; E_value=0.039; Accession=PF08541.1; Description=3 -Oxoacyl-[acyl-carrier-protein (ACP)
  Pfam annotation: Domain name=HMG_CoA_synt_C; Domain location=118-386; Score=413.6; E_value=2.7e-121; Accession=PF08540.1; Description =Hydroxymethylglutaryl-coenzyme A synth
  Pfam annotation: Domain name=HMG_CoA_synt_N; Domain location=1-117; Score=161.2; E_value=2.6e-45; Accession=PF01154.8; Description =Hydroxymethylglutaryl-coenzyme A synth
  Pfam module annotation: Pfam domain module=ACP_syn_III::ACP_syn_III _C::HMG_CoA_synt_C::HMG_CoA_synt_N; Domain location=54-128::235 -305::118-386::1-117
LTVVTSLLEKFNVDPKQIGRLEVGSETVIDKSKSIKTFLMQVFEASGNIDIEGVDSTNACYGGTAALFNCVNWVESSSWDGRYGLVVCTDTAVYAEGPARPTGGAAAIAMLVGPDAPIAFESKLRGSHMSHAYDFYKPNLASEYPVVDGKLSQTCYLMALDSCYQLYCKKASRGAAVKLCLGDLLVMGSNPETASCICKALTTPRKLGFVDEVARDTLAPYASLSGDDSYQSRDLEKANQQAAKHLYDAKVQPSTLIPKQVGNMYTASLYAAFASLLHNKNSSLVGKRVVMFSYGSGLTATMFSFHLQEGQHPFNLSNIVTVMNVSDKLKQRVEIPPEKFVETLKIMEHRYGGKDFVTSKDCSYLPPGTFYLTNVDSMYRRFYAKKE

SEQ ID NO: 161729 - protein, 431 aa, Glycine max
  Coding DNA Sequence Number=SeqID_44951
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=86%, HitCoverage=96%, E-value=1e-166, Identity=70%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=45-422; Score=- 412.6; E_value=9.7e-05; Accession=PF00743.9; Description=Flavin -binding monooxygenase-like
  Pfam annotation: Domain name=Pyr_redox_2; Domain location=44-358; Score=-40.0; E_value=0.082; Accession=PF07992.4; Description =Pyridine nucleotide-disulphide oxidor
  Pfam module annotation: Pfam domain module=FMO-like::Pyr_redox_2; Domain location=45-422::44-358
MDYCLRELEGKQAHDPLFLQKMKNSSSQSTTTSSERCVWVPGPVIVGAGPSGLATAAYLKEKGLPSLILERSNCIASLWQLKTYDRLHLHLPKNFCQLPLMGFPCDFPTYPTKQQFIEYLESYAESFDIRPRFNETVRRAEFDATLGFWRVKSFNKKEVATEFVCRWLIVATGENAEAEVPEIEGMGEFGGAIKHTSFYKSGEEFRGKRVLVVGCGNSGMEVCLDLCNHNATPSLVVRDTVHILPREMLGKSTFGLSMWLLKWLPIRFVDWFLLIVSWLMLGDTARFGLDRPKLGPLQLKNLSGKTPVLDVGTLAKIKSGHIKEDDMFSKEDGFPTKPFPDGWKGENGLYAVGFTKRGLLGASMDAERIGEDIESGYQTVESGVGSEGIIPKLLHCGAASEVAPTKPFENVAPLIGLASAKGHTIMHWLKG

SEQ ID NO: 161730 - protein, 43 aa, Glycine max
  Coding DNA Sequence Number=SeqID_44952
MDGTVGYGGLKWLVWIKVGVESASISIHDNGSPTEEFKAQRGL

SEQ ID NO: 161731 - protein, 111 aa, Glycine max
  Coding DNA Sequence Number=SeqID_44953
  Homolog annotation: Hit_ID=Q1S7B8; Match level="QueryCoverage=82%, HitCoverage=11%, E-value=5e-07, Identity=33%"; Hit description=RNA -directed DNA polymerase
MRVDGSILFWSGRLGTIVRLGFGRAIDKLLEDAINGISLNLEAHDYWTWKLESSGTFSTSFEYSALIDINFPCNENPLLEKIWHLDVPPKVSFLPGHLLLNRLPTVDNLKR

SEQ ID NO: 161732 - protein, 325 aa, Glycine max
  Coding DNA Sequence Number=SeqID_44954
  Gene Ontology: Mol. function=oxidoreductase activity; Cellular component=vacuole; Biological process=hydrogen peroxide catabolic process
  Homolog annotation: Hit_ID=Q9LT91; Match level="QueryCoverage=96%, HitCoverage=97%, E-value=1e-125, Identity=69%"; Hit description =Peroxidase 66 precursor
  Pfam annotation: Domain name=peroxidase; Domain location=46-291; Score=407.6; E_value=1.8e-119; Accession=PF00141.13; Description =Peroxidase
MALLPYSKCKFLFPIIFLSLTLSSMSQAELDAHYYDKTCPQAEKIISDTVLRASTFDPKVPARILRIFFQDCFIRVCDASILLDSTPKNLAEKDGPPNLSVHAFYVIDEAKAKLEKACPRTVSCADLIAIAARDVVALSGGPYWNVLKGRKDGRVSKASETVNLPAPTLNVNQLIQSFAKRGLGVKDMVTLSGGHTLGFSHCSSFQARIHNFSLLHDIDPSLNTEFALDLKKKCPKPNTNFSAGQFLDSTASVFDNDYYRQLLVGKGLFSSDQSLVGDQRTSWIVKAFAKDQSLFFKEFADSMLKLGNVGVSENGEVRLNCKVVN

SEQ ID NO: 161733 - protein, 326 aa, Glycine max
  Coding DNA Sequence Number=SeqID_44955
  Homolog annotation: Hit_ID=Q9FIS0; Match level="QueryCoverage=83%, HitCoverage=37%, E-value=5e-23, Identity=34%"; Hit description =Arabidopsis thaliana genomic DNA, chromosome 5, P1 clone:MTG10
MNPINDRVVGITQWYKAPVPNNRAGLVSGLGKGLEVSAVKIKSQLSKGIGLPIMGKEWYFAGRSSKRGVVGVGGEAEAETQAPSGCMCAVFQFFDFHPFHFPNINQHHQQEQTSFKPPSCTSEDHTTVPKGAEAPRNSLESEDGDGTVSSLSSKEEDFKIPKNIVQIKTSGGTRASGGNLNDLSSELTGSPGTKTPTLVARLMGLDLLPGANSPSFSSCLSTPNTQGNVSHLHHHLRHKQHVQTKHRNSIDSSDIASTRSLPETPRISSARRSDVDHHHRLSLQINKENMNLGEDLELPRLSFSKRKSDENNGRSPSYYARQIVKQ

SEQ ID NO: 161734 - protein, 481 aa, Glycine max
  Coding DNA Sequence Number=SeqID_44956
  Gene Ontology: Mol. function=ribokinase activity; Cellular component =cytoplasm; Biological process=D-ribose metabolic process
  Homolog annotation: Hit_ID=Q8H277; Match level="QueryCoverage=62%, HitCoverage=79%, E-value=1e-122, Identity=73%"; Hit description =Fructokinase
  Pfam annotation: Domain name=PfkB; Domain location=1-295; Score =230.1; E_value=5e-66; Accession=PF00294.14; Description=pfkB family carbohydrate kinase
MVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAARELANLALEMKLTSGPKKAALEHMREKIEASTEKIRMTKINEEQARKVVARGGGDGASDGTTEEREDGRSSSSQDSAIQDGSTVSSTRESNGGTAGNVPYQNNGQKVPVTNEHKLQPPSEGEGRNKKKVNFRRGKGIGAVPKTRSSTPDMVPALMQMEEPESTMVIRYCTKYIFG

SEQ ID NO: 161735 - protein, 79 aa, Glycine max
  Coding DNA Sequence Number=SeqID_44957
MYKSYLNQKQASVQEVHPYLKFEAPQRRGVLHDSENGFLLQFRVEVMSNFGALMEASMERKKKRKATWEGEEKLLNFAE

SEQ ID NO: 161736 - protein, 408 aa, Glycine max
  Coding DNA Sequence Number=SeqID_44958
  Gene Ontology: Mol. function=helicase activity; Biological process =viral genome replication
  Homolog annotation: Hit_ID=Q1SRJ5; Match level="QueryCoverage=99%, HitCoverage=51%, E-value=1e-103, Identity=45%"; Hit description =Probable helicase [imported]-Arabidopsis thaliana-related
YVSAPEACWKIFAFPMHGHAPAVERLYFHLENQQPVYWKDSEEIGTVLAKSTIKESMFTTWMDSNKIYHHGRDLTYAEYVSKFVYDARKRCWKPRKQGNTIGRLIWVPPSSGELVYMRMMLSSAKGSQCYEDIRTVENVVYHTFREACFAKGFLGSDQEFVGALREANTWGTPHYLRKLFVKLLFMNTMDRPEYVWKQTWQWMANDIVFNHRRQGIQLIDKEKMHLCLTTIENLLQANRKSLRDFPSMPYPLGYAANTHQNNLIYNELAYDGDILAAEFDKCYQWLTDEQASIFNKIMHVVATQSGGVYFLYGYGGTGKTFVWKTLSSAIRSTGGIVLTVASSGIASILLPGGRTTYSKFAIPVPATKNSTCNIYQGSDLAKLLHITKLIIWDEAPMCHRYNIEALDK

SEQ ID NO: 161737 - protein, 299 aa, Glycine max
  Coding DNA Sequence Number=SeqID_44959
KDLNHGLKQLFDDIGALEMVDIARCEGHGTEGNGGNDENVEENIPDANVGSTTGSSGATKDADVTITLNDSEEETNEREGFVGKPKGSTSTEKEGVLPPEPQPEINDDVQHEVLPQHQHMEMDDDTYNLKELHTKSKDEDGSKIRQEHPVWVMHNDLKDYIVKDNCTKGKGSYKDSYTWFIFITIQEINDYNHELMKSNEESTVDLTTHPFEGNLEELENNNSDVSLAFHRLYICLKVCKDSFFKLVEGENTNSWKWFMELLIKDLGAREKPIVSMLENIHIYLMERWDTNSKKVVAWE

SEQ ID NO: 161738 - protein, 135 aa, Glycine max
  Coding DNA Sequence Number=SeqID_44960
  Homolog annotation: Hit_ID=Q1RTJ9; Match level="QueryCoverage=88%, HitCoverage=36%, E-value=3e-14, Identity=39%"; Hit description =Cyclin-like F-box; F-box protein interaction domain
MDKKISREIPEGYRVCFWNKETRVISRELPTLSFSPGIGRRTMFGFGYDPSSDKYKVVAIALTMLSLDVSEKTEMKVYGAGDSSWRNLKGFPVLWTLPKVGGVYLSGTLNWVVIKGKETIHSEIVIISVDLEKET

SEQ ID NO: 161739 - protein, 91 aa, Glycine max
  Coding DNA Sequence Number=SeqID_44961
MVQFYHAFSSTLTGFSAPNIVSLNKVYAICNENAKRNGETNAVGWTEVHVEVVKIQTTSKSLNCLRLHYSWMNGVDSTMEEMEGGSSLPKM

SEQ ID NO: 161740 - protein, 373 aa, Glycine max
  Coding DNA Sequence Number=SeqID_44962
  Homolog annotation: Hit_ID=Q3R3K1; Match level="QueryCoverage=80%, HitCoverage=95%, E-value=3e-66, Identity=45%"; Hit description =Hypothetical protein precursor
PARAGTGDDGWRPGRARTVDAQAAAGCSVGPRARPHPPSAPIERCVLHGPAAPMSASRGSLRCRPAFRTRAQAGCRGVPSASRKCCAAHRPPGRGAADAAPRRWHGHGYAADRCRSPAVQAPRPRPAGRPAAAVPATPTTMPAPGPAAGWWTGGYAAVPASHGVRWERPVPLRHGRAQAARSSRCCHPAADEGRAAHADHAVRGLRAGATVARPVPARPRSHRSARRTTGDARQWHWRWPLRQAAGPAAAPDCCCSSARPAAWPPAGWQRTGRSGWAAHRCDGGPAASARLRACVAVPAAACVPSVWPRSIHRDGLQDRARQCRSRTGFGFRHQPVTSHCDEQRLHVLGHDMPATQQQGMCPGRTQQCQAGAW

SEQ ID NO: 161741 - protein, 268 aa, Glycine max
  Coding DNA Sequence Number=SeqID_44963
  Gene Ontology: Mol. function=protein histidine kinase activity; Cellular component=integral to membrane; Biological process=two -component signal transduction system (phosphorelay)
  Homolog annotation: Hit_ID=P27896; Match level="QueryCoverage=81%, HitCoverage=40%, E-value=1e-31, Identity=41%"; Hit description =Nitrate/nitrite sensor protein narQ
  Subcellular localization annotation: CTP_CleavageSite=73; ConfidenceScore=5.35e-01
RCSCCRAGKGLRVKVSVSQCKPGCAGGKSVQYFASQTRLIQGNVNRVKRPVTRTIARALSAIVLLSLLTTGLALMTLSSSLRDAEAVNVAGSLRMQIYRLAWDSTRDPQQLAHHMQQYQQTLESPALQHLERPWVPIEVSSRYRYLRDSWPVLQETLQPARAQVYQQRVAGYVTLCRAENASGGRQQPVRLSGDCRAGAVEHWLYSPQRGASARFAGHRQSIRRAGQLQFSAAFRASAQRAGRAGAGLYHYGGAAAFALSPAGVRGTQ

SEQ ID NO: 161742 - protein, 174 aa, Glycine max
  Coding DNA Sequence Number=SeqID_44964
  Gene Ontology: Mol. function=protein histidine kinase activity; Cellular component=integral to membrane; Biological process=two -component signal transduction system (phosphorelay)
  Homolog annotation: Hit_ID=Q6D5Y8; Match level="QueryCoverage=100%, HitCoverage=30%, E-value=7e-32, Identity=44%"; Hit description =Nitrate/nitrite sensor protein
LLIGLGQRAIEIGDDRLCLWLAAIDITPQQRQLDTQKRERLRQRIVQLARNGGALFNQQHLLILLLRLPDPQCTRQHVGQTVHQLIGRRRAAGLPAQFAEALLLLLQRQPLPAEIVGGHAGLEGDILAGDLQHLQCFPSLHQPQQALEQLGIERAAGENLRAFIQQRQRAVGLG

SEQ ID NO: 161743 - protein, 90 aa, Glycine max
  Coding DNA Sequence Number=SeqID_44965
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=99%, HitCoverage=18%, E-value=2e-44, Identity=89%"; Hit description =Isoflavone conjugate-specific beta-glucosidase
DDFRDYEDLCFKEFGDRVKFWVTLNQPWLFSQGGYATGPGRCTGPQCLGGDAGNEPYIVTHNQILAHAAAVHVYKTKYQAYQKVKIGITL

SEQ ID NO: 161744 - protein, 72 aa, Glycine max
  Coding DNA Sequence Number=SeqID_44966
  Subcellular localization annotation: CTP_CleavageSite=41; ConfidenceScore=5.04e-01
MPVPPGKGSRLQDTKWTRRSPTRSWSCQALITGLCQFYGVPVTSSKGIRPPTNRAFIKKYCVPRQAQGEIPQ

SEQ ID NO: 161745 - protein, 113 aa, Glycine max
  Coding DNA Sequence Number=SeqID_44967
MNLIIVMKRKERALRHPYQTRARARVMGEVEEVQEQIKADMEAMKEKMATMMEAIMRMKEIMEVNAVALLSPHCVQILNKHAFAPFGLPPNYTPPNLTYTPGEDVNNSLSHTH

SEQ ID NO: 161746 - protein, 537 aa, Glycine max
  Coding DNA Sequence Number=SeqID_44968
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS8; Match level="QueryCoverage=95%, HitCoverage=98%, E-value=0.0, Identity=67%"; Hit description =Glycoside hydrolase, family 1
  Pfam annotation: Domain name=Glyco_hydro_1; Domain location=53-531; Score=765.4; E_value=3.4e-227; Accession=PF00232.9; Description =Glycosyl hydrolase family 1
MKQTTKQDISQDMAFSGYFLLGLIALVIVRSSKVTCEELAVNTVSPIIDISLSRNSFPEGFIFGAGSSSYQFEGAAKEGGREPSVWDTFTHNYPGKIMDRSNGDVAIDSYHHYKEDVGMMKDMNLDSYRFSISWSRILPKGKLSGGINQEGINYYNNLINELVANGIQPLVTLFHWDLPQALEDEYGGFLSPRIVKDFRDYAELCFREFGDRVKYWVTLNEPWSYSQNGYANGRMAPGRCSAWMNLNCTGGDSSTEPYLVTHHQLLAHATAVRVYKTKYQASQSGVIGITLVANWFLPLRDTKSDQKATERAIDFMYGWFVDPLTSGDYPKSMRSLVRTRLPKFTAEQSKLLIGSFDFIGLNYYSTTYASDAPHLSNARPSYLTDSLVTPAYERDGKPIGIKIASDWLYVYPRGIRDLLLYTKEKYNNPLIYITENGINEYNEPILSLEESLMDIFRIDYHYRHLFYLRSAIRDGANVKGYYVWSLFDNFEWSSGYTSRFGMIFVDYKNNLKRYQKLSAQWFKNFLRKETRLYSSCK

SEQ ID NO: 161747 - protein, 82 aa, Glycine max
  Coding DNA Sequence Number=SeqID_44969
  Gene Ontology: Mol. function=protein serine/threonine kinase activity; Biological process=protein amino acid phosphorylation
  Homolog annotation: Hit_ID=Q67UT0; Match level="QueryCoverage=60%, HitCoverage=12%, E-value=2e-15, Identity=70%"; Hit description =Putative serine/threonine protein kinase
MFGNPNRATRGRAFESTKNATIDNGECLSDYIEVIRYEPYNEKCDVYSFGVILNELLTGNYPYVETKYGPTKIVVEVVEGKL

SEQ ID NO: 161748 - protein, 703 aa, Glycine max
  Coding DNA Sequence Number=SeqID_44970
  Homolog annotation: Hit_ID=Q6ZGD1; Match level="QueryCoverage=82%, HitCoverage=71%, E-value=1e-146, Identity=48%"; Hit description=DENN (AEX-3) domain-containing protein-like
  Pfam annotation: Domain name=DENN; Domain location=172-578; Score =26.1; E_value=2.9e-10; Accession=PF02141.11; Description=DENN (AEX -3) domain
MLEVPSSTHLGCSIRHKWQWVCAVERTPSMSELNEILFGQAKAYKKFPTASMPPLVPHSIPHIPSTPHAPLTPFATNLLPPAHSIRVPLQQAPPPQFPSYPCHLCPSLVPELGEHLKQRDLSFVFRLQGAENSTLYGCCVLVEELVQKPSGLLSLISDKQPSYSSLRRHILITQRCYCILSRIPAFELHFGVLNSIFTQERLERLTKGVGDLNLEFDEGNHKEENLQGYSESVLVSDGPIEDRLGGNTVISQSRVRKSTPENIVDDGQSEHLTVDGELQTYKERINYDDALLTDPVNDRTTAKEDSGPANSENSDHYGDAFATNKQSEDKHLPNAILPLLRYCQYESSESSCSFQGSPCEDRNFRSDVDDNETEEASFSGQEDLNDLNDILEWAKENNHGPLQIVSEFYRLSCPARGSSLTFHPLEHLHPLEYHRSAETVLRLADSTVDLKTSSTGLGLADAHIALLVEEANALSLWAVACLCGTLRLENVLTFFAGVLLEKQIVVVCSNLGILSASVLSVIPLIQPYRWQSLLMPVLPNDMLEFLDAPVPYVVGIKNKTSEVQSKFTNVILVDADRNLLIREIDRVGLTVEKMVKSPTIPQLPRQKELVSSLRPYHETLVGESYLGRRRPVYECTEVQIEAAKGFLSVLRSYLDSLCCNIRSHTITNVQSNDDKVSLLLKESFIDSFPYRDWPFMKGLARSP

SEQ ID NO: 161749 - protein, 348 aa, Glycine max
  Coding DNA Sequence Number=SeqID_44971
  Homolog annotation: Hit_ID=Q9SDZ5; Match level="QueryCoverage=100%, HitCoverage=91%, E-value=4e-46, Identity=36%"; Hit description =Growth-regulating factor 1
  Pfam annotation: Domain name=QLQ; Domain location=11-47; Score=66.6; E_value=8.1e-17; Accession=PF08880.1; Description=QLQ
  Pfam annotation: Domain name=WRC; Domain location=78-123; Score=97.9; E_value=3.1e-26; Accession=PF08879.1; Description=WRC
  Pfam module annotation: Pfam domain module=QLQ::WRC; Domain location =11-47::78-123
MNGRNVNTNRFPFTPSQWQELEHQALIYKYMASGISIPPDLLFTIKRTTHLDSSRLLPHHPQHFGWNYLPMGLGRKIDPEPGRCRRTDGKKWRCSKEAYPDSKYCERHMHRGKNRSRKPVEVLKTTPTTAAVATNTDASTPTTILSITKNSPAHALSPTTHSLSHDTYHHHHHHPHPQQHSSHSFLYHHSSRPSSGAALSFQDNSAPLFLDTASCSQNNNNTDCRYVYGLKEEVDEHAFFTEPSGTMRSFSASSMEDSWQLTPLTISSSSSSKQRNCSGLSNDNNEYSYLQLQSLNGNNSKQPQQDQGCYISGSDVKCETFMKLGKEEPQKTVHRFFDEWPPKSRGSW

SEQ ID NO: 161750 - protein, 82 aa, Glycine max
  Coding DNA Sequence Number=SeqID_44972
MHRCEMAPKKLPAKRSRKDVARKGSSAAPQADVDFDRHRFWSEEHQQRFEAIKGVKASFMMMNQVDSSSFDDNKDDDKKPKE

SEQ ID NO: 161751 - protein, 73 aa, Glycine max
  Coding DNA Sequence Number=SeqID_44973
MGHAGSDVYDVDSQFWLWNSMGLVVSSTVELGCVTLKNQHGYARIVWPAGRGENRLGRLTGAYDLAYIKSGLV

SEQ ID NO: 161752 - protein, 302 aa, Glycine max
  Coding DNA Sequence Number=SeqID_44974
  Gene Ontology: Mol. function=DNA-directed RNA polymerase activity; Cellular component=DNA-directed RNA polymerase III complex; Biological process=transcription from RNA polymerase III promoter
  Homolog annotation: Hit_ID=Q28DL8; Match level="QueryCoverage=41%, HitCoverage=35%, E-value=9e-11, Identity=28%"; Hit description =Polymerase (RNA) III (DNA directed) polypeptide D, 44kDa (Polymerase (RNA) III (DNA directed) polypeptide D)
  Pfam annotation: Domain name=RNA_pol_Rpc4; Domain location=178-292; Score=105.6; E_value=1.4e-28; Accession=PF05132.5; Description=RNA polymerase III RPC4
MASESGKDGAGVPRKLKFKPRAPPRRVIKQEVKAEVADDVDVDADAEHAAKENLLKRFHERESAVKAKYKVEKKVLASQIAFGYGGESTSMKSYGIPRGGSSININQSSASNGAKEKEYQEPWDYDSNYPVTLPLRRPYSGNPALLDDQEFGEAAEPRAYDENASNSAMELDLLEHNPEASMFFINLPTKLPMIKQSATAGSSDVNVKSRPHGGSKNVEELCELNELSSGFMGKMLVYKSGAIKLKLGDTLYDVSSGMKCACAQDLVAINTAQKHCCTIGEISKRVSITPDIDAIIDNLPDL

SEQ ID NO: 161753 - protein, 304 aa, Glycine max
  Coding DNA Sequence Number=SeqID_44975
  Gene Ontology: Mol. function=DNA binding; Cellular component=nucleus; Biological process=regulation of transcription, DNA-dependent
  Homolog annotation: Hit_ID=Q9ATD5; Match level="QueryCoverage=98%, HitCoverage=98%, E-value=4e-83, Identity=54%"; Hit description =GHMYB10
  Pfam annotation: Domain name=Myb_DNA-binding; Domain location=14-61; Score=48.6; E_value=2.2e-11; Accession=PF00249.21; Description=Myb -like DNA-binding domain
  Pfam annotation: Domain name=Myb_DNA-binding; Domain location=67-112; Score=53.1; E_value=9.5e-13; Accession=PF00249.21; Description=Myb -like DNA-binding domain
  Pfam module annotation: Pfam domain module=Myb_DNA-binding::Myb_DNA -binding; Domain location=14-61::67-112
MGRSPCCSKEGLNRGAWTAHEDKILREYIRVHGEGRWRNLPKRAGLKRCGKSCRLRWLNYLRPDIKRGNISPDEEELIIRLHKLLGNRWSLIAGRLPGRTDNEIKNYWNTNLGKKVKDGHQTTANNTQNPMPHLAPIHMATSSISLSPPKLDSRVVRTKATKCSKVLFLNPPPHPSMPNKSKTEAEAEARLVDGVISNQMEHTTYDNGFLSFPDEEKELSTDFLIDFNVGDVCLSDLLNSDFSNTYNFSCTNVNHHEQLSPCSDQPDAMFSDEVLKDWTHSNFADEANASNNLHSFISFESTEE

SEQ ID NO: 161754 - protein, 222 aa, Glycine max
  Coding DNA Sequence Number=SeqID_44976
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=99%, HitCoverage=81%, E-value=7e-64, Identity=48%"; Hit description =Peptidase C1A, papain
  Pfam annotation: Domain name=Inhibitor_I29; Domain location=1-54; Score=64.2; E_value=4.3e-16; Accession=PF08246.2; Description =Cathepsin propeptide inhibitor domain (
  Pfam annotation: Domain name=Peptidase_C1; Domain location=75-221; Score=41.9; E_value=1.2e-14; Accession=PF00112.13; Description =Papain family cysteine protease
  Pfam module annotation: Pfam domain module=Inhibitor_I29::Peptidase _C1; Domain location=1-54::75-221
MAQYGKVYEDAAEMEKRFQIFKNNVQFIESFNVAGDKPFNIRINQFPDLHDEEFKALLINGQRKVSGVETATEETSFRYGSCWALSAVAAIEGIHQITTSKLMFLSKQKLVDSVKGESEGCIGGYVEDAFEFIVKKGGILRYEKVPSNNKKALLKVVANQPVSVYIDVGAHAFKYYSSEIFNARNCGSDPNHVVAVVGYGKALDGAKYWPVKNSWGTEWGGK

SEQ ID NO: 161755 - protein, 109 aa, Glycine max
  Coding DNA Sequence Number=SeqID_44977
MSKNKVLKVHNRTFLNWFKDTNFGDNNASEMLRKLVDGPKRNVIICGVTLRAESQYFTSVHDDNPRVASIPLWVDNNIGVQIDDLGFMLVDLMKLAYQNNPFIMAEQAK

SEQ ID NO: 161756 - protein, 218 aa, Glycine max
  Coding DNA Sequence Number=SeqID_44978
  Pfam annotation: Domain name=Dabb; Domain location=114-208; Score =38.6; E_value=2.1e-08; Accession=PF07876.3; Description=Stress responsive AB Barrel Domain
  Pfam annotation: Domain name=Dabb; Domain location=4-101; Score=82.5; E_value=1.3e-21; Accession=PF07876.3; Description=Stress responsive AB Barrel Domain
  Pfam module annotation: Pfam domain module=Dabb::Dabb; Domain location=114-208::4-101
MSIIEHVVLFKVKEDVAPSEADTMVERINSLASLEQLLHLTVGPLFRIRTSPPSLKFTHFFHTRFNSKDDLRSYVAHPAHVAVVKANTPLVDDAMALDWLAEVPGGTVPPPGSALRVTFFKLKEGVEDRVKDEIVGAMRGFQREFKQAIQLTCGGNFSPARAKGFSIASLEVFPGLSELEAAKELGDYHKNEKIKEHLESVMVLDYVVPSSSKAHSAS

SEQ ID NO: 161757 - protein, 100 aa, Glycine max
  Coding DNA Sequence Number=SeqID_44979
  Homolog annotation: Hit_ID=Q5FAM5; Match level="QueryCoverage=51%, HitCoverage=30%, E-value=6e-08, Identity=51%"; Hit description =Putative Basic helix-loop-helix(BHLH) family protein
MLKLAQAFKYHDTSSYLKVVGNKLKDILEMISSMPAVLAARERDEVNLANIAMKKIQAGKLSELVDPSFGFESNQPTKLCTNSCVAKLYVPDFSSRKYEK

SEQ ID NO: 161758 - protein, 65 aa, Glycine max
  Coding DNA Sequence Number=SeqID_44980
MKNNDGLWWLMVVVGDGETTRKQRLKRSNEKCSRERKLNAHSRHLLKDPNGQTVDKFLVKLKAKF

SEQ ID NO: 161759 - protein, 361 aa, Glycine max
  Coding DNA Sequence Number=SeqID_44981
  Gene Ontology: Cellular component=nucleus; Biological process=rRNA processing
  Homolog annotation: Hit_ID=Q5SY16; Match level="QueryCoverage=92%, HitCoverage=51%, E-value=3e-18, Identity=34%"; Hit description =Nucleolar protein 9
  Pfam annotation: Domain name=NUC156; Domain location=205-350; Score =144.7; E_value=2.4e-40; Accession=PF08160.2; Description=NUC156 domain
MDSSPSPDICIPEQWLEATESIAHSSMLPIALICGAKNCGKTTFSRYLLNILLNKYTKVAYLDTDVGQPEFTPPAFLSLTIVHKVTPDLTVPCLKTPERCLFFGDVSCKRDPSTYLSYVFAIYNHYRKEYCISDKGEYPHKIEVPLIVNTPGWVKVKISISSEKKNLPAGEFWSDGEHDETINIIEINSARQDSLNRSVLVQKDARLLRDLRIMAYFRQCFSSESNISTIKELAHALTSHCPYEVPIASIKIRHLHCEVPSSEIFYSLNATVVGLAVDSDGPENLPWCLGLGSGAQKYCEVMLIFGLASSDLIWIVRGIDSVKGVLYVITPVPNSSLEKVNLLLQGKKFLAFFYFLIDIIL

SEQ ID NO: 161760 - protein, 280 aa, Glycine max
  Coding DNA Sequence Number=SeqID_44982
  Gene Ontology: Mol. function=5-formyltetrahydrofolate cyclo-ligase activity; Cellular component=mitochondrion; Biological process=folic acid and derivative biosynthetic process
  Homolog annotation: Hit_ID=Q8L539; Match level="QueryCoverage=90%, HitCoverage=84%, E-value=8e-72, Identity=54%"; Hit description=5 -formyltetrahydrofolate cyclo-ligase-like protein
  Pfam annotation: Domain name=5-FTHF_cyc-lig; Domain location=41-263; Score=84.0; E_value=4.6e-22; Accession=PF01812.10; Description=5 -formyltetrahydrofolate cyclo-ligase family
MRAQTLMTQWCTRAATCGQLRMSTNTNTPKHDGLDAIFKHKRLLRTQVRKTLKSIQPSLRSHQAIISLLKCDHKFSLPSPFIDNTVQDIVLGAPWFKSSRRLCAYISCAALREVDTLKILSQILQHNNATDGKKLYVPRVEDKNSHMRMLHISGIDDLIANSMDILEPAPVDVDGNAREDVMQANDPVDLFLLPGLAFDRSGRRLGRGRGYYDTFLKNYQDLAKTRNWKQPLLVALSYSEQILDEGLIPMTSSDLPVDALVSPEGIIIKGKRAVQCPNGM

SEQ ID NO: 161761 - protein, 590 aa, Glycine max
  Coding DNA Sequence Number=SeqID_44983
  Homolog annotation: Hit_ID=Q10C07; Match level="QueryCoverage=64%, HitCoverage=66%, E-value=4e-29, Identity=44%"; Hit description =Expressed protein
  Pfam annotation: Domain name=DUF593; Domain location=319-412; Score =166.0; E_value=9.3e-47; Accession=PF04576.6; Description=Protein of unknown function, DUF593
MGKFTHFVIYVLLEWVLIFILFLDGFLAFLANEFARFFELHIPCWLCTRFDHVMVHRNPDFYYNESVCEAHKKDMSSLAFCHNHKKLSDIRKMCEGCLLSFATEKESDCDTYKSLVGILHKDLECFVQDDQPIQLSLKDDGVMQVDRSSNQKCSCCGEPLKMKSSSNSNIKVKHSSSFARAPTPSPRAFPFSTSKSEEPNGLELHHIRYKELKFMSDPELQEDEFGFNVNSPIVKSSGDTKSTSLPLLGEVEDLNDESSKFTPTFTRGNKFFGIPLTDSANNSPRWTYRINRKSPLEKTEFSSDSNDVNPQTDFDDAILNNLKRQVRLDRKSLMALYMELDEERSASAVAANNAMAMITRLQAEKAAVQMEALQYQRMMEEQAEYDEEALQASNDMLLKREEDLKALEAELEIYRKKYGSLAEENTFSRESNSSIGDNSSSFKLNEGEGNAEKGLNSNQVVSSQAENGGVKHNESVKDFKAEKTYLLGRMKKTENRTPLAESGIYSLLSSSDSVNNLDSETGKGGEAFLPKELSFLTERVKALKANSRFLELVSIRDEKDSEGTKILSEISQNLEKLSHLVMTSFEVANA

SEQ ID NO: 161762 - protein, 89 aa, Glycine max
  Coding DNA Sequence Number=SeqID_44984
MKKMQGLQAPDGATLFIMARKLNSIMDITAQKENWKADKIVAQIKNVDLGKWNDVVKVGAYAVFIQNSMCGSRLFINEDLKDIKDYKNG

SEQ ID NO: 161763 - protein, 86 aa, Glycine max
  Coding DNA Sequence Number=SeqID_44985
MFENCFAKTGLKEHLRCSHDVHYCKIHNFQEKNQIYSKMYPAEEVWQVLPREGLKACGRRFRRFFHEKKMEPAEEGVLPRAPAEER

SEQ ID NO: 161764 - protein, 275 aa, Glycine max
  Coding DNA Sequence Number=SeqID_44986
MEDFQHMVHQCGLVDLGFLGRQFTWSRGTLSERLDRAFASTSWRTQFPKNCNLTVTLRQWDRDVFGHIGKRKRELVRRLAGIDRKIAQRENRYLRKMQGDLWNELENTLFHEELLWFQKSHYIFQDDGVFEPFCFKGCFPRLEASCLEEMRKDCATVGPYLSRLLRQISLNPKEKLSHLILLAVEHRFSKPIKLSRRGANISHLMFADDLILFSEAFVDHVEVISAFLDFFCESSVEKLCRLIRCNLYFYPERCGKRWIKFAGIFFGGIMKMSNM

SEQ ID NO: 161765 - protein, 81 aa, Glycine max
  Coding DNA Sequence Number=SeqID_44987
MESPTVATYPSAAGRCETHGCVFQERNTRGVATNVYLRKNVRKTGKDVVYELYVKGHLRRWTIKQSFDSFERRENIKALDH

SEQ ID NO: 161766 - protein, 86 aa, Glycine max
  Coding DNA Sequence Number=SeqID_44988
FTENEEINGSIVPWNVEIKEVRVRDPLTYASSNKNCQKVARELDVNGSLRLQDSHGNLERYKAKLFAKGFTQKDGVDYKDSFSPFS

SEQ ID NO: 161767 - protein, 103 aa, Glycine max
  Coding DNA Sequence Number=SeqID_44989
MYEIQFWTRTFPYCRSFKLRRYSQNGFSSCVIHNDTGRAIGDDIRHNDGEGRRTWWCGAVLGLICPLSSSGSISFRNNSVGLIEKKKEEGVEEGEEEEIIFWD

SEQ ID NO: 161768 - protein, 180 aa, Glycine max
  Coding DNA Sequence Number=SeqID_44990
  Gene Ontology: Mol. function=zinc ion binding; Cellular component =integral to membrane; Biological process=ubiquitin cycle
  Homolog annotation: Hit_ID=Q1SGA9; Match level="QueryCoverage=59%, HitCoverage=30%, E-value=6e-15, Identity=39%"; Hit description=Zinc finger, RING-type; RINGv
  Pfam annotation: Domain name=zf-C3HC4; Domain location=113-154; Score= 20.8; E_value=0.0011; Accession=PF00097.15; Description=Zinc finger, C3HC4 type (RING finger)
  Subcellular localization annotation: CTP_CleavageSite=69; ConfidenceScore=5.50e-01
MGDFQGPFIVSPPPSLSSSDKSSTTMLYYGLVVVGVAAMALALYNFVIIKRSRRRHMQSQAEGANGLVEVAMESSRIENCQRNNFNLLSSFKYKKEAAKEGSGDGDYDYDDECPVCLSGFEEGEEVRKLPRCKHWFHAPCIDMWLYSHFDCPICRTPVGQFYHRFHSGPELLESGGGVSV

SEQ ID NO: 161769 - protein, 240 aa, Glycine max
  Coding DNA Sequence Number=SeqID_44991
  Homolog annotation: Hit_ID=Q6YUB8; Match level="QueryCoverage=69%, HitCoverage=42%, E-value=7e-34, Identity=53%"; Hit description=Major intrinsic protein-like
SSKLESAEESPVTPPLNRERLPRNMYRPTGMGMGYSSSDSFDHQSMQSRHFYDSNGMNSTPKVSTISAAKTEISSMDASIRSSSSREADRSGDFSISNASDLETEWVEQDEPGVYITIRALPGGARELKRVRFRSQWNLFLGVLMCYTAEKNLGRCMLDYGGKRTVPEYMNNTCPARISYDAQTYEKACHQNEIFFRKYKHKLHASSGTEFISGKRYDNELVTWSLISKSSPWLYDWLWN

SEQ ID NO: 161770 - protein, 334 aa, Glycine max
  Coding DNA Sequence Number=SeqID_44992
  Homolog annotation: Hit_ID=Q287W0; Match level="QueryCoverage=74%, HitCoverage=65%, E-value=5e-15, Identity=30%"; Hit description =Expressed protein
  Subcellular localization annotation: CTP_CleavageSite=34; ConfidenceScore=5.01e-01
MNLRRAVMLEDWMEKHGSHSLNAQLLNSSSSSSECSSAGGIFSSSETDTTTTLTLKKQRPARLTSEKKKKKQDRIMSSEKQNKESGFTRTKLRALKIYGELNQRVKQPISPGSRIASFLSSIFNSQNVKKAKMCYAGAVEDVSFEHKSNSPCFSSIPSSFSRRSCMSKTPSSAKKSNNNEVKRSVRFYPVSVILGEDSEPQSSYHKCNIIYESEPNLGVRSSSIKELKKNTARGNENGAEEAAARGFVKGYRNSGQGEFDFRGFYDDDDEDDDDDVSCSSSDLFELDHLIGAARYQEELPVYETTNLETNKAIASDGSSAVVTSCSLAQLVKAS

SEQ ID NO: 161771 - protein, 118 aa, Glycine max
  Coding DNA Sequence Number=SeqID_44993
  Gene Ontology: Biological process=protein transport
  Homolog annotation: Hit_ID=Q9SKI2; Match level="QueryCoverage=89%, HitCoverage=52%, E-value=2e-19, Identity=50%"; Hit description =Expressed protein
MGEAMKGVTKAMGHMNRQMNLSSLQKILQEFETQNERMELITEVTRDAIDDALEGDEEEEETEDLVNQLLNAPSNAVAASATKTKVPQVGTVGKDAAAIDSYLQARDSSFTGKTGAHL

SEQ ID NO: 161772 - protein, 104 aa, Glycine max
  Coding DNA Sequence Number=SeqID_44994
MEFHKDVDEVREYCLKKRAGKHISLRRFKASFDFLKTKSLEASEPMVETQQGDREKRTIETKFADSPKEDKHHGGSGSDGAGERTLAGKAAGKHKEFAGRRATS

SEQ ID NO: 161773 - protein, 124 aa, Glycine max
  Coding DNA Sequence Number=SeqID_44995
  Homolog annotation: Hit_ID=Q9FI44; Match level="QueryCoverage=34%, HitCoverage=22%, E-value=3e-10, Identity=67%"; Hit description =Arabidopsis thaliana genomic DNA, chromosome 5, TAC clone:K3K7
  Pfam annotation: Domain name=DUF339; Domain location=35-104; Score =9.5; E_value=0.00019; Accession=PF03937.6; Description=Protein of unknown function (DUF339)
MASVGFSTTTSVVTFDTCRKLIVDIPSKATIAAFTNPLHTLRLLYRSNQRGFLELDLVLGKWVEDSIHSLDEILIKALVHVLDMVTEKCSFGVVLLELVTGRSPVQPLEQGGDLVTCVRRAIHA

SEQ ID NO: 161774 - protein, 59 aa, Glycine max
  Coding DNA Sequence Number=SeqID_44996
MEAQSQSQSQDYFGECSYYVMHWMSTIILGTFRNNWEAIIRAREIKSIADPVGTVLSPS

SEQ ID NO: 161775 - protein, 185 aa, Glycine max
  Coding DNA Sequence Number=SeqID_44997
  Homolog annotation: Hit_ID=Q6YUB8; Match level="QueryCoverage=87%, HitCoverage=45%, E-value=9e-23, Identity=40%"; Hit description=Major intrinsic protein-like
MLTCIARPKKPDESDPNNATSAAKSQAVKSLTSQIRDMALKASGAYKHCAPCTGPATQGRFRSNTTESDADSDRFRWSYRRTGSSSSTTTRTWGKEMEARLKGISSGEGTPNSASGRRAEPVVLFVEENEPKEWVAQVEPGVLITFVSLPRGGNDLKRIRFSDDDNDCLLLHLSSRVAFASAYAS

SEQ ID NO: 161776 - protein, 69 aa, Glycine max
  Coding DNA Sequence Number=SeqID_44998
  Homolog annotation: Hit_ID=Q6YUB8; Match level="QueryCoverage=77%, HitCoverage=13%, E-value=1e-17, Identity=74%"; Hit description=Major intrinsic protein-like
  Pfam annotation: Domain name=DZC; Domain location=13-44; Score=39.2; E_value=1.5e-08; Accession=PF08381.1; Description=Disease resistancezinc fingerchromo
MVLCSNAYSSYDDIRTTRENREMFNKWQAQRWWAENYDKVMELYNVQRFNRQAFPLPTPPRSEDEGSDF

SEQ ID NO: 161777 - protein, 303 aa, Glycine max
  Coding DNA Sequence Number=SeqID_44999
  Subcellular localization annotation: CTP_CleavageSite=97; ConfidenceScore=5.10e-01
MVAISLYRGNLHRVPDVPRRWPMPAPKITLKDFKSLLARRSKALSRLQNSNPNPTPTPLPNGSQTEPPPTVTVNHGEGPSTTVAREDGYRKETPLVAVSSAKKPLAGSDSEKPQLDSKIDEASVKKPSDGVAASEEKQTEPVAENVDQLNEKKKRKKEIEEKLQGLNDNKHNLVLVLKQILNAEEELKRRNSMQVVAMHGPSVPLQGDGTNDTGLMIRHMPPRLGSQGNLVAADVDGGEGDDFANYTMHSRHVLRTSSMSPSSESPLRRTPSLQQNVGGYRRVNYGRLAIMCVWISNDERNEV

SEQ ID NO: 161778 - protein, 366 aa, Glycine max
  Coding DNA Sequence Number=SeqID_45000
  Gene Ontology: Mol. function=DNA binding; Cellular component=nucleus; Biological process=regulation of transcription
  Homolog annotation: Hit_ID=Q40880; Match level="QueryCoverage=96%, HitCoverage=98%, E-value=1e-104, Identity=57%"; Hit description=NAM protein
  Pfam annotation: Domain name=NAM; Domain location=21-149; Score =321.5; E_value=1.5e-93; Accession=PF02365.6; Description=No apical meristem (NAM) protein
MDSYYHQHHNPHFDNNNEPHLPPGFRFHPTDEELITYYLLKKVLDSSFTGRAIVEVDLNKCEPWELPEKAKMGEKEWYFYSLRDRKYPTGLRTNRATEAGYWKATGKDREIYSSKTCSLVGMKKTLVFYRGRAPKGEKSNWVMHEYRLEGKFAYHYLSRSSKEEWVISRVFQKNTTGGGSTVSSASAATTGGSSKKTRMTTSNNSSNMSLCPEPGSPSSIYLPPLLESSPYAAAAATFNDRERCSFDSAANNNQREHVSCFSTISGAAFDHLVPSPEPPLDPSARFHRNNNNNVGVGISTFPCLRSLHDNLNLPFFFSPTGHISSAEVASFGAVGNWTAAPEEHRMADSGSGMTIVPSELDCMWDY

SEQ ID NO: 161779 - protein, 350 aa, Glycine max
  Coding DNA Sequence Number=SeqID_45001
  Gene Ontology: Mol. function=phosphatidylcholine-sterol O -acyltransferase activity; Cellular component=endoplasmic reticulum; Biological process=lipid metabolic process
  Homolog annotation: Hit_ID=Q67U60; Match level="QueryCoverage=100%, HitCoverage=49%, E-value=1e-160, Identity=77%"; Hit description =Putative lecithin diacylglycerol cholesterol acyltransferase
  Pfam annotation: Domain name=LACT; Domain location=34-350; Score=3.0; E_value=1.6e-12; Accession=PF02450.6; Description=Lecithin:cholesterol acyltransferase
ITGPLPDPPGVKLRKEGLTVKHPVVFVPGIVTGGLELWEGRQCADGLFRKRLWGGTFGELYKRPLCWVEHMSLDNETGLDRPGIRVRPVSGLVAADYFAPGYFVWAVLIANLARIGYEEKNMYMAAYDWRISFQNTEMDFFSPSFDQVRDRTLSRMKSNIELMVATNGGNKVVVIPHSMGVLYFLHFMKWVEAPAPMGGGGGSDWCAKHIKAVMNIGGPFLGVPKSVAGLFSIEARDIAVARTFAPGFLDKDVFGLQTLQHLMRMTRTWDSTMSMIPKGGDTIWGGLDWSADVSYNCSAKKHKNNDTYSAFQNGKENLGFMKNINYGRLISFGKDIAELHSSKLERLDFR

SEQ ID NO: 161780 - protein, 121 aa, Glycine max
  Coding DNA Sequence Number=SeqID_45002
MDSFKTWFIRYGNTQSNGKEALDEDKLKGFCYLVWRTASMRVYMLRDKAVWRNFHACGGEIYGCFSLKPCLFSFFILAMSYCLVLATTIDPQRKKDDEKEKKQNTEERTGEPVHLEVVTYL

SEQ ID NO: 161781 - protein, 94 aa, Glycine max
  Coding DNA Sequence Number=SeqID_45003
MMFALLARASRLLAKAKAMANVYSTPEEEQMKADMLALKDQMASMTEAMLSIVATCPFAGERGEAHGCTFQRRKDARSRHQRLFVENVGKTKGN

SEQ ID NO: 161782 - protein, 76 aa, Glycine max
  Coding DNA Sequence Number=SeqID_45004
  Gene Ontology: Mol. function=zinc ion binding
  Homolog annotation: Hit_ID=Q5YLY5; Match level="QueryCoverage=79%, HitCoverage=13%, E-value=2e-12, Identity=54%"; Hit description=Zinc finger protein-like
MKTISILLPLNNDTHAEVTQRLTSAKESSSKPALQSHEDLAKKLQVELERNRKASGSKSDGSARRMKEVACPICIV

SEQ ID NO: 161783 - protein, 239 aa, Glycine max
  Coding DNA Sequence Number=SeqID_45005
  Gene Ontology: Mol. function=DNA binding; Cellular component=nucleus; Biological process=regulation of transcription
  Homolog annotation: Hit_ID=Q1S505; Match level="QueryCoverage=56%, HitCoverage=41%, E-value=5e-44, Identity=61%"; Hit description =Homeodomain-related
  Pfam annotation: Domain name=Myb_DNA-binding; Domain location=13-50; Score=2.3; E_value=3.4; Accession=PF00249.21; Description=Myb-like DNA-binding domain
  Pfam annotation: Domain name=Myb_DNA-binding; Domain location=56-100; Score=22.9; E_value=0.0011; Accession=PF00249.21; Description=Myb -like DNA-binding domain
  Pfam module annotation: Pfam domain module=Myb_DNA-binding::Myb_DNA -binding; Domain location=13-50::56-100
MVRYPCEKINVKRGVWTTEEDTKKLAFGSKHRSGLKRCGKSCRLRWTNYPRPDLKDDNFTTQEDLIMKLHAAIGSRWSIVAQQLLGRTDNDVKNYWNTKLKKKLSQMGIDPVTHKPFSKLISDYGNIGDCQKPSTPITSTNKDFKDAMMLGSDPRQTLPQGFTNINDQPKLSPKTIPVSMFGEDCLSKTSSPSTPSTCFTSSAFSWNDFLLEDAFIPFTNQEQRLGEPNRGCDQTKLLE

SEQ ID NO: 161784 - protein, 351 aa, Glycine max
  Coding DNA Sequence Number=SeqID_45006
  Gene Ontology: Mol. function=transferase activity; Biological process= alkaloid metabolic process
  Homolog annotation: Hit_ID=Q1SE38; Match level="QueryCoverage=88%, HitCoverage=70%, E-value=4e-83, Identity=49%"; Hit description =Transferase
  Pfam annotation: Domain name=Transferase; Domain location=1-339; Score=-30.5; E_value=1.8e-09; Accession=PF02458.6; Description =Transferase family
MEASVNINMEEFLNPPKLELLNKLLPCEPNKCHPCQEVLPQLLVQVNLFQCGGIAIGMCNLHILLDAYSCSAFLKTWFAICKGSKEEISSWPDFISASSFFPPRNTIGVRAGMLNINKDSNVEAKCTTRRFLFDSKSINKLESMSSSDETKPTRYQAVSSFMCKHMILACTKECCDTKRPMVALHVVDMRKRMGEPFSKGAIGNLLWPALVLLEDVNKNTNIRDLVRVLKEGLGKLTKELFLKVQNDPRFLWSDECAQLMLEGIATKNPITFVFTSWANMGFNEVDFGRGKPLWLAQRGGTKETIPNTVVLMETKEGIEAWVTMAEKHIANLENDMDFLQFSLVNPSVSNI

SEQ ID NO: 161785 - protein, 49 aa, Glycine max
  Coding DNA Sequence Number=SeqID_45007
MSTEYLYGWRFEPNDKIAVEGEGDVRTKRRRKTTVEGEGATTDERATYE

SEQ ID NO: 161786 - protein, 62 aa, Glycine max
  Coding DNA Sequence Number=SeqID_45008
MVMEKKGRKRRKDFESGMVMEKKGRKRRKGLNDARAYVRKAEEDQELQSDQPQTNHIPICKW

SEQ ID NO: 161787 - protein, 37 aa, Glycine max
  Coding DNA Sequence Number=SeqID_45009
MEEVDSSLSACSCLARSLDFSALKNPQRSSKGLYVGK

SEQ ID NO: 161788 - protein, 86 aa, Glycine max
  Coding DNA Sequence Number=SeqID_45010
  Subcellular localization annotation: CTP_CleavageSite=53; ConfidenceScore=5.24e-01
MRTSDEIGTTATNKTSNTEHGTTKSSNTSLHGTTNRLQKGPPPKQQQTEETNKANGKRNKANGRRNKANGRRNKESAVKHSLNTLI

SEQ ID NO: 161789 - protein, 73 aa, Glycine max
  Coding DNA Sequence Number=SeqID_45011
MISSGIDESEELMVRNEELEITLVVRMIGTVGLWIYQFIDITFCIILIRIFGIPIDIGTIWCPVGGMEHAKGE

SEQ ID NO: 161790 - protein, 49 aa, Glycine max
  Coding DNA Sequence Number=SeqID_45012
GVVLACSPIDAALVATAGGDDRRFLRKIGLGDWAFELQGICMTLKLVMD

SEQ ID NO: 161791 - protein, 250 aa, Glycine max
  Coding DNA Sequence Number=SeqID_45013
  Homolog annotation: Hit_ID=Q8TGM6; Match level="QueryCoverage=48%, HitCoverage=97%, E-value=1e-09, Identity=43%"; Hit description =Protein TAR1
MLSLEPSQKIRSVGGAPTGGSTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 161792 - protein, 63 aa, Glycine max
  Coding DNA Sequence Number=SeqID_45014
MASKPQVGQGALAGSMDGSVSAELRCSTPVTAQDERSFNVLIKNVKDTKKKGQKGIFIEFLGP

SEQ ID NO: 161793 - protein, 481 aa, Glycine max
  Coding DNA Sequence Number=SeqID_45015
  Gene Ontology: Mol. function=calcium ion binding; Cellular component =extracellular region; Biological process=pathogenesis
  Homolog annotation: Hit_ID=Q8XQP2; Match level="QueryCoverage=98%, HitCoverage=87%, E-value=3e-93, Identity=38%"; Hit description =Probable hemagglutinin/hemolysin-related protein
SNGTWTYTPTAPLGEGPHTFTVVATDAAGNTSLPSTGFNIIVDTTPPVAATIASVTDDVGGVQGPLSSGDTTDDTQPLLQGTAPPDAVVTVYDGTTLLGTAILDGSGGWSFTPVTPLTDGPHSLTVHTTDAAGNTSVSSPFVLTVDTVAPATPDIPAITVNPDGTETPLNPGETTRDTTPTLSGTGNPGDTVTIYNGGVKLDDVVVDGTGNWTWTPATPLPNGTYDITLTVTNMDGTGNESAPSQPVTITIDTDAPAAPAVPVITDSVSQITGPVADGETINDPRPVLSGTGTPNDVITIYDSVDGGTPAAVGTVTVDGNGNWSWRPESAIDEGSHEFTATATDEAGNVSDPSTGITITVDTLAPDTPVIGAIAGEPNGGVTTDTTPTVGGTGVTGETVIVYNNGVELGRVVVANGEWSFTLPTQTDGPLNITVAAVDAAGNVSALSPVFTVTVDTTAPEIPLINSVEDSQLTNGTLYTRD

SEQ ID NO: 161794 - protein, 190 aa, Glycine max
  Coding DNA Sequence Number=SeqID_45016
  Homolog annotation: Hit_ID=Q0KIN0; Match level="QueryCoverage=35%, HitCoverage=4%, E-value=9e-10, Identity=40%"; Hit description =Integrase core domain containing protein
MKKYVDLNDTKYLIDRIKKESVEKGNKIKLSESTFQLTKTQSFKLASERDRRKSATKTLQIAPSSELPRASTHRYSFGCCPTRVVHAPPCRHRNLVRVAPAASSAAPGCFPSVGFSFRQACVSASVELWFLGQGHHDHLEKGIDTVPSDRKSEWEKLDYQLCAVLWQSVETDVLEILRSFKTCCSFWKKA

SEQ ID NO: 161795 - protein, 291 aa, Glycine max
  Coding DNA Sequence Number=SeqID_45017
  Gene Ontology: Mol. function=DNA binding; Cellular component=nucleus; Biological process=regulation of transcription, DNA-dependent
  Homolog annotation: Hit_ID=P93417; Match level="QueryCoverage=94%, HitCoverage=55%, E-value=1e-15, Identity=29%"; Hit description =Transcription factor GAMYB
MRPTKRPRESEMLYDSFGSCSINAAPLFDQYGNYTFEKISDHPGLSLPCDPVLNTTDQFHGDNLTGSHAALNGNASASVPIFGAMKLELPSLQYPETQHGSWGPPMSPLPSLESVDTLIQSPTLEPILSDPISPQSSGLLEAIVYNSKSLKGSNNDLLLQETIATANEVANISTLNHSFQTEWDELGDPNSPLGQSAASVLTDYTPVRMCSVDGYQSTETSQDHDDKHEAPTTQFPDSSSKKKILKQVDYTQPDALLDLGWFGNNTKYESDQFVQQDALGALFGDNCQHQP

SEQ ID NO: 161796 - protein, 249 aa, Glycine max
  Coding DNA Sequence Number=SeqID_45018
  Gene Ontology: Mol. function=nucleic acid binding; Biological process= DNA integration
  Homolog annotation: Hit_ID=Q1T010; Match level="QueryCoverage=63%, HitCoverage=11%, E-value=2e-44, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MHRSNTEKMHSHHHKYKCHNFGQVVPQVSPSHTHILIPSTTPKPHTDKIIGMYRVQTRTPNIYTSNLLYFGVRETRENCEVHLSEEQSEKMNGNGGFNTHLPVFDGKNWSRWSIQMRVLFGAQDVLEFVNDGVPDLAENTTEAQRNLHREKKKKDQKALFYIHQCVDAKIFEKIEESTTAKAAWDTLVRCYGGNATVKKVKLQSLRKQYENLNMKHNEKVADYVSRIITVTNEMKTCGETISEQMIVEK

SEQ ID NO: 161797 - protein, 158 aa, Glycine max
  Coding DNA Sequence Number=SeqID_45019
  Gene Ontology: Mol. function=transcription factor activity; Cellular component=nucleus; Biological process=regulation of transcription, DNA-dependent
  Homolog annotation: Hit_ID=Q9LVJ7; Match level="QueryCoverage=63%, HitCoverage=31%, E-value=3e-10, Identity=39%"; Hit description =Nuclear transcription factor Y subunit A-6
PYLHESRHRHALKRVRGTGGRFLSAKQLQQFNAELVTDAHSGPGPVNVYQKKDASEAESHPSRTGKNASITFTAISGLTSMSGNSVSFRRPEHNFLGNSPNIGGSSQCSGGLTFGGGARQCTSVGRLCISTQTFASAFPCILKVALVSVVELDQKVCA

SEQ ID NO: 161798 - protein, 245 aa, Glycine max
  Coding DNA Sequence Number=SeqID_45020
  Gene Ontology: Mol. function=aminopeptidase activity; Cellular component=integral to membrane; Biological process=aromatic compound metabolic process
  Homolog annotation: Hit_ID=Q6YSE8; Match level="QueryCoverage=87%, HitCoverage=87%, E-value=1e-82, Identity=56%"; Hit description =Putative membrane protein
  Pfam annotation: Domain name=Abhydrolase_2; Domain location=36-232; Score=-74.7; E_value=0.031; Accession=PF02230.7; Description =PhospholipaseCarboxylesterase
  Pfam annotation: Domain name=BAAT_C; Domain location=95-234; Score= -77.6; E_value=0.017; Accession=PF08840.1; Description=BAAT  Acyl-CoA thioester hydrolase C t
  Pfam annotation: Domain name=Peptidase_S9; Domain location=61-235; Score=-49.1; E_value=0.0004; Accession=PF00326.11; Description =Prolyl oligopeptidase family
  Pfam module annotation: Pfam domain module=Abhydrolase_2::BAAT _C::Peptidase_S9; Domain location=36-232::95-234::61-235
MVSYVNILLYGVGGLVVAGMALLVAFQEKLVYVPVLPGITKSYAINPSRLRLIYEDVWLQSSDGVRLHAWFIKLFPNCRASDGYPSQHGITKDAQAALDHLSQRPDIDTSRIVVFGRSLGGAVGAVLTKNNPDKWFIGGSSSNGPKVLNFLVRSPWSTIDVVGQIKQPILFLSGLQDEMVPPSHMQMLYAKAAARNNQCLFVDFPTGMHMDTWLAGGDQYWRTIQQFLEQHAPEQKEDRSSQNAN

SEQ ID NO: 161799 - protein, 137 aa, Glycine max
  Coding DNA Sequence Number=SeqID_45021
MIVLGKALCYMNFLKKDGLCTKELLLQELELALNSVSELETVAMESPNIMEAKSEYKLRKSHSLDDVTESVASGFLSMLGLDHSPMGLSFESEPESPRECLLRQFKKEALSEGFSLFDFGMDNDNEADDGYDASFWI

SEQ ID NO: 161800 - protein, 220 aa, Glycine max
  Coding DNA Sequence Number=SeqID_45022
  Gene Ontology: Mol. function=zinc ion binding; Cellular component =integral to membrane
  Homolog annotation: Hit_ID=Q06A78; Match level="QueryCoverage=53%, HitCoverage=46%, E-value=8e-52, Identity=83%"; Hit description=PHD2
MDGGVNYNPRTVEEVFRDFKGRRAGMIKALTTDVEEFFQQCDPEKDNLCLYGFPNEQWEVNLPAEEVPPELPEPALGINFARDGMQDKDWLSLVAVHSDAWLLAVAFYFGARFGFDKADRLEYQDCLLCKRSNEPEPNQSSEEFEDLSGSYSHGFSRSASASLHHISVLKHCALGFFGLGGWGLHLSLLFDGSCQAAVSASELEIPQSPEKPRSGFSNCV

SEQ ID NO: 161801 - protein, 347 aa, Glycine max
  Coding DNA Sequence Number=SeqID_45023
MGFDYNGFGNSMYVLPEEPLPLPPLAEGLGPFLQTKEWGVSNPLVMLAEMGSGIMEILQCLASLGIEKLSMQANKLIPLEDITGKTMQQISREAKLVLEETHRQYHLQHDLVTGQDSICTQSGLKGTLSGGLESDKFSSSSIGDQRGSEFVSLEDLAPLAMDKDEPSNIIAQSLGGICALQGNKGGLRIQSGMLNEDEPSNIIAQSLGGICALQGNKWGEKDSSSDGVDGIIGLSLTLDEWMRLDCGEIDDDIDNIGEHTSKLLAAHHIMAGNNNDECEIVAKVELKANKEDKSSEEEEEAIPQFRITEVHVAGLKTEPHKKKNNKDPLLKSKGVSKSSAKITTANV

SEQ ID NO: 161802 - protein, 187 aa, Glycine max
  Coding DNA Sequence Number=SeqID_45024
MSKTEGGQKSAEEENDVLCVHWKRRGALLVTPPAKVIQGVAEFQDILTRNCSIHGSRSGPHNSAKYEAKHFMLLLSLVPQDLIWGSTGWISQGCSLSHWKSLNRRKTLGNGLQRRWGIFMRCCHHQHYHEPAHEKEKPEENSGNEGKTCSLVHVKPELDVFQEILETVKPDDYRLPDSGIESFKERE

SEQ ID NO: 161803 - protein, 94 aa, Glycine max
  Coding DNA Sequence Number=SeqID_45025
  Gene Ontology: Cellular component=integral to membrane; Biological process=defense response to Gram-negative bacterium
  Homolog annotation: Hit_ID=Q9LTR7; Match level="QueryCoverage=87%, HitCoverage=55%, E-value=1e-12, Identity=40%"; Hit description =Arabidopsis thaliana genomic DNA, chromosome 5, P1 clone:MHM17
MVFHRNKLCHLCLAYARVEETVDLRTNVELVRSVSDKHHDLLRPSARNLSRGQSTDAAGHGKGKYALIRDPEVFQTGVYDKPLPFFGCGIGWFS

SEQ ID NO: 161804 - protein, 294 aa, Glycine max
  Coding DNA Sequence Number=SeqID_45026
  Gene Ontology: Mol. function=nucleic acid binding; Cellular component= intracellular
  Homolog annotation: Hit_ID=Q8S8S8; Match level="QueryCoverage=95%, HitCoverage=90%, E-value=9e-45, Identity=42%"; Hit description =Expressed protein
  Pfam annotation: Domain name=zf-LYAR; Domain location=17-44; Score =60.4; E_value=5.8e-15; Accession=PF08790.1; Description=LYAR-type C2HC zinc finger
MTKINTRKTNQQRLDHLSCIDCGEIFGRDTVQDHTQCITEAEKYGPKGQGKTLNVATANPNKDSKQRPDIDINVGLSDRPPWFCSLCNTKATSKQTLLLHADGKKHRAKARAFHASKQQPVEADKSTTDAKVAVETAPNDDVRDGKNGGLPKLQESSEQNNSKPGNEISSAKKKRKLEALEDDRIKKTKNDTSVDMGNGEVIQGEEATGESNLKKERSAVKNKIKWKKFIKSALKSHPDRILKMKKLRKVVLRALQECGIVVDDTELSEALEQKINSSSRFAVENKYVRLLAKD

SEQ ID NO: 161805 - protein, 91 aa, Glycine max
  Coding DNA Sequence Number=SeqID_45027
MKKQIARKKIPFHMHCNQGNSQEERVCSCEIKNAETLVRIGMKLKKKELLYQQERMQRERNGSNKKVCENGKAGKVVMREKERERKGHEYL

SEQ ID NO: 161806 - protein, 656 aa, Glycine max
  Coding DNA Sequence Number=SeqID_45028
  Gene Ontology: Mol. function=galactosyltransferase activity; Cellular component=membrane; Biological process=protein amino acid glycosylation
  Homolog annotation: Hit_ID=Q10BV0; Match level="QueryCoverage=97%, HitCoverage=98%, E-value=0.0, Identity=58%"; Hit description =Galactosyltransferase family protein, putative, expressed
  Pfam annotation: Domain name=Gal-bind_lectin; Domain location=167 -376; Score=167.1; E_value=4.4e-47; Accession=PF00337.12; Description= Galactoside-binding lectin
  Pfam annotation: Domain name=Galactosyl_T; Domain location=422-610; Score=60.9; E_value=4.2e-15; Accession=PF01762.12; Description =Galactosyltransferase
  Pfam module annotation: Pfam domain module=Gal-bind_lectin::Galactosyl _T; Domain location=167-376::422-610
MMKRKLETLVWLTRKRSIQFLIGVFFLYLVLVTLELPFVFRTDFATVTTTRSPRLLSEEDSLRKDSPARPLKTVSNADSPSQLARRRSSVVSALVLNDAAFGSHVNNGSSELYKQVKHAREVGRSLWEDLESGKPLTRTVAARAAENRSGSCPGSVSLSGPDVVDVSGVVPLPCGLTLGSHITVVGKPLEARPDFEPKITVVTEDEPVMVSQFVVELQGLKTVDGEEPPRVFHFNPRLKGDWGGKPVIELNTCYRMQWGSALRCDGWKSKADEDTVDSMAKCEKWIRDDEDHLEGSKATWWLSRLIGHTKKVTIDWPFPFSEGKLFVLSISAGLEGYHVSVDGRHVTSFPYRAGFTLEDATGLSLTGDIDVHSVFAASLPSSHPSFAPQRHLEFSTRWRAQPLHDSGIELFIGVLSAGNHFAERMAVRKSWMQHRLIKSGVVVARFFVALHARQEINAELKKEAEFFGDIVIVPYLDNYDLVVLKTVAICEYGVHTVSAKYVMKGDDDTFVRVDAVIDEARKVPDGTSFYIGNINYYHKPLRYGKWAVTYEEWPEEDYPPYANGPGYILSSDIARYIVSEFEMHKLRLFKMEDVSMGMWVEQFNSSKPVHYSHSLKFCQFGCIEDYYTAHYQSPRQMMCLWDKLQRYSRPQCCNMR

SEQ ID NO: 161807 - protein, 421 aa, Glycine max
  Coding DNA Sequence Number=SeqID_45029
  Gene Ontology: Mol. function=aminoacyl-tRNA ligase activity
  Homolog annotation: Hit_ID=Q2PF39; Match level="QueryCoverage=96%, HitCoverage=55%, E-value=1e-112, Identity=55%"; Hit description =Aminoacyl-tRNA synthetase
MWDWLPYLNRMEKLFTSKNRTEASVGKKVKIDMLPEIEKVHRRKEKLLKKQHRQALLLDNFLGVDGLAPGRSLRDRKPVTYTFDDYDRSISEAIKITKRKPPSPELIPRREAGAKHAALTNGKWSGPSHDPQDLNFGMPSPKSPDFDDMEEDNQTDMLDLDRSNRRRQKPKRYSEKEFVEALSDNEADYDSDDDIVGEAVYDEEYLQKRKQRKKASSSSGSEGDEEYHWDEDNVEDEEDDDEDSLSASEDSDKPRKIKQLPGRTRKETKLRSVGEIQSGLRRSKRATTKSRINYRRYEISDSETEFIKSDKSNASDDHSDPTENGEYMMESEDSDSNDEEEQETKAVEPVTYPAEENNQSPAVGENEQNQNQPPEKASSPGQEVEGTAKRRFLDLNELAHSSGFDDGPNTTTLKDEGNDDN

SEQ ID NO: 161808 - protein, 82 aa, Glycine max
  Coding DNA Sequence Number=SeqID_45030
  Homolog annotation: Hit_ID=Q1T1H9; Match level="QueryCoverage=37%, HitCoverage=10%, E-value=2e-07, Identity=80%"; Hit description=SAM (And some other nucleotide) binding motif
MVTKEERADEKKRKCCSSKYQVHGSETEGSLLILSGICLRVATHTCTFLQSKVFDGSLEGYVLYLFGQLMHLNVRRTIPEYK

SEQ ID NO: 161809 - protein, 187 aa, Glycine max
  Coding DNA Sequence Number=SeqID_45031
  Homolog annotation: Hit_ID=Q2PF39; Match level="QueryCoverage=40%, HitCoverage=10%, E-value=7e-15, Identity=59%"; Hit description =Aminoacyl-tRNA synthetase
  Pfam annotation: Domain name=DDT; Domain location=112-170; Score =10.4; E_value=0.048; Accession=PF02791.7; Description=DDT domain
  Subcellular localization annotation: CTP_CleavageSite=68; ConfidenceScore=5.05e-01
PPQDTTEPSPEPDSYKEETTATTTNSTAADAAPPAPTRSPPTRSRPSRACTMRTAARLYAASQPARPKAARREPRREESPSPPSPKLQQCSKIVTPLVEPPPPVQLPRYNLRSMWELASILNFLNLFRPLLNISVEFSAEEFETALLTPNDTLGDIHMPLLKFCASFVECAVAWVGEKFGAMKWSSC

SEQ ID NO: 161810 - protein, 130 aa, Glycine max
  Coding DNA Sequence Number=SeqID_45032
MSHAQRCLTEEEKNDDAPSGNRNLKSYLSTLSQTFLSSLFLCSYFSPIFPRRYAKTETYGTSLSISLLINEEKKILSKIVNVLSKVRGEGFSNILSNPRLTTFSKKQAIIFPSYRYMWVNMVYHAESFIS

SEQ ID NO: 161811 - protein, 88 aa, Glycine max
  Coding DNA Sequence Number=SeqID_45033
MVPESTTTPPLPWPSIRGIGCGVWCGCDKDDFCNSGGGGRVDTTSRMGGEGGGMAREEGRDGGGAVVTAGERGRSNGQEHEDRRIVHS

SEQ ID NO: 161812 - protein, 50 aa, Glycine max
  Coding DNA Sequence Number=SeqID_45034
  Subcellular localization annotation: CTP_CleavageSite=7; ConfidenceScore=5.13e-01
MRERGVSSSTPAPMCTVGTLTFRPTPSRKRKPFPPKSPVPHTLRAAFPYI

SEQ ID NO: 161813 - protein, 170 aa, Glycine max
  Coding DNA Sequence Number=SeqID_45035
  Homolog annotation: Hit_ID=Q9LSJ7; Match level="QueryCoverage=94%, HitCoverage=83%, E-value=1e-21, Identity=33%"; Hit description =Arabidopsis thaliana genomic DNA, chromosome 3, P1 clone: MFJ20
  Pfam annotation: Domain name=FlaC_arch; Domain location=11-131; Score= -9.8; E_value=0.028; Accession=PF05377.2; Description=Flagella accessory protein C (FlaC)
MAGTGMGRGSDSQKQLWSLIRNFAAEKSQGERRVVNLRKQIEKLKSELSEANAELENAKRCKELVEQDLKGFEVQLMLTESSAQTLEARVSLIQNHISAVGSDLETLKTFAWKLRMHFDIVLDASQVTMKENDAEVAIMALESTLLEVVSQIAKEDEEYQAEQKNYENVR

SEQ ID NO: 161814 - protein, 393 aa, Glycine max
  Coding DNA Sequence Number=SeqID_45036
  Gene Ontology: Mol. function=DNA binding; Cellular component =membrane; Biological process=DNA integration
  Homolog annotation: Hit_ID=Q1S1B7; Match level="QueryCoverage=73%, HitCoverage=58%, E-value=3e-44, Identity=31%"; Hit description =Integrase, catalytic region
MLLIGACGRKPEEAWCGRKPTVNHFRIFGCIAYADIPNKKRSKFDDKERFWENNIDEAKQILANFDEDNEDEELQTRELEEQRIPAIIVEYERPQRARRRHAWMSDYEELCDLPNGHNTIGVKWIFKTKQKENGEVDKYKARLVAKGYKQQYGVDYTEVFSPVARHDTIRNCTLMFDEFKKSMMNEFGMIDLAMMHYFLGIEIAQSDVGIFLSQKKYVRDILDIFQMHDCNSVNTPVEWGLKLHKDPEGIKINSTLYKQIVGSLMYLTTTRPNIMYFSAAISWSSWKQPIVTLSTTEAEFIAASTCACQAIWLRNILEEVHFKQQGPTLIYFDNSSTIKLSKNPIMHGRSKHIDVRFHFLRDLSNEGIIDLIYCKSEEKIADIMTKPLKLSTF

SEQ ID NO: 161815 - protein, 182 aa, Glycine max
  Coding DNA Sequence Number=SeqID_45037
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=75%, HitCoverage=55%, E-value=2e-61, Identity=86%"; Hit description=MADS -box protein GmNMH7
  Pfam annotation: Domain name=K-box; Domain location=71-172; Score =65.0; E_value=2.4e-16; Accession=PF01486.8; Description=K-box region
  Pfam annotation: Domain name=SRF-TF; Domain location=9-59; Score =110.0; E_value=6.9e-30; Accession=PF00319.9; Description=SRF-type transcription factor (DNA-binding and dimerisation domain)
  Pfam annotation: Domain name=zf-CCHC; Domain location=147-164; Score =19.2; E_value=0.00067; Accession=PF00098.13; Description=Zinc knuckle
  Pfam module annotation: Pfam domain module=K-box::SRF-TF::zf-CCHC; Domain location=71-172::9-59::147-164
MARGKIQIKRIENNTNRQVTYSKRRNGLFKKANELTVLCDAKVSIIMFSSTGKLHQYISPSTSTKQFFDQYQMTLGVDLWNSHYENMQENLKKLKEVNRNLRKEIRQRMGDCLNELGMEDLKLLEEEMDKAAKVVRERKIVFTPGQDKCFLCGLMGHMAANCEGKAKRKVEQESLMKKERLL

SEQ ID NO: 161816 - protein, 93 aa, Glycine max
  Coding DNA Sequence Number=SeqID_45038
MTRQNRCKKASITDVESLFCSSVSGFSRLNFQKLELCLYYELLVLRVSMSHSSGLKVKDSDEIEHTYKSWNLLGEELEPLSIKELHSLEETTG

SEQ ID NO: 161817 - protein, 94 aa, Glycine max
  Coding DNA Sequence Number=SeqID_45039
MSFRTCGKAWAEQMRKMSDKEFSTSALFSWFRVVHDVWILWKLGGVDHPVMRGTRIRATWGYVSLVESGQLVMVGSCLICGCGRVDLHHRPIAT

SEQ ID NO: 161818 - protein, 329 aa, Glycine max
  Coding DNA Sequence Number=SeqID_45040
  Gene Ontology: Mol. function=O-methyltransferase activity; Cellular component=integral to membrane; Biological process=antibiotic biosynthetic process
  Homolog annotation: Hit_ID=Q2AKN9; Match level="QueryCoverage=67%, HitCoverage=95%, E-value=1e-66, Identity=56%"; Hit description=O -methyltransferase, family 3
  Pfam annotation: Domain name=Methyltransf_3; Domain location=122-328; Score=107.7; E_value=3.3e-29; Accession=PF01596.8; Description=O -methyltransferase
GYSQSQCNQALYAYEKTVRNAFAEVNNSLDAITRYQEQLTELLAQQDVARETLRIAQNRYRNGYSSYLDVLDAQRSLFSVQTSVVQRWAAAGSVPEDLPGGAALTGPGFRPVGRWSAVDNFMISSLIPEDDILNQVLENNKRAGLPEHDVAANQGQLLALFVRMTQARRVLEIGTLGAYSSIWMARALPPDGRLITLEADPTHADVARQNIVLAGLNERIELIEGPALNSLEKFGDIPPFDLIFIDADKPNNPGYLEWALHYSRPGTLIIGDNVVREGEVINGQSDDARVQGVRRFIEMTGDNPRLTATALQTVGVKGWDGFTLAIVNE

SEQ ID NO: 161819 - protein, 139 aa, Glycine max
  Coding DNA Sequence Number=SeqID_45041
  Homolog annotation: Hit_ID=Q1SKD7; Match level="QueryCoverage=52%, HitCoverage=19%, E-value=2e-07, Identity=36%"; Hit description =Ankyrin
MALQQGKIRVMIAGEDVAEKQRHLDLCQGGHASAHDPHPPSRHTSWDPLAPHLGALIPDSFLYGPCISIEFHDYFWVIFSHGPCELSPLPPGNFLLELSVFSLSQLDPSLLEERPTLDRFKAVLVFLTSESVSIKFYIR

SEQ ID NO: 161820 - protein, 71 aa, Glycine max
  Coding DNA Sequence Number=SeqID_45042
MKSGDMRGYRMVYFSRPKIFKPNDARDSSLLGGDDQISKEGQLPYPNFIRGPLFGGMQPSLDHLEVLNTLR

SEQ ID NO: 161821 - protein, 121 aa, Glycine max
  Coding DNA Sequence Number=SeqID_45043
MVKEKCKEVSVSSKRLTKKESHFAIKKNIKETSLLRQHSHLLLCKRTLVSIVIPLELEVIPQENESLDDGLVRKSLNSCALLVPKIGVEGRSPKFQEPLDLRSNPFQGGRDDAIQAPKSIR

SEQ ID NO: 161822 - protein, 276 aa, Glycine max
  Coding DNA Sequence Number=SeqID_45044
  Gene Ontology: Mol. function=protein serine/threonine kinase activity; Cellular component=anchored to membrane; Biological process=protein amino acid phosphorylation
  Homolog annotation: Hit_ID=Q1SLH3; Match level="QueryCoverage=79%, HitCoverage=92%, E-value=3e-68, Identity=53%"; Hit description =Thaumatin, pathogenesis-related
  Pfam annotation: Domain name=Thaumatin; Domain location=25-221; Score= 181.2; E_value=2.5e-51; Accession=PF00314.8; Description=Thaumatin family
  Subcellular localization annotation: CTP_CleavageSite=14; ConfidenceScore=5.10e-01
MAFTTVVFFLGFLSGSYGATLMVTNKCSYTVWPAILSAARSLPVHTPGLVLQPGDTNTIQVPPTWSGRLWGRTLCSYNITGSFTCVTGDCISSTVECGGATAPVTLAEFTLNGTGGLDYFDVSLVDGFNLPLVVEPRSAIGAENCRATGCRRNLNKKCPVELQVIKEGEGVVGCKSSCEVHEPCSNNSNLFSHFLKTRCPDAYHNASFTCVSADFTITFCPAFSKSMLIRTSEQKISSWGGGTLIPLRPLAPDEDTHTYCVLSFYFKLLRMQRGIL

SEQ ID NO: 161823 - protein, 186 aa, Glycine max
  Coding DNA Sequence Number=SeqID_45045
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=130-147; Score =29.2; E_value=1.4e-05; Accession=PF00098.13; Description=Zinc knuckle
MDKLQRLRQGSMSVEEYRQQMELLLLRARLRGEERTSIARFLSGLNMEVRDEVDLLPYRNLDDLAQLCIMVEQQLKRKPTSKSYGSHSYPKKDQGQGILGAAASKPKDDKGKTIEKQPPKASMQEKTSSIKCFKCLGIGHIASQCPTKKTMIMRGQEIYSCQDEVTTSPSSSESEEVKGEEPSEEI

SEQ ID NO: 161824 - protein, 265 aa, Glycine max
  Coding DNA Sequence Number=SeqID_45046
  Homolog annotation: Hit_ID=Q5IGR9; Match level="QueryCoverage=36%, HitCoverage=56%, E-value=6e-36, Identity=75%"; Hit description=NAC -domain protein
  Pfam annotation: Domain name=NAM; Domain location=31-124; Score=88.7; E_value=1.7e-23; Accession=PF02365.6; Description=No apical meristem (NAM) protein
MLKNVDTSEVVRGPHDAPGHWLVTAAKLVIELVLQYLKRKVFSYPLPASIIPELHVCKSDPWDLPGDLEQERYFFSTKVAKYPNGNRSNRATNSGYWKATGLDKQIVTSEASLLMDSELIGSCTSIGSSLTALSLRSCRKPRDVDDDLDGDDRKSEREIVTANIPLVVTGARERDGERKDRDKDRKRRDKDRRDRDRDRERERREKDRERERERAERERAERERSTRSRSRSERDRDREQDFDMCDARAVYGGKANGVAIILCKD

SEQ ID NO: 161825 - protein, 139 aa, Glycine max
  Coding DNA Sequence Number=SeqID_45047
MLKQADGSYACIAENANRFSLGELHTNPLTDIGQRGIVEGLGTSRRRGKLSRISSKRLQGIIVAITCSSAVVKLGARHICCPLLVLSLEDVLVKLMFWALGTSVLDYYAALNIIKLFFISPIQDALKCAASGSQLGLPT

SEQ ID NO: 161826 - protein, 301 aa, Glycine max
  Coding DNA Sequence Number=SeqID_45048
  Gene Ontology: Mol. function=DNA binding; Biological process=DNA integration
  Homolog annotation: Hit_ID=Q1SLU3; Match level="QueryCoverage=50%, HitCoverage=14%, E-value=3e-31, Identity=39%"; Hit description =Integrase, catalytic region
  Subcellular localization annotation: CTP_CleavageSite=50; ConfidenceScore=5.21e-01
MDPFPPVNHVLSMIIQQERHNSSSPITIESNTFVNVAQSTFGRRRGRGVPAGQSSDNTQTFSNKKCIYCGRRPRFHNKESSSSSATVNNVAQEEDPHSSMNPNSPSNGLGYGFTKAPYHSLLGLLQQQSNGPGASSQPKNVNLIQVSSVGTSNSTNIGLSHTCPSDALPTSMPSHQSSSKVSYPIHDSLDYSRLSPYSHYLMSLSSEHEPTTYREAATQPCWQEAMNVEIWALVSNHTWDIVQAPPNVCPIGCKWVYKIKRGPDGTIERISSINNWHLQQLDVSNAFLYGDLTEDVYMTIP

SEQ ID NO: 161827 - protein, 96 aa, Glycine max
  Coding DNA Sequence Number=SeqID_45049
  Gene Ontology: Mol. function=serine O-acetyltransferase activity; Cellular component=cytoplasm; Biological process=cysteine biosynthetic process from serine
  Homolog annotation: Hit_ID=Q8L5G2; Match level="QueryCoverage=56%, HitCoverage=22%, E-value=2e-19, Identity=81%"; Hit description =Serine acetyltransferase
  Subcellular localization annotation: CTP_CleavageSite=65; ConfidenceScore=5.02e-01
MSTTRFRKMTLCAMGGDREFSSQDMTKNFFQLAFFTWTSPFGAGSVVIKDVPPRTIVVGNPAKLVGGKNSSVKLDKISIFTMDHTSHIADFYDYCV

SEQ ID NO: 161828 - protein, 135 aa, Glycine max
  Coding DNA Sequence Number=SeqID_45050
  Gene Ontology: Mol. function=RNA-directed DNA polymerase activity; Cellular component=chromatin; Biological process=chromatin assembly or disassembly
MRLHKEPTALSWPHCVQLRGFLHLTGFYQKLIRAYAAIISPLTTFLRKDQFSWQLALQQAFDQLKHLMTQAPVIATPNFSLPFTVEIGTSGTTLGVVLLQNSHPIAYYSKVFCPHLQKASTYVHELHAITSTVHK

SEQ ID NO: 161829 - protein, 210 aa, Glycine max
  Coding DNA Sequence Number=SeqID_45051
MARTKQTSYIAGYNPHEGFLYEREDPQSMLVVDRIIGPPFGGGLVDLSLIWSYRDDYVGHVLPLPTNLQASDYVERSSLIENGEDPIDDSSWHFSRGRGWSGGKHRIDMRPYRPERGNVVPLEDPWTCTSNYLPWFYKVSHPYVILLDEGKPSRGAMQSIEDLKVMPKGIHHQLIQQALQLLHKGFMARCISGIQRQKKRIAKDCGKGDK

SEQ ID NO: 161830 - protein, 134 aa, Glycine max
  Coding DNA Sequence Number=SeqID_45052
MTTCMQEHSTYTTHKTRQNPSSTLTDPYRSTKSKAQPWLISAKLRRLDKTQGKHVPGLRLDKLKVHPWNIGLSKTQGSSLVLTSPKPKARPWYTFYAKPKVHPWYSYLQNPRSTFGTYFYKTQRDLLGLLTCSN

SEQ ID NO: 161831 - protein, 502 aa, Glycine max
  Coding DNA Sequence Number=SeqID_45053
MERVDKEILEQLSASLDARTILALPSASNPLATLDGIVCDLAWRSLMKQVGPGGGTVPPSTATSSVEEGGQPADEVGHIVVAAEPQDVPPAPPAIKAPTVNTATVAPSPPSIVAIQEVAPTAIEVVMPTTQAGSVVALSSTVVAPLLSVGVAATSAPTMLSPSSATPVTSPFTVLVAVGATYKSEQKTPIGFVSAFDKNLIRSSGENGLRHQEAMQKEASLEVKVAKWRVTACTLWRVEHPKVANATVAFVEVVRSNRQLSSKVSGVLTKLLRTQLDGDELFGYCKDLQAEKMNLSDKVESLAIERDGLAKVVVDLEARLKESESKLEASELQAAKTREATRELEEELFLYKKEAIKQAGFFDPFKDVKDGVLLNEEKIAAKEETANEGHLRFDFNLVKGLVTHLVGLPSVLWNFSPDGSSLLMVMRSWCELNQIEGLIMQLVAVHLVELGPWTMIVLVTASKQTKEVPLGFVEVCTKGGPWVLETYIPAQIKVRNKKDCQG

SEQ ID NO: 161832 - protein, 310 aa, Glycine max
  Coding DNA Sequence Number=SeqID_45054
TNIVICTLCQPGASEPVDTQRLTSSSAPLSSRYGRSDDMRRYLSGYPYKMISVNPDPRSQVVDGDTQVIIQTNVVICTLCQPRASEPADTQRLTSSFAPLSSRDDESDDMRRYPSGYPYKRFLLNLIQEVRRRYLVVIRTFCQPAASEPVDTQRLTSSSTPLSSRDGESDDMQRYPSGYPYKMISINLDPRSQVAGKDTQVVIRYKRFLLILTREVRWQAEIPQVVIRTHTILLAQPVRSQVACGDALYGGSNWAASSSTLPKNVKYKKGGELSNWGALRNLPQDASRRQAPPFFPINKGGGAVSNVHDP

SEQ ID NO: 161833 - protein, 60 aa, Glycine max
  Coding DNA Sequence Number=SeqID_45055
MDNAYVSTSPPMGPENQLNDRKLTILLRGLSDSNLSMSSMRTCPKERGERIPIKGTSTLK

SEQ ID NO: 161834 - protein, 67 aa, Glycine max
  Coding DNA Sequence Number=SeqID_45056
MGWISCSFKMNCRDEAPKLIVTGVTSKGNASDESVDEGVFEDVLAVGRDGGSKSGIGAEEWRRGHTR

SEQ ID NO: 161835 - protein, 401 aa, Glycine max
  Coding DNA Sequence Number=SeqID_45057
MVLIEGSSLEESVDNGSEVCGYNDEVFEVSSNSNFLGIFEPVAKKMGENITTLVAMDATDTRTSMRVAPQLKKSPVQKEKCSHAPITLLGYTWVDGEVRLPFDDFLAIRASYPKRGFNATSSKWSFARQGSMDIVDLDTKTKPFVSFLPIGNNAPARIMTQANANMNAFCLACRNQIVVSKGPLNPHLNRTSGPCDAPTDVVPPPVTVTTKVARGKLLVIRKGAPERKKVKQQMLEFQPSTTTTLANFSALTNQGLFVKDFQLDRLIPPTMISNHGWQVLSKSNDTANWAIFWAFLAKGLETRTTNVEAFVRSWDGEISRLRSTLVVAEKEKEEAAVLHLCEFSDLGVFGINKDVYYGELMLIDDILKDATPTLERLMTPTKDFQDDGAGAEDEDHVWPRD

SEQ ID NO: 161836 - protein, 159 aa, Glycine max
  Coding DNA Sequence Number=SeqID_45058
LISLAQLVYGTGMVFGIDCLRTCQGGLVVCLSYIDQGDRGHTVRPDNGALPTNSFDKGVEGVYGPRKASKCSCGSIVPLYCSRLSGFHPKGMFVSVIQSTKGCRRIVRPTGWCMQGVGGLLVVLGTSDMSLYLIMLSNEDGSLGEGFGLRPDQVLTMDE

SEQ ID NO: 161837 - protein, 601 aa, Glycine max
  Coding DNA Sequence Number=SeqID_45059
  Gene Ontology: Mol. function=protein serine/threonine kinase activity; Cellular component=flagellin-based flagellum; Biological process=protein amino acid phosphorylation
  Homolog annotation: Hit_ID=Q8W4I7; Match level="QueryCoverage=95%, HitCoverage=100%, E-value=0.0, Identity=64%"; Hit description =Calcium-dependent protein kinase
  Pfam annotation: Domain name=Pkinase; Domain location=74-332; Score =330.7; E_value=2.5e-96; Accession=PF00069.15; Description=Protein kinase domain
  Pfam annotation: Domain name=Pkinase_Tyr; Domain location=74-336; Score=-15.6; E_value=1.6e-11; Accession=PF07714.7; Description =Protein tyrosine kinase
  Pfam annotation: Domain name=RIO1; Domain location=89-241; Score= -97.1; E_value=0.083; Accession=PF01163.12; Description=RIO1 family
  Pfam annotation: Domain name=efhand; Domain location=404-432; Score =38.0; E_value=3.3e-08; Accession=PF00036.22; Description=EF hand
  Pfam annotation: Domain name=efhand; Domain location=440-468; Score =27.8; E_value=3.8e-05; Accession=PF00036.22; Description=EF hand
  Pfam annotation: Domain name=efhand; Domain location=476-504; Score =30.1; E_value=7.9e-06; Accession=PF00036.22; Description=EF hand
  Pfam annotation: Domain name=efhand; Domain location=512-540; Score =41.0; E_value=4e-09; Accession=PF00036.22; Description=EF hand
  Pfam module annotation: Pfam domain module=Pkinase::Pkinase _Tyr::RIO1::efhand::efhand::efhand::efhand; Domain location=74 -332::74-336::89-241::404-432::440-468::476-504::512-540
MGNCNACAKADVVEDSTNNRNKKSNETNRGGRKKEQNQKKPNPFSDEPARSAAPIRVLKDVIPMSHRTRISDKYILGRELGRGEFGITYLCTDRETKEALACKSISKRKLRTAVDIEDVRREVAIMSTLPEHPNIVKLKATYEDNENVHLVMELCEGGELFDRIVARGHYSERAAASVARTIAEVVRMCHSNGVMHRDLKPENFLFANKKENSALKAIDFGLSVFFKPGERFVEIVGSPYYMAPEVLKRNYGPEVDVWSAGVILYILLCGVPPFWAETEQGVALAILRGVIDFKREPWPQISESAKSLVRRMLEPDPKKRLTAEQVLGGNWEGGEFGMKTTSHFLDMTKIREEHPWLQNAKKAPNVPLGDIVRSRLKQFSVMNRFKKKALRVIAEHLSVEEVEIIKDMFTLMDTDKDGRVTFEELKAGLRKVGSQLAEPEIKMLMEVADVDGNGVLDYGEFVAVTIHLQKMENDEHFHKAFKFFDKDGSGYIELGELEEALADESGETDADVLNDIMREVDTDKDGCISYEEFVAMMKTGTDWRKASRQYSRERFKSLSLNLMKDGSLQLHDEITGQAVVHSNDLELELELVILVAWMLDA

SEQ ID NO: 161838 - protein, 99 aa, Glycine max
  Coding DNA Sequence Number=SeqID_45060
MEHFGKVALNIRKLDPAVAMHHLITVLRSGAFANILCKKPAFDLNELRMRMAKYMQMQELAKYRNQEFVHKPQSYRPNNPYRPESSRRKNREHVGRSER

SEQ ID NO: 161839 - protein, 323 aa, Glycine max
  Coding DNA Sequence Number=SeqID_45061
  Gene Ontology: Mol. function=RNA-directed DNA polymerase activity; Cellular component=intracellular; Biological process=RNA-dependent DNA replication
MAAQFIREINYSTWLSNVIIVKKQNKKLRMCTNYIDLNRACPKNAYPLSNMNHLVDGANRHKMLSFLDAYSSNNKIKMDLGDEEKKIFITEFANFCYKVMPFGLKNAGVTYQRLMDKVFKSHLGQNLEVYVDDMVVKYDNLATPITDLKEVFGQLRRYNMRLNTKKFVFEDDECEKAFWHLKETLATLSVLLKHGTNKKLIVYLSVSSEVLRGTSIRRRKLFEASIFCELSATGSRNEVPNDGKGMVDGACRRLLQSTWKWNWGDLRRTQWHSCGSIFTFWLQGHMKLGRIQGSPNGTKTCQRGQRWSDSKVVAAQINKVFHI

SEQ ID NO: 161840 - protein, 219 aa, Glycine max
  Coding DNA Sequence Number=SeqID_45062
  Gene Ontology: Mol. function=RNA-directed DNA polymerase activity; Cellular component=intracellular; Biological process=RNA-dependent DNA replication
GVVVKAFDGSRKSVIGEVDLPITIGLFVFQITFQVMDIQVAYSCLLGRPWIHEAGAVTSTLHQKLKFVRNGRLITVSGEEALLVSHLSAFSFIGADETEGTSFQGLTVEGKKPEKNEVSFATWKSAQKVVQEGTGVGWGKVVQLIESKNREGLGFASSAGSATNSVGSSSITSTFCSAGFINNSPEANAVLEDVPEERVLAFVTPGKLVRNWDAVDVPS

SEQ ID NO: 161841 - protein, 254 aa, Glycine max
  Coding DNA Sequence Number=SeqID_45063
  Gene Ontology: Mol. function=RNA-directed DNA polymerase activity; Biological process=RNA-dependent DNA replication
  Homolog annotation: Hit_ID=Q1SD42; Match level="QueryCoverage=52%, HitCoverage=12%, E-value=9e-11, Identity=34%"; Hit description=RNA -directed DNA polymerase
MEGFSVLIGRAKWRGELHGVNHLLFADDCFIFCKVDGVECELLANILENYGNASGKLINFHKSEAMFSKNTPLIGRVGGQGMEENPVMDREVTTQVCHVQVFGVPKLFYGRVVDCVWGVGRILGCGAMLGLGEKHMHLFNQSLPHILEISLLGIFSSQGSRCWNKDLLKAFLERKDVEEVLKFPILPHNGKHKRKAILREVCRWPIFNMIYIPWGKEHGGYAASEGPWELEPTVVSVRINVSCERRVTYVGTNK

SEQ ID NO: 161842 - protein, 379 aa, Glycine max
  Coding DNA Sequence Number=SeqID_45064
  Gene Ontology: Mol. function=protein binding; Cellular component =cytoskeleton
  Homolog annotation: Hit_ID=Q9LSW2; Match level="QueryCoverage=83%, HitCoverage=42%, E-value=2e-83, Identity=54%"; Hit description=Actin- like protein
MAIFLADVEYLNTSPSCPRLNIWNVKFARLDIYGWPNIKDWTDFDTILETALILSLPLAYFAEIKEILSLVLRELCFGSAVVHQMDTGIIRKPHSRGVGSVPQDWYQACLLEGLAAVFGNGLSTACVVNIGAQVTSLICIEKFGSRLMTALYVDQHITDGGALPSTGKTLPFGGEDISRAFLWTQRQRQTWPPIHSDVFGKPIDLLVLNQLKETYCEVKEGEFDAVAVVHSYENKVPAGPHKTRLSALNVPPMGLFCPMLLTPDAYPPPPRTWFHDYEDMLEDTWHIDFSRRADMSDTFYPNVNGGLPMWESYPVFSTKPKKEEKVGLAEAITNCILSTGRIDIQRKLFCSIQLELTHFSGIDWRGGFDKWLNCSSRRK

SEQ ID NO: 161843 - protein, 690 aa, Glycine max
  Coding DNA Sequence Number=SeqID_45065
  Homolog annotation: Hit_ID=Q53M54; Match level="QueryCoverage=36%, HitCoverage=38%, E-value=2e-11, Identity=28%"; Hit description =Expressed protein
  Subcellular localization annotation: CTP_CleavageSite=45; ConfidenceScore=5.80e-01
MSKAFSSKKYYSSLPPPPTPITAATSRAKKRQSPRSPLQDLNRISSSSNSSYASSSVSTEAPKGCLRFLSSSSFRTPVHRPKSLTKTPSSAPRAAALKQSKSNSSKENLPKGNAGLRTKTLASDKMQMTHKKNPPCLYQWQSGKKSGSRTGRKSNPCSAFNEHGKRLPRLPSASEELKEKEDILGGRNDNAGEHDAHVKLGCGAVNLTPSSKKVAGSYLEDIRLFGDVEENPNSSASRTPPIHNSLSPEIQCGSSLVPKTATPACYGAGYVVSGVADKRKCRPRGILTVEKNYSGSDKIAANSFDDDDDDARKKVMDTNDHASPSLLPLPTEAVVHWLSSPCNKGKKILSKEFENGLNQSQGLAESTTLASSTSPSSSSKTFWNVSDSSDLSGGANGIMRKISSSISPNGLAEFQVPSDYILSPSHSSLLFSPNPTPICRAGSSGKGKTDQYNLIDENSPFSLNSFGSGNVIQTPQSDSSSVLHVGLSLAHADNRKEDISNPGLNSSSKILLSENLLLNSSMPLEDSVNSSFQFDCLTMPCESIDLSKLPNFLDGQDPWLSSSTIENASQSQMRISWREGLMSQSYELDEFDCCRCLSDEEEEIANESGTNRFSGPQVNIETNDGKKLNSDVGITETEDTEQEIHGLDKEKIPALMSCSGAESISTDGGGLVASGDSDWTLCHVNKSFEV

SEQ ID NO: 161844 - protein, 108 aa, Glycine max
  Coding DNA Sequence Number=SeqID_45066
MGETHEVPHHNLADFEPHLGYATEGRAFVPPAMVERGKFDHIEERLRTIEGGRDYAFVDMVELCLVPDVIISPKFKVSDFDKYKGTTCPKNHLKMYCKKMGAYAKDKK

SEQ ID NO: 161845 - protein, 65 aa, Glycine max
  Coding DNA Sequence Number=SeqID_45067
  Subcellular localization annotation: CTP_CleavageSite=13; ConfidenceScore=5.08e-01
MVQFKITSNNNKPCSNKSVTDGAPQMPMPHYLEKTNMSTPAVTARDSTTINKYVECNHNMAICMT

SEQ ID NO: 161846 - protein, 60 aa, Glycine max
  Coding DNA Sequence Number=SeqID_45068
MNHKGIPSFVFSDYNQEVIPTSCNELKSVFNQEDLLLKTLTKSQSPEKLFVRMEEERKIE

SEQ ID NO: 161847 - protein, 129 aa, Glycine max
  Coding DNA Sequence Number=SeqID_45069
MWHCCYIYPLQEPSIPLMLFMKTKSWTCLKLVHKKQEMRHFNVTGHMFGYPDCETFIIANYWIYKYFSTIASYIADEDYHERTSCACCWKSGKALLVSMYHKRLDRLTSNVVCWISYGDRCAFREFELI

SEQ ID NO: 161848 - protein, 62 aa, Glycine max
  Coding DNA Sequence Number=SeqID_45070
MATPMSTVCYLDKDEFAQSIDIKQYRGSVSDFVESKTDRKSTSGTCQLRVGIGQTSLQGPMT

SEQ ID NO: 161849 - protein, 86 aa, Glycine max
  Coding DNA Sequence Number=SeqID_45071
MEESVELDGFPNHWTSSPLNYGGYDLECLSTFDQRDVKDIKQLTLFTIMFKSSRIIEFEFSLTVKKSMASSRREMAPLVAGKEKVD

SEQ ID NO: 161850 - protein, 247 aa, Glycine max
  Coding DNA Sequence Number=SeqID_45072
  Gene Ontology: Mol. function=RNA-directed DNA polymerase activity; Biological process=RNA-dependent DNA replication
MRPSRNVIGTLGNGGGEPPMIEQMMAQMEDMRREMEDIRRENVKNLEMQQRANQAQATLQAQATNLRGLEGEAAVEQPRDFSPFMEVVMNTEILANILFPKMLPFVESTDPNQNLKNFCALMMINSGTNEVKCKLFIGTLTRVSLDWFSALPDNSITYFDKFSLVFVAQFVANKEWLALTINLFYVPQQLGKSLKGFHMRFNGVVVWVTNPDKRMVMATFCKGLRVRSFGESLVCLQSDTMTNVYLE

SEQ ID NO: 161851 - protein, 77 aa, Glycine max
  Coding DNA Sequence Number=SeqID_45073
MGAIKGQVLADFVVLFVDGSVNMTGSRAGIILAKVVMLAKGDSKVTGKAKAGECIKEAFRVLLAYTLIRLHGIREEV

SEQ ID NO: 161852 - protein, 110 aa, Glycine max
  Coding DNA Sequence Number=SeqID_45074
MSDTMSRTSCPKILELLHNAQGKIKELKLQDPRCRIRCPGHLARKYWTHKSVISLTDYCAIFQENDRSPPAQVVAAQIRTLLYKHEGCTGLSTKSEIEELFCEFWDLSVL

SEQ ID NO: 161853 - protein, 386 aa, Glycine max
  Coding DNA Sequence Number=SeqID_45075
  Gene Ontology: Mol. function=hydrolase activity; Cellular component =endoplasmic reticulum
  Homolog annotation: Hit_ID=Q019A0; Match level="QueryCoverage=74%, HitCoverage=18%, E-value=1e-63, Identity=43%"; Hit description=[U] KOG0946 ER-Golgi vesicle-tethering protein p115
  Pfam annotation: Domain name=Metallophos; Domain location=53-312; Score=36.4; E_value=9.7e-08; Accession=PF00149.18; Description =Calcineurin-like phosphoesterase
MGSEEISTSLCEDIPNLLSSFVDTFVDFSVSGGLFLPPPPPPPPLPTRLPSPPRLVAIGDLHGDLEKSKEALRLAGLIDVADRYTGGSATVVQIGDVLDRGGDELKILYFLEKLKREAARRGGRIITMNGNHEIMNVEGDFRFATLPGVEEFRVWWEWFEIGNKMKTLCHGLENPKDPMEGIPSSFRGVREEFHDGFRARVAALRPNGPIAKRFLSQNVTVLVVGDSIFVHGGLLPQHTSYGLEKINEEVRDWVNGSTGRFSPDYCRGADGLVWVRKFSRGDEKECDCSALEHVLSTVPGVKRMVMGHTIQTVGINGVCDDKAIRIDVGLSKGCGDGLPEVLEISGSSGLRILTGNPLYQNKGNVDVGKEQGLGEHGGPRQVEVKA

SEQ ID NO: 161854 - protein, 78 aa, Glycine max
  Coding DNA Sequence Number=SeqID_45076
MTPSHDALLYHNGRWNMPRQGEFMGYLFTGKNPKRFDIPSGCSIDELKDVIKQVAPQGISPYGIHESQMVRRLFFRQP

SEQ ID NO: 161855 - protein, 90 aa, Glycine max
  Coding DNA Sequence Number=SeqID_45077
MGFRPSNWESPRREASDDDNDAPGMEDLPYLPARVVEDPLTAAEELNKEQQQSPVEEERRERPELRLSSHGRKMAKFGRPTPQIEGLVAA

SEQ ID NO: 161856 - protein, 204 aa, Glycine max
  Coding DNA Sequence Number=SeqID_45078
  Gene Ontology: Mol. function=heat shock protein binding; Cellular component=cellular_component; Biological process=protein folding
  Homolog annotation: Hit_ID=Q9SU57; Match level="QueryCoverage=99%, HitCoverage=57%, E-value=2e-52, Identity=56%"; Hit description=Heat shock-like protein
  Pfam annotation: Domain name=DnaJ; Domain location=4-67; Score=124.9; E_value=2.2e-34; Accession=PF00226.21; Description=DnaJ domain
MGMDYYNILKVNRNASDDDLKKAYKRLARIWHPDKNPVNNTEAEAKFKRISEAYDVLSDPQKRQIYDLYGEEALKSGQFPPPHSSSSSSSSRAFHHRQNNNNNNNNNNNNKNNSNPPPAASSFRFNPRDADDIYAEFFGPEDIGAGGPDAFFRTSNGGGAFGASAAAGRKAAAVENALPCSLEDLYKGVKKKMKISRNVYDAFG

SEQ ID NO: 161857 - protein, 132 aa, Glycine max
  Coding DNA Sequence Number=SeqID_45079
MCHPTNENRQPSEAESSEAELISPPSFFNPITLLNSHIPMSNPQTNNNRHQPSRLQRRAPSSLQINRAVEWNVAIPLLSPLASSPPPMELKPPQEPPQREAEKVTVSFKKWQHPAAPFCYEPAPMVPPFVPV

SEQ ID NO: 161858 - protein, 83 aa, Glycine max
  Coding DNA Sequence Number=SeqID_45080
MSTLFRGKKGVSLWVWMEHLQAGDSHKSWGQITNYAIYKQVPSVTVDVTASYNVQTLTHDLIVKHAYKLEDCVKVVQNTEATS

SEQ ID NO: 161859 - protein, 261 aa, Glycine max
  Coding DNA Sequence Number=SeqID_45081
  Gene Ontology: Mol. function=receptor activity; Cellular component =mitochondrion
  Homolog annotation: Hit_ID=Q10AB4; Match level="QueryCoverage=93%, HitCoverage=51%, E-value=2e-29, Identity=34%"; Hit description =Expressed protein
MVAEAWIVKMGNQVSANLKHALLLEPSAKRKHNPKSQDNKELIGILSFEVANVMSKIVHLHRSLSEPEIVKLKNEISNSQGVQNLVSSQEGYLLGLARAEKLEELNRVANVVSRLGKKCSLPALQGFEHVYGDIVSGVIDVRELGFLVKHMEGMVRKMDRYVSATRSLHSEMGVLNDLEQAVKKFQHNLHEESRRAFEQKLTWQKQDVRHLKEISLWNQNFDKVVELLARTVCTIYARICMIFGDSTWRKSNSLGLSGGSP

SEQ ID NO: 161860 - protein, 280 aa, Glycine max
  Coding DNA Sequence Number=SeqID_45082
  Gene Ontology: Mol. function=DNA binding
  Homolog annotation: Hit_ID=Q6K709; Match level="QueryCoverage=49%, HitCoverage=52%, E-value=5e-53, Identity=75%"; Hit description=DNA -binding protein-like
  Pfam annotation: Domain name=DUF296; Domain location=85-202; Score =201.4; E_value=2.1e-57; Accession=PF03479.5; Description=Domain of unknown function (DUF296)
MWGGLSGVDHPGTHSPGLSKRHSDLGINENSDSHNNREEFDEDNRDEPKEGAVEVGTRRPRGRPPGSKNKPKPPIFVTRDSPNALRSHVMEITGGADVAESVAQFARRRQRGVCVLSGSGSVANVTLRQPSAPGAVVALHGRFEILSLTGTFLPGPAPPGSTGLTVYLAGGQGQVVGGSVVGSLVAAGPVMVIAATFANATYERLPLDEDDEGPSSMVGAQGGGGSPPLPLGIGSSGGGQLQGGIPDPSSLPLYNLPPNGGGGGQVGHEALAWAHGRAPF

SEQ ID NO: 161861 - protein, 240 aa, Glycine max
  Coding DNA Sequence Number=SeqID_45083
  Gene Ontology: Mol. function=two-component response regulator activity; Cellular component=endoplasmic reticulum; Biological process=two-component signal transduction system (phosphorelay)
  Homolog annotation: Hit_ID=Q949H5; Match level="QueryCoverage=91%, HitCoverage=26%, E-value=2e-71, Identity=61%"; Hit description =Ethylene receptor
  Pfam annotation: Domain name=Response_reg; Domain location=114-230; Score=92.7; E_value=1.1e-24; Accession=PF00072.14; Description =Response regulator receiver domain
  Subcellular localization annotation: CTP_CleavageSite=22; ConfidenceScore=5.39e-01
INSSDSEVGSSISSGFGGRKYSSDRVGGRLSFSICKRVVQFSLFIFSSLKCLGHSSGKLELMQGNIWLVPCNHGFPQSMTLLLRFQLRPSITIAISDPGEGSEHTDSNSMLRSLQVLLVDNDDVNRAVTQRLLQKLGCVVTSVASGFECLTVIGPAGSSIQVILLDLHMPDIDGFEVATRIRKFRSGNRPMIVALTASAEEDLWDRCMQVGINGVIRKPVLLHGIASELRRILMQGNIVL

SEQ ID NO: 161862 - protein, 88 aa, Glycine max
  Coding DNA Sequence Number=SeqID_45084
HPQKGRTRFLCGTVKMISFLIDMLLGFGGFFKWVSFFGLPNGGGGDLVNVLLLARYLSSTRLCSFQGKVKDLMKVVYLIALGACCNSS

SEQ ID NO: 161863 - protein, 220 aa, Glycine max
  Coding DNA Sequence Number=SeqID_45085
  Gene Ontology: Mol. function=hydrolase activity, acting on acid anhydrides, catalyzing transmembrane movement of substances; Cellular component=integral to membrane; Biological process =potassium ion transport
  Homolog annotation: Hit_ID=Q2K0Q4; Match level="QueryCoverage=99%, HitCoverage=32%, E-value=1e-107, Identity=91%"; Hit description =Potassium-transporting ATPase B chain protein
MGIRTVMITGDNPLTAAAIAAEAGVDDFLAQATPEMKLALMRQEQAQGKLVAMCGDGTNDAPALAQADVGVAMNTGTVAAREAGNMVDLDSDPTKLIEIVEIGKQLLMTRGALTTFSIANDIAKYFAIIPAMFIAFYPQLKMLNVMGLATPQSAILSAIIFNALIIVALIPLSLKGVRYRPIGAGALLSRNLLIYGLGGVIVPFIGIKAIDMAITALGLA

SEQ ID NO: 161864 - protein, 63 aa, Glycine max
  Coding DNA Sequence Number=SeqID_45086
VKTPEVLSGNHDERAKRAYALSLFIATVKILDFHMNALNGPCRTKRAKRALCTKPECFLLRLS

SEQ ID NO: 161865 - protein, 139 aa, Glycine max
  Coding DNA Sequence Number=SeqID_45087
MECNICGVKIKSDGPADKGTGRIDVDADEAVGIGAGAEEGGISEDGKASDLFPLALCSPLKIFNGSPSAFNSNPLPGMHNQAASSCGSGFERQNLEYTGKFSPSLSITGVFKNEFKVSTSNFTKQPLTFTCLGGLSSGS

SEQ ID NO: 161866 - protein, 47 aa, Glycine max
  Coding DNA Sequence Number=SeqID_45088
MGQETVKEKHKKRIEEKEVWTRKRRWRGSMRSRRTWNWNQRPKKYYR

SEQ ID NO: 161867 - protein, 168 aa, Glycine max
  Coding DNA Sequence Number=SeqID_45089
  Pfam annotation: Domain name=RRM_1; Domain location=19-87; Score =13.8; E_value=0.0075; Accession=PF00076.12; Description=RNA recognition motif. (a.k.a. RRM, R
METTVNTGTLQGSWKQATTRFPSWVTEKDLWQTFQKWGKVWEVFIPKSKNKGGHRFGFVRFKEVADELGLERHLDNNIFFDGMKMFVNRPKFQRGRVVSSHHNHNTRRGTDSIKGVDRCSYGAHVVNVNGGRIRSYAEVVRMSSPGASILCNQTSAFPQPPKDGMRPM

SEQ ID NO: 161868 - protein, 98 aa, Glycine max
  Coding DNA Sequence Number=SeqID_45090
MKVLNFILALILVLGVVNVQPNLAGRVLNMKEQLSLVSLDDKGPVTPSGPSTCTYIPGTGGTNCPPVKEINVAGNALHLSGETYPRLVVPFGVSKNQH

SEQ ID NO: 161869 - protein, 102 aa, Glycine max
  Coding DNA Sequence Number=SeqID_45091
MEGREKLDFIGERLIVVKGFGGYPFTDMIELCLVADVVIPPKFKVPDFDKYKGTTCPKNHLNMYCWKMGEYFRDEKLLMHFFQESLAGAAVIWCGKAEVKAP

SEQ ID NO: 161870 - protein, 302 aa, Glycine max
  Coding DNA Sequence Number=SeqID_45092
MGEIEEVQERIKANMEAMQEQMATMMEAMMSMKKIMEVNATAVGATSAVARVDSTPPFWLNQINHPSLNMVGRGGKELGCMGGPHFLQVHNMHAFPPYGLPPNYTPPNVAHAPNENVDNSTPITPFFGGVPLPNTLEGPQFLPQPQPLHFVVGIVPSAMEEKGKLDHIEERFRDIEGGGDHAFANMTELCLVLDVIIPLKFKVPDLNKYKGIACPKNHLKMYCQKMGAYSEDEKLLMHFFQESLTGAAVTWYTNLEPSRVHSWKDLMVVFVRQYQYNSNMAPDRTQLQKMCKKEHESFKEYA

SEQ ID NO: 161871 - protein, 56 aa, Glycine max
  Coding DNA Sequence Number=SeqID_45093
MELWKLFVTALMPVLKVLLITAVGTFLALHRFNILRESARKHLNTLSLNLFPPFCS

SEQ ID NO: 161872 - protein, 74 aa, Glycine max
  Coding DNA Sequence Number=SeqID_45094
  Subcellular localization annotation: CTP_CleavageSite=45; ConfidenceScore=5.27e-01
MKNGGKPSRNRPRKHLGSVTEAPRLGFSSRKQFFSLISREKRVVVAAQLAQASWVASTRRRRLLLEHPGRPKWV

SEQ ID NO: 161873 - protein, 435 aa, Glycine max
  Coding DNA Sequence Number=SeqID_45095
  Gene Ontology: Cellular component=integral to membrane
  Homolog annotation: Hit_ID=UPI0000162E4C; Match level="QueryCoverage =95%, HitCoverage=55%, E-value=3e-37, Identity=36%"; Hit description =auxin:hydrogen symporter
  Pfam annotation: Domain name=Mem_trans; Domain location=140-435; Score=-58.1; E_value=5.8e-05; Accession=PF03547.8; Description =Membrane transport protein
NLGNLPLIIVPAVCKESSSPFGAVDVCNKKGMAYASLSMAVGHIYIWTFVYNIIRVYSCRIFNVNKVDDSTVGPAAIETDLENYSTRPVVTAEDLSQTNDHVSQFGSECALPGGRDRMSLCPNIFGNVDTLCALVLQILGLIIGVVPPFQKMFVGDDAPLRVIEDSASMLGDASIPAITLLVGANLLDGLKRSGMKLSLVVGIIVVRYIALPILGVGIVKGETHSASAPEKQPLWKPLSPFGANFRSSSFHGAEECAVCKECSSPFGAVDVCNEKGMAYASVLGSPVSAIETDLESHSTVPVVASEVLSETNDHVTTLPGGRAKILGLIIGVVPPFRKMFVGDNAPLSVVEDSASMLGEASIPAMTLLLGANLLNGLKRSGMKFSLLMGITVIRYIALPILGVVIVKGAIHFGIIHHDPLYQFVLLLQYVLPPAT

SEQ ID NO: 161874 - protein, 747 aa, Glycine max
  Coding DNA Sequence Number=SeqID_45096
  Gene Ontology: Mol. function=cyclopropane-fatty-acyl-phospholipid synthase activity; Biological process=lipid biosynthetic process
  Homolog annotation: Hit_ID=Q9LK67; Match level="QueryCoverage=100%, HitCoverage=96%, E-value=0.0, Identity=60%"; Hit description =Similarity to cyclopropane fatty acid synthase
  Pfam annotation: Domain name=Amino_oxidase; Domain location=10-403; Score=-36.3; E_value=0.00049; Accession=PF01593.14; Description =Flavin containing amine oxidoreductase
  Pfam annotation: Domain name=CMAS; Domain location=512-745; Score =160.5; E_value=4.2e-45; Accession=PF02353.10; Description =Cyclopropane-fatty-acyl-phospholipid synthase
  Pfam annotation: Domain name=DAO; Domain location=2-308; Score=-36.9; E_value=0.0016; Accession=PF01266.14; Description=FAD dependent oxidoreductase
  Pfam annotation: Domain name=MTS; Domain location=485-637; Score= -66.6; E_value=0.0008; Accession=PF05175.4; Description =Methyltransferase small domain
  Pfam annotation: Domain name=Methyltransf_11; Domain location=537 -636; Score=49.1; E_value=1.5e-11; Accession=PF08241.2; Description =Methyltransferase domain
  Pfam annotation: Domain name=Methyltransf_12; Domain location=537 -634; Score=63.4; E_value=7.1e-16; Accession=PF08242.2; Description =Methyltransferase domain
  Pfam module annotation: Pfam domain module=Amino_oxidase::CMAS::DAO::M TS::Methyltransf_11::Methyltransf_12; Domain location=10-403::512 -745::2-308::485-637::537-636::537-634
MRVAVVGAGISGLASAYVLAKGGVNVVLYEKEDSLGGHAKTVNVDGVDIDLGFMVFNRNLGVDMELSDMSFSVSLDKGRGCEWGSRNGLTSLFAQKRNVLNPYFWQMIREIVKFKDDVIRQVALDKFVYSSAFSALHVEFELNSKMFKVVKNTNWNYLDMLENNPDIDRNEPLGEFIKSYELLCLLSSFILSQPPSTSALWQTTVANCKMAVKEELEREGSQIITNREVQLVSTSEKECVVHCKDGSEEMYDGCIMAVHAPDALRLLGDEATFDERRILGAFQYAYSDIFLHRDKNLMPQNPAAWSAWNFLGSNNNKVCLTYWINILQNIKETSQPFLVTLNPDHIPENTLLKWSTGHPVPSVAAFKASLELDHIQGKRKIWFSGAYLGYGFHEDGFKAYRLLEEGGTMFTFEGTGKNCGLKSVLRVHNPQFYWKVMTQADLGLADAYINGDFSFVDKDEGLLILILILIANRDSNASNLKLKKNRGWWTPVFLTSALTSAKFFMEHVSRRNTLTQARRNISRHYDLARIDKTHEILEIGCGWGSLAIEVVKQTGCKYTGITLSKEQLKLAEQRVKDAGLQDRIKFLLCDYRQLPKAYKYDRIISCEMIEAVGHEYMEEFFGCCESVLADNGLLVLQFISIPDERYDEYRRSSDFIKEYIFPGGCLPSLSRITSAMAATSRLWYNGEHVENIGIHYYQTLRCWRKNFLERQNEIMALGFNEKFIRTWEYYFDYCGAGFKSLTLGNYQ

SEQ ID NO: 161875 - protein, 219 aa, Glycine max
  Coding DNA Sequence Number=SeqID_45097
  Homolog annotation: Hit_ID=Q1SRN1; Match level="QueryCoverage=37%, HitCoverage=5%, E-value=9e-27, Identity=69%"; Hit description =Integrase, catalytic region
MTKMIVMVMTTVVIMFFNNNGQLHVSNQEQEVVKVVDQEDNSNLEQEGVKAVDQEDNKHRQIQFIKMRDLDAYLKELVLGHLLIISLTNIDMSHEDKDNNNTTITKMMVMVTMMMTTVVIMFFNNNRQLHVSILEQGEEEYNALTRNRTWDLVPLSVGRQAIECKWVFRIKENVDGSINRYKARLVAKEFHQVHGFDFHETFSPVVKSVTIRVVLTLAL

SEQ ID NO: 161876 - protein, 834 aa, Glycine max
  Coding DNA Sequence Number=SeqID_45098
  Homolog annotation: Hit_ID=Q7XDI4; Match level="QueryCoverage=99%, HitCoverage=83%, E-value=0.0, Identity=45%"; Hit description =Expressed protein
  Pfam annotation: Domain name=DUF810; Domain location=1-834; Score =1291.6; E_value=0; Accession=PF05664.2; Description=Protein of unknown function (DUF810)
MKMGRRAETIILPLELIRHLKPSEFSDSHEYHVWQKRQLKVLEAGLLLYPSIPLEKTNTFATRLRDIIYSGESKPIDTGKNADTIRSLCNSVVSLSWRSHNGTPTDVCHWADGFPFNVHLYTSLLQSIFDVRDETLVLDEVDELLELIKKTWSTLGITLPIHNACFTWVLFKQYVSTGQIEPDLLCASHAMLNEVEIDAKRVKDSLYVKMLSSVLSSMQGWAEKRLLNYHDYFQRGNAGQIENLLPVLLTVSKILDEDLTLTDGERGEQGGITVVDSSSDRVDSYIRSSMKNAFDKVLETVNANSAEFERRKELSEVLLQLAQETEALIMKERHHFSPILKKWHSTAGAVAAMVLHTCFGKMLKQYVSEVTSLTTESVQVLQKAGKLEKVMVQVMVEDSSECEDGGKNVIREMAPYDVDSVILSLLGKWIDESLHKGKQCLQRAKETETWNPKSKSESHAQSAAELMKLAAITVEEFFQVPIVITEDLVQDLADGLENLFQDYMKFVASCGSKQSYIPMLPPLTRCNSDSRFTKLWKRAAPCNAGFDAHIQHINGRHEGHNPRPSTSRGTQRLYVRLNTLHYLLTQIHSLEKTLSMNSGVVPSNRLRFASNRKSCCSYFETVNLSLLGACQHVSEVAAYRLIFHDSGSVLYDSLYAGGVGRGQIRAALRILKQNLTLMTTTLTDRAQPLALKEVMKASYDIFLMVLLAGGSSRVFHRYDHEIIREDFKNLKRVFSNSVEGLIAENVVDGEAAVVEGVIALMGQSSEQLIEDFSIMSCESSGIGLMSNGHTLPMPPTTGKWHRSDPNTILRVLCYRNDHAANLFLKRTFQLAKRR

SEQ ID NO: 161877 - protein, 83 aa, Glycine max
  Coding DNA Sequence Number=SeqID_45099
STKDTNGCVNKPMALTMTLTVASLEGRKVEDRNKEDDSDSNSLLPLRKGGISRKSDKTYRKRKVQWNDRIGNKLVEVLEYEPR

SEQ ID NO: 161878 - protein, 313 aa, Glycine max
  Coding DNA Sequence Number=SeqID_45100
MGCFMACFGLSNKRKRRKTIYKVLAGHQKYGNYEVLAITEKSTIPDSDSRGRDEVKEQNSVKTKKKKVTFNLNVQVYEPNPTAYQILNNEEEENRNYAAETEGSATLPVKYPSNHRYYNSGDGYDEEDGMAYEDSDIEDYEYDWEDDNEFDDDEYDWDDDGSDGSLENDEAEVCNGNSKQKELSEPCYPSLAQDKIKNQMLDDAKLKSNLRGRDRSTGMHSVLIPVENLTQWKAIKTKVAPSSKHRRKENVPSKQHTSMPSVSEASLNFSPCSLESNALQSKPLLPEISVDASLSNWLVSPNYHVSSTTIHCQ

SEQ ID NO: 161879 - protein, 88 aa, Glycine max
  Coding DNA Sequence Number=SeqID_45101
MARTKKTGQMTSEAAKEIAEEIDSLEEQASQGSFVPHGHQDVLTTAIGRAEHPGRVRAVGVGVTIKQYFGSAPRTSHSSSSLPPEDLQ

SEQ ID NO: 161880 - protein, 198 aa, Glycine max
  Coding DNA Sequence Number=SeqID_45102
IEKLKAGVSNKEYEIITECAVSNFSEVPHIPPPLNQYSSMTLNDTTGDIVPEVTNVVDSGTINVEASILLKLCVSINLVELSLYTGLTRDASLATVQVSSAWLLYKSSTAGNGFLSATLQGFSVFDDREGVEQEFRLAIGKSENVGASPLNTSSYNQNQDSVDSVKGDNFDLVQTMLIVDVKFGQDSTFVSLCVQRPQ

SEQ ID NO: 161881 - protein, 62 aa, Glycine max
  Coding DNA Sequence Number=SeqID_45103
MILLRTWSSWECCDANSNPITLLLSLPFSVYANLFRKWKKYVFDEMGLRELSQTDLNNAMLS

SEQ ID NO: 161882 - protein, 186 aa, Glycine max
  Coding DNA Sequence Number=SeqID_45104
  Gene Ontology: Mol. function=2-oxoglutarate decarboxylase activity; Biological process=menaquinone biosynthetic process
  Homolog annotation: Hit_ID=Q15KI9; Match level="QueryCoverage=57%, HitCoverage=6%, E-value=4e-27, Identity=56%"; Hit description =Chloroplast Phyllo
MPGFRFNWLDWLVQSEFYNTAHKIPLVLNHRQYTAHLPCTEIQHFIKRTKTARLNSIHVTLGLYAFILFCNDSLDHANELSNSLKESANINTVRASLIVEECTRLGLMYLCIAPGSRPSPVAAAAASHKLITCISCFDERSLAYHAVGYGRGSHIPAVAITSSGTAVSNLLPAGDQNCGLSIIGDQ

SEQ ID NO: 161883 - protein, 351 aa, Glycine max
  Coding DNA Sequence Number=SeqID_45105
  Gene Ontology: Mol. function=protein transporter activity; Cellular component=membrane; Biological process=protein secretion
  Homolog annotation: Hit_ID=Q27T25; Match level="QueryCoverage=52%, HitCoverage=46%, E-value=3e-55, Identity=65%"; Hit description=EtsA
PRQLDDGRRALAGVDRLPLLRNHGDDDAVHRRDHAGIAQIDFFLVDFNLRLHQAGIERKLLGAGGGERGFGGFEVLPRAGFVVQHAALAFETRLGLFQLRLFGLQFGLDDVQRRLGVAQIVALLQIVDVGDRLPFGDAIAQFDLQRFHFTGDPRPDVNAFDGIQSPGGQHGVLDIAQAGRCGNVILLRRALPIEGQRDGDADENDDGDQRQTTGHAQVFHNDKSGGSSLPSWQRQLELALNVRRFPAGKGIVKAFPLKITRSRRDNAAAMMPNRLEPELDIYQYPEHLRACLAPLPKGPGVYLFHGESESLPLYIGRGENAAPNPAHQLYRDRRRVGRIAAGGAVDQAATT

SEQ ID NO: 161884 - protein, 253 aa, Glycine max
  Coding DNA Sequence Number=SeqID_45106
  Gene Ontology: Mol. function=RNA-directed DNA polymerase activity; Cellular component=membrane; Biological process=RNA-dependent DNA replication
  Homolog annotation: Hit_ID=Q1RXD8; Match level="QueryCoverage=97%, HitCoverage=41%, E-value=1e-32, Identity=29%"; Hit description=RNA -directed DNA polymerase
QFGDTFKKVKRIQDELNRFEEMTMDTQLSSQETRVRRQLQANLWVVAHSHESLLRQKARSRWIKEGDCNSRYFHLMMNASRRHNLLKGIMSEGGWVDEPQKVKETLNQQQNDILTGSFREEEVREAVWECGRDKSPGSDGLNFKFIKKFWKIIKPDVLRFLDEFHINGIFPKGGNASFIALIPKVMSSIIDGRQFAFIEGKHLLHGVLIANEVVEEARRRKKPCMVFKEFTPTRGLRQGDPLAPFLFNIVAEG

SEQ ID NO: 161885 - protein, 408 aa, Glycine max
  Coding DNA Sequence Number=SeqID_45107
  Homolog annotation: Hit_ID=Q1PFY7; Match level="QueryCoverage=98%, HitCoverage=96%, E-value=6e-76, Identity=46%"; Hit description=Zinc finger CONSTANS-like protein
  Pfam annotation: Domain name=CCT; Domain location=316-354; Score =83.3; E_value=7.3e-22; Accession=PF06203.4; Description=CCT motif
MWLQDEISSPLSARIFELCNTDFFPETLPNSEVTSSSNCCYEENSSYATTNISVTVDVDNKLNSNSNTVTTPTSTTTTNTNNNTTNSSNLSIIFDSQEEIDNDISASIDFSLSPSFNVPPFLPATSQQEQFDFSSVQHQVQLAACSVVEGFSQYPNDSVAPPFMGAPLPSVFEEDCISSVPSYMALNPSSPCTYLSPGMPPYMPHGPLTTALSTGSSGIFGGNILLGSELQAQELEYQGENGRMYCTDSIQRVFNPPDLQVSSLKGCSSKALGTESQQLVPGAGSSASLPEISNLEDSSFKVGKLSVEQRKEKINRYMKKRNERNFSKKIKYACRKTLADSRPRVRGRFAKNDDFGETNRTTSSNHEEDDEEEVVVKDEDDMVDSSDIFAHISGVNSFKCNYSFQSWI

SEQ ID NO: 161886 - protein, 67 aa, Glycine max
  Coding DNA Sequence Number=SeqID_45108
MSPLRRLRHTDDTEPSTPVVDPSSPQHAADPSTPVLEKPKDQTTPVLTLGTSPPATPVLHLTDEEDV

SEQ ID NO: 161887 - protein, 108 aa, Glycine max
  Coding DNA Sequence Number=SeqID_45109
MHKSVKEEGLYTNCRYSNTDPEMRKETNEEATFGNTLKEGRRVSSGSRFLHRYPFVRDSFLRRPNTVVLLSSPWRPHATKPYTGSAREAYHPLWWLSPPSAMFWGETP

SEQ ID NO: 161888 - protein, 44 aa, Glycine max
  Coding DNA Sequence Number=SeqID_45110
MVYGKGVLPKGVKLASKRDIRWAIHSLQTLLALGCHLPMPLSLS

SEQ ID NO: 161889 - protein, 58 aa, Glycine max
  Coding DNA Sequence Number=SeqID_45111
CKDRGESLALHKLPNSKELRAVRRVVHVHRRVHRMEEQRRGLCCFNVNVFTHRTGKRG

SEQ ID NO: 161890 - protein, 309 aa, Glycine max
  Coding DNA Sequence Number=SeqID_45112
  Gene Ontology: Mol. function=receptor activity; Cellular component =anchored to membrane; Biological process=protein amino acid phosphorylation
  Homolog annotation: Hit_ID=O22784; Match level="QueryCoverage=88%, HitCoverage=89%, E-value=2e-97, Identity=60%"; Hit description =Expressed protein
  Pfam annotation: Domain name=DUF26; Domain location=187-238; Score =52.1; E_value=1.9e-12; Accession=PF01657.8; Description=Domain of unknown function DUF26
  Pfam annotation: Domain name=DUF26; Domain location=82-136; Score =57.7; E_value=3.8e-14; Accession=PF01657.8; Description=Domain of unknown function DUF26
  Pfam module annotation: Pfam domain module=DUF26::DUF26; Domain location=187-238::82-136
MGFPRKSLFLLLLLIFFTNLDLAESASDYATLVYKGCSKETFTDPNGVYSQALSSLFGSLVSQSTKAKFFKATTGNGGQTSMTGLFQCRGDLSNSDCYNCVSRLPVLSDKLCGKTTAARIQLLGCYMLYEVVGFSQQISGMQILYKTCGGTNAAGRGFEERRDTAFSVMENGVVSGHGFYATSYQSLYVMGQCEGDVGDSDCGECVKSAVQRAQVECGSSISGQVYLHKCFISYSYYPNGVPGRHSSSSSASSSSSNSYSSSSSGQNTGKTVAIILGGAAGVAFLVICLMFARSLKKKRDGRLLTVEDG

SEQ ID NO: 161891 - protein, 297 aa, Glycine max
  Coding DNA Sequence Number=SeqID_45113
  Homolog annotation: Hit_ID=Q1S8Y1; Match level="QueryCoverage=51%, HitCoverage=48%, E-value=4e-36, Identity=56%"; Hit description=TLD, putative
  Pfam annotation: Domain name=TLD; Domain location=213-297; Score =14.4; E_value=1e-06; Accession=PF07534.6; Description=TLD
MYSFKDKVTQKLSHLFPNSSSSSPQKMKPGEEFQLLCVYLAPYFSRALLLKLHLLLALSLWLCEQYTNRETDSPYSQEDKPLSSYLSYIIPSISFDGSKSNKNQHELKPIQSASSGYNYENFEYQDVPSDNYVDCTNMDLLKDDNDNINEDPTSRRSSSSSEVFEEANEQQTPNTSKKSRLNLTDDSTFISPELYEFLEICLPNIVKGRQWVLLYSTLKHGVSLRTLIRKSAELSCPGLLIAGDMQGAVFGGLLDCPLKPTAKRKYQGTNQTFVFTTVYGQPRLFLPTGKDYHGLNA

SEQ ID NO: 161892 - protein, 403 aa, Glycine max
  Coding DNA Sequence Number=SeqID_45114
  Gene Ontology: Mol. function=binding; Cellular component =intracellular; Biological process=metabolic process
  Homolog annotation: Hit_ID=Q6ZIP5; Match level="QueryCoverage=84%, HitCoverage=70%, E-value=1e-128, Identity=44%"; Hit description =Pentatricopeptide (PPR) repeat-containing protein-like protein
  Pfam annotation: Domain name=PPR; Domain location=108-142; Score =15.5; E_value=0.11; Accession=PF01535.11; Description=PPR repeat
  Pfam annotation: Domain name=PPR; Domain location=174-208; Score =16.0; E_value=0.094; Accession=PF01535.11; Description=PPR repeat
  Pfam annotation: Domain name=PPR; Domain location=37-71; Score=42.1; E_value=1.9e-09; Accession=PF01535.11; Description=PPR repeat
  Pfam annotation: Domain name=PPR; Domain location=72-106; Score=12.4; E_value=0.26; Accession=PF01535.11; Description=PPR repeat
  Pfam module annotation: Pfam domain module=PPR::PPR::PPR::PPR; Domain location=108-142::174-208::37-71::72-106
HDSSLSVGNALITMYSRCGLVEAADTVFLTMPYVDSVSWNAMIAALAQHGHGVQAIQLYEKMLKEDILPDRITFLTILSACSHAGLVKEGRHYFDTMRVCYGITPEEDHYSRLIDLLCRAGMFSEAKNVTESMPFEPGAPIWEALLAGCWIHGNMELGIQAADRLLELMPQQDGTYISLSNMYAALGQWDEVARVRKLMRERGVKKEPGCSWIEVENMVHVFLVDDAVHPEVHAVYRYLEQLVHEMRKLGYVPDTKFVLHDMESEQKEYALSTHSEKLAVVYGIMKLPLGATIRVFKNLRICGDCHNAFKYISKVVDREIIVRDRKRFHHFRNGECSCSNYCLKDGNLPSTNPPLLHMDDRVHYCYIKSLTIFNFCFKRLLALTIASGTVIQFSGAQFKCPGR

SEQ ID NO: 161893 - protein, 134 aa, Glycine max
  Coding DNA Sequence Number=SeqID_45115
MIMRGRDIYSNQDEATTSPSSSESEEAKGEESSEEIYPREEGQPLMVKNECKEVNVSSKMLAKKESHFTIKTNIKETSPLRQPPQFLLCQKTLVSTVTPLGLEVIPQVNELLDEGLVRKSLNPCALLVPKIGTH

SEQ ID NO: 161894 - protein, 92 aa, Glycine max
  Coding DNA Sequence Number=SeqID_45116
  Subcellular localization annotation: CTP_CleavageSite=27; ConfidenceScore=5.15e-01
VDSEDSALIKTFLSVSWFDNKQRWLMVATGGRGWFRRSELVSLSESPLLALSATFRAYSNSSQYLVGIALSALLAVIEKSQNVILKIPMVRL

SEQ ID NO: 161895 - protein, 197 aa, Glycine max
  Coding DNA Sequence Number=SeqID_45117
MSVLELYIEKDVVGGSAFHSANSVRSCENNLSNNESEPPRNVSNLHEDEDEDNNDYLVSNSYVEDSLDEDDSVDGISDTDDEVADMVQPVTIVQPREDGIQNPFWSDAFHYNNINWSHPNEEDICDLDMPSTFNVGQELYVGMDFDSKDALKNALKQYVMKVHQSFKVLETKSHKYIVCCPNKSAKCPCPFYEGNFI

SEQ ID NO: 161896 - protein, 78 aa, Glycine max
  Coding DNA Sequence Number=SeqID_45118
  Subcellular localization annotation: CTP_CleavageSite=43; ConfidenceScore=5.50e-01
MIMMKMKENHKFGASDHMAPVPLKKSNRSSMSSSSWAGSMAPGASAGPALVWQTSQSPGHAIIAQNCSRVGHMKGVEP

SEQ ID NO: 161897 - protein, 87 aa, Glycine max
  Coding DNA Sequence Number=SeqID_45119
MVRWMFIKNLMLKDTGTQCSDRMLKAGVAAHDVQRYVKESDWAAQCTRQDKMSNEELKLQDPRCRIRCPGHPARKYWTHKSVISLTD

SEQ ID NO: 161898 - protein, 194 aa, Glycine max
  Coding DNA Sequence Number=SeqID_45120
MASRDQAWSFCTHDMWRDLTVIRPPFPFRYSSVGWQAETKDQVWSFCTHDTRRYLTVIRPPLPFRHSRVRWQAETKFGHSAHMIRGDTLRLSAPLCHSDTVVFDGKQRPNRTLDSKQGLTQSSAPFVPPGTTKSFTCGNFMVTRDSCQPRGAKLVSYADFRGPLLDDMRPFFGPCEVLGIHHQAVCEILGTTSH

SEQ ID NO: 161899 - protein, 241 aa, Glycine max
  Coding DNA Sequence Number=SeqID_45121
MGETHEVPRYHTLADSKPHLGYATKGQAFGGIPLPNTLGGPQYCPQPQPLHFVVERLPLAMVERVKFDHIEERLRVIERGGNYVFADMAESCLVPDVVIPLKFKVSDFNKYKGTTCPKNHLWMYCRKMGAYAKDEKLLMHLFQESLTGVAVTWYTNLESSWLQNICKREHESFKEYAQRWRDLAAQVAPPNGENKKEGGTHAMTVIPTWPNFPPTQQYQYSVNISPSHYPPPYQSRTPNHP

SEQ ID NO: 161900 - protein, 152 aa, Glycine max
  Coding DNA Sequence Number=SeqID_45122
  Gene Ontology: Mol. function=RNA-directed DNA polymerase activity; Cellular component=extracellular region; Biological process=RNA -dependent DNA replication
MRDKVWKKLKRWKENVLSKARCETLIKVAIESILTYAKSYFKLPFSSCWYFDMMIAMFFWGGKSDSRKLHWLRWEAMFKSKWKTGLRMSYTWYSIIASREIVKKGSIWWVGDRTSIHVWDDKWLPNVVHGILQSDWNQVIDHELLLANLIDH

SEQ ID NO: 161901 - protein, 373 aa, Glycine max
  Coding DNA Sequence Number=SeqID_45123
  Gene Ontology: Mol. function=cation transporter activity; Cellular component=integral to membrane; Biological process=cation transport
  Homolog annotation: Hit_ID=Q1H413; Match level="QueryCoverage=99%, HitCoverage=36%, E-value=1e-150, Identity=71%"; Hit description =Heavy metal efflux pump CzcA
  Pfam annotation: Domain name=ACR_tran; Domain location=1-367; Score= -485.0; E_value=0.00038; Accession=PF00873.9; Description =AcrBAcrDAcrF family
MAQPISDRVDELLTGVRADVAVKIFGEDLDTLKKKADEIARIAGSVRGATEIKVEKVSGQQYLNITIDRQAIARHGINASDVHDVIETAVGGKIATEIFEGQRRFSAAVRYPESFRDNEEAIRNIMLTSPNGSRVALDDLADIEVKDGPAQISRELAKRRIVIGVNVKDRDLGGFVAELQQVLDQRLQLPDGYYLEYGGQFQNMERAMSHLMIIIPVTIAAIFFLLFLLFQSLRFATMIILVLPFASIGGVIALFVTGEYLSVPASVGFIALWGIAVLNAVVLVSYIRTLREEGLDQLEAIRKGCAQRFRPVMMTATVAMLGLVPFLFATGPGSEVQRPLAIVVIGGLITSTLLTLIVVPTLYRKFEESKIEA

SEQ ID NO: 161902 - protein, 309 aa, Glycine max
  Coding DNA Sequence Number=SeqID_45124
  Gene Ontology: Cellular component=nuclear chromosome; Biological process=chromosome organization and biogenesis (sensu Eukaryota)
  Homolog annotation: Hit_ID=Q1SKA6; Match level="QueryCoverage=70%, HitCoverage=25%, E-value=2e-25, Identity=39%"; Hit description =Rad21/Rec8 like protein, C-terminal; Rad21/Rec8 like protein, N- terminal
FEEFDVGENTSSFDQDIVGNALLSKLLNMMDDEVSPQNSPTDLLPESWDKFQSSISGFQENVSDEDDERLSVIPPKSKNVDATPQSKFQGYSAGRPQRDSATKESLHVSTPAARDHPPFLRKRRIILDRMILLPSKVVRKNIESAKDLLRFPFPRESRRTLLNARCVKKHRESPTSSLPDRFYEPLLPCSSSELQLQFSKRKMKLPNSLKIVETPGNPDVPESPTAGPLLSPSQSSFSLEIEETPRMLDVPQSQDSSIQMNEVPNLIDEESCKLLASEFSTCKKRKRGHHKLFTSLWRPSTERICPVVL

SEQ ID NO: 161903 - protein, 43 aa, Glycine max
  Coding DNA Sequence Number=SeqID_45125
EVFGLWKAKSSVGSSLGNWSDSKVLDRTGLSCCAITRNRGTRT

SEQ ID NO: 161904 - protein, 69 aa, Glycine max
  Coding DNA Sequence Number=SeqID_45126
MLHPTAAINEGGEAYLDGRSGGDVSTEAANARKRNQQVKGMSSNAHTQEENKPTGRRRREEKEAAQGGV

SEQ ID NO: 161905 - protein, 170 aa, Glycine max
  Coding DNA Sequence Number=SeqID_45127
MELSYDVMASTSRCYICEIPGSHKIIMESFQLCKKGVSVCNPIPESTDPFTFSFIAGWEGGVQETIGECINESPSWNLELWLVPAESSICWGHQVCRSKPKMSLPEDIRVLLGAASAKVKVLQVGGDCCGGWSIATLSKIDEDQWMYDNIMSEEVDMNDENEHEAGVNEE

SEQ ID NO: 161906 - protein, 83 aa, Glycine max
  Coding DNA Sequence Number=SeqID_45128
  Gene Ontology: Mol. function=RNA-directed DNA polymerase activity; Cellular component=mitochondrion; Biological process=RNA-dependent DNA replication
MALKLNMYKAYNRVKWKFLERILVKMGFPNHWCDLILKCITIVCFVVLINGAPSKGFKAYWGWRKGTPCPLTNSSFMLKHFPL

SEQ ID NO: 161907 - protein, 381 aa, Glycine max
  Coding DNA Sequence Number=SeqID_45129
  Gene Ontology: Mol. function=nucleic acid binding; Biological process= DNA integration
MGPKSTLRLMRTLGPSLASLAQSTWSLLSNALAGREGMPLKEHLDEINYVLMELRDIDVKMEDEDLEIILLAFFPPFYENFLRLKVFGNGDEASAFGLSRTGYAKRQKKKKDKGGSIPIRMHDGVVRTLIKVHHVLELEKNIVCMGALDSKGFSCWIEGGVTLIEGKGWSMKNQTGNIAKCLRTDNDLELWKKKFVKNQTGKTVKCLRSDNGLEKSKKLKSLLSSEFKMMDMRVIEKILGMEIKRDEVLCTPLIASIRLPELNSTRSELEKEYMFSVPYASVIGSLMYVIVCPRSNLAQIVSVASRYLKGTTDIRLIYHGDTSYVGYLDSEHATDLDARRSMIGYAFTIGNSLVSWKATLQPTVALSAIEAEYMALEKVAM

SEQ ID NO: 161908 - protein, 125 aa, Glycine max
  Coding DNA Sequence Number=SeqID_45130
MGRLMLSEDLGSVNLRREIYMYDLSSPKLASGSPGPLIYFRVKEPARLGEPVTSGVSINSPGRTAMALSAHFPINRHARGVEERFQGPEGEEIERREKEEETKSRRRQIATVINPYIVSCSMFFV

SEQ ID NO: 161909 - protein, 160 aa, Glycine max
  Coding DNA Sequence Number=SeqID_45131
MNTLMHPTTYLGLDDKSTKMDGTQYRIMIGSLHYLTASIPDIMCEISTRTKGVSEVRESGIPSNSPRHIKTRARKVNPKFGEKEWTISFFGNKENPTSSSSDSNPQSTPSFFEVIHAKPLPRESIIVQALAWMRHDYVHTPSEAFMALPIDVIVHLQPLQ

SEQ ID NO: 161910 - protein, 174 aa, Glycine max
  Coding DNA Sequence Number=SeqID_45132
IVMAVQLIHDRVEMECLEGAWETLEGNTRCRFRGTIRFTATSLVHPEEPARTLQRTVEWILPTPTPYRLVEPVQVIEVTSSEEDPEEDPEELPPEPAVDALDFLEGDEDPLLEVDSPEDVMSASEADSTEESGPGEMATSVEGRSPEYQEPRDLRSNPFQGGGDDAILPPKGIG

SEQ ID NO: 161911 - protein, 240 aa, Glycine max
  Coding DNA Sequence Number=SeqID_45133
MYVRDQVMAYPSGLHISRATDIKIVANTVCPHLPIWDDAKKKGFKLYYTKEMPSSGKKLICAPDAYDARTFQNYIVWMDTLNASTYVYDERDNVVYHNIILVLRPIRKYHFDDACVCFTKDAKNYPFIHCLLQFPTIQYERTYNLFKINEEQMIAHVTQLHDAQHFSNLGVILLQNLQQAQMSMLGVVVALAPRPVPVPPTQEPTPSSIEPTPSSIAPTPLPPPSSPPPTQPPPPPLAQD

SEQ ID NO: 161912 - protein, 99 aa, Glycine max
  Coding DNA Sequence Number=SeqID_45134
  Homolog annotation: Hit_ID=Q1S8I5; Match level="QueryCoverage=72%, HitCoverage=38%, E-value=8e-10, Identity=34%"; Hit description =Probable Ta11-like non-LTR retroelement protein [imported] -Arabidopsis thaliana
MAKTWKIKGELEIKDVKRNLLTFRFQRQNNMVMILEHGPWNFDWKFLVLHKLSPDKTPRDISLTKCPFWIRMNGSEMEKEEREETPFQGEDESRRSSPP

SEQ ID NO: 161913 - protein, 111 aa, Glycine max
  Coding DNA Sequence Number=SeqID_45135
MCLAWSSYGMDDLLENFPKSIVRDVEKSTIKDITLPTSHALPFSASFARVVDNNTITSSSSSLKGTKVFPLSMEREGQEKFLGDHKRQSLGGESLLSLLGKPSREERGESY

SEQ ID NO: 161914 - protein, 488 aa, Glycine max
  Coding DNA Sequence Number=SeqID_45136
  Gene Ontology: Mol. function=nucleic acid binding; Cellular component= beta-galactosidase complex; Biological process=DNA integration
  Homolog annotation: Hit_ID=Q1S1G2; Match level="QueryCoverage=83%, HitCoverage=32%, E-value=7e-68, Identity=34%"; Hit description =Integrase, catalytic region; Zinc finger, CCHC-type; Peptidase aspartic, catalytic
  Pfam annotation: Domain name=zf-CCHC; Domain location=164-181; Score =8.7; E_value=0.036; Accession=PF00098.13; Description=Zinc knuckle
  Pfam annotation: Domain name=zf-CCHC; Domain location=202-219; Score =13.8; E_value=0.0052; Accession=PF00098.13; Description=Zinc knuckle
  Pfam module annotation: Pfam domain module=zf-CCHC::zf-CCHC; Domain location=164-181::202-219
MNELLLNLESYLYLHPSENPAVALVSPALDSSNYHSWSRSMMTALSVKNKVEFVNGKAPEPLKTDRTYGAWNRCNNMVAKEIWNDLKSRYAQGDLLRVSDLQQEVVSIKQGSLSVTEYFTKLRVIWDEIENFRPDPERQLAGNNSLPSFNLETKEGPSVNAVKSICEFCGRIGHNESICYKKHGVPSSYDGKGKGFSARNGKTCTYCGKLGHTIDVCYKKHGCPPGFKFTNGKAIANNVVAVEGKATNDQTQHQESQELVRFSPEQYKALLAVIQQPCDGNSASTKSQVASISSCSNHDTTGTILSYEKANSTSWILDSGATDHVSFSLTNFHSYHQINPITVRLPNGQFVYATHSGTVQLSALIILKDVLYILSFTFNLISISKLVSSTNYKLIFSSNTCILQDTNTKVRIGTTEVSCGLYQLTPEHTKSHTICSIIIHPKCKVTPIMMQSYPARALDRRLQADWTRDPREGPRVLMILRVDFEPMG

SEQ ID NO: 161915 - protein, 44 aa, Glycine max
  Coding DNA Sequence Number=SeqID_45137
MGTHAYEMTSVCPSKHAKQEFSNKGLVGIKSIIVLVSFDEKSDK

SEQ ID NO: 161916 - protein, 54 aa, Glycine max
  Coding DNA Sequence Number=SeqID_45138
MERILNLGRGGISRGSECVMEVFQEKCTGELEDQAFVCDSEGYLRNISTQKRED

SEQ ID NO: 161917 - protein, 513 aa, Glycine max
  Coding DNA Sequence Number=SeqID_45139
  Gene Ontology: Mol. function=nucleic acid binding; Cellular component= mitochondrion; Biological process=DNA integration
  Homolog annotation: Hit_ID=Q1ST43; Match level="QueryCoverage=96%, HitCoverage=36%, E-value=1e-119, Identity=47%"; Hit description =Integrase, catalytic region; Peptidase aspartic, catalytic
MSISTSIEPSSYAEASKHDCWIKAMHAELQAFQQNQTWILTQLPRHKMTIGCRWVYKIKHNADGTIERYKTRLIAKGYTQMEGLDFLDTFSPVAKLTTVRLLLALAALRNWHLRQLDVNNAFLHGDLNEEVYMKLPPGLIMDNPNLVCHLQRSLYGLKQASRQWFTRLSSFLLSQGFHQSSADHSLFLYTNNSHDITTILVYVDDIILTGNNLNTIIHITKLLDQTFNIKDLGILKFFLGLEVARSSHGIHLCQHKYALDILSDSDASSVALYILQTLAPTLLRSFNNSANIWPTQPPHTHKLLFGFYVTSKGLPVLAFSLRLKEDSLLKPSATSTGQDAATHAIPSLGSPSIWAILSFPGDSLISWRSKKQSTVSHSSSEAEYRALASTTCELQWLSFLLHDFRVPLLQPASLYCDNQSAIQIASNPVFHERTKHIEIDCHIVRDKVNKGLLKLLTISSSMQLADIFTKPFPPALFQGFHSKLGMMNIHSQLAGAISRDSSVRSLVISLLVS

SEQ ID NO: 161918 - protein, 74 aa, Glycine max
  Coding DNA Sequence Number=SeqID_45140
MQHLMKLLERDQYIHWHRLKDEDMVCDMFWCHPDAVKQYLQNKQRAFAKRNLQWLSERKNPEEDELSSSLSAPL

SEQ ID NO: 161919 - protein, 193 aa, Glycine max
  Coding DNA Sequence Number=SeqID_45141
  Homolog annotation: Hit_ID=Q47522; Match level="QueryCoverage=18%, HitCoverage=44%, E-value=5e-14, Identity=100%"; Hit description=LacZ protein
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDQNCRALSGQCQPERAIGWTEPSKAIGVGLPQASGAQLLPEVCPQCIKLIDTVDLEGGPGTSFCSL

SEQ ID NO: 161920 - protein, 87 aa, Glycine max
  Coding DNA Sequence Number=SeqID_45142
MEMFDAQVAWPRDQPSSSREGGASTAQEPVIEEPPAPSPSRAAAKEKTTPAQTPQPSPPSAPTPEETQLSGDDWMIVLIKFSVIRRK

SEQ ID NO: 161921 - protein, 227 aa, Glycine max
  Coding DNA Sequence Number=SeqID_45143
  Pfam annotation: Domain name=Transposase_23; Domain location=46-116; Score=3.9; E_value=0.00043; Accession=PF03017.5; Description =TNP1ENSPM transposase
MTSFSQLQSQMQYQGPPEPLVGPGPFGPRVSTKGSCVDPSGNDPETGDSDRYGLYIEADPARLVTVGRVYEGSTLVHNTPLLPGQVKVSVDKVKDADAAVPVPTVEVSLVGQALHTFLAWPTHQIKSLSNQVRWDATVFGVVNPDFPLYIKNEDLSEIAHDGQCLSISVLQLWILHLTETCMRAGNSDIYEFLEPQSIQRSGQSQFESESYLKSWMPSSQSDVYLGA

SEQ ID NO: 161922 - protein, 66 aa, Glycine max
  Coding DNA Sequence Number=SeqID_45144
MEHSREGLHLGNHEAKLQTRKWRTHEQCYAITFMGLRRRVRMEESLEGPHNNVHGVPKKGENGGLP

SEQ ID NO: 161923 - protein, 62 aa, Glycine max
  Coding DNA Sequence Number=SeqID_45145
DLEEDLEELSPEPAMDSPDLPEDNVDPLPDVDSLENIMPASEADSTEESGPGGTTNSDDSSS

SEQ ID NO: 161924 - protein, 227 aa, Glycine max
  Coding DNA Sequence Number=SeqID_45146
  Gene Ontology: Mol. function=4-alpha-glucanotransferase activity; Biological process=carbohydrate metabolic process
  Homolog annotation: Hit_ID=Q5PM02; Match level="QueryCoverage=97%, HitCoverage=31%, E-value=5e-58, Identity=50%"; Hit description=4 -alpha-glucanotransferase
ALQCHRCPIIVAPRRCYEPAELLAGESLWGSCIQLYTLRSAANWGIGDFGDLRQMIAETARRGGAFVGLNPLHALFPAAPESASPYSPSSRRWLNILYIDVGAVADFGLSDAAQAWWQAEETQQAIRAARDAAWVDYTAVTRLKLQGLRLAWQQFRRRTADDGQAQAFAEFVRAGGDSLVHQGLFDALHAARSAQDGTGYGWQHWPAEWQQANSAAVLAFRIEHSDE

SEQ ID NO: 161925 - protein, 155 aa, Glycine max
  Coding DNA Sequence Number=SeqID_45147
  Gene Ontology: Mol. function=two-component sensor activity; Cellular component=outer membrane-bounded periplasmic space; Biological process=two-component signal transduction system (phosphorelay)
  Homolog annotation: Hit_ID=Q6D5N3; Match level="QueryCoverage=72%, HitCoverage=19%, E-value=6e-29, Identity=54%"; Hit description =Putative signaling protein
  Pfam annotation: Domain name=EAL; Domain location=2-126; Score=-55.8; E_value=6.4e-07; Accession=PF00563.11; Description=EAL domain
MLQARLPTSLLGIECLETEQIINSPAALQGLEMLKLRGFGISLDDFGTGYSNIGYLRRMPLDVIKLDRALISEIASDTASRIIARSIITMLKQLDYTVLAEGVENVDTVAALAEYGCDQAQVYAGERLEQIQWQYDESVSLKQNDTSKVKQKYPA

SEQ ID NO: 161926 - protein, 133 aa, Glycine max
  Coding DNA Sequence Number=SeqID_45148
  Gene Ontology: Biological process=regulation of transcription, DNA -dependent
  Homolog annotation: Hit_ID=P0C079; Match level="QueryCoverage=54%, HitCoverage=92%, E-value=4e-32, Identity=95%"; Hit description =Antitoxin RelB
  Pfam annotation: Domain name=Plasmid_stabil; Domain location=31-123; Score=26.6; E_value=8.6e-05; Accession=PF05016.5; Description =Plasmid stabilisation system protein
  Pfam annotation: Domain name=RelB; Domain location=1-79; Score=123.7; E_value=5.1e-34; Accession=PF04221.3; Description=RelB antitoxin
  Pfam module annotation: Pfam domain module=Plasmid_stabil::RelB; Domain location=31-123::1-79
MGSINLRIDDELKARSYAALEKMGVTPSEAVRFMLEYIAENERLPFKQTLLSDEDAELVEIVKERLRNPKPVRAPRIEANKLRGMPDCYKIKLRSSGYRLVYQVIDEKVVVFVISVGKRERAEVYNEAVKRIL

SEQ ID NO: 161927 - protein, 77 aa, Glycine max
  Coding DNA Sequence Number=SeqID_45149
MSIGFNDEICAISAHQWAKRTSTAKCNFGMLNALEESGKASISRSCAKHEISALSAVVVFSQAQCMIGAKLKSTYSC

SEQ ID NO: 161928 - protein, 438 aa, Glycine max
  Coding DNA Sequence Number=SeqID_45150
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=82%, HitCoverage=23%, E-value=1e-46, Identity=31%"; Hit description=Chromo
MATHDKSTLDRIEDAISKLAASQIHVTEKLEDLLLRVANLEQTSTNTHSPSSSSANPSPANTNNPQKMKLDVPRFDGSDPSGWIFKIQQFFAYHSTPDSERLTIASFYMEGPALAWFQWLMRNHQLTTWQSFLEALDVRFSHSPYEDPTGLLFKLTQIGTVTEYLTQFEAIANRIVGLSLSLLLSCFISGLDPDIRREVKMLQPLTMVHAVGLARLQEEKLADTRRPSRHRATPSPQPYFPPNPPTIPLSSPPPPTLPLLPPPPKPPPIPLKHLTPTEMASHRERGLCFNCVKKFMRGHHCASRFFVLIADSEPPDNTPQPNLSPTHPDPNLNPQPDDPTQPKPPQAQISFYALSGHSASETLRLLGHIGCQPVVILVDGGSTHNFVQARLVRHLGLTATPTPPLRVLVGNKNELECHLLSSATSIRIQGHTFKTDLH

SEQ ID NO: 161929 - protein, 76 aa, Glycine max
  Coding DNA Sequence Number=SeqID_45151
MSAQDFLIIFGNLEIWVDDPSKLVFWVDDPAWVGDPEEVDDFLMVGSGRASLAPLPVLLPLLREIPDALGGITTFL

SEQ ID NO: 161930 - protein, 827 aa, Glycine max
  Coding DNA Sequence Number=SeqID_45152
  Gene Ontology: Mol. function=RNA-directed DNA polymerase activity; Cellular component=chromatin; Biological process=chromatin assembly or disassembly
  Pfam annotation: Domain name=Chromo; Domain location=715-766; Score =14.5; E_value=0.019; Accession=PF00385.14; Description='chromo' (CHRromatin Organisation MOdifier
  Pfam annotation: Domain name=rve; Domain location=447-566; Score =11.1; E_value=0.0007; Accession=PF00665.16; Description=Integrase core domain
  Pfam annotation: Domain name=zf-H2C2; Domain location=388-429; Score =6.7; E_value=0.046; Accession=PF09337.1; Description=His(2)-Cys(2) zinc finger
  Pfam module annotation: Pfam domain module=Chromo::RVT_1::rve::zf -H2C2; Domain location=715-766::12-181::447-566::388-429
MLQSGIIRPSTSPFSSPVLFVKKRDGSWRFCVDYKALNALTIKDRFPIPTIDELLDELGGAKWFSKLDLMQGYHQILMAESDIGKTAFRTHQGHYEFLVMPFGLCNAPSTFQATMNSTFGPYLRKFVIIFFDDILIYSQTHQLFLKLSKCTFAVTEVEYLGHIVSQHGVAPVPAKITAIQQWPTPQSARALRGFLSLSGFYRRFIKGYSSIATPLTLLLAKDSFQWNDSATAAFNQLKDALCRAPVLSLSDFSLPFFMETDASGVGMGVMLSQRNHPIAFFSKPFCPALLRASTYVRELAAITATTPEQHRYLARLLGYDFTIQYRAGRELKKELNRDPTFLDYCHRIQATPEAYPDCVIHQKLILQKRHLWLPKDSPIIHTIISEFHNTPTGGHMGVAKTTARVDENFIWPSMRKDIKLFVAACLVCQQTKNDHRKSAELLCLLPVPARPKEDLSLDFIVGLPSYQGHTTILVIVDRFSKGVHLGLLPTHYIAFKVARVFMEVSGKLHGPPRSLVSDRDPLFISRFWAFVHDKPSTWGRFLMWMEWSYNTSVHSATGMSPYEITFGKKPPNLPQYVARNSNIDVVDTWLTDRDLMFKSLRHKLFKAQQHMKELADKHHRELHFTEGDMVLVKLHPRRQSTVVGAPYTKLAKRYYGPFQVIQKLSPVAYKLNLPPTSRIHPVFHCSLLRPYNPPLSALDTPIMLPESAEDNQPLVTPLTILDSKWSGSGDDHQLLLLVQWSGLWSEDTSWEPWHLLKETYNLGGKVVFDAHGNVITRDMKQQEAETEPISELKPATMQEKEPKATTETRRPKREITKPQYLKDFVAK

SEQ ID NO: 161931 - protein, 54 aa, Glycine max
  Coding DNA Sequence Number=SeqID_45153
MTDFSGVSALIDYQVIITIFSINNKLVFTSKQSKNQEIIKEYSLHLKNYILTSE

SEQ ID NO: 161932 - protein, 231 aa, Glycine max
  Coding DNA Sequence Number=SeqID_45154
  Subcellular localization annotation: CTP_CleavageSite=77; ConfidenceScore=5.37e-01
MSRLLAQQTSPLSEKNETFLMGVTSITPTFQKFVPFLLPLSLKLLSVRFCFFCFASFCSHQSFATQVLIRELAKRALCAKRVYFLRMNTHPPGTVPVAKYTDNVLGRHILAERKVEIYNTELDEFKAELERRNFHKRLTNLADSSIDLALVKEFYANLYSPGGPSPKQVRIQGHLIRICADNLNAFLETPVVLAEGESLPAYSRYCRMPTDIREIEAALCIPGRGFILNAE

SEQ ID NO: 161933 - protein, 171 aa, Glycine max
  Coding DNA Sequence Number=SeqID_45155
  Subcellular localization annotation: CTP_CleavageSite=55; ConfidenceScore=5.06e-01
SEQKTQAGFVSAFDKNIIRLVGVQKARDSAKVAKWRAITRTLWRMERPKVSNVTVAFAEAIRLNRQLSSKVEKKDLGGKVESIAIERDELVKVVVELEARLEELESKLNKSKPEAAKEREVSKELEKELLDVRQASFFAKDLDLGLFGPFKDGVFLDEEDINAKEEVVDEE

SEQ ID NO: 161934 - protein, 289 aa, Glycine max
  Coding DNA Sequence Number=SeqID_45156
  Gene Ontology: Mol. function=RNA-directed DNA polymerase activity; Cellular component=chromatin; Biological process=chromatin assembly or disassembly
  Pfam annotation: Domain name=rve; Domain location=31-192; Score=66.7; E_value=7.3e-17; Accession=PF00665.16; Description=Integrase core domain
MVASLVLSGCSVRVLVRQKRERDKSVFYGCYTEHVWQHITMDFIEGLRLSFVKQVIFAMVDRLSKAAHFMALSHPYTAADVAQCFLDHVFKLHGFPETITSDRDPVFVSHFWKEFMSLQGIQVQLSTAYHPQTDGQLEVVNRCLETYLSTIKASPYEIVYGQAPLVDLPYLLSELKIALVNRSLQKRDEMLKLLKFHMKRTQDRMKQLVDKGRSDRSFHIGDLVYVKLHAYHQVSVQAISNLKKFTGTATSGNFSPSPLLDTSQKEPEAITDRMTVKRRNRVVTKVLVQ

SEQ ID NO: 161935 - protein, 211 aa, Glycine max
  Coding DNA Sequence Number=SeqID_45157
  Gene Ontology: Mol. function=protein binding; Cellular component =mitochondrial outer membrane translocase complex; Biological process= protein import into mitochondrial outer membrane
  Homolog annotation: Hit_ID=P92792; Match level="QueryCoverage=60%, HitCoverage=62%, E-value=1e-52, Identity=78%"; Hit description =Mitochondrial import receptor subunit TOM20
  Pfam annotation: Domain name=TOM20_plant; Domain location=8-144; Score=249.4; E_value=7.3e-72; Accession=PF06552.3; Description=Plant specific mitochondrial import recep
MDLQQSEFDRLLFFEHARKAAEAEYEKNPLDADNLTRWGGALLELSQFQSFPESKKMTQEAVSKLEEALAVNPKKHDTLWCLGNAHTSQAFLIPDQDEAKVYFDKAAEYFQQAVDEDPSNELYRKSLEVAAKGLKNSDQPLPHILLSSFVFSLFFTSSWDILWPMSLSDYDDLTCGVGAGEPSTYTWQQPRLKKVTASSKRELYKMKRKMM

SEQ ID NO: 161936 - protein, 77 aa, Glycine max
  Coding DNA Sequence Number=SeqID_45158
MSASIIRLIKGCQRVVCPTGRAYRPMDVAEVDSWTSHDFERCLFLENMRGTRKIKDARWLSVHTPITRMTRRVNKYL

SEQ ID NO: 161937 - protein, 41 aa, Glycine max
  Coding DNA Sequence Number=SeqID_45159
MMKTPPVQDYIGNGDLPPDKEFDPGIFNTYSEYTPKQGFMT

SEQ ID NO: 161938 - protein, 58 aa, Glycine max
  Coding DNA Sequence Number=SeqID_45160
MPQPHGINMGLKEHSNRVSLPPRPRLRRICLGLTFLIQPILLSNNPYTYEFHDEKSPT

SEQ ID NO: 161939 - protein, 243 aa, Glycine max
  Coding DNA Sequence Number=SeqID_45161
  Gene Ontology: Mol. function=RNA-directed DNA polymerase activity; Cellular component=chromatin; Biological process=chromatin assembly or disassembly
MDASDVHKTAFRTYGGYFEYLVMPFGLTNAPATFQGLMNLVFQHYLRRLLLVFFDDILMYNRSMEDHLSHLHQVLLTMRTHSLYAKKSKFYFDVDKVEYLGHFITKEGVSTDPSKIAVVQDWPLSQNLKQLRNFLGLPAKEAFQELKQRLVTTPVLALSDTQLRQDILTWIHASTCGGHSGRDATLQKMKNLVYWRGMSKAVKFFVYQCATCQRTKYDTAASPGLLQPLPIPECGTLYPYNYN

SEQ ID NO: 161940 - protein, 130 aa, Glycine max
  Coding DNA Sequence Number=SeqID_45162
MDRIDTMKFVLERYGNDGKELDVDAVDSEGRTAIHMAATERAREGYQNYTFGMPHTGRQTVDDGAAREVARGRNLEAVREAVIKQEQEDDGHQKIDDDAAAREVVRGRNLEATAAIKATSLRVATKRETF

SEQ ID NO: 161941 - protein, 102 aa, Glycine max
  Coding DNA Sequence Number=SeqID_45163
MSELTRNSPQISTSPHQLDLAHYASGPYNAQWNAPRLLHDKHTLCSSRILREMEVEEPWLGLWLPLHYQVSFVVDLGMAFVDNWVVGKEKGCYWLSNDIVGL

SEQ ID NO: 161942 - protein, 67 aa, Glycine max
  Coding DNA Sequence Number=SeqID_45164
MDTKFQPEIDRTKLPLEVEEEEVTCPPSKHQEPYVAPKAFKKDPPKGIEILPPPKWKCDVPLFSPIS

SEQ ID NO: 161943 - protein, 193 aa, Glycine max
  Coding DNA Sequence Number=SeqID_45165
MEVMKEQMTTMMEAMMSMRRMMEVNAATIVATSTTTEADPTHPPGFNQVNHPASDIVGQGGKVLGSAGGPHFLQVQKKHSFPPYGLPPNYTPPNVAHAPDENVDNSSPILIESQQPQSSQAQVPQPMGRHMKLLLGMVEREKFDQIEEMLRVIEGGGDYSFADMAELCLVPDVVIPSKFKVPDFDKYKETTCP

SEQ ID NO: 161944 - protein, 198 aa, Glycine max
  Coding DNA Sequence Number=SeqID_45166
MGPKKSEIIRIPINNNIEYAKKVFPKDWFIPKKWVNFENLMEEEFSVKDLFDHEKDITQETVDIMLYQKLHPNTIDKKALVGFLRNVNLEYMCRFIHNFLFNIVMPRLGSRDYHSRTNFKRRTRRTLFLMRNGGVDVFELEPSTGATQLKCVTFVKMGITDNFPKYAQNHIKSKRSRKSRRRNHSQWLDKRKGLKSNQ

SEQ ID NO: 161945 - protein, 216 aa, Glycine max
  Coding DNA Sequence Number=SeqID_45167
  Gene Ontology: Mol. function=RNA-directed DNA polymerase activity; Biological process=RNA-dependent DNA replication
  Homolog annotation: Hit_ID=Q1RVP6; Match level="QueryCoverage=49%, HitCoverage=73%, E-value=1e-15, Identity=39%"; Hit description=80C09_ 29, related
MTNRKKNNKIHKLTNDLKVEVEGQQGLNATAYGYFSNMFKCTQSNYDPLVSIVQPYLIEKDKIKLVEPFTKAGFEKTLFQMHPGKSPGLDGLNVVFYQRLWALRGSEIAIACSKWNVIDTGKRDVLNSLQVKEGLEFGRYLGVPSREKLGMRKSVGGKRFRNIYAFNIAMLRKQGWNFMTILEALVLHIFKAIYYPKGDFLESKLGHKPCYSWSNI

SEQ ID NO: 161946 - protein, 47 aa, Glycine max
  Coding DNA Sequence Number=SeqID_45168
MLKCSKGIRKVLLTNMMSAYIACAASPRFVVTSPGSRGRVESPTSGG

SEQ ID NO: 161947 - protein, 59 aa, Glycine max
  Coding DNA Sequence Number=SeqID_45169
  Subcellular localization annotation: CTP_CleavageSite=35; ConfidenceScore=5.19e-01
MSVVFFLRAESPCSATAPPLVLSSPGKLRVVFSLRASALSRCRDDPYIVVSNIEDYGST

SEQ ID NO: 161948 - protein, 65 aa, Glycine max
  Coding DNA Sequence Number=SeqID_45170
MLMHSYVFPWTARPRFLMIALPSPDQASSADSSSQQLSPELSRTLESDQFPLLNDPNKAYIYMIK

SEQ ID NO: 161949 - protein, 144 aa, Glycine max
  Coding DNA Sequence Number=SeqID_45171
MRAGNSDIYGFLEPQSIQRFHCSGHWQMVVILPKEHLVFWFCSLHNRPDNYLKGIINSATKGLDDAPQPKSKAPARWIVVKCNRQKGTTECNYYVMHWMSTIILGSFRNNWEAYFNDPRPLEPERLKALRIQWAQFYLRIRDQA

SEQ ID NO: 161950 - protein, 138 aa, Glycine max
  Coding DNA Sequence Number=SeqID_45172
MLGPSTERLIYLALLYLVLRINTFSNAKNPNFAHQWVIRPKACNKISQQRYLAFHRKATPFSYKMRVKKKITYYTVARLAPVLRLVRVSEHLLSELGALSTGRDKRLVKRADDALSVQMLLRFSSRFSQLAKRAECLA

SEQ ID NO: 161951 - protein, 441 aa, Glycine max
  Coding DNA Sequence Number=SeqID_45173
  Gene Ontology: Mol. function=oxidoreductase activity; Cellular component=glycerol-3-phosphate dehydrogenase complex; Biological process=electron transport
  Homolog annotation: Hit_ID=Q9F811; Match level="QueryCoverage=60%, HitCoverage=83%, E-value=1e-101, Identity=65%"; Hit description =Putative amino acid oxidase flavoprotein ThiO
  Pfam annotation: Domain name=DAO; Domain location=123-393; Score =76.0; E_value=1.2e-19; Accession=PF01266.14; Description=FAD dependent oxidoreductase
  Pfam annotation: Domain name=Rick_17kDa_Anti; Domain location=4-45; Score=11.6; E_value=0.012; Accession=PF05433.5; Description =Rickettsia 17 kDa surface antigen
  Pfam annotation: Domain name=ThiS; Domain location=379-441; Score =39.4; E_value=1.2e-08; Accession=PF02597.10; Description=ThiS family
  Pfam module annotation: Pfam domain module=DAO::Rick_17kDa _Anti::ThiS; Domain location=123-393::4-45::379-441
MSHRGRNTAIGAGVGAVGGAVLTGGSTFGTLGGAAIGGLIGHEAIDNGLRDKVMAIDATVDHQRGADNRIKFAGFGQAFGQQRHFKRAGLTASCAKPSGAKASPIAGVDSLHLYLRVSVITERPIVLGSGVSGLCVATLLAERGETVEVIDDEARQPASWFAGGMLAPWCEAESAPAEGTLVLAPPRDNPELNRFARMTTAHQWVDPASLEPALENRFARGLFFPREAHLDPRRALSELRDKLLQRGVRFDARQPSGRIIDCRGIHARAQLSGLRAVRGEMLILQSHEVSFSRPIRLLHPRFPCYLVPRRDGHFMLGATMIESDDASAISARAMMELLSAAYTLHPALAEARVIESGSGLRPAWPANLPEIHYHNAMNIQLNGRTISTEATSLSELLIEQQIDAACVATACNGDFVPKSQYASLQLQEGWQLEVLSPMQGG

SEQ ID NO: 161952 - protein, 417 aa, Glycine max
  Coding DNA Sequence Number=SeqID_45174
  Gene Ontology: Mol. function=hydrolase activity, acting on glycosyl bonds; Cellular component=outer membrane; Biological process =metabolic process
  Homolog annotation: Hit_ID=P41052; Match level="QueryCoverage=65%, HitCoverage=77%, E-value=1e-114, Identity=72%"; Hit description =Membrane-bound lytic murein transglycosylase B precursor
RHRFAQLHQLRQIALNGMIGHAGHRDRFTGGRTAFGQRDLQQLRCASGIVIEQLIEIAHAIKQQDVRMIGLQAQGQPGWMVITLADNERADVSIFAQPASSASRCFWLATISNCDRRSKPAPQQQSAVVPAPKGGFLLEPSHAIQPMFGDFAGNPAAEQFIDQMVAKHGFNRDQLHAVIGQAKRLDYVLRLMDQQAPSYTPPTGPNGAWIRYRNKFITPDNVQNGVAFWNQYQDALQRAQQVYGVPPEIIVGIIGVETRWGRVMGKTRLLDALATLSFSYPRRAAYFSSELETFLLMARTEQDDPLDLRGSFAGAMGYGQFMPSSYKQYAVDFNGDGHINLWDPVDAIGSVANYFKAHGWRSGENVAVPASGQAPALENGFKTSYSVNTLAASGLAPQAGAGGRPGASGQHALILSL

SEQ ID NO: 161953 - protein, 119 aa, Glycine max
  Coding DNA Sequence Number=SeqID_45175
MVSGNRLQRECNRLPGLKGQEARRAASNRLPRGCNRLPGLEMKAAGCGGLCFHVLKLYNSSLASDEPARTLQRTVEWILPTATPYRLVEPVQVIEVTSSEEDPKEDLEELPPEPVVDAL

SEQ ID NO: 161954 - protein, 185 aa, Glycine max
  Coding DNA Sequence Number=SeqID_45176
MRTSNVLPSDHNSNLSLLKCQLVYAILTQMSVHVAQVCHPPGTLWTRISLTGPWVSDIDHGPLPVVQGSRHPSKVIRPPITRDFIEKYCTPRQAQGDGYQAANAPPPPRQVDPTGSLGMERYLQHLVRQQAANHHGQVQIHECLYRFSLSQQGQGSAENGFSFAGSHLPCREFIWSEDFPFPIFH

SEQ ID NO: 161955 - protein, 118 aa, Glycine max
  Coding DNA Sequence Number=SeqID_45177
  Gene Ontology: Mol. function=structural constituent of ribosome; Cellular component=ribonucleoprotein complex; Biological process =translation
  Homolog annotation: Hit_ID=P82278; Match level="QueryCoverage=55%, HitCoverage=33%, E-value=9e-25, Identity=86%"; Hit description=30S ribosomal protein S9, chloroplast precursor
  Pfam annotation: Domain name=Ribosomal_S9; Domain location=23-118; Score=69.7; E_value=9.2e-18; Accession=PF00380.9; Description =Ribosomal protein S9S16
MKIASIKKAYGFVECPIYRAYGSGASLLLDGRLEELINYFQGSLNVNQYCNNLKAEGGGLSGQAQAISLGIARALLKVSEDHRAPLRQEGLLTRDSRVVERKKVGLKKARKAPQYSKR

SEQ ID NO: 161956 - protein, 170 aa, Glycine max
  Coding DNA Sequence Number=SeqID_45178
  Gene Ontology: Mol. function=drug transporter activity; Cellular component=membrane; Biological process=multidrug transport
  Homolog annotation: Hit_ID=UPI000034F09A; Match level="QueryCoverage =94%, HitCoverage=29%, E-value=6e-40, Identity=52%"; Hit description =antiporter/ drug transporter/ transporter
  Pfam annotation: Domain name=MatE; Domain location=1-112; Score=-6.6; E_value=0.0042; Accession=PF01554.9; Description=MatE
  Subcellular localization annotation: CTP_CleavageSite=85; ConfidenceScore=5.07e-01
MDSVRVSNELGAGDFKAAKFSVWVVSITSVFIGVVAMIGVLSTKDYFPYLFTTSVPVANETTRLAALLGVTVLLNSLQPVLSGVAVGAGWQSLVACINIVCYYVIGLPAGIILGFPLGLGAEGIWSGMIAGIVLQTTILIIVTSIRNWKKEAEEAESRVKKWGGAIAYDQ

SEQ ID NO: 161957 - protein, 117 aa, Glycine max
  Coding DNA Sequence Number=SeqID_45179
  Gene Ontology: Mol. function=structural constituent of ribosome; Cellular component=ribonucleoprotein complex; Biological process =translation
  Homolog annotation: Hit_ID=P82278; Match level="QueryCoverage=61%, HitCoverage=37%, E-value=1e-12, Identity=55%"; Hit description=30S ribosomal protein S9, chloroplast precursor
  Subcellular localization annotation: CTP_CleavageSite=61; ConfidenceScore=5.36e-01
MALLRRPVPMIVCAANPPGSLDLTYFFRSSVSGSASAVAVTTREEGVLGKGETERERDSVLAKERVQGLWEMWEEKESEEREVVSADRETAIVFLPLPLQNRSSTTQGCSQNKGITI

SEQ ID NO: 161958 - protein, 100 aa, Glycine max
  Coding DNA Sequence Number=SeqID_45180
  Homolog annotation: Hit_ID=Q84V85; Match level="QueryCoverage=42%, HitCoverage=8%, E-value=6e-13, Identity=74%"; Hit description=Allene oxide synthase
LDAGLEELVAALLVEIVLPVLQGTDHREPAVAGDFADGELAWLRGVEGRERRAWWRLRMPFLMGRERAIATIYIERDDVLTSDHSPFKSAVSFIHLKNGD

SEQ ID NO: 161959 - protein, 103 aa, Glycine max
  Coding DNA Sequence Number=SeqID_45181
  Homolog annotation: Hit_ID=O22797; Match level="QueryCoverage=54%, HitCoverage=28%, E-value=7e-09, Identity=50%"; Hit description =Expressed protein
MEGTVFTPALQEIEHVKSDQGEILSKLFLDACKHILPAVASGGSNLARLGELGGKLLPYFAINRGRSEEERGSAFLALLILSKLLRKIVSVKKIQAKTLPLQL

SEQ ID NO: 161960 - protein, 112 aa, Glycine max
  Coding DNA Sequence Number=SeqID_45182
MTCTPHHRYAFRHDKSTLHNIDPPSAVTHLQRTSPSLLDDIEKIPNKMSSKKTLLVTNVNFPISLVEKTPLHVVVEMVVVLLDHHVDTNVLTLGGCDPAGHPQNPNIGLPPR

SEQ ID NO: 161961 - protein, 107 aa, Glycine max
  Coding DNA Sequence Number=SeqID_45183
  Homolog annotation: Hit_ID=Q1RZZ2; Match level="QueryCoverage=56%, HitCoverage=30%, E-value=2e-07, Identity=45%"; Hit description =Ribonuclease H
MKDVFGKGNKSACGGVLQDHNVSFICGFGANLGGCLVLIAELKAMMVGLKLAWSRRFQKICVNFDSPLEVELLSEESQQVAYGLAKHAMEDGFTSVFEFAPSFVLEV

SEQ ID NO: 161962 - protein, 171 aa, Glycine max
  Coding DNA Sequence Number=SeqID_45184
MGRGVQCFRMFGEDGYWVGDEDDAECGVPVTKMRPPQQPLGFPVMPYGKPEKPLSNSKNLDLEEDVRKETLKQGGFINEDTNEKKQHKGGIIIKKSTTTRKFFGTIPVKGGIGGYLVRTIKEALGGSICSGVCVVKDDKAEANHIWDIATNMRVLYARNKEQRWKVYVDKP

SEQ ID NO: 161963 - protein, 333 aa, Glycine max
  Coding DNA Sequence Number=SeqID_45185
  Gene Ontology: Mol. function=RNA-directed DNA polymerase activity; Biological process=RNA-dependent DNA replication
MERRRDNNNVAIGGRDMNTFNKFTRDLEVEDISLQSFDVQGRVAYIFKEKLKLLKKELKKWNLEKFENLEKQCKKLIAKVNFLDVIDEEVGLTKEEIERRRICEGEYWEIAKRHESFLHQKSRTKWIKDGDGNTILFFHNVINWRRRKNAIKGLQLGGRWIEDPCRVKRVKEVVWESGGDKSLVLDAENSSFITLIPKDLTEFWPISLIGGRNMLDSILIVNEVVDDAKRRKKPCLIFKVYFKKAYDYICWDFLIYMMVRMSFNHKWISGIKTCLEMTTISILVNGSPTEEFKPRKRLRQGDIIASFLYLIVAEGLSSLMRQALKIGKYVGHK

SEQ ID NO: 161964 - protein, 93 aa, Glycine max
  Coding DNA Sequence Number=SeqID_45186
LGRIDGDPVLREMRIWATWEYVSSVGGGQQGMSGTWRYVAGVRRPWGRQASSWQSTDKRKTRPQSKEACGGWPAGAKMVSGNRLPGDVIDYQA

SEQ ID NO: 161965 - protein, 379 aa, Glycine max
  Coding DNA Sequence Number=SeqID_45187
  Gene Ontology: Mol. function=transferase activity; Biological process= biosynthetic process
  Homolog annotation: Hit_ID=Q5XWK4; Match level="QueryCoverage=75%, HitCoverage=75%, E-value=5e-60, Identity=42%"; Hit description =Expressed protein-like
  Pfam annotation: Domain name=DUF616; Domain location=69-370; Score =570.3; E_value=1.9e-168; Accession=PF04765.4; Description=Protein of unknown function (DUF616)
MSCVLVILMDKYVSEVVISVVRLLECCLKLLPPEKLEQLDIPVEEESSSVPVGEVLYMSESDRSFVGGSVTLSQLRTEDTRFNLFTGNQTFDQRDQSFEVKETLAVHCGFYSVNGGFKISDEDKSYMQGCKVVVSTCAFGGGDDLYQPIGMSEASLKKVCYVAFWDEITLKAQELVERRIGENGFIGKWRVVVVQDLPFADQRLNGKIPKMLSHRLFPQAKYSIWVDSKSQFRRDPLGVLEALLWRTNSLLAISEHGARSSVYDEAKAVVKKNKAKPEEVEVQLNQYRKDGLPEDKRFSGKKALCEASVIVRKHTPVTNLLMCVWFNEVVRFTSRDQLSFPYVLWRLKAFKNINMFPVCTRKDLVNSMGHVRKAKPLQS

SEQ ID NO: 161966 - protein, 58 aa, Glycine max
  Coding DNA Sequence Number=SeqID_45188
MVKSNAILKDPVFNLATPGGKIIFPNYRTQISSGKTKGHKNHFQTQRMETQDKPATLI

SEQ ID NO: 161967 - protein, 145 aa, Glycine max
  Coding DNA Sequence Number=SeqID_45189
  Homolog annotation: Hit_ID=Q5YLM3; Match level="QueryCoverage=99%, HitCoverage=12%, E-value=2e-42, Identity=62%"; Hit description =Roothairless 1
VLQGLDAATSCVEDMDEWLSIFNVKLRHMREDIASVRTCALQFKNINFLDTIYSLVVMAVFAGSMIETRNNNLEMQSVNNKSLIEELDKLLERLRVPSEYATNLTGGSFDEARMLQNVEACEWLTSALRGLGVPNLDPSYANMRT

SEQ ID NO: 161968 - protein, 57 aa, Glycine max
  Coding DNA Sequence Number=SeqID_45190
  Gene Ontology: Mol. function=hydrolase activity; Cellular component =membrane; Biological process=metabolic process
  Homolog annotation: Hit_ID=Q67Y53; Match level="QueryCoverage=87%, HitCoverage=19%, E-value=2e-17, Identity=82%"; Hit description=MRNA, , clone: RAFL25-14-B08
MAIGDGENDVEMLELASLGIALSNGSEKTKSVANVIGLSNDEDGAADAIYRSSKLKA

SEQ ID NO: 161969 - protein, 75 aa, Glycine max
  Coding DNA Sequence Number=SeqID_45191
  Homolog annotation: Hit_ID=Q6K3A9; Match level="QueryCoverage=92%, HitCoverage=58%, E-value=5e-20, Identity=67%"; Hit description =Pentatricopeptide (PPR) repeat-containing protein-like
MDIIDSGMRSKIVRDKFARLTQMAKILNLDKVSEILDFWGENSGPMTWRLTLAEVRHVLGLLVDFKPEAIAALKL

SEQ ID NO: 161970 - protein, 72 aa, Glycine max
  Coding DNA Sequence Number=SeqID_45192
MENWRTALGNDIRGAPDSKVEWRMENWRTALGNDIRGAPDSKVEDTCTALGNDIHGAPKKVENGELANSAWQ

SEQ ID NO: 161971 - protein, 161 aa, Glycine max
  Coding DNA Sequence Number=SeqID_45193
  Gene Ontology: Mol. function=protein-tyrosine kinase activity; Cellular component=membrane; Biological process=protein amino acid phosphorylation
  Homolog annotation: Hit_ID=Q709M0; Match level="QueryCoverage=98%, HitCoverage=43%, E-value=4e-64, Identity=73%"; Hit description =Protein kinase 2
  Pfam annotation: Domain name=Pkinase; Domain location=3-161; Score= -106.3; E_value=0.032; Accession=PF00069.15; Description=Protein kinase domain
  Pfam annotation: Domain name=Pkinase_Tyr; Domain location=1-159; Score=-80.8; E_value=1.6e-07; Accession=PF07714.7; Description =Protein tyrosine kinase
  Pfam module annotation: Pfam domain module=Pkinase::Pkinase_Tyr; Domain location=3-161::1-159
MEAAIKKLDTSSSPDPDSDFAAQLSIVSRLKNEHFVELMGYCLEENYRILVYQYASLGSLHDVLHGRKGVQGAEPGPILNWSQRIKIAFGAAKGLEFLHEKCQPSIVHRDVRSSNVLLFNDYESKVADFNLTNQSSDTAARLHSTRVLGTFGYHAPEYAKT

SEQ ID NO: 161972 - protein, 526 aa, Glycine max
  Coding DNA Sequence Number=SeqID_45194
  Gene Ontology: Mol. function=ubiquitin thiolesterase activity; Cellular component=barrier septum; Biological process=ubiquitin -dependent protein catabolic process
  Homolog annotation: Hit_ID=Q9FPS7; Match level="QueryCoverage=63%, HitCoverage=47%, E-value=5e-73, Identity=45%"; Hit description =Ubiquitin-specific protease 20
  Pfam annotation: Domain name=UCH; Domain location=2-224; Score=108.2; E_value=2.4e-29; Accession=PF00443.19; Description=Ubiquitin carboxyl- terminal hydrolase
RYQQEDAHEFMQCTLDKLERCFLGLKKSNLNFEDVNLVEKVFGGRLISKLQCSTCDHTSNTFEPLIDMSLEIDNVDSLPSALESFTKVENIDDNLQCDNCKEEVSMEKQLMLDQTPSVAAFHLKRFKTDGILVEKIDKHIDFPLELDLQPYTIKVMEDPGAENDVPLKYDLYAIVVHTGLSSTSGHYFCFVRSAPDTWHKLDDSMVTEVSVETVLSQEAYILFYARQGTPWFLSIMEEKTQCLNPNIMSTSPKSVLDVGDNMSKSNPILLPNIERSVAEESKEYSEPQFDYYCQEDHGFLEINDTEDVTHGSGQLLSGSNQEIFYSNTSKDVDAQKLFSSRGGHKVATHGCGQLLSGLNQESVGLNSSKNVDAQQLFRNWTTLDDSAMFDIGNSYIENGSLDNDNTFQEAVDFLEKAGFHSLTLPSLPPDDAPDKFHISCDNLKRENHRSCKRSSNKLTGDSEERREAVKYLCKNRSRRGALLKFVTPNKVLDKKRKNMDSLQCKKSTKKPSHTSVTPPVAAGSSR

SEQ ID NO: 161973 - protein, 57 aa, Glycine max
  Coding DNA Sequence Number=SeqID_45195
MPTWARGSSLARQGELGGKLLPLFPINTERREEQKRSTLLIFRRLSFVLHRSSVLNR

SEQ ID NO: 161974 - protein, 159 aa, Glycine max
  Coding DNA Sequence Number=SeqID_45196
  Homolog annotation: Hit_ID=Q9FPS6; Match level="QueryCoverage=28%, HitCoverage=6%, E-value=4e-09, Identity=56%"; Hit description =Ubiquitin-specific protease 21
MASEEPMDAPPAPNLLSETLSAAELVADLGGDYALFPPGGGSTEFRQLDDDVSSSLWSSALVSNSRVSAVAPESWIAPQGNWLLPENEGSDNAESASEVVPSKMGAGLVNLGNTCFLNAILQCFTHTVPLVQGLRSSTHPIPCSVLLGFTDDPVLFDFL

SEQ ID NO: 161975 - protein, 158 aa, Glycine max
  Coding DNA Sequence Number=SeqID_45197
MSEKNNNVDASDCMILDDHEGEEHCYGKGTNARSVSFLPRSQEKIGDSAKVVIKQDIKGGEHKYGFNNNKREKPEKVRVVDDETGDKHELFVVLRMPSRTKNRCLKFFTEGRRVIINIVFYIYQTPNPMHVKYTQYFDYPSPFEYRLKANWETYKIQI

SEQ ID NO: 161976 - protein, 331 aa, Glycine max
  Coding DNA Sequence Number=SeqID_45198
  Gene Ontology: Mol. function=inositol or phosphatidylinositol phosphatase activity; Cellular component=cytosol; Biological process= sulfur metabolic process
  Homolog annotation: Hit_ID=Q38945; Match level="QueryCoverage=96%, HitCoverage=83%, E-value=1e-111, Identity=64%"; Hit description=PAP -specific phosphatase HAL2-like (3'(2'),5'-bisphosphate nucleotidase) (EC 3.1.3.7) ...
  Homolog annotation: Hit description=(3'(2'),5-bisphosphonucleoside 3'(2')- phosphohydrolase)
  Pfam annotation: Domain name=Inositol_P; Domain location=1-327; Score= 143.1; E_value=7.3e-40; Accession=PF00459.15; Description=Inositol monophosphatase family
MVLKVFVSGANVAHKILGVQNVSIVAEEDIETISKDESASLLEAVVNTVNESLAFASKYGLQCPETTLGTPEVLEAIARCNSTGGPRGRYWVLDPVDGTLGFVRGDQYAVALALIEDGKVVLGVLGCPNYPVKIEWLNYHYQHHQTMPESSLKTPDTGGKGCVLYARKGSGEAWLQSLIDGDNMLEWPNCARLIRVSSIDDPALATLCEPVERANSNHSFTAGLAHSVGLRKQPLRVHSMVKYAAIARGDAEIFMKFAKCGYKEKIWDHAAGVVIVEEAGGVVTDAGGRPLDFSKGMYLEGLDRGIIACSGVALHEKLIDAVYASWDSSNL

SEQ ID NO: 161977 - protein, 191 aa, Glycine max
  Coding DNA Sequence Number=SeqID_45199
  Gene Ontology: Mol. function=nucleic acid binding; Biological process= DNA integration
  Homolog annotation: Hit_ID=Q1SRN1; Match level="QueryCoverage=65%, HitCoverage=14%, E-value=6e-28, Identity=36%"; Hit description =Integrase, catalytic region
MKTFVDLPFSRSPIGYKWVFRVKENPDGIVNKYKAKLVAKEEVYMTQPPGFEDSNKQLVCKLNKAIYGLNNNPNFIKSLISKLNFEFPLKDLGPLDYFLGIEVNSQPNGYLILTQSKYVRDLMAKTTMDKVIGRHLQVVHFPIADQRANILTKKKPRCEKENCKVHKPFPDHHKSDLHLTRALFLFSSSSP

SEQ ID NO: 161978 - protein, 65 aa, Glycine max
  Coding DNA Sequence Number=SeqID_45200
METISKQFEELDVYGKFTLKSKLQEIAYPDLNSMCAPPEKATMDKWMNITDIRYMIASRTIIWLK

SEQ ID NO: 161979 - protein, 227 aa, Glycine max
  Coding DNA Sequence Number=SeqID_45201
MVYGLVMKMNMDSLSLAINLTYIRKNYWNPADLSITFLRSRKAKARTPAEAPPVAPPPPRLSVSPFSSTPLDQIIPMLQSIHHGQCLVIQSIHHLSQQQPVISLQDFLEQALEAQDPAGETDKADACAADAEMAQDPIDEADDADVGAIDAEMDADYVADVTSAQGAWDPWPTQDRKYRQGIGREVEAQRFTLNAPGLLSELLSRSRGFSLSAKKQHGESAVMRRGA

SEQ ID NO: 161980 - protein, 201 aa, Glycine max
  Coding DNA Sequence Number=SeqID_45202
MGGGIKVGVRKNTPGLSQCGQILPQQLPSEVAVPVAIQLMEEFVIMGMRELNIPFRVALNALWNQEKGWLSATRALSLIRDKGQPERFGLRAEGALCLEVKGVLGLSAMVELSPCKKTQKPRNYEHKKGLTKRKEQAYQVRPKPKKSLKEIMNSLNAQRVHHNPVKIAKKGMNSLSSWVRLSEFIKNPETMKKIMNLLGAQ

SEQ ID NO: 161981 - protein, 174 aa, Glycine max
  Coding DNA Sequence Number=SeqID_45203
  Gene Ontology: Mol. function=RNA-directed DNA polymerase activity; Cellular component=exocyst; Biological process=RNA-dependent DNA replication
  Homolog annotation: Hit_ID=Q1SFJ7; Match level="QueryCoverage=86%, HitCoverage=17%, E-value=1e-30, Identity=44%"; Hit description=RNA -directed DNA polymerase
MKLSVTLNRFSLSQFLSGLIFLLPKVVTSSFITLAPKKDNSQSVADYCLISLIGSVHKIWSKLLILWLRRVISKVISSCQNAFLLGRYILDDVLVANEFVDYVDRHNKGYVLFKIDFENAYDSISSDFLDYMMERLGFSMKWRSWVKAITCGSNNFVLVKDSPTIEFQSQKGLK

SEQ ID NO: 161982 - protein, 86 aa, Glycine max
  Coding DNA Sequence Number=SeqID_45204
  Gene Ontology: Mol. function=RNA-directed DNA polymerase activity; Biological process=RNA-dependent DNA replication
MEQNLWVIKAILHSFKLVSGLRINFSKSKLYGINAPMNFLEGATTFLHYFVATIPFKFLELPIGINHRREIAWELIVKLFRKTLSS

SEQ ID NO: 161983 - protein, 218 aa, Glycine max
  Coding DNA Sequence Number=SeqID_45205
  Homolog annotation: Hit_ID=Q93YI7; Match level="QueryCoverage=29%, HitCoverage=8%, E-value=2e-27, Identity=82%"; Hit description=Inward rectifying potassium channel
MDNADDKQFTIPACIEAEQVTRKGMVYFDFMRSFRVEFDEYFEDGLISMIEVGMVSCGELRYPSCSVKHGWRYPGIGEFQDDDFKLIGRMSPAQGGYGTYMLIFQQPLDMQHLVLLLCMTILAQFMEVVVESFLARNQHEQKSRKQKHEVNLFSVHCVGCFNYLIADRYLDSKRTWIGAVYPNFKEESLWDKYVTAIYWSIVTVTTTGYGDLHKRDVV

SEQ ID NO: 161984 - protein, 69 aa, Glycine max
  Coding DNA Sequence Number=SeqID_45206
  Subcellular localization annotation: CTP_CleavageSite=57; ConfidenceScore=5.47e-01
MTAPWRSWRLWQHGANSIFLFFFSAVGVGLTRPNPTRLNQNSERSPPPTKSATPAPSCDHPHAKRSQQQ

SEQ ID NO: 161985 - protein, 125 aa, Glycine max
  Coding DNA Sequence Number=SeqID_45207
MVGYTPSNFTDLVFAGEKIEVGLERGKFNNPALMNEKTRANEEGENEGETHVAIAITTWPNFPPAQQCHYSANNKPSPYPPPSYPQRPSLNQPQNPPTTRPMLNTTFSTNQNTNQEMSFAVKKNL

SEQ ID NO: 161986 - protein, 99 aa, Glycine max
  Coding DNA Sequence Number=SeqID_45208
MAHIKKTGQMTSEAAKQIADKIDVLTTVIGQPEYPSRVRAVGASVTIKQYFELAPRTSRTSSSMAPEDLEQLTQQIRDQLEESITEKVTRQLMLSFSQM

SEQ ID NO: 161987 - protein, 69 aa, Glycine max
  Coding DNA Sequence Number=SeqID_45209
MRLHGRIGLSYVRTITLKTRCFCKGHRMIQKQTGIAGIVPETASAEPKSDVQIAGKAKRRITKPHHLKD

SEQ ID NO: 161988 - protein, 60 aa, Glycine max
  Coding DNA Sequence Number=SeqID_45210
MQYTLANCRYALKDNVVIWFCSLHNRLDNYLKGIINSALKEFNNSQGSKSKVAARWILVK

SEQ ID NO: 161989 - protein, 368 aa, Glycine max
  Coding DNA Sequence Number=SeqID_45211
  Homolog annotation: Hit_ID=P0AD05; Match level="QueryCoverage=56%, HitCoverage=93%, E-value=2e-67, Identity=55%"; Hit description =Hypothetical protein yecA
  Pfam annotation: Domain name=SEC-C; Domain location=194-214; Score =19.1; E_value=0.0041; Accession=PF02810.6; Description=SEC-C motif
MAWLEETLMSYGHDDASVLDVSELDGMLTAVLSGPVVVEPDTWLVAVWGGEKYIPRWKNDREMNRFIDLCFKHMNDIAERLSEYPDQFEPMFGYNDVDGETYTVVEEWCYGYMRGVALTDWSALPDELKADLDVIALHGSEENGGELDELTEEEYAASIERIQPAALRLYNYWVNNPQQPEVKKPMVNGTKVGRNDPCPCGSGKNQTQRTAAVSLQLRGIPVEDAAGDSSMPAGKGGSGPEPTVPPLRTPAPSQTREDRRGRRPAVAGSGIAALEQVGQVIEQAEGHAEERGRQRQVGKQVYRQLNVRGGDDLPQRQQKAVQTRMLCHQPNKGNKRDRAAPHKDAAQLANIAVHIADNAWHAAVEAKR

SEQ ID NO: 161990 - protein, 93 aa, Glycine max
  Coding DNA Sequence Number=SeqID_45212
MRSIWAHEIQLSCLQKKNEKSDMRNFKEKKEKKGYITWEDNVINSSSDSEKKIISLGIMMKDYVNGEEQSRYIDSNFSKHMACIKVYSYFSPR

SEQ ID NO: 161991 - protein, 110 aa, Glycine max
  Coding DNA Sequence Number=SeqID_45213
MEDESPEATIPEPFDIGEEAEETQVRQVAATTPEQSLEATLEPSTPVVNLPPPHPAAHPSTPLLHILEDPTTPILAVDTSPPTTPVFQLTDERMVRHRTHRISHRNFDSR

SEQ ID NO: 161992 - protein, 91 aa, Glycine max
  Coding DNA Sequence Number=SeqID_45214
MMIWKQRAKLVMATARTTFLNEKLYTVPELQQTLLTTTKMKHEYGDPTVMWLCMPSDSWVTVTKIRVVDKSRAFAPTYPQFVMRNSDLRSS

SEQ ID NO: 161993 - protein, 83 aa, Glycine max
  Coding DNA Sequence Number=SeqID_45215
MEFKFYASWSYHRGVVISGPFSKTAVNYNAGCKTGMANVVPLSFDLAIEILVELVTKHECTYYYKARFLHRSKMTFYIGGQPM

SEQ ID NO: 161994 - protein, 203 aa, Glycine max
  Coding DNA Sequence Number=SeqID_45216
  Gene Ontology: Mol. function=ATPase activity, coupled to transmembrane movement of substances; Cellular component=integral to membrane; Biological process=transport
  Homolog annotation: Hit_ID=Q6Y3H9; Match level="QueryCoverage=57%, HitCoverage=11%, E-value=6e-21, Identity=46%"; Hit description =Multidrug resistance associated protein 2
MRIIGYVCNVNTGIKPDLKKLRSCKLEMHSPFYIIYTIYANFYTFDFTWQNINIEGLSQSYMMECLLGLLKSKTVIYITHQVEFLPNADLILVSDSRISWSRIQTTAFRQFTILLVSDFELEKNVENTNDQTDKSNDTVVEPKGQLVQEEEREKGRVGFKVYWKYIITAYVGTLVPFILLQSKGWISDWIFYLLSHLPAVWFS

SEQ ID NO: 161995 - protein, 109 aa, Glycine max
  Coding DNA Sequence Number=SeqID_45217
  Subcellular localization annotation: CTP_CleavageSite=31; ConfidenceScore=5.00e-01
MNINVKGEWILMHIMSCPNFLSLSSYYSITSSNYGTSHVLVLADFSPSTRTTKLEKLFENFKDCGFVIRWVNDTIALAVFRTPPVGNSTFNIGADKYGVFKMVLTSVPS

SEQ ID NO: 161996 - protein, 88 aa, Glycine max
  Coding DNA Sequence Number=SeqID_45218
  Homolog annotation: Hit_ID=Q1S5H4; Match level="QueryCoverage=43%, HitCoverage=8%, E-value=3e-13, Identity=92%"; Hit description =Glycosyl hydrolases family 17, putative
MFLKKRDSERNLGVEAIKIVRVEVDQEGGVGVVKELEEWRFVLLKYYLEPLGHGNTRELLKYYTWYEGHHIQIGENCMVLHRLMVRQS

SEQ ID NO: 161997 - protein, 221 aa, Glycine max
  Coding DNA Sequence Number=SeqID_45219
  Pfam annotation: Domain name=DUF296; Domain location=9-134; Score =6.9; E_value=0.00013; Accession=PF03479.5; Description=Domain of unknown function (DUF296)
MAMPGEPFVRIVIINVDPSKDIMESILDAVHLGRAYLTILNTFGTVTMVILHNSLHVVATLTLHEPFTLLCLNGSYLLNNNFNLNFRAIIPPPLSFGIHLSTSRGQAIGGAIGSQVIVDGNVKITLWTFWHPKIYKYIPEGNKVSSSSPARAVVQQLKRIVVVAIRYHNHGIGSDKNKDKRLSDGGLDSTTEGFGFSHNPLKMLNGLGEDWPIGQVHQMTS

SEQ ID NO: 161998 - protein, 47 aa, Glycine max
  Coding DNA Sequence Number=SeqID_45220
MEKGTSLPMEKGFKILLFPIIDSLGNPLRIFTCGIRACVMKFMILQE

SEQ ID NO: 161999 - protein, 67 aa, Glycine max
  Coding DNA Sequence Number=SeqID_45221
MTTLCKSKGRKSEHFQKDYLKCKSWFEKKSELNARRFLTIQTISSNEKFIFMGNRVKLQCKQLRLIA

SEQ ID NO: 162000 - protein, 47 aa, Glycine max
  Coding DNA Sequence Number=SeqID_45222
MEIKHELYRQIGFHMESLLNLCLLIMLERYTSHEDWSMIINTARMHG

SEQ ID NO: 162001 - protein, 331 aa, Glycine max
  Coding DNA Sequence Number=SeqID_45223
  Gene Ontology: Mol. function=DNA binding; Cellular component=nucleus; Biological process=regulation of transcription, DNA-dependent
  Homolog annotation: Hit_ID=Q40173; Match level="QueryCoverage=68%, HitCoverage=81%, E-value=2e-76, Identity=63%"; Hit description=Myb -related transcription factor
  Pfam annotation: Domain name=Myb_DNA-binding; Domain location=14-61; Score=44.3; E_value=4.3e-10; Accession=PF00249.21; Description=Myb -like DNA-binding domain
  Pfam annotation: Domain name=Myb_DNA-binding; Domain location=67-112; Score=39.2; E_value=1.4e-08; Accession=PF00249.21; Description=Myb -like DNA-binding domain
  Pfam module annotation: Pfam domain module=Myb_DNA-binding::Myb_DNA -binding; Domain location=14-61::67-112
MGRQPCCDKVGLKKGPWTAEEDKKLINFILTNGQCCWRALPKLAGLLRCGKSCRLRWTNYLRPDLKRGLLSEYEEKMVIDLHAQLGNRWSKIASHLPGRTDNEIKNHWNTHIKKKLKKMGIDPVTHKPLSNKTEETQAQPDEQTHQPLQEQQQQQHQHQQQPIPVEKDLKFEPEKEQNREPETSVESSTITEEVKEEDQIMTPLFDSWELMNEFCTDEAPIIEPNEILVPSAPSSASPTTTTISSSTSTSSYSNSSNFLEDLLLPDLEWSDDYNDTNFDNNSSMALWDDDFIGSWNSLINGDGDRKQVFDAPINQYPSVIMDSDSWDYGLF

SEQ ID NO: 162002 - protein, 323 aa, Glycine max
  Coding DNA Sequence Number=SeqID_45224
  Gene Ontology: Mol. function=transferase activity, transferring phosphorus-containing groups; Cellular component=membrane; Biological process=peptidyl-histidine phosphorylation
  Homolog annotation: Hit_ID=Q2KVA5; Match level="QueryCoverage=60%, HitCoverage=40%, E-value=3e-66, Identity=65%"; Hit description =Sensor protein
MQTLPRRSGRPCAWPSPGAGGVDSPERAEIAIRIPVSASRPPSAAGKNPGPMAVRALGMAPRACAIRLFTTSRLADYGRKLLIRFLCAVAILNPGVIPDGERCVAPRGSGRWNESLAELLFAGELDVGGTRILRDGRRQRQPQHGGQADPALRVGLAVAQFDVAIVAAGIGPGDGQSQARAGGCHRFVGPDTLEAGEGAGSQERLQAGAVIGHGHLGAVFDPADRYRDARPDGRVMDGVVDQVGQGLMQFGFAAGHGRADFLALRVDGLHPAQILLLFVRQRQVLQHHLARDGVHVEQLARQLVRLVGMRQRQQLLGQAAGAA

SEQ ID NO: 162003 - protein, 141 aa, Glycine max
  Coding DNA Sequence Number=SeqID_45225
MHKALRLNAPLPYPHLVTLFHQHFNIPLDSEPYVPIKRSFLIGASVIASFGYIKEHDGSWVKKGARNVGEEGQEGEDSSLLSKIMDRFDGLQTFVGERFDTLELQMDMRFNEMESRITKVEEDVSYIRSSFDLPPPPPPSS

SEQ ID NO: 162004 - protein, 86 aa, Glycine max
  Coding DNA Sequence Number=SeqID_45226
VAWPEAQPSLFGGGAASAAQEPALEEPAAVVAVEGEDELTPPKPFYFDADVHMAQEEETSTDQIPGPSPTPTPDDAIPFAPTSKLE

SEQ ID NO: 162005 - protein, 146 aa, Glycine max
  Coding DNA Sequence Number=SeqID_45227
MASRKRKAIASRPQPHYDTYRLTYEDTWNCCADNILGQNILLERNAKLFVTKFDEFRIELVRRNWHRTLTNLMEGSIDVALVKEFYANRYDPKDKFPKQVRVRGHLIKFDADSLNTFLETPVVLEPGETLPAYSRFCRLRPDPQEL

SEQ ID NO: 162006 - protein, 149 aa, Glycine max
  Coding DNA Sequence Number=SeqID_45228
  Gene Ontology: Biological process=cell redox homeostasis
  Homolog annotation: Hit_ID=Q1T131; Match level="QueryCoverage=84%, HitCoverage=72%, E-value=6e-39, Identity=65%"; Hit description =Thioredoxin-related
  Subcellular localization annotation: CTP_CleavageSite=81; ConfidenceScore=5.55e-01
MSLFLHCHAPHHSMATLSPFSTFNSKPLCASLPNPSFLTHQQQQQHPYPLTTTTTSDHKPLSVSTLPRKLLCKPPKGKYVREDYLVKKLSAQEIQELVKGERKVPLIIDFYATWCGPCILMAQELETHNVSDVLFQSLLISPSKKEDSG

SEQ ID NO: 162007 - protein, 78 aa, Glycine max
  Coding DNA Sequence Number=SeqID_45229
MSPKKTIGKKGVVTGHMIRGTRVKYPSAKSEGQGNKGYKITKLTHDSNKWQGRCCTCDGGQQHSCSVRVVGGSDDGHR

SEQ ID NO: 162008 - protein, 64 aa, Glycine max
  Coding DNA Sequence Number=SeqID_45230
MTNCTDYTDLNRACPKDAYLLPNIDRVCEGKFLSFMITHQGIEVNPDKYTAILEMHNPTNIQEV

SEQ ID NO: 162009 - protein, 572 aa, Glycine max
  Coding DNA Sequence Number=SeqID_45231
MARTSCRTGGGTSLPRERAQPSVAAEELVLVTVILPLSASRVRGELVATEIVSKNLFEFDTNVFNHFKDHFFKVLVIDVVADGMPLMFNRDGEPLFPFYWQFDPIRFKSYDEDLLTIVERVDKEILEQLPASLEARAILSLPSASDHFTSLDDNVMGDFAWRPLVKQVGPTGGDVPPSVDASSTGEEGQHASEVGPIIVVVEVVASAPSSILVKRKRDDATGPSSHKKLKAPMSLYALRQAAGLGSIAGRLMIAQDVPLAPPVINEVFPIVVKVVVPATQADSVVVSSSTIVALLLSVGVVTTSAPRVLPLSSSAPMVLSAAVLAAMGSPSSFSHPHVSLDHLSISSDANSLWAIDKNLIRLAGVQNATNSAKVFLQRSLEILEENGLRHQEAVQKVVFLEAEALRVNCQLSSKVGDALAKLLHTRLDGDELFNCCKCLQAEKIDLGGKVESMAAKKDGFAKRIAELEARLRESESTLEGSELRASKEREASMKLEEELILYKKKVVEQHEKGFQKAVKKVGFFAKDLDLGLFDPFKDVKEGVWLDEEQIDAEEKVVDEGQGVVKQGDDVCV

SEQ ID NO: 162010 - protein, 85 aa, Glycine max
  Coding DNA Sequence Number=SeqID_45232
  Homolog annotation: Hit_ID=Q0KIN0; Match level="QueryCoverage=67%, HitCoverage=3%, E-value=2e-07, Identity=50%"; Hit description =Integrase core domain containing protein
MVALHGSGTWELFSLTSSENYYWLLGLYSEGIKVAQSSSSIVISQRKYTLDILTESDMLGSHPSDTLMDPNVKLFMAQGEPLEDP

SEQ ID NO: 162011 - protein, 213 aa, Glycine max
  Coding DNA Sequence Number=SeqID_45233
  Subcellular localization annotation: CTP_CleavageSite=37; ConfidenceScore=5.02e-01
MVIRFCFFQDYYSLLCLLKTIKSVGMQRQSWSPTFVVCKTIAVFFAFQRQSSPLAYGDNHGHPFLLFSRLLQSFSSSKDNQVCWQSETIMSSALYLFKDHQSLSSRLRCLPYFARLQGFTDWAFASGRSDGFMTFRKEMCKIFKRGAKGSLLGHFSAPGLTRKHRAEVTNTPGHEGAEEKGPASYIERFSLKLVRRRRKKKKNQGWGASVMLP

SEQ ID NO: 162012 - protein, 364 aa, Glycine max
  Coding DNA Sequence Number=SeqID_45234
  Gene Ontology: Mol. function=DNA binding; Cellular component=nucleus; Biological process=regulation of transcription
  Homolog annotation: Hit_ID=Q1T126; Match level="QueryCoverage=89%, HitCoverage=96%, E-value=3e-93, Identity=59%"; Hit description=Myb, DNA-binding
MEDNNNNNNKAEKQQDDSSHHPSLLLPKPNHSTINNIKEDHHQSPRKLAIGGGGGGSGDRLKRDEWSEGAVTTLLEAYEAKWVHRNRAKLKGHDWEDVAKHVSARANSTKSPKTQTQCKNKIESMKKRYRSESATTADASSWPLYSRLDVLLRGTGLISSSLPPPIAATAIAAPSQSPHATINNNQALVLLEPPSLAVLQAPPSVAPPPIAIAQNSHGPNGVERLLAKEDGIGAKSSEQVSNKNPMDSDSSTPALYSKKDKVRCNKRKMKSENNNKRRRNNNNNNEDVEIAKSIRWLAEVVVRSEQTRMDTMKEIERMRVEAEAKRGEMELKRTEIIANTQLEIARIFASVNKGVDSSLRIGRS

SEQ ID NO: 162013 - protein, 79 aa, Glycine max
  Coding DNA Sequence Number=SeqID_45235
MESSTIATYPSAGERRQAHGCIFQGRKMRGVTTKIYLRKTSEKPKPGLQIFRIKSKKTVKALDLERIQAIFMDKSLIMS

SEQ ID NO: 162014 - protein, 129 aa, Glycine max
  Coding DNA Sequence Number=SeqID_45236
MDELHERAKGYIQMEEMFRFWNEVRHAGQKCNECKAHTKPDAHKSDKRHKPDKRQPLSKGSRYECYTPLMVNHTMILEETFNLDVPIWLPCTKPPKTGSDVTKYCQYHHNIGDNTEDCWALKEKIEELI

SEQ ID NO: 162015 - protein, 81 aa, Glycine max
  Coding DNA Sequence Number=SeqID_45237
MRLVSGALRTESFDKNVKVVYGPGWESTVPGQCLSLERCREDMTLNRDVVGVECCLCVGGVIPLGCVQARCGRIARRPRDV

SEQ ID NO: 162016 - protein, 329 aa, Glycine max
  Coding DNA Sequence Number=SeqID_45238
MSSGRLLVDPNGQNVGLCTMDFQVFCLCFVLLGCDSLCCVNVVLLGCCGSLGGLMGTRGWWVYARIVDVENLLCTIARPPPGTTCDGVVPGDMSRGSGDLGDVRRAPGSQQIKGKQDHKARRLVVAGQLLENEVRKLREPLVIDYQPVLCNSSLASGNRLPRLCNRLPEMKSLKILLLTSCSGYEIVMAAQLIRDRVEMECLEGAWETLEGNTRCRFRGTIRFTATSLVHPDEPARTLQRTVEWILPTPTPYRLVEPAQVIEITSSEEDPEEDLEELPPEPAVDALDFLEGDEDPLLETLRRIAARGRWRSAGALHPSGQLFGLVLYTF

SEQ ID NO: 162017 - protein, 238 aa, Glycine max
  Coding DNA Sequence Number=SeqID_45239
  Gene Ontology: Mol. function=RNA-directed DNA polymerase activity; Biological process=RNA-dependent DNA replication
MIGEVPTEPRALPQFRSKLQLHKLLYGLWASTGGVISRIYVKFFAQARLVDSQVSDLRPFAHCHDLSAFNRCGAFCIALACLLFVNLDGYNLPFQSPRELSLIEGGHQVHIASGLDSLAYKIEEWTGVRVDSVGGTALVDEDPGQHEICYGDKDNHGVVLVDGVDVLEVPVRKGLAGLSSIGNATSDGVDYTFDVMGGFLLQWRSSALLLPASWFLFYFFGCPLGLALAWWLFGLLTN

SEQ ID NO: 162018 - protein, 63 aa, Glycine max
  Coding DNA Sequence Number=SeqID_45240
MGSSLAMGCSSRFDVCICGSCECGVKGDGGWRMVLLVKGVTIVGAVFVVVDMRVVETMAVVEE

SEQ ID NO: 162019 - protein, 130 aa, Glycine max
  Coding DNA Sequence Number=SeqID_45241
  Gene Ontology: Mol. function=ribonuclease H activity; Cellular component=mitochondrion; Biological process=DNA integration
MAFMAYASWLGVSLVVVLGGLEDDSVSCLCLSISLRMFSKGDQEAVPADEVLPGEFFLFASHNFLKWSCFYPYVYSPQGKRPRVPQTVTVVRRSMWHVCKLLTSSASPSKVEGISPKCWLVIASSHRFGG

SEQ ID NO: 162020 - protein, 94 aa, Glycine max
  Coding DNA Sequence Number=SeqID_45242
MAMMKHFLALVMQFSRKPQEMPRETKEKHVQRWQRGSKLTWRGGGEKGWSQDWRGREKQRILKAIVPEEAKLQRMGGSYKEEPKQQVGRRGVRE

SEQ ID NO: 162021 - protein, 35 aa, Glycine max
  Coding DNA Sequence Number=SeqID_45243
MSISTLADEGTWERIIDNFTKFELGRGEYSGGNCK

SEQ ID NO: 162022 - protein, 53 aa, Glycine max
  Coding DNA Sequence Number=SeqID_45244
MELATQFEAHSRGKESTMKFAAAFRVVKKPQNEALESTVNEYFIMEIRLVDPW

SEQ ID NO: 162023 - protein, 75 aa, Glycine max
  Coding DNA Sequence Number=SeqID_45245
MDQSLKAGEDEWRERERRGTKFCASNEEKQCSKMSIFNVCSPEEFDVHQQLQSSYISSTNFIGAVTKQYGVERLL

SEQ ID NO: 162024 - protein, 207 aa, Glycine max
  Coding DNA Sequence Number=SeqID_45246
  Gene Ontology: Mol. function=DNA binding
  Homolog annotation: Hit_ID=Q1SZ33; Match level="QueryCoverage=73%, HitCoverage=45%, E-value=8e-10, Identity=30%"; Hit description=HMG-I and HMG-Y, DNA-binding
  Pfam annotation: Domain name=DUF296; Domain location=38-157; Score =15.2; E_value=2.7e-05; Accession=PF03479.5; Description=Domain of unknown function (DUF296)
NLFLPTQLPRKPCGRPPGSKNKHKIISLPVAQPSESFLRIVIINVDSGKDIIESIADVAGLGHANLAVLSPSGTITRVTLHNSLHGATALTLNGPTLRLAFPQQLILIQRPQLPPPLSFGIHLTTSRGLAIGGAIGGQVNASDEIKITLCTFWNPEIYKYIPEGSNGDNDDNNISKKNYKNNPIDCNGVETNWCSAFSCGIHGWQIM

SEQ ID NO: 162025 - protein, 118 aa, Glycine max
  Coding DNA Sequence Number=SeqID_45247
MEKELCIWMEAELCLDGSSDGGAMGSRRVPREGLWEIGKAVKCLEAICHRCTTCSASVTISSKLFHHRNRSCTRDSSSLRSLDTKEEVAGTRLLIDGRTCLLQGIGDMYRAFLHKLNS

SEQ ID NO: 162026 - protein, 46 aa, Glycine max
  Coding DNA Sequence Number=SeqID_45248
MTVKKRLSFELQNAAVGLSAYPPPMAASAHLTQRRIWQSISIKVAR

SEQ ID NO: 162027 - protein, 84 aa, Glycine max
  Coding DNA Sequence Number=SeqID_45249
  Gene Ontology: Cellular component=chloroplast
MDEYASIRFMLVWLGFPEEDAIRLMRNKKGISKIRVAEAEAATFEVTERKATTGVGESESKRGFLTSFSHSKPCMRLSSRTAPK

SEQ ID NO: 162028 - protein, 53 aa, Glycine max
  Coding DNA Sequence Number=SeqID_45250
MALWKEEAKKQLWQAGPMHLNFPMPDPVSLLQMIVRCQVMHKILRQHYHCITG

SEQ ID NO: 162029 - protein, 271 aa, Glycine max
  Coding DNA Sequence Number=SeqID_45251
MNPLTDLEAKVVQLKNWGSILPARHLFCGVQLASGYNKIFVEPYNSQFMAHQFGLTQHLPMAFLTTTSPNSHRLLFAKEKSSSTGITINPSPAPQSEDDTSPKLAPLTFKRTTRSITAQKSSVPNPPSTRESVFTEEPSNAPFESFAIPFMPTLTLGQLSTFTRPILPNVIEEALVEYLQSPASYVPVVSDKSPIDHHFSHVEQFMSRYVPSNSAMLKSIRLSFAKLAATPTIFDASCQLLNHITMAIGDLIFNLICTDVDIILPRLIWNS

SEQ ID NO: 162030 - protein, 59 aa, Glycine max
  Coding DNA Sequence Number=SeqID_45252
MAREGGFPLLEMLRAWILKSMQRHTEHVLMGLAGMVVISHLALGRAKCAFGLSRGPSSR

SEQ ID NO: 162031 - protein, 103 aa, Glycine max
  Coding DNA Sequence Number=SeqID_45253
MVEALAMHTIADDRNVVQQRKGWEKLKERVIKPNIDALVKQNQVSAKVIFCNSREEAISAASLILPYVFEAHVAKEAYWIEECPPQIQPFLLDDVRPMVSLSQ

SEQ ID NO: 162032 - protein, 96 aa, Glycine max
  Coding DNA Sequence Number=SeqID_45254
MKLVDTIELCREFVDYWYPYLTDKISSLVCFQTRLSHWRYDAILHRKGPVTRATSKRLQEDWIRAAEEGPMVFMNLRVGYPRNVGFFSPCILGHLD

SEQ ID NO: 162033 - protein, 50 aa, Glycine max
  Coding DNA Sequence Number=SeqID_45255
MSSPNSSQSKPHEYTDHSNVLFLPTWALGSRGSHPYYRWLKRVTTSKEAY

SEQ ID NO: 162034 - protein, 60 aa, Glycine max
  Coding DNA Sequence Number=SeqID_45256
MDNITVNAGFDAEKVWKELYQIGHMDFGRTSYNYSFLTFVKREALDVKVYSCVSQECISF

SEQ ID NO: 162035 - protein, 225 aa, Glycine max
  Coding DNA Sequence Number=SeqID_45257
  Homolog annotation: Hit_ID=Q1T2D5; Match level="QueryCoverage=55%, HitCoverage=7%, E-value=1e-30, Identity=51%"; Hit description=Chromo
MADNTRMKELTGDVKRILETMENRNKEYAARFETLETTLEMTLKDKTRDPGSISLAMNNHPFKVVPWYQMMTRENSFTTWIAFTRALETEFGPSPCECPRSQLFKLTQIGSVQSYYVQFTSLANRVQGITQEALLDCFVGGLKPNIRMDVIAQSPTSLLRTVSLAKLYEEKYTPKLKPFSSSFSSKTQTSNTNSNLNTNQNSPQSLKSTSLPPLLLTLIHQTYQC

SEQ ID NO: 162036 - protein, 185 aa, Glycine max
  Coding DNA Sequence Number=SeqID_45258
MDPQPIPGVEDSVMDETVAGDDGKSTVEAPTQGPFDELGHSPGLSGSISNPVRKQKSIAEIMGEDKDVHTANRELDATVEMVNAIGSNVGKKRKGSEDGMASKPVQKKMELLLDADGDVSCAKNDGNGDEGNSDVGSLLQSKEKKEAFDEGKSEERNEKGNLSRERKRSKYLSPPFTIPTRGQRE

SEQ ID NO: 162037 - protein, 340 aa, Glycine max
  Coding DNA Sequence Number=SeqID_45259
MGTDESDSMVLGSEQEKEVREVLGGLRSEEGSCGVTVNGDGFSSIESEGLCCDGVVDFVVENSSVLETKVSVLSENDCQVLADSEVNGVPSWLGMQESDMDAVFSGDGAEKLDFGYGSEKLDYMFASESTVPEAAVLSVNRSVEVGGEDGRGGKSEETGTFEDCDGGIVAVGSESRVAEASVSSVEGLVGVSTEDRRGGMKEEEGIDENCDEDAVATASESRAAEAAVLSVDNLVRVVGEDGSVEGINEEDGKDVDCDGNIVAVASESREAEASILSVDSLIGIGGEVVRDGGESEEVEKDEDCNGNILTLESESRVAEAADLIVDSSVGLGGEDKNREG

SEQ ID NO: 162038 - protein, 85 aa, Glycine max
  Coding DNA Sequence Number=SeqID_45260
MAMREKKKRTNQASERPNPTGALSAHQALSEQLTAGAKRGVKHEGAEIVTRAKPGAQRAIQQKHRLSVHGAPSARSERAKRDVWR

SEQ ID NO: 162039 - protein, 102 aa, Glycine max
  Coding DNA Sequence Number=SeqID_45261
MVCNYLCAKDRTIELGVENALDVNDIMSKGENEEEVVHSVSIDLEGSSSAIRKNTRPSKNGEKQGMISSIKKVVESMKEFVEVTKKKTENKKKMEIKEAQEM

SEQ ID NO: 162040 - protein, 298 aa, Glycine max
  Coding DNA Sequence Number=SeqID_45262
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q2K200; Match level="QueryCoverage=92%, HitCoverage=47%, E-value=5e-85, Identity=55%"; Hit description =Probable glycerol-3-phosphate dehydrogenase protein
  Pfam annotation: Domain name=DAO; Domain location=21-298; Score=48.5; E_value=2.3e-11; Accession=PF01266.14; Description=FAD dependent oxidoreductase
MEQVLTREQRLSRLRARSSLPVLIVGGGINGISTFRELALQGIPAVLVEKGDWCQAASGALSRMIHGGLRYLETGEFGLVKESVMERDRLLKNAAHYVFPLRTTVPIDNLGGGLVNATRRFLRQSDKPTRRGALLIKTGLSLYDLYTRQYGAMPRHQLRNEAATRDRWPGFAPWVKYSASYYDAWISAPERLGFELIEDAERACPEALALNYLRVVSASDETVLLEDTLSGERFSLQPHVLVNAGGAWIDQLNQQLAVHSPPTRLIGGTKGSHLILDHPQLLQMLDGEMVYFENQEGR

SEQ ID NO: 162041 - protein, 180 aa, Glycine max
  Coding DNA Sequence Number=SeqID_45263
  Gene Ontology: Mol. function=beta-lactamase activity; Cellular component=outer membrane-bounded periplasmic space; Biological process=beta-lactam antibiotic catabolic process
  Homolog annotation: Hit_ID=Q1I188; Match level="QueryCoverage=78%, HitCoverage=37%, E-value=1e-51, Identity=66%"; Hit description=Beta -lactamase
  Pfam annotation: Domain name=Beta-lactamase; Domain location=38-180; Score=-15.9; E_value=0.00028; Accession=PF00144.14; Description=Beta- lactamase
MRIVGKPGRGKGIFMFSWARLSALALLVSGSALATTSPDSIIKPLMQQYQIPGMAVAILHDGKTEFYNYGVASKESGQPINEQTLFEIGSLSKTFTATLASYAAQQNKLNFSDAASQWLPELKGSAFDRVSLLNLATHTSGTPLFVPDDVTNTRELMRWYKQWQPEAQPGTVRVYSNLGI

SEQ ID NO: 162042 - protein, 67 aa, Glycine max
  Coding DNA Sequence Number=SeqID_45264
MPSHLKYQVIFMNHLEGDSPLRKGTLIIGVVGQIGGSLNAGVVGINIGTFTTCGETSTTIGSMTNAL

SEQ ID NO: 162043 - protein, 88 aa, Glycine max
  Coding DNA Sequence Number=SeqID_45265
  Gene Ontology: Cellular component=retromer complex; Biological process=vacuolar transport
  Homolog annotation: Hit_ID=Q1SNV0; Match level="QueryCoverage=51%, HitCoverage=14%, E-value=7e-15, Identity=82%"; Hit description =Vacuolar protein sorting-associated protein 26
MLESPKPYKPYTRTSYFHKGLKAHTLQLDPNILQHDDSPPIPFSVEFKVAIVISFQSELSKLHKKSDPKTPRLWLAMETLPLELIRTK

SEQ ID NO: 162044 - protein, 330 aa, Glycine max
  Coding DNA Sequence Number=SeqID_45266
  Gene Ontology: Mol. function=molecular_function; Cellular component =retromer complex; Biological process=vacuolar transport
  Homolog annotation: Hit_ID=Q1SNV0; Match level="QueryCoverage=97%, HitCoverage=95%, E-value=1e-133, Identity=75%"; Hit description =Vacuolar protein sorting-associated protein 26
  Pfam annotation: Domain name=Arrestin_N; Domain location=3-137; Score= -28.6; E_value=0.052; Accession=PF00339.19; Description=Arrestin (or S-antigen), N-terminal domain
  Pfam annotation: Domain name=Vps26; Domain location=2-305; Score=0.9; E_value=5.5e-12; Accession=PF03643.6; Description=Vacuolar protein sorting-associated protein 26
  Pfam module annotation: Pfam domain module=Arrestin_N::Vps26; Domain location=3-137::2-305
MSVELKLSRSNRIYRPSEALEGKIVVKTQSSISHYGIRLTVKGSVNLQVRGGSAGVVESFYGVIKPIPIVNRTIEVKSSGKIGSGTSEIPFSVNLRQRDENLERFYETFHGANISIQSLKLICCQYKFFLLPSYALNMTVPHFGNQDISRGYLHKSLSATMELIVESDKADLLQRPLSPEMAIFYITQDTQRHPLLPELKSGGFRVTGKICTQCSLSGPISGELTVETSAVPIHSIDLQLFRVESILLGEKIVTETSLIADGDVCRNLTLPIYVIVPRLLTCPITLAGPFSVEFKVAIVISFQSELSKLHKRFDAKTPTLWVGSGPLLDL

SEQ ID NO: 162045 - protein, 67 aa, Glycine max
  Coding DNA Sequence Number=SeqID_45267
MLISEFFGFLMLPKGEKKVVAKKKLKKKLNKLRNQVIMYCIVIIKKGEIVDAIGFDVLMMIMIMCCN

SEQ ID NO: 162046 - protein, 518 aa, Glycine max
  Coding DNA Sequence Number=SeqID_45268
  Gene Ontology: Mol. function=protein serine/threonine kinase activity; Cellular component=intracellular; Biological process =protein amino acid phosphorylation
  Homolog annotation: Hit_ID=Q1SC20; Match level="QueryCoverage=99%, HitCoverage=100%, E-value=0.0, Identity=91%"; Hit description =Protein kinase; Nuclear transport factor 2
  Pfam annotation: Domain name=Pkinase; Domain location=83-339; Score =227.6; E_value=2.7e-65; Accession=PF00069.15; Description=Protein kinase domain
  Pfam annotation: Domain name=Pkinase_Tyr; Domain location=83-339; Score=20.5; E_value=1e-13; Accession=PF07714.7; Description=Protein tyrosine kinase
  Pfam module annotation: Pfam domain module=Pkinase::Pkinase_Tyr; Domain location=83-339::83-339
MSGLEELRKKLAPLFDAEKGFSSSSTLDPCDSYTFSDGGTVNLLSRSYGVYNINELGLQKCTSRSVDETDHSEKTYRCGSHEMRIFGAIGSGASSVVQRAIHIPTHRILALKKINIFEKEKRQQLLTEIRTLCEAPCYEGLVEFHGAFYTPDSGQISIALEYMDGGSLADILRMHRRIPEPILSSMFQKLLHGLSYLHGVRHLVHRDIKPANLLVNLKGEPKITDFGISAGLENSVAMCATFVGTVTYMSPERIRNESYSYPADIWSLGLALFECGTGEFPYTANEGPVNLMLQILDDPSPSPLKNKFSPEFCSFVDACLQKDPDTRPTAEQLLSHPFITKHDDAKVDLAGFVRSVFDPTQRLKDLADMLTIHYYLLFDGPDDLWQHTKNLYSESSIFSFSGKQHCGPSNIFTSLSSIRTTLVGDWPPEKLVHVVERLQCRAHGEDGVAIRVSGSFIIGNQFLICGDGIQVEGLPNFKDLGIDIPSKRMGIFHEQFIVEPKSLIGCYTIVKQELYINQ

SEQ ID NO: 162047 - protein, 66 aa, Glycine max
  Coding DNA Sequence Number=SeqID_45269
MVNVNKASKGRTITYRRGWYPIERGGDGIGKTLSQRKGCRWNENGVLRGKHGLSSWTPARIFKEKT

SEQ ID NO: 162048 - protein, 183 aa, Glycine max
  Coding DNA Sequence Number=SeqID_45270
  Subcellular localization annotation: CTP_CleavageSite=62; ConfidenceScore=5.48e-01
MEFDSSFQGPQYLSSPFPPTTQTMFPSQSSILIPPSPQPIMFHPNNTTFHHFQDFITNVPTFVMEGPSSNITTPLYRGSFLGGFVNIHHHHPNKMDALHGHHHKGKIIWDFSQQLMVHSSEASSSKSSSPLSLSNEYGLVMGDYHWHTNQRSVQQNMKVVKVNMDTNIANDNIIKGQWTLEQD

SEQ ID NO: 162049 - protein, 846 aa, Glycine max
  Coding DNA Sequence Number=SeqID_45271
  Gene Ontology: Mol. function=ATP-dependent helicase activity; Cellular component=nucleus; Biological process=mRNA catabolic process, nonsense-mediated decay
  Homolog annotation: Hit_ID=UPI00005DC27C; Match level="QueryCoverage =72%, HitCoverage=84%, E-value=0.0, Identity=65%"; Hit description =ATP binding / ATP-dependent helicase/ helicase/ nucleic acid binding
  Pfam annotation: Domain name=DEAD; Domain location=264-434; Score =259.9; E_value=5.2e-75; Accession=PF00270.19; Description=DEADDEAH box helicase
  Pfam annotation: Domain name=Helicase_C; Domain location=504-579; Score=129.0; E_value=1.3e-35; Accession=PF00271.21; Description =Helicase conserved C-terminal domain
  Pfam annotation: Domain name=ResIII; Domain location=260-429; Score= -8.6; E_value=0.00024; Accession=PF04851.6; Description=Type III restriction enzyme, res subunit
  Pfam annotation: Domain name=WW; Domain location=21-51; Score=37.2; E_ value=5.5e-08; Accession=PF00397.16; Description=WW domain
  Pfam module annotation: Pfam domain module=DEAD::Helicase _C::ResIII::WW; Domain location=264-434::504-579::260-429::21-51
MAATATASSMGPRYAPADPTLPKPWRGLVDGKTGYLYFWNPETNVTQYERPSSSSTAQPKSSSVPNSSVQVQQSSQGSQCGHSPDFSDRYDRNGSGGSNEAGSRNNQKSSKGGSYASHDVSNGTHVAGNVDSSVRGHGASDAGAGLSPESYRHRHEISVTGDNVPPPLASFGSTGFPSELLREWQLGGYPSFHRCDICSWGGANVHLVWTLERPLWWTKFLEGLSEPSKFVAGTAVGHDSVCHLVCTEEEASPHVQNAGFSAPTPIQAQSWPIALQGRDIVAIAKTGSGKTLGYLVPAFIHLKRSGNNSKMGPTALVLSPTRELATQIQDEAVKFGKSSRISCACLYGGAPKGPQLRDIDRGADIVVATPGRLNDILEMRRISLNQVSYLVLDEADRMLDMGFEPQIRKIVNEVPNRRQTLMFTATWPKEVRKIAADLLVKPVQVNIGNVDELVANKSITQHVEVLPPMEKQRRLEHILRSQDSGSKIIIFCSTKKMCDQLARNLTRQFGAAAIHGDKSQAERDHVLNQFRTGRSPVLVATDVAARGLDIKDIRVVVNYDFPTGVEDYVHRIGRTGRAGATGLAYTFFGDHDAKYASDLIKVLEGANQKVPPELRDMSSRSGGGMGRSRRWGSGGRGGDSGYGGRNNDSGYGGRGNDAGYGGRGSDSNYGGRGTSASGRGGGRGFDYESQRNDRDRSPDKGSSWRDRFKSVNRDRSRSPNRAALPQHSQGGSFHKAMMERGGWDSDRNKSFNRDRSRSPSPHRQVKGPAVREHSPVYSFHRSMMGRGQSSPSSQRQRACSPHRNSTPSQGDGRHGGSHSSYNGEVEEGMIPEEEGMIGQDDPVNVD

SEQ ID NO: 162050 - protein, 280 aa, Glycine max
  Coding DNA Sequence Number=SeqID_45272
  Gene Ontology: Mol. function=oxidoreductase activity, acting on the CH-OH group of donors, NAD or NADP as acceptor; Cellular component =mitochondrion; Biological process=isocitrate metabolic process
  Homolog annotation: Hit_ID=Q7Y0W7; Match level="QueryCoverage=84%, HitCoverage=48%, E-value=1e-131, Identity=95%"; Hit description=NADP- specific isocitrate dehydrogenase
  Pfam annotation: Domain name=Iso_dh; Domain location=1-254; Score =16.9; E_value=1.3e-13; Accession=PF00180.10; Description =Isocitrateisopropylmalate dehydrogenase
TVFREPIICCNIPRIVSGWKKPICIGRHAFGDQYRATDAIITGPGKLKLVFVPEDGDAPMELDVYNFKGPGVALAMYNVDESIRAFAESSMSLAFAKKWPLYLSTKNTILKKYDGRFKDIFQEVYEERWRQKFEEHSIWYEHRLIDDMVAYALKSEGGYVWACKNYDGDVQSDLLAQGFGSLGLMTSVLLSSDGKTLEAEAAHGTVTRHFRFHQKGQETSTNSIASIFAWTRGLEHRYFVALFKLQIIVHFDALWKFSFVNLISKYERTLQCFCLSFRLE

SEQ ID NO: 162051 - protein, 438 aa, Glycine max
  Coding DNA Sequence Number=SeqID_45273
  Gene Ontology: Mol. function=nucleic acid binding; Cellular component= chromatin; Biological process=DNA integration
  Homolog annotation: Hit_ID=Q1T4S3; Match level="QueryCoverage=90%, HitCoverage=73%, E-value=4e-46, Identity=51%"; Hit description=Zinc finger, CCHC-type
  Subcellular localization annotation: CTP_CleavageSite=36; ConfidenceScore=5.37e-01
MPPQYFYPPPQFQSQLVNPTASSPSPHAHVASVQPVQSTNWYPDSGASHHVTNVSQNIQQATTFEGPDQITIGNGQGLNINALGVSSFHSPFNSKIPLTFKNLLFVPSITKNLLSVSQFCKDNSVFFEFHPNPVISAPALPTSVQSTAESPPLLVRPDNTPSICIRAKAGIVKPRLQPTLPLTHAEPKSTKSAPSNPTWHAAMKAEYDALLLNNTWTLVDLPSSRSPIGCKWVFRVKENPDGTLQKLDVNNAFLNDILEEEVYMTQPPGFEDSNKHLLCSLISLSHYSVHAYCDADWASDPDDRRSTSGAAIFLGPNLVSWWSKKQLVVARSNTGAKYRSLVLATAKLKVPHAPPVIFCDNLSTVALAHNPAMHYKTKHIELDLFFVQEKVIGKHVQVVHVPAADQRANIPTKALTPSNFTAYRSKLRVVEKISANPS

SEQ ID NO: 162052 - protein, 642 aa, Glycine max
  Coding DNA Sequence Number=SeqID_45274
  Gene Ontology: Mol. function=protein serine/threonine kinase activity; Biological process=protein amino acid phosphorylation
  Homolog annotation: Hit_ID=Q9FNE1; Match level="QueryCoverage=95%, HitCoverage=97%, E-value=1e-117, Identity=54%"; Hit description =Receptor-like serine/threonine kinase
  Pfam annotation: Domain name=DUF26; Domain location=201-254; Score =59.5; E_value=1.1e-14; Accession=PF01657.8; Description=Domain of unknown function DUF26
  Pfam annotation: Domain name=DUF26; Domain location=89-142; Score =64.6; E_value=3.2e-16; Accession=PF01657.8; Description=Domain of unknown function DUF26
  Pfam annotation: Domain name=Pkinase; Domain location=304-572; Score =145.9; E_value=1.1e-40; Accession=PF00069.15; Description=Protein kinase domain
  Pfam annotation: Domain name=Pkinase_Tyr; Domain location=304-572; Score=115.6; E_value=1.4e-31; Accession=PF07714.7; Description =Protein tyrosine kinase
  Pfam module annotation: Pfam domain module=DUF26::DUF26::Pkinase::Pkin ase_Tyr; Domain location=201-254::89-142::304-572::304-572
MASKYDNKYNNPSFVVVIFTVATLLCFFSHSALSDPRISEVGHYCSTQKSPTSGDYFPIFTKEMEKLQEVVTKQNWGTHSEGMSSTTPIYGLAQCFQDLSSIDCLQCFASSRTKLPRCLPSVSARIYLDGCFLRYDNYSFYTEDTDPLRDTVNCTSQYGAVVGDGEKLVFAESVAKVVESVVRVAVNEGRGIFAVGEGGGVYALAQCWKTVGVKGCSDCLRKAENEVKGCLPKREGRALNTGCYLRYSTVKFYNQGGEDGQGDDSSRKRAIVAAGSVLAAAVVVLTLAASYVASPKREKATDYFSSSRKIGQGGAGSVYKGTLPNGNDVAVKRLVFNNRQWVDDFFNEVNLISGMQHKNLVKLLGCSIEGPESLIVYEYLPNKSLDQFIFEKDITRILKWKQRFEIILGTAEGLAYLHGGSEIRIIHRDIKSSNVLLDENLNPKIADFGLARCFGTDKTHLSTGIAGTLGYMAPEYLIQGQLTDKADVYSFGVLVLEIASGRKNNVFREDSGSLLQTVWKLYQSNRLGEAVDPGLGEDFPAREASRVFQIGLLCTQASASLRPSMTQVVSILSNSNLDAPIPKQPPFLNSRLLDQASPLGFSIGSSSSNTFKKTGVSYSPSEFSSTCSLIGPTRNEETIMEA

SEQ ID NO: 162053 - protein, 791 aa, Glycine max
  Coding DNA Sequence Number=SeqID_45275
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=45%, HitCoverage=99%, E-value=1e-112, Identity=52%"; Hit description =Integrase, catalytic region
  Pfam annotation: Domain name=Chromo; Domain location=335-386; Score =16.8; E_value=0.01; Accession=PF00385.14; Description='chromo' (CHRromatin Organisation MOdifier
  Pfam annotation: Domain name=S1; Domain location=494-566; Score=51.6; E_value=2.6e-12; Accession=PF00575.13; Description=S1 RNA binding domain
  Pfam annotation: Domain name=rve; Domain location=51-189; Score=66.6; E_value=8e-17; Accession=PF00665.16; Description=Integrase core domain
  Pfam annotation: Domain name=zf-H2C2; Domain location=5-46; Score =5.7; E_value=0.064; Accession=PF09337.1; Description=His(2)-Cys(2) zinc finger
  Pfam module annotation: Pfam domain module=Chromo::S1::rve::zf-H2C2; Domain location=335-386::494-566::51-189::5-46
MEEFHSTPLGGHTGATKTLHRLRQSFDWPNIRSDVRRFVAQCITCQQTKYEPQKPPGLLQPIPLPSAGAHFGPLPTSHTAHKVACLFFDMVCKHHGFPRSLISDRDALFLSSFWRELFKLSGTKLRMSTAYHPQSDGQTEVVNRVLEQYLRSFVHHKPHHWSRFLSLAEWSYNTTVHTSTGYTPFEVTYGKAPPSLIDYVRGTSPIDAVDSMLTDRTELHNTLLRRLRKAQEFMTTSANKHRRDLQFSVGDWAYVKLRPYRQKSVAPAYSKLSKRYYGPYQVIERIGSVAYRLQLPPSSRIHPVFHVSLLKRHQGPLPLTSAALPPSSVEHHPLVTPLAFLDWQWDTSVTPAARKVFVQWAGLPPEDASWESWSDVKHTFNLEDEVPFEGEGDDSNIQITEHIETAAVPNYTADNKEEFTAINSRNKRDTHRPKYLANYNTFTEHVVMYVLQSGARMSVGDGTLTIVAKNQSVMDKILEKFNHVCQIDFIVGRQIEVGGIYTGIVTTIKEYGAFVEFNGGQQGLLHISELSHEPVSRVSEVVSVGQKLSLICIGQDVHGNIKLSLKATLPHPGGLETNVVVEESVASVKETANIWAPVGNVSSIQEEQNSASELSLGNLELGEAKSETSQVPVILIRSAAECDEEEKSSSLNLSSKNPQVDNGVQLDLKSKSRSQNAKSCRSRDVDAPSSHSGPLPYTNVKKSKLSMHKESKSDLQRPKGDEQGPKDKVTAEDLKLGSEVTAKVSQIGAHGLVLDLGGGLRGIYRFEINGMKLEKVVGKWVFEMLDASLPS

SEQ ID NO: 162054 - protein, 114 aa, Glycine max
  Coding DNA Sequence Number=SeqID_45276
  Homolog annotation: Hit_ID=Q9S7G6; Match level="QueryCoverage=41%, HitCoverage=4%, E-value=4e-11, Identity=70%"; Hit description =Polynucleotide phosphorylase
MAGEDSGGDGGKDVGVVHGQNDGAIGEARDLAGLERDHARTDFELLCEGLEVLGGGGGEGAEAEGTPCEEVRQGAEEWLRSLHSQRVKGNEGRRSSLMIVELVQSTKANELQTK

SEQ ID NO: 162055 - protein, 1013 aa, Glycine max
  Coding DNA Sequence Number=SeqID_45277
  Gene Ontology: Mol. function=RNA-directed DNA polymerase activity; Cellular component=chromatin; Biological process=chromatin assembly or disassembly
  Pfam annotation: Domain name=RVP_2; Domain location=350-467; Score= -48.7; E_value=0.0062; Accession=PF08284.2; Description=Retroviral aspartyl protease
  Pfam annotation: Domain name=RnaseH; Domain location=866-984; Score= -32.5; E_value=0.062; Accession=PF00075.14; Description=RNase H
  Pfam module annotation: Pfam domain module=RVP_2::RVT_1::Retrotrans _gag::RnaseH; Domain location=350-467::606-775::126-216::866-984
MPEHHTRQVTLDKLDDAVQRLSQGQISLTEGQASLSQNHHSLNIKIDNIHASLTTQIESLFDRLAAIAVPHSSPVSATQPPPSPISRHHHLKLDVPRFDGHDPLGWIFKVSQFFDYQGIPEPERLTIASFYMDGPALSWYQWMHRNGYFPSWPAMLQALESRFAPSFYDDPQGSLFKLQQTGSVTDYLTAFERLANRTIGIAPSSLLSCFVSGLIPELRREVQALRPMSLPQAIELARLQEDKLIDRRRGSRPPFPAPPHPSPAPPQSFSPKPTTSPFPKSPTPLPSPRIPVKRLSAEELAIRRDQGLCYHCDDKWSHGHRCRSRLHLLLADEDIENPDISPDPNPDPPLVSQISLNAMEGTVAPQTCRLLGMIGHHQLIVLVDGGSSHNFIQTRIARFLALPTAPTPPLRVMVGNGNTLDCDTLSPQTLLSLQGHEFTLDLFHLPLCGADIVLGVQWLKLLGPVTTDYSALTMTFPYLGHTITLFADAPPTLTSASAHQLKRFAQTHSISALYHITPIPAQPVSPLPASPPTPPSITIVLNRYASIFNEPDHLPPSRNIQHHIHLLPHSTPVNVKPYRYPHFQKTEIETQISSMLASGLIQPSHSPFSSPILLVKKKDGSWRCCVDYRALNSITVKDRFPMPTIDELLDDLGKASCFSKLDLRQGFHQIRMAASDIPKTAFRTHQGHYEYCVMPFGLCNAPSTFQAAMHDALRPFLRKFVAVFFDDILVYSPDISTHASHLDSVLSTLLDKQFFLKASKCLFAQSQLNYLGHIISAQGIAPDPDKVQAMIDWPIPTTTTVLRGFLGLTGFYRKFIQGYASVAAPLTALLRKDQFLWSPTASTAFDTLKTLMTQAPILATPDFSLPFILETDASAVAIGAVLLQRHHPIAYFSKVLCPRLQQASAYVRELHAITAAVRKWRHYLLGSSFTILTDHRSLKDLMSQVIQTPEQQTYLVKLLGYDYDIKYKPGSSNIVADALSRLPQGECFSFSVPHYDFMDKLRHTLMQEPSIGT

SEQ ID NO: 162056 - protein, 619 aa, Glycine max
  Coding DNA Sequence Number=SeqID_45278
  Gene Ontology: Mol. function=transporter activity; Cellular component= membrane; Biological process=oligopeptide transport
  Homolog annotation: Hit_ID=Q9CAS0; Match level="QueryCoverage=94%, HitCoverage=95%, E-value=1e-175, Identity=52%"; Hit description =Putative peptide transporter; 37139-33250
  Pfam annotation: Domain name=MFS_1; Domain location=63-552; Score =7.9; E_value=0.00014; Accession=PF07690.6; Description=Major Facilitator Superfamily
  Pfam annotation: Domain name=PTR2; Domain location=125-536; Score =250.3; E_value=3.9e-72; Accession=PF00854.12; Description=POT family
  Pfam module annotation: Pfam domain module=MFS_1::PTR2; Domain location=63-552::125-536
  Subcellular localization annotation: CTP_CleavageSite=27; ConfidenceScore=5.33e-01
MEGNKKTKQYGLDSATSWFGSCISSCSSSEKVSTHRKLPRTASESSVTNPMKKRGGWKAIIFILGNETFERLAVFGLFANFMVYLTREFHLDQVYASNIISLWFGISNFTPLLGAFISDAYVGRFRTIAFASFGTLSGLIVVSLTSWLPELHPPSCTPQQLASRQCVRASSSQIGVLLMGLCFLTIGSAGVRPCSIPFGVDQFDPTTDEGRKGINSYFNWYYTTFTMVLLVTQTVVVYIQDSVSWRIGFGIPTVCMLCSIIMFFVGTRVYVHVKPEGSIFSGIAQVLVTAYKKRKLNLPMSEEKPDGVFYDPPLIGITVVSKLPLTKEFRALNKAALIMEGELNPDGTRVNQWRLVSIQQVEEVKCLARIIPIWAAGILSLISMTQQGTFTVSQAMKMNRHLGAKFQIPAGSVSVISLITIALWLPFYDRILVPKLRKMTKHEGGITLLLRIGIGMVFSILSMVVAGYVEKVRRDSANSNPTPLGIAPMSVLWLAPHLILMGLCEAFNIIGQIEFFNRQFPEHMRSIGNSFFSCSFGVSSYVSSIIVNIVHHSTRTHSHPDWLTDDINAGRLDYFYYLIAGLTSLNLVFFIYVARRYQYKGNVDLLDETHQVELGSHKA

SEQ ID NO: 162057 - protein, 164 aa, Glycine max
  Coding DNA Sequence Number=SeqID_45279
MTIATLFSKLKYELELGRLKDEEFEKKKKGLALKTSTSHNEASDEDPSKNLDNESMDFLVKKFSKFLKKKRRDTRKFQKNSTKKIYSTPITYTSLSVGSKVTSSSEEEEANLCLMAIIDEDETKNNVSDTSSESNTNYENLLGAFKELHEEAQRLTFVKKTLKG

SEQ ID NO: 162058 - protein, 110 aa, Glycine max
  Coding DNA Sequence Number=SeqID_45280
MGFSHSDLESESKKWVIAGIGVRSLKPINTKRVGGGSGGGDAENEEEEARSTTPTAKEARIPEKLPCPPAPRKRRPPPSRCGNGGGGGVREFFTPPDLESVFKCHVEKAK

SEQ ID NO: 162059 - protein, 76 aa, Glycine max
  Coding DNA Sequence Number=SeqID_45281
MTPMIEADLVDLTASWGSKGGKMSLTEDGVVRLDGGACGFGLGSVEGKEDGFKACKGRWLRGVDVGEEEVDEERDG

SEQ ID NO: 162060 - protein, 267 aa, Glycine max
  Coding DNA Sequence Number=SeqID_45282
  Gene Ontology: Mol. function=translation elongation factor activity; Cellular component=intracellular
  Homolog annotation: Hit_ID=Q1SFH4; Match level="QueryCoverage=50%, HitCoverage=19%, E-value=3e-37, Identity=64%"; Hit description=Zinc finger, RanBP2-type; AAA ATPase; Translation elongation factor Tu
MRKSRQDSSIESKLSKYVAIDLQTSGKTSNSLLESLSKHKGNNITKINSLKNGTIDIQSSKEKSGSLSTRSKVKESDNINPSSIKDGKLESISSSFSNMVVNIRSGNSEYTNAKGTCSHVSYKPEIWILPQQVEDTLTQLNLSIMMKESQSKDNATIRWDIGFNKKRVAYFVFPNWIKLFYPSKVLLVGASSIIMIYFLDTSYTLLGRITEGIEESVCGRLYYGTSKKIPPSELLDTIGVGDAFVGVILYCTCNLFIKSLHMQDGTF

SEQ ID NO: 162061 - protein, 71 aa, Glycine max
  Coding DNA Sequence Number=SeqID_45283
IVRGIDTVKGVLYVITPVPHNSLEKVNVLLQGYIQIPSCLLQASYCFHNEQSAACERQTKTTNMMKPSLET

SEQ ID NO: 162062 - protein, 202 aa, Glycine max
  Coding DNA Sequence Number=SeqID_45284
  Pfam annotation: Domain name=NUC156; Domain location=139-200; Score= -23.4; E_value=0.03; Accession=PF08160.2; Description=NUC156 domain
MEWLGLGPFLIVVKCLFFGDVSSKRDPSTYLSYVFAIYDYYQKKYCIYEKGENPCKVKLPLIVNTPGWVKGVGYDVLVDMLKYISPTHVVKISIASEKKNLPAGEFWLDGEHDETINLIEINSAHQDSLNRSLLVQKDARLLRDLRIMAYFKQCFSSDSNISTIKELAHALASHCPYEVPIASIKIRHLHCEVGLNFTFLPF

SEQ ID NO: 162063 - protein, 509 aa, Glycine max
  Coding DNA Sequence Number=SeqID_45285
  Gene Ontology: Mol. function=protein binding, bridging; Cellular component=nucleus; Biological process=cell division
  Homolog annotation: Hit_ID=Q1SC21; Match level="QueryCoverage=99%, HitCoverage=100%, E-value=1e-164, Identity=60%"; Hit description =WD40-like
  Pfam annotation: Domain name=WD40; Domain location=138-177; Score =49.4; E_value=1.2e-11; Accession=PF00400.22; Description=WD domain, G-beta repeat
  Pfam annotation: Domain name=WD40; Domain location=260-298; Score =6.2; E_value=6.8; Accession=PF00400.22; Description=WD domain, G -beta repeat
  Pfam annotation: Domain name=WD40; Domain location=306-344; Score =8.9; E_value=3.3; Accession=PF00400.22; Description=WD domain, G -beta repeat
  Pfam annotation: Domain name=WD40; Domain location=350-389; Score =22.9; E_value=0.0011; Accession=PF00400.22; Description=WD domain, G- beta repeat
  Pfam annotation: Domain name=WD40; Domain location=38-79; Score=3.0; E_value=16; Accession=PF00400.22; Description=WD domain, G-beta repeat
  Pfam annotation: Domain name=WD40; Domain location=96-134; Score =29.2; E_value=1.4e-05; Accession=PF00400.22; Description=WD domain, G-beta repeat
  Pfam module annotation: Pfam domain module=WD40::WD40::WD40::WD40::WD4 0::WD40; Domain location=138-177::260-298::306-344::350-389::38 -79::96-134
METPSSHSLFAHIASRELFRVPKRHRMDGFVSGFNETGLLAVQHNAEDTIPLSLSFCKTSKFGHILAVSDEDGYITLFDTRRNFPVTANFEENSEKVKICHWVSHQNAVFDTCWIKEDTQILTASGDQTIKLWDVQEQKCLGVLTGHTGSVKSMCSHPTNSDIIVSGSRDGSFRIWDLRCKSTAKSRHGEVGICSMGGVKGAHISSQARRTRRGKAAPMSITSVLCLKDQVSIATAGAVDSVLKFWDTRNLKSTVTQTSPSPQSAEKQTLHGISSLSQDESGLFLSASCMDNRIYLYNTLQLDKGPLKSFSGCRIESFFVKSAISPDASNIVSGSSDGNAYVWKVDKPLEDPTILKSHDDGEVTAVDWCSSEIGKLATCSDDFTVRTWNKNSYVSSIQCASAIRRRVMAIPSIECKMLLNNGKRYSKTNEDAFLPDDALHPITSPTPITPPKMNISEGHTNQLSSRLDLNASSEKTPESALKSPSSVLNPPSSLKRTIRDYFLASSKTL

SEQ ID NO: 162064 - protein, 99 aa, Glycine max
  Coding DNA Sequence Number=SeqID_45286
  Homolog annotation: Hit_ID=Q8GZU9; Match level="QueryCoverage=66%, HitCoverage=6%, E-value=1e-10, Identity=56%"; Hit description =Ribonucleotide reductase large subunit A
  Subcellular localization annotation: CTP_CleavageSite=38; ConfidenceScore=5.06e-01
MAIIISLSFSFPIFNSVLIPLLSCSHTSLLRYALSTFRAKEEEVERKPCVKALPFKEVCVEIYKGVTTSQLNELVAETTAAMIANHPDYSSLAARTIFL

SEQ ID NO: 162065 - protein, 83 aa, Glycine max
  Coding DNA Sequence Number=SeqID_45287
  Subcellular localization annotation: CTP_CleavageSite=57; ConfidenceScore=5.37e-01
MTTLSPLSSSHLCLKTKLPNHPFHWITPNATVVVATTCRRKKFSCGGYGWSERMAVTAEEGNTKEISLAAKLKLGQVPYFRCS

SEQ ID NO: 162066 - protein, 122 aa, Glycine max
  Coding DNA Sequence Number=SeqID_45288
  Subcellular localization annotation: CTP_CleavageSite=42; ConfidenceScore=5.44e-01
MAPPLTSIPLSSAASPWTQRSSLHRSSTSKLPSYPKVQENPRAFPLISDPIYLYSSIQCPCGGNTRLTGASSKGGRHTESPPTFIRGKRRKNQNMWSTNFNLERFGSCFYTRGRYYHPTRLP

SEQ ID NO: 162067 - protein, 75 aa, Glycine max
  Coding DNA Sequence Number=SeqID_45289
YIGMDASGDRVTIDRSLPLPGAKQAENVAARQPRGTFSSPKTLPPHFKNPQPHENYENSSPQASIVEFFASLFTL

SEQ ID NO: 162068 - protein, 289 aa, Glycine max
  Coding DNA Sequence Number=SeqID_45290
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=7e-37, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLSFRGLHILAFRGLHVLAFRGLHVLAFRGLHVLAFRGLDVLAFRGLHTLIFRGLHILSFRGPHILAFRGLYILAFRRLHALAFRGLQVLNLRGLHTYAFRGPHVLAFRGLYILAFTGRHVLAFRRLHVLVFRRLNILTFRGLHVLIFRGLHALTLRWLHALAFRGLHALAFLGLHVLALRGLHVLAIRGLHILLFRGMHVLGFRGLHTLTFKGLNVLAYRGPHVLTFRGLHVLTLRGPHVLSFRGLHILALRGLQALAFRGLHVLAFQRTIVLDQVASEQLRRGGG

SEQ ID NO: 162069 - protein, 309 aa, Glycine max
  Coding DNA Sequence Number=SeqID_45291
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=2e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHAFAFRGMQVLAFRGLHILPFRGIDVLGFRGLHTLTFKGLNVLAYRGPHVLAFRGILVLTFRGLDALAFRGLHARALRRMHALAFIGLLDLTFGGIHVLDFKGLHLLTFRGPDVLAFRGLHILSFRGLHPLTFKGLHVLAFRGLQVLAFRGLHVLPLRGAHVLTFRGLHSLALRRLHSFAIRVLHVLAFTGQQDLPFRGLYVLTFRGLHAMAFIGLHALTFIGLNVLTFRELHVPTFKGLHVHAFRGLHVLTFRGLHDLAFIGLYALEFKGLHVFTFTKYMSSPLEGCTPSPSEGYTPLPLEACTSLP

SEQ ID NO: 162070 - protein, 320 aa, Glycine max
  Coding DNA Sequence Number=SeqID_45292
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=4e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MARRRLQSTARRHVLAFRGLHVLTFRGLHVLTFRGLHALALRRLHAFAFRGLHVLELRGLLIFALRGRHALTIRGLHVLAFRGGLQVLAFRGLHVLPFRGTHVLTFRGLHSLAVRGLHALTFRGLQVLAFRGLHVLAFRGVHVFTFRALHVLAFTGLQDLDFRGLYVLTFRGLHALAFIGLHALTLIGLHVLACRGLHILAFRGLHILAFRGLHILAFRGLHALALRGLHALAFRGFDILAFRGLHILAFVGLPNLAFGGLHRTTRARLQRTLGPRLQRTAHPHTLAFRGLLVLAFRGPHVHAFRGLHALAFEELHALAF

SEQ ID NO: 162071 - protein, 281 aa, Glycine max
  Coding DNA Sequence Number=SeqID_45293
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=99%, E-value=3e-22, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TRCPHRKRVHAHAFRGSHVLAFKGLHILVFRGLHALAFRGLLSLAFRGLHILAFRVLNILTFRGPHVLAFRGLHILALRGLHALAFRGLQILAFIGLPILAFEGLHVLDFRGLHVLAVRGLHILSFRELHAFTFKGLHVLTFRAQQRTTRPRLRRAIHPHLQISTRPDLQRTTRPRLQRATRPHLQRSTRPQLQRTTRSQLQRTTRPRLHRTTRPHLQRTIVLTFRGLDALAFIGLHTLTFVGLNVLTFRELHVLTFKGLDELAFRGLYVLTFRGLHALSF

SEQ ID NO: 162072 - protein, 337 aa, Glycine max
  Coding DNA Sequence Number=SeqID_45294
  Homolog annotation: Hit_ID=Q47522; Match level="QueryCoverage=17%, HitCoverage=77%, E-value=6e-19, Identity=74%"; Hit description=LacZ protein
GHQDLFILRSDLPSQWLLFLSAVPPVQLLTGWCVTAKAPPDISAGKCSGHAARRVPFAIQAAQLLGRAIGAGFFAITPAGERGMCCKAIKLGNARVFPEFDDTYVSPTKIYPAASCNGEASPTCCTMNPTNKVMVGPETQMAYKENSHCNSPIEVDTGKSSKKDDVRSKLNFDASNMPESLDKSLSNEVYTSESDKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 162073 - protein, 95 aa, Glycine max
  Coding DNA Sequence Number=SeqID_45295
  Homolog annotation: Hit_ID=Q1RT71; Match level="QueryCoverage=83%, HitCoverage=18%, E-value=2e-38, Identity=93%"; Hit description =Cyclin-like F-box
MDEGKTLRIGAWKILVVDTTACLCRVDTGLKTVAGAKRYVPGTKLCLRPDIKPSIHPTRNKPARGDRSRSQSPLLPGLPDDLAIACLIRVPRVEH

SEQ ID NO: 162074 - protein, 82 aa, Glycine max
  Coding DNA Sequence Number=SeqID_45296
MVDSEKLGAKGEALKEGPWPQLNSTAQPTKHKTKTMCLRLQQQYTDPLHQLQLQFQIFQPLDYINDKKSATCHYRSREDRQP

SEQ ID NO: 162075 - protein, 239 aa, Glycine max
  Coding DNA Sequence Number=SeqID_45297
  Gene Ontology: Mol. function=protein serine/threonine kinase activity; Cellular component=intracellular; Biological process =protein amino acid phosphorylation
  Homolog annotation: Hit_ID=Q1SC20; Match level="QueryCoverage=92%, HitCoverage=62%, E-value=6e-55, Identity=80%"; Hit description =Protein kinase; Nuclear transport factor 2
MRFGQTVKITCLPNGCISLFNKLTEIRTLCEAPCYEGLVEFHGAFYTPDSGQISIALDRVHGWRIACRYLVNVLLLSVEQENSNIQLMKVLSNLSCKTSPHTYSKNFSLKQFILYIHDGLKLIILFCPALLQLLSHPFITKYEDAKVDLARFVRSVFDPTQRMKDLADMLTIHHYLLFDSPDDLWQHTRNLYIESSIFSFSGKQHCGPSNIFTSLSSIRTTLVGDWPPEKLVHVVERLQ

SEQ ID NO: 162076 - protein, 75 aa, Glycine max
  Coding DNA Sequence Number=SeqID_45298
MLCGICHTLISSGDYCLVACNLRLTASRYLTPIASKKGGANSKQPTWATEGSAFWWKQPCSPGRAERQLPPSFLL

SEQ ID NO: 162077 - protein, 310 aa, Glycine max
  Coding DNA Sequence Number=SeqID_45299
  Gene Ontology: Mol. function=protein binding; Cellular component =nucleus; Biological process=intracellular protein transport
  Homolog annotation: Hit_ID=Q1RT71; Match level="QueryCoverage=99%, HitCoverage=72%, E-value=1e-175, Identity=93%"; Hit description =Cyclin-like F-box
  Pfam annotation: Domain name=Kelch_1; Domain location=39-85; Score =32.6; E_value=1.4e-06; Accession=PF01344.15; Description=Kelch motif
  Pfam annotation: Domain name=Kelch_1; Domain location=87-134; Score =62.0; E_value=1.9e-15; Accession=PF01344.15; Description=Kelch motif
  Pfam annotation: Domain name=Kelch_2; Domain location=39-85; Score =3.6; E_value=13; Accession=PF07646.5; Description=Kelch motif
  Pfam annotation: Domain name=Kelch_2; Domain location=87-134; Score =26.1; E_value=0.00012; Accession=PF07646.5; Description=Kelch motif
  Pfam module annotation: Pfam domain module=Kelch_1::Kelch_1::Kelch _2::Kelch_2; Domain location=39-85::87-134::39-85::87-134
EWIYVIKRDRDGKISWHAFDPVYQLWQPLPPVPKEYSGALGFGCAVLNGCHLYLFGGKDPLKGSMRRVIFYNARTNKWHRAPDMLRRRHFFGSCVINNCLYVAGGENEGVHRSLRSAEVYDPNKNRWSFISDMSTAMVPFIGVVYDGKWFLKGLGSHRQVLSEVYQPENDSWYPIYDGLVSGWRNPSTTLNGKLYALDCKDGCKIRVYDEVADSWSKHIDSKLHLGSSRALEAAALVPLNGKLCIIRNNMSISLVDVSKLEDLKGSSAEQLWETIAGKGQFKTLVTNLWSSLAGRNRLKTHIVHCQVLQA

SEQ ID NO: 162078 - protein, 94 aa, Glycine max
  Coding DNA Sequence Number=SeqID_45300
  Gene Ontology: Mol. function=protein dimerization activity; Cellular component=nucleus; Biological process=regulation of transcription, DNA-dependent
MFQALCEELTRKVATLVAENENLKREKELALKEYESLETTNKNLKTQIAKSINTEVEKTPVEPVSSVAEITPSSEEDKKAFEMTESKEATLLEA

SEQ ID NO: 162079 - protein, 76 aa, Glycine max
  Coding DNA Sequence Number=SeqID_45301
  Gene Ontology: Mol. function=nucleic acid binding
  Homolog annotation: Hit_ID=Q1SJY4; Match level="QueryCoverage=96%, HitCoverage=15%, E-value=4e-13, Identity=47%"; Hit description=Zinc finger, CCHC-type
MRDGETIEEMFGRLQTLLNGLQALGYEYTKAQINLKILDNFPKVWKPKTTTTQEARNMKTLTLDELLGALHVHEVH

SEQ ID NO: 162080 - protein, 39 aa, Glycine max
  Coding DNA Sequence Number=SeqID_45302
MADTTMAIFNGCEVTSTGKTKSRGERFFNERGEKIVIPP

SEQ ID NO: 162081 - protein, 88 aa, Glycine max
  Coding DNA Sequence Number=SeqID_45303
  Subcellular localization annotation: CTP_CleavageSite=31; ConfidenceScore=5.15e-01
MVQQSSCYTKPNTFYITCSKLKYSNQNWRSSVGLGWKRMKERLRDRKMQRVQRQTKHEQLFGCWKLERAKCRVRNKHMRLHDAKTRVK

SEQ ID NO: 162082 - protein, 75 aa, Glycine max
  Coding DNA Sequence Number=SeqID_45304
  Gene Ontology: Mol. function=amino acid binding; Biological process =metabolic process
  Homolog annotation: Hit_ID=Q75IY1; Match level="QueryCoverage=70%, HitCoverage=11%, E-value=5e-15, Identity=82%"; Hit description =Putative ACT domain containing protein, ACR4, with alternative splicing forms
MVEMHTTIMVKPMPPECRPYYCVRIGQSFSISDIVCTLTDMKYVVFHANIDAEGPEAYQEYYIKHIDGSPVKSDA

SEQ ID NO: 162083 - protein, 111 aa, Glycine max
  Coding DNA Sequence Number=SeqID_45305
MEDAPESLASLARKRVGCDSISLGMDKFFWAFMSDGTFSTKSFYDLLACPYVQSDPTLRNCLWSIPDCKGVMDTISDPKANFSELMSIVSECRSLQLAKFNAYILHNSLLA

SEQ ID NO: 162084 - protein, 89 aa, Glycine max
  Coding DNA Sequence Number=SeqID_45306
MAMLVCSKKVIKRVRCGLRLLKNKRQAIARQLRKDLAELIQSSHEEIAFNRECELKRTTLCRPLWIMTPLILFIFLSHRFGWQQKIIAN

SEQ ID NO: 162085 - protein, 229 aa, Glycine max
  Coding DNA Sequence Number=SeqID_45307
  Gene Ontology: Mol. function=zinc ion binding; Cellular component =nucleus; Biological process=regulation of transcription
  Homolog annotation: Hit_ID=Q1SDI6; Match level="QueryCoverage=59%, HitCoverage=20%, E-value=4e-25, Identity=43%"; Hit description=FAR1; Zinc finger, SWIM-type
  Pfam annotation: Domain name=SWIM; Domain location=22-58; Score=37.0; E_value=6.3e-08; Accession=PF04434.8; Description=SWIM zinc finger
MEAHGEYVITMMDENGECRVSYESQIENGELTITCSCRKFEQLGILCCHSLRILFHKDVKLLPNKYILKRWTRQARCDTYNDNSGRQIDVDPRLESSNRYKQLCPMLMRLSDEASDYPEACSLVYQGVLELSKKVAEIRLNQQPHGPRDSTREATRYAMEPLASKGIGFKKRDVWCVNSKPMIYQESQVLLEASNSDSLIGCAHLNQLSLQESTSILSEAYTHLVSFPP

SEQ ID NO: 162086 - protein, 249 aa, Glycine max
  Coding DNA Sequence Number=SeqID_45308
MGAATVHENDEVVALMLPTTLIGVRRVKGLGVVLLEGKKEKKLSTTVMVGAIAFVVVVAQATLATRRHSYLGKAFIGGGGKRGGRVEEGGRVEIGWGAKEGGLGRDERRASRPKMKQLRRKGVERPIIQFARASNSTRKDDHEGRGRGFECLKARNNLVQPGVQGVLGGGEGVLVLGKILELEARKYLQNAKQNDGASCTHNEDTHDEEGLFMVLFGLVAAALSWIVYDFLEQEIVSVLVELSLVKIQP

SEQ ID NO: 162087 - protein, 601 aa, Glycine max
  Coding DNA Sequence Number=SeqID_45309
  Gene Ontology: Mol. function=RNA-directed DNA polymerase activity; Cellular component=chromatin; Biological process=chromatin assembly or disassembly
  Pfam annotation: Domain name=Chromo; Domain location=521-570; Score =32.5; E_value=1.4e-06; Accession=PF00385.14; Description='chromo' (CHRromatin Organisation MOdifier
  Pfam annotation: Domain name=rve; Domain location=295-448; Score =19.5; E_value=0.00014; Accession=PF00665.16; Description=Integrase core domain
  Pfam annotation: Domain name=zf-H2C2; Domain location=267-308; Score =6.9; E_value=0.044; Accession=PF09337.1; Description=His(2)-Cys(2) zinc finger
  Pfam module annotation: Pfam domain module=Chromo::rve::zf-H2C2; Domain location=521-570::295-448::267-308
MDLAQGFHQIRMVEHDVPKTTFRMHQGHYDRDFKAHLKHLDCVFQTLQQGSGARSFQNQSYATMASPIISQTVARVPGLDWVLSAFRPPICSNRGAAYPTTTEGSIRMTDALGFGMGVVLMQRSHPIAYFSKQFCPKLLRSPTYIHELHAITTAVKRWLQYLLGHAFVILTDHKRLRELMTQLVQTLEQHVYLAKLLGYNYTIQYKARHNNVELAVLEEFKTLMNRVHDNPLQCPEFKIRDNLLLYQGHIWINRGNPFIPLLLEEYHKSPLGGHMGLAKTLCRLQQSFFWEGMRRDTQQFIKQCTNCLQTKLPNSNGAMIIMIVVDHFPKGAHLGSLPPHFTAQLFIDLVCKLHGFPRSLISDRDPIFVSKFWREPFKLCGTKLRMSTAYHPQSDGQSEVMYGKPPPDIPDYLPGSSSVEAVDFLLTTRQDMFDALRQKLERSQARMKNSTDPHRQEVNFKIGDWVYVKLRLYRQTSIADNLASTAKIHPVFHCSKLKPHHGPLVSTQSLLPSSWDNNPAVEPLAILDHKWDNHNPPQLSVLVQWTGLQPEDATWENWTDLQGIYHLEDKVFQEAVEDDSAAATRPKRTMKRPLSWEKYIH

SEQ ID NO: 162088 - protein, 217 aa, Glycine max
  Coding DNA Sequence Number=SeqID_45310
  Gene Ontology: Mol. function=sequence-specific DNA binding; Cellular component=nucleus; Biological process=regulation of transcription
  Homolog annotation: Hit_ID=Q6R4S8; Match level="QueryCoverage=92%, HitCoverage=64%, E-value=3e-29, Identity=40%"; Hit description=WRKY transcription factor 11
MEGLKGMDNLIQILSHHPSYINTELANIIVSKFKKLNALLNRTGHARFRRTPIHSTAPVHSTNPVHNASTSSTQVPLSENPNLFALVQSPVPVQVHRMPASVALDFMEPHNPLISFNAKSVELEFSKETFNVPSKSSFISPAITNNGNVSNKEIFLASAPPTTSVEKVLAFKKQCYEHHEQSVDISGSSKCHYLKQRREDIKHQNQEDLTQLIEQCV

SEQ ID NO: 162089 - protein, 170 aa, Glycine max
  Coding DNA Sequence Number=SeqID_45311
  Gene Ontology: Mol. function=histone-lysine N-methyltransferase activity; Cellular component=nucleus; Biological process =multicellular organismal development
  Homolog annotation: Hit_ID=Q8L8Q3; Match level="QueryCoverage=66%, HitCoverage=71%, E-value=2e-52, Identity=84%"; Hit description=LOB domain-containing protein 25
  Pfam annotation: Domain name=DUF260; Domain location=10-110; Score =233.9; E_value=3.5e-67; Accession=PF03195.5; Description=Protein of unknown function DUF260
MASSSYSNSPCAACKFLRRKCMPDCIFAPYFPPEEPHKFANVHKIFGASNVSKLLNEVQPHQREDAVNSLAYEAEARIKDPVYGCVGAISVLQKQVLRLQKELDATNADLIRYSACNEIPNTTTHHGGRRMSDDGGGGGSSLAHSHGFYYPSNWNNDPCGNSNGYPRGDI

SEQ ID NO: 162090 - protein, 143 aa, Glycine max
  Coding DNA Sequence Number=SeqID_45312
  Gene Ontology: Mol. function=zinc ion binding
  Homolog annotation: Hit_ID=Q1S5Q3; Match level="QueryCoverage=65%, HitCoverage=65%, E-value=1e-08, Identity=33%"; Hit description=Zinc finger, GRF-type
  Pfam annotation: Domain name=zf-GRF; Domain location=15-60; Score =39.6; E_value=1.1e-08; Accession=PF06839.3; Description=GRF zinc finger
MHHHLEQRVSSQVVLFCGCGRRAVRRVAGTNINRGRAFFTCSINKDEVGYCGYFIWVDQLIEALGVDDSLGTFSMEQRRQFGREEDKTMWKAQVNSKLDCIGIEMKMFRTIVYGMFLIQLLSMVVFYVHFVAKLHKIQFCIRA

SEQ ID NO: 162091 - protein, 76 aa, Glycine max
  Coding DNA Sequence Number=SeqID_45313
MIMRGQDIYSSQDEVTTSPSSSESEEGKVEESSEEIYPQEEVDLLMVRRLLGGQSCDLTQPHFSQKIVVHVAIVAA

SEQ ID NO: 162092 - protein, 250 aa, Glycine max
  Coding DNA Sequence Number=SeqID_45314
  Gene Ontology: Mol. function=DNA binding
  Homolog annotation: Hit_ID=Q1RTB4; Match level="QueryCoverage=92%, HitCoverage=53%, E-value=4e-19, Identity=30%"; Hit description=IMP dehydrogenase/GMP reductase
LDVTSLKELGQLMGPFQRQAFRKVYGKILGGDRSGENRIFSPAFFLSLSKIAAVIGDSAKELDRMKQTRNGVVGLPRKYLEGKARGMASQEKWGPFADILALLIFGVVLFPNVDGLVDLAAIDAFLAYHHSKESPMVAILADLFDTFDRSMINWFPRWKEGKEGVLFSCGDYPNVPLIGTRGCINYNPAFAIRQLGYPMSGAPTEESLSPFLVRDLGTQGLKVIQRIHKAWRSSLRKDKELRDIRNGIIG

SEQ ID NO: 162093 - protein, 76 aa, Glycine max
  Coding DNA Sequence Number=SeqID_45315
MDLKGINLINQNYPVVVSIIIANFMVSKRLKVFPDIVHPHAGQLLSFAGKRVETRGYMDLMTTFDQAKLSRSFTMR

SEQ ID NO: 162094 - protein, 42 aa, Glycine max
  Coding DNA Sequence Number=SeqID_45316
MGVKYLKVVKRRSHPNKQMMFRAQIGDPLSTLMTLVPLAALG

SEQ ID NO: 162095 - protein, 73 aa, Glycine max
  Coding DNA Sequence Number=SeqID_45317
MRGKRLARVKKRAMSWRPAWNEAADADSCELRKPPRNEGSCRIYLLGYYQPLDLEERVNYCGLAPTQPLHTVA

SEQ ID NO: 162096 - protein, 124 aa, Glycine max
  Coding DNA Sequence Number=SeqID_45318
  Gene Ontology: Mol. function=metal ion binding; Biological process =metal ion transport
  Homolog annotation: Hit_ID=Q69N34; Match level="QueryCoverage=51%, HitCoverage=11%, E-value=5e-17, Identity=60%"; Hit description =Agenet domain-containing protein / bromo-adjacent homology (BAH) domain-containing protein-like
MEVRSIMNPVQMLAEHFILAEYFCMVMRINIDCNGCYRKVKRALLDMPELDTHLLEKNQTRVIVCGRFIPRDVAIMIRKKTNRRVEILDIQDLSESNAEMEDQKPMTNNWTLLTTQNQMETCLA

SEQ ID NO: 162097 - protein, 231 aa, Glycine max
  Coding DNA Sequence Number=SeqID_45319
  Gene Ontology: Mol. function=binding; Cellular component=protein phosphatase type 2A complex; Biological process=ethylene mediated signaling pathway
  Homolog annotation: Hit_ID=Q38950; Match level="QueryCoverage=98%, HitCoverage=36%, E-value=1e-100, Identity=79%"; Hit description =Serine/threonine-protein phosphatase 2A 65 kDa regulatory subunit A beta isoform
  Pfam annotation: Domain name=HEAT; Domain location=174-210; Score =23.5; E_value=0.00075; Accession=PF02985.12; Description=HEAT repeat
  Pfam annotation: Domain name=HEAT; Domain location=43-78; Score=2.1; E_value=24; Accession=PF02985.12; Description=HEAT repeat
  Pfam annotation: Domain name=HEAT; Domain location=81-117; Score =15.9; E_value=0.14; Accession=PF02985.12; Description=HEAT repeat
  Pfam module annotation: Pfam domain module=HEAT::HEAT::HEAT; Domain location=174-210::43-78::81-117
MAMVDQPLYPIAVLIDELKNEDIQLRLNSIRRLSTIARALGEDRTRKELIPFLSENNDDDDEVLLAMAEELGVFIPYVGGVDHANVLLPPLETLCTVEETCVRDKSVESLCRIGAQMREQDLVEHFIPLVKVVHVPSCIAFSFVVLRRLAAGEWFTARVSSCGLFHIAYPSAPESVKTELRAIYGQLCQDDMPMVRRSAATNLGKFAATVEAPHLKSDIMSVFEDLTQDGM

SEQ ID NO: 162098 - protein, 565 aa, Glycine max
  Coding DNA Sequence Number=SeqID_45320
  Gene Ontology: Mol. function=transferase activity; Cellular component= mitochondrion; Biological process=metabolic process
  Homolog annotation: Hit_ID=Q9FND8; Match level="QueryCoverage=89%, HitCoverage=82%, E-value=1e-145, Identity=50%"; Hit description=Salt- inducible protein-like
  Pfam annotation: Domain name=PPR; Domain location=179-213; Score =19.8; E_value=0.0098; Accession=PF01535.11; Description=PPR repeat
  Pfam annotation: Domain name=PPR; Domain location=214-248; Score =22.9; E_value=0.0012; Accession=PF01535.11; Description=PPR repeat
  Pfam annotation: Domain name=PPR; Domain location=249-283; Score =39.9; E_value=8.8e-09; Accession=PF01535.11; Description=PPR repeat
  Pfam annotation: Domain name=PPR; Domain location=284-318; Score =41.6; E_value=2.8e-09; Accession=PF01535.11; Description=PPR repeat
  Pfam annotation: Domain name=PPR; Domain location=319-353; Score =44.6; E_value=3.4e-10; Accession=PF01535.11; Description=PPR repeat
  Pfam annotation: Domain name=PPR; Domain location=354-388; Score =53.8; E_value=5.7e-13; Accession=PF01535.11; Description=PPR repeat
  Pfam annotation: Domain name=PPR; Domain location=389-423; Score =12.8; E_value=0.22; Accession=PF01535.11; Description=PPR repeat
  Pfam annotation: Domain name=PPR; Domain location=424-458; Score =11.2; E_value=0.35; Accession=PF01535.11; Description=PPR repeat
  Pfam annotation: Domain name=PPR; Domain location=459-493; Score =25.0; E_value=0.00026; Accession=PF01535.11; Description=PPR repeat
  Pfam annotation: Domain name=PPR; Domain location=494-528; Score =41.2; E_value=3.5e-09; Accession=PF01535.11; Description=PPR repeat
  Pfam module annotation: Pfam domain module=PPR::PPR::PPR::PPR::PPR::PP R::PPR::PPR::PPR::PPR; Domain location=179-213::214-248::249-283::284- 318::319-353::354-388::389-423::424-458::459-493::494-528
  Subcellular localization annotation: CTP_CleavageSite=57; ConfidenceScore=5.33e-01
MIRRPSIYVPTLSQSMFFSSSSSLIALHDSHSKSTLSPFYNLLPPTQNPNNIVNLISSILKHKSSNLSLLHSSNNDIKGILPHMGPHEISRILLRCQSDHSSVLTFFNWVKNDLNITPTLHNYCVIVHILAWSRVFSHAMNLLSELIQLVEVEGVCVPPNDGIYENLVECTEDCNWNPAIFDMLIKAYVKAGMVEKGLATFRRNIEACFIPNVIACNCLLSGLSRFNYIGQCWAVYEEMGRLGIHRNAYTFNIMTHVLCKDGDTDKVTRFLDKMEEEGFEPDLVTYNTLVNSYCKKRRLEDAFYLYKIMYIRGVMPNLITHTVLMNGLCEEGKVKEAHQLFHQMVHRGIDPDVVSYNTLVSGYCREGKMQMCRSLLHEMIGNGICPDSVTCRLIVEGFARDGKLLSALNTVVELKRFRIKIPEDLYDYLIVALCIEGRPFAARSFLLRISQDGYMPKINTYNKLVESLCKFNNVEEALILKSEMVKRSMILNLVAYRAVISCLCRVNRTLEAEGLLEEMVSSGILPDVEISRALINGLTCKYVIHGLQKAMEQDDEMLGHDMLEV

SEQ ID NO: 162099 - protein, 169 aa, Glycine max
  Coding DNA Sequence Number=SeqID_45321
  Homolog annotation: Hit_ID=Q1S3Q9; Match level="QueryCoverage=97%, HitCoverage=39%, E-value=1e-16, Identity=30%"; Hit description =Cyclin-like F-box; F-box protein interaction domain
MFGFGYDPSSDKYKVVAIALTMLSLDVSEKTEMKVYGEGDSSWRNLKGFPVLWTLPKVGGVYLSGTLNWVVIMGKETIHSEIIDSLCVWQDSNTHIGLWQMRKFGDDKSWIQLINFSYLHLNIRPYEEKSMILPLCMPNNGDFFMLKFTRNADDEYQTILYNQGDDVSS

SEQ ID NO: 162100 - protein, 493 aa, Glycine max
  Coding DNA Sequence Number=SeqID_45322
  Gene Ontology: Mol. function=nucleic acid binding; Cellular component= spliceosome; Biological process=mRNA processing
  Homolog annotation: Hit_ID=Q9LVX1; Match level="QueryCoverage=94%, HitCoverage=50%, E-value=1e-83, Identity=40%"; Hit description =Arabidopsis thaliana genomic DNA, chromosome 3, P1 clone: MGF10
  Pfam annotation: Domain name=GAGA; Domain location=161-213; Score =9.2; E_value=0.092; Accession=PF09237.1; Description=GAGA factor
  Pfam annotation: Domain name=RRM_1; Domain location=189-254; Score =41.4; E_value=3.1e-09; Accession=PF00076.12; Description=RNA recognition motif. (a.k.a. RRM, R
  Pfam module annotation: Pfam domain module=GAGA::RRM_1; Domain location=161-213::189-254
NASTPSVNNKCLPGKISKSVVNDDGLPLDGVYTGPGCTSGADLYDPDQPLWNDCGLESSNALLTLQSSKIDESKPISNDAPDSDCPVGTARTSVSSQGASSSVWARIGSSKNRFDMKEKTNSTTSSFNYPENQLKEDNDELVGAHNASFQVKQNIADDADPKALEASLKAQTDSMRNIRKSSQKAFCTLFVNGIPQKYNKREALLAHFKKFGEVIDIYIPLNSERAFVQFSKREEAEAALKAPDAVMGNRFIKLWWANRDSIRKDSTTSGNGVIVTPRGQAPAFVPSHPVVTDRGKDIHQADASKTMYEVSSPTDQSKPVITDGPKVPPPLQKKLVNLESLKEELRKKQEMLDQKRNEFKRQLNKFEKQASGLKGEVSTEQATKRLKMGGTSDVAKLASPQSSDADVGMTSPHTEATADKNKQLVYPVSQSPKSSTATRLQESTGLKHPIQPLMPVNRYKLDNRPAAFRIIPPLPAGLANVSILSVFLSVVKV

SEQ ID NO: 162101 - protein, 41 aa, Glycine max
  Coding DNA Sequence Number=SeqID_45323
MGQTLELGKITKNTVTDYNIDAHVGLQIQKALMVELGASSL

SEQ ID NO: 162102 - protein, 366 aa, Glycine max
  Coding DNA Sequence Number=SeqID_45324
  Gene Ontology: Mol. function=pepsin A activity; Cellular component =cellulose and pectin-containing cell wall; Biological process =proteolysis
  Homolog annotation: Hit_ID=Q5Z6M6; Match level="QueryCoverage=88%, HitCoverage=59%, E-value=4e-96, Identity=53%"; Hit description =Putative nucellin-like aspartic protease
  Pfam annotation: Domain name=Asp; Domain location=48-342; Score= -113.5; E_value=6.7e-07; Accession=PF00026.14; Description=Eukaryotic aspartyl protease
KDLKLQLGKLVQKEKFLTQRDVGDGSGVVAVDSSSVFPVSGNVYPDGLYFTILRVGNPPKSYFLDVDTGSDLTWMQCDAPCRSCGKGAHVQYKPTRSNVVSSVDSLCLDVQKNQKNGHHDESLLQCDYEIQYADHSSSLGVLVRDELHLVTTNGSKTKLNVVFGCGYDQEGLILNTLAKTDGIMGLSRAKVSLPYQLASKGLIKNVVGHCLSNDGAGGGYMFLGDDFVPYWGMNWVPMAYTLTTDLYQTEILGINYGNRQLKFDGQSKVGKVFFDSGSSYTYFPKEAYLDLVASLNEVSGLGLVQDDSDTTLPICWQANFQIRSIKDVKDYFKTLTLRFGSKWWILSTLFQIPPEGYLIISVILSF

SEQ ID NO: 162103 - protein, 330 aa, Glycine max
  Coding DNA Sequence Number=SeqID_45325
  Gene Ontology: Mol. function=oxidoreductase activity; Cellular component=nucleus; Biological process=electron transport
  Homolog annotation: Hit_ID=Q6Z690; Match level="QueryCoverage=71%, HitCoverage=28%, E-value=3e-67, Identity=54%"; Hit description =Putative polyamine oxidase
  Pfam annotation: Domain name=SWIRM; Domain location=94-186; Score =85.5; E_value=1.7e-22; Accession=PF04433.7; Description=SWIRM domain
MAEPPSPPPPPPPQSVSPENDVAMSPHNLDLQNSSEDPDSSFPTQTTPEPAVPDSPDSTTTRPDPNPPPRKRRRRKKFFTELTTGTSTRRNDVAKDCDVEALIAISVGFPVDSLTEEEIEANVVSTVGGSEQSNYIVVRNHILARWRSNVSVWLTHDQALRSIRSEHKGLVETAYRFLLEHGYINFGLAHEIKTLKQKPFDGSYRGTVIVIGAGFAGLVAARQLVFMGFKVVILEGRTRPGGRVKTKKMSGDGVEAAADFGGSVLTGINGNPLGVLARQLGLPLHKVRDICPLYLPDGRSVDSEVDSRVEVSFNKLLERVCKLRQAMIEE

SEQ ID NO: 162104 - protein, 140 aa, Glycine max
  Coding DNA Sequence Number=SeqID_45326
  Gene Ontology: Cellular component=integral to membrane
  Homolog annotation: Hit_ID=Q9XCF4; Match level="QueryCoverage=80%, HitCoverage=51%, E-value=7e-17, Identity=37%"; Hit description=TmtpA
  Pfam annotation: Domain name=Mycobact_memb; Domain location=37-140; Score=38.6; E_value=1e-11; Accession=PF05423.4; Description =Mycobacterium membrane protein
MWCYRRQYPRGYGICRHSPRVYRRKLVQTMRTATASVLKRAWVPAVVSCAVGLGAIAVTNLRGAFGSEPIFSATGTSAEPLASSTIKHVRYEVYGPSNATGAVSYLDKDARSQRVDFTSLPWTHTIETSAPAVIASVVAQ

SEQ ID NO: 162105 - protein, 105 aa, Glycine max
  Coding DNA Sequence Number=SeqID_45327
  Gene Ontology: Mol. function=protein disulfide oxidoreductase activity; Cellular component=outer membrane-bounded periplasmic space
  Homolog annotation: Hit_ID=Q3W5S3; Match level="QueryCoverage=81%, HitCoverage=32%, E-value=8e-10, Identity=33%"; Hit description=DSBA oxidoreductase
MPYASGWRCSGKRTVRCEDLAGSGVSVLVEHRTLAGRGRDRVRNTGRLAADEPGRVERGQGAARRAAGPDAGLATGGSAHGGHPVRAGPAGSAHRVLRLRPTVFR

SEQ ID NO: 162106 - protein, 232 aa, Glycine max
  Coding DNA Sequence Number=SeqID_45328
MFENDLGWFQNNISRVVGDGREVSFWRTRWLGRESLLKNFNRIFLNLEQRDAKIAEVSSWNMGTMDETLVPMGTNSTAANVGLDTIGEFRPKQNKPDGWAWNLNVEKKYEVREVRETLIMEETMEDEEFFKQMWKLPISSKHNISGSVAICGLGICLPASCINHFWQHKELINRNNPSLAWWVVWAAMLWGIWLHSNAIKFNAKPIDAEEVFYFNPRPYYWKYSIILPKLRR

SEQ ID NO: 162107 - protein, 782 aa, Glycine max
  Coding DNA Sequence Number=SeqID_45329
  Homolog annotation: Hit_ID=Q1T1F7; Match level="QueryCoverage=44%, HitCoverage=74%, E-value=1e-53, Identity=34%"; Hit description=IMP dehydrogenase/GMP reductase
  Pfam annotation: Domain name=DUF1723; Domain location=178-227; Score =59.5; E_value=1.1e-14; Accession=PF08330.1; Description=Protein of unknown function (DUF1723)
MLSKIDRTKKKKHKENMLHVLAGASARLTQLETRTHHLENSVENLKVSVGNNHGSTDGKLRQLANILGEAEDVSSRDLKPMQLTDEAFPGGPEDVSSQDLKPMQLTDEAFPGGPQDLSLLRSFRNHVATRLWIGEDRHELKVVNHGRKVTDFRLENEHVKAIVEMSGLAPLLEACYRIVDKGLLSAFAERWHKDTSSFHLPVGEMTITLDDVSSLLHLPISGDLCSFPSFGADEACLYLVELLGATKEEAVRETKFTRGAHVRFRWLQDLYEANIEDGHFDYAARAFLLHLVGCTIFADKSATYADVALLELFRDLKTCGKYAWGASALAYMYDQLNDASMHHTKQMAGYMTLLQAWIFEHFPAIGSRQLTIGYKERAPRACRWTPIRGAGDVFTIRTALDMLQTKDILWMPYTVHREHRPFHDISLFSGYIRCGSSAFPLRAHTGHSCSSQCGNSSMNTTPFMDKQIMDLTHGHGSSSSSTTQSQSKDFIDLMKEPPQHHHHHHLEDEDNDEEEKARGNGISKDDIVPSYDFQPIRPLAASNNFDSAAFSRPWNSDSNSNASPPVIKNYSSLDSMEPAKVIVEKDRSAFDATMLSEIDRTMKKHMENMLHVLEGVSARLTQLETRTHHLENSVDDLKVSVGNNHGSTDGKLRQLENILRETIKDKQDIVQAQLQLAKLQVSKTDQQSEMQTSAITNPVQQAASAPVQSQPQLPTPANLPQSIPVVPPPNAPPQPPPQQGLPPPVQLPNQFSQNQIPAAPQRDPYFPPPVQSQETPNQQYQM

SEQ ID NO: 162108 - protein, 198 aa, Glycine max
  Coding DNA Sequence Number=SeqID_45330
  Gene Ontology: Cellular component=integral to membrane
  Homolog annotation: Hit_ID=Q73TG7; Match level="QueryCoverage=97%, HitCoverage=18%, E-value=1e-55, Identity=54%"; Hit description=MmpL4_ 5
  Pfam annotation: Domain name=MMPL; Domain location=134-198; Score= -7.2; E_value=0.013; Accession=PF03176.6; Description=MMPL family
MTWYGHCATTSIGNNTGFDLPACSAIRSVFDALDGVDAFSDKMRALTTDIGNVDAVIPQMAAQLPPIIAVARSMQDTLLTMHSSFSNLITQMAHMTDTASAMGQAFDASRSGDYFYLPPEAFQNPDFQRGLKLFLSPDGTAARFIITHDRDPATPAGISTVTSELESAHQAVKGTALTDAKFYLAGTAAIYRDIQSGS

SEQ ID NO: 162109 - protein, 117 aa, Glycine max
  Coding DNA Sequence Number=SeqID_45331
RVHLLGGCYTENKRGYISCGSVQVEGTSTWLFKENKGGYIPCESLKLKEEDFKCFGEKLEEKTLKKNWKNWIVRLARNPGLARTLTKRESSDLVRRRLTRKSKNTFSAKVCAQHEVS

SEQ ID NO: 162110 - protein, 102 aa, Glycine max
  Coding DNA Sequence Number=SeqID_45332
MSSESIYCGKAKPVGLLETWHDERVGGKGSKGLHVITPSVEDLQQALYVLNNNDEVFPYILLHEGLVKEKSKLMEEKKKKQLQEATKSGSTDTVIDPPSPIR

SEQ ID NO: 162111 - protein, 212 aa, Glycine max
  Coding DNA Sequence Number=SeqID_45333
  Gene Ontology: Mol. function=nutrient reservoir activity; Cellular component=apoplast; Biological process=auxin mediated signaling pathway
  Homolog annotation: Hit_ID=Q1SKM2; Match level="QueryCoverage=98%, HitCoverage=95%, E-value=8e-72, Identity=62%"; Hit description=Cupin region
  Pfam annotation: Domain name=Cupin_1; Domain location=58-209; Score =151.7; E_value=1.9e-42; Accession=PF00190.13; Description=Cupin
  Pfam annotation: Domain name=Cupin_2; Domain location=93-171; Score =36.8; E_value=7.6e-08; Accession=PF07883.2; Description=Cupin domain
  Pfam module annotation: Pfam domain module=Cupin_1::Cupin_2; Domain location=58-209::93-171
MKVIYFLVAILALASSIVSAYDPSPLQDFCVATNETNGVYVNGKFCKHPNLTIPEDFFRHVEPGSTANQLGLGLSPVNVAQLPGLNTLGVSMSRIDYAPKGLNPPHTHPRGTEMLMVMEGTLFVGFVSSNQDNNRLFSKVLNKGDVFVFPIGLIHFQYNVGKGNAVAITAFSSQNAGVIGISSAVFLSTPPIPSEILAKGFQVGQNVIDEFR

SEQ ID NO: 162112 - protein, 118 aa, Glycine max
  Coding DNA Sequence Number=SeqID_45334
MVIILLKENVVIWFCSLHLARQLPENNYLQVSYIFNTFTLALVVNINILIVQYASMFVLKSSLKGFVDTPQSKSKAAARWIVVKYFTDTRPLEPERLKALRIQWASYYLKVKNETISV

SEQ ID NO: 162113 - protein, 75 aa, Glycine max
  Coding DNA Sequence Number=SeqID_45335
MDESGQETPIRCKLNMKKSGPPPTLHEKLHKHAPYTSMELEMKCRGATAKGRTTQKMTVEKTNSLIWEVSQSSVT

SEQ ID NO: 162114 - protein, 80 aa, Glycine max
  Coding DNA Sequence Number=SeqID_45336
RKGLPRVDLGFNELWTKGAFILGFDKAHQVQTLGLSSLWRSETHQGQTLGSPRVDLRYDEPLEKRDSPRADLGFDEPLEK

SEQ ID NO: 162115 - protein, 205 aa, Glycine max
  Coding DNA Sequence Number=SeqID_45337
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=91%, HitCoverage=40%, E-value=2e-26, Identity=45%"; Hit description=Beta -galactosidase
MVTPTVYTYDGKSVCFIGNVHQTRDVTINFRNNEHTIPAGSISILSNCSFEAYNTAKNYGPFFDNIEVGVLGPVQLVAAVGDYDYDDEIVKDLSKKKNGVIKLDSTGIMTCITTMRTALKHGIQMTTFKSPIGDDPVVVDLSGLGKGYAWVNGKSVGRYWSSYLAADVNGCSPKCDYRGAYTSNKCFCQCVHNLLKDGNQINFFN

SEQ ID NO: 162116 - protein, 463 aa, Glycine max
  Coding DNA Sequence Number=SeqID_45338
  Gene Ontology: Mol. function=transferase activity, transferring glycosyl groups; Cellular component=cytoplasm; Biological process =metabolic process
  Homolog annotation: Hit_ID=Q8S9A3; Match level="QueryCoverage=85%, HitCoverage=96%, E-value=1e-114, Identity=55%"; Hit description =Glucosyltransferase-6
  Pfam annotation: Domain name=UDPGT; Domain location=8-463; Score= -28.9; E_value=3.6e-09; Accession=PF00201.9; Description=UDP -glucoronosyl and UDP-glucosyl transferase
MAKTTHIAVFTIPVFTHQASIIELCKRLHLHHHFHITCIFPTINSPILSTTMLLKSLPSTAISHIFLPPVNEQDLPHQDVSPQTKVQLAVSQSMQSFRDTLASLRASSTTPPLAALVVDAFANEALEIAKEFDLASYVYIVTSAMTLSLLLHLPTLHEEVACEYKDCVEGIRIPGCVSIQGRDLPDDFQDRSSFAYELILQRSKRFDLACGFLVNSFCEMEENVVTAFHEDGKVNVPIYLVGPVIQTGPSSESNGNSECLSWLENQMPNSVLYVSFGSVCALTQQQINELALGLELSGKKFLWVFRAPSDVDVKNDDPLKFLPHGFLERTKEQGLVITSWAPQTQILSHTSTGGFVTHCGWNSTVESIVAGVPMITWPLCAEQRMNAALVTEGLRVGLRPKFRENDGIVEKEETAKVVKNLLGDEGKGIRQRIGKLKDAAADALKEHGRSTSALFQFVTQLEN

SEQ ID NO: 162117 - protein, 128 aa, Glycine max
  Coding DNA Sequence Number=SeqID_45339
  Gene Ontology: Mol. function=hydrolase activity, acting on glycosyl bonds; Cellular component=lysosome; Biological process=carbohydrate metabolic process
  Homolog annotation: Hit_ID=P94078; Match level="QueryCoverage=89%, HitCoverage=11%, E-value=3e-29, Identity=67%"; Hit description=Alpha- mannosidase
  Pfam annotation: Domain name=Alpha-mann_mid; Domain location=37-87; Score=16.9; E_value=1.7e-06; Accession=PF09261.1; Description=Alpha mannosidase, middle domain
  Subcellular localization annotation: CTP_CleavageSite=46; ConfidenceScore=5.02e-01
MKQIPVMLIVQMHTGQDTLPVGQLSNAILQGRQCPPLAARQLEFFRGRRNSGPNTDSLADALAIAQHHDAVTGTEKQHVANDYSKQLSIGYKKAEDLVSSSLAWLIESPLLTTCQNTVTKFLKELKSF

SEQ ID NO: 162118 - protein, 216 aa, Glycine max
  Coding DNA Sequence Number=SeqID_45340
  Gene Ontology: Mol. function=DNA binding; Cellular component =nucleosome; Biological process=chromosome organization and biogenesis (sensu Eukaryota)
  Homolog annotation: Hit_ID=Q93YH8; Match level="QueryCoverage=33%, HitCoverage=17%, E-value=9e-21, Identity=73%"; Hit description=HMG I/Y like protein
  Pfam annotation: Domain name=AT_hook; Domain location=128-140; Score =15.7; E_value=0.045; Accession=PF02178.9; Description=AT hook motif
  Pfam annotation: Domain name=Linker_histone; Domain location=30-99; Score=60.2; E_value=7e-15; Accession=PF00538.9; Description=linker histone H1 and H5 family
  Pfam module annotation: Pfam domain module=AT_hook::Linker_histone; Domain location=128-140::30-99
MALKKRRRRVYLPTEPNDHLPPPIPEPPSNHPPYAEMIYTAIEALKEKDGSSKRAIAKYIEQVYTQLPPNHSNLLTQHLTHLKSRGLLQMVKKSYALPRSVPVSVPGPAPTEGTSTVPTVVVAITTTPRPRGRPRKAQNPVQNSPLAQDTVNVQVQQNAEPVWAALGLADEIGKSKLFEYLRLTTVGVIGASNRTPELLKMNPIGKVHFACSRLTT

SEQ ID NO: 162119 - protein, 892 aa, Glycine max
  Coding DNA Sequence Number=SeqID_45341
  Gene Ontology: Mol. function=metal ion binding; Cellular component =integral to membrane; Biological process=SRP-dependent cotranslational protein targeting to membrane
  Homolog annotation: Hit_ID=Q67UM6; Match level="QueryCoverage=85%, HitCoverage=81%, E-value=1e-90, Identity=50%"; Hit description =Putative ring finger protein 10
  Pfam annotation: Domain name=zf-C3HC4; Domain location=231-277; Score= 34.5; E_value=3.7e-07; Accession=PF00097.15; Description=Zinc finger, C3HC4 type (RING finger)
  Subcellular localization annotation: CTP_CleavageSite=17; ConfidenceScore=5.37e-01
MRQRYPRSREDTASTITASSSSSSAPSPNPNPQHGTGNPIPQPFSSLSPSPINLAFGSLQISDTPGSSSSAAQDSGGSSGKVTEVGSPSGVMVSPEQNSRTRSRSHGARWTRTRTGTVSYHRNQQTPGSVSSHGSAPLPGRKAQTVNGNYLLNFQYDPISRSQPRGPPPSPTTRRHRKRKPYSKDLFLQANYKFTVLGSGNYSPESMDPDKMLQWEDIICVTYLTPFSVQCPICLEYPLCPQITSCGHIFCFPCILQYLLMGEEDHKGDSWKRCPLCFVMISAKDLYTVHITNVKQYQVRDNAEFTFLTRKKDSFTLSLKNKQETNITSRANEDICDPFSKFTLTSDVDLSVRHAISDLDGWLARADSGLVDDLEKLPYVCAAMQQLEQRKRYWSELRSHDSEKSSKLNDYEHQIPSTVANSVDSDDENCSNGSRTSSSDFLDQNKVMMLDKSTAGICLDQKLDVEKELIEQEMNLSSSYEEKNDIQRHSSGVVGDVKENDSYSFYQIACAVEVMREISVCPYALLSNGGNGGAMAVLHDGNLKKRYRIAVAWRVYNGGTIAMARGNAAQNAACNQERHPAPCSDPARSSHHAPSSDDPTARTHDLVATSTGTRRRRAPADDPAKAMPHRPCTLTKANVVAQFSVAADGQHLILHPLNMKCLLHHYGSYDMLPHRISGRILQLESVTQSEAIRRRYRFLSHFPLTTTFQLCEVDLSEMLPPEAFSPFMDEIKKRANQRKQLARKEKKEKIMAEATAAYSLPISLSHQFTSRNDPPTFSMDDFEALGNSTISSSPPLAGERKSFSNVTRLGFAAAHDSPSLQIQETSGLHNNNTTADSSVTTGLRNGETQSYSNATSRTESNISSNAPKTNELGKKGKKPNRVLLSTAGGRRY

SEQ ID NO: 162120 - protein, 506 aa, Glycine max
  Coding DNA Sequence Number=SeqID_45342
  Gene Ontology: Mol. function=DNA binding; Biological process=DNA integration
  Homolog annotation: Hit_ID=Q1RSZ9; Match level="QueryCoverage=98%, HitCoverage=82%, E-value=4e-79, Identity=69%"; Hit description =Polynucleotidyl transferase, Ribonuclease H fold
MEDFPNAYVYCQQLKELFDQLKNVGAPVSNNCLVLQMVVDLTKAYNGATVNLAICPTATSLIHQRDSLPPFYQAYFMLTLEEAGLPKKVATSGVVAMGQNHNNSGKKNGGNHGGIKSSGGGGCNGCHNSGWQQQSGQQQSGHQQWPTEQWQWPWMPWALPPCPYPSSNAPPPPYIGLGPIFSKPNSTKQASLGQNHHRHTATVAPPTPTNIEAMMHTFGLNPLDANWYMDIGATSRMTLEQGNLSSYFNLSNTRGLIVANGHSIAIRGYGHTNLSPTNPSSTLKNDFQTRIRLMRCESRGDLYPITTNQATSPSTFSALAPSLWHARGQFLSQQKYATKIIERTDMSSCKPSPTVVDTKPKLSANSSTPYVDPSHYRSLAGAIQYVTFTRPDIAYVAQHMCLFMHDPREEHMHAFKHIVHYIQGTLDHGLHLYPSSTSIFLSYSCADWGGCSDTRRSTSGYCVFLSDNLISWFTKQQTTLSRSSAEAEYRGSANVVSESCWYETFF

SEQ ID NO: 162121 - protein, 160 aa, Glycine max
  Coding DNA Sequence Number=SeqID_45343
MVRTRGLGRALGRVSGRGLGKEDRDDSDDAPQRRRPTAFACRQRVLITVADAEPVVPAAKADVAVTEADVVADEPMVEVDVHDTGANTAAYTGAQATVDEPKGFLGGLTDPSVLTKYVEHVAASVWTGEESPKLKLSSHGRKVHNLGRHIPAIEGLVART

SEQ ID NO: 162122 - protein, 92 aa, Glycine max
  Coding DNA Sequence Number=SeqID_45344
MTIDPHAKVELGYMSLVFLNCEERNIENQIYLCENEENKNFGRIRPDGVVIRSQWDVRVSYTFVEFEENAEKENQNLKMLKKLPKIKVLSWG

SEQ ID NO: 162123 - protein, 155 aa, Glycine max
  Coding DNA Sequence Number=SeqID_45345
  Homolog annotation: Hit_ID=Q6AVG1; Match level="QueryCoverage=39%, HitCoverage=14%, E-value=9e-07, Identity=42%"; Hit description =Expressed protein
MKRKVVQHKWKKKLFALILVVFCLGSLLFMQTRYHHVAGLVSLQHRFVSEPEVQGPKVAFLFIARNRLPLEMVWDAFFRGGDRKFSIFVHCRPGFLLNKATTRSPYFLNRQVNDSVQVALLSLFSTESVYVYYPLPRDLSVVFILHIDKLLHAYT

SEQ ID NO: 162124 - protein, 164 aa, Glycine max
  Coding DNA Sequence Number=SeqID_45346
  Gene Ontology: Mol. function=ribonuclease H activity
  Homolog annotation: Hit_ID=Q1RYI2; Match level="QueryCoverage=63%, HitCoverage=15%, E-value=1e-13, Identity=35%"; Hit description =Ribonuclease H
MLPLVNTIKPGSNFWRGLFSTWDIFCRNIIWRVGNGRDVKFWRHNWVPECGLLMDKASGSVPEEELNDTIVSFCNDAGEWRGDRIASFLPQPIAREVVGRVTPLPGVRHLMEAIYAAFVSSTRNLYFTRLRIVLVRDLFGNFSSRLVVLDQTGSSSRSMYKDKG

SEQ ID NO: 162125 - protein, 146 aa, Glycine max
  Coding DNA Sequence Number=SeqID_45347
  Gene Ontology: Mol. function=RNA-directed DNA polymerase activity; Biological process=RNA-dependent DNA replication
MVVLPWGTNASFIALIAKVDDPQSLGDFRPISLVRFMYKIVAKLLTKRLKKVLPGEGEEEMFGVLGKDVVTDLRRTPNAAEIFQTDVFQCPQKVEEVNQPFLTLIPKKDESKWGQYCSCPGGVPLDEEQRGEKRMDGYQAGLGKGL

SEQ ID NO: 162126 - protein, 115 aa, Glycine max
  Coding DNA Sequence Number=SeqID_45348
  Gene Ontology: Mol. function=DNA binding; Biological process=DNA integration
  Homolog annotation: Hit_ID=Q1S326; Match level="QueryCoverage=93%, HitCoverage=76%, E-value=1e-14, Identity=54%"; Hit description =Putative receptor kinase-related
MTDEMSALESNNTWELVSLPPGKSVIGCRWVLIVNTKVGPNVPVKIRRTSRLSNNIYFSTSKLIVRILRYIKGSPRKGLVYTDRGHSNIIGYSDEDSAGDAGDRQSTSSNCIFVG

SEQ ID NO: 162127 - protein, 446 aa, Glycine max
  Coding DNA Sequence Number=SeqID_45349
  Gene Ontology: Mol. function=hydroxymethylbilane synthase activity; Cellular component=GPI-anchor transamidase complex; Biological process=tetrapyrrole biosynthetic process
  Homolog annotation: Hit_ID=Q8GUL0; Match level="QueryCoverage=94%, HitCoverage=58%, E-value=1e-139, Identity=59%"; Hit description =GPAA1-like protein
MTREKIINRMGIVGRAKRREDMGASENNSAKPRVRPIVRLGIFLISHSNIVSVVCFIAGVVALLLLPILAKNTYISENALMPGSANNMLSTHHVSDANKFIKDLTDLEFRSGASPIESQKLIAHYMSALDAEVTFHKFYPQFNQFHPLHFFTSPNSGIISENATCSSFGINTVGIIRAPRGDGKEAIVLVTPYNPNKVGLGEALSLGIAYSVFSLLSRVTWLAKDIVWLVADSQYGEYSGVAAWLREYHAPAFRRVDIVNSETCNESSTFNQLGQGLYWDGKLYGGFRRAGTMAAALVIKVAEQGNQYEDSLNIYAEASNGQMPNLDLINIVNYLAVHKQGLRIKVNKMWSLLGSRWLNTLGVIFESLGKFARSLNPQWKFGIPATEYVEGAATLASSLYYQGLGVPTGPHGAFRDYQVDAITLEISPKVSLTKMIRRNEFILHSG

SEQ ID NO: 162128 - protein, 77 aa, Glycine max
  Coding DNA Sequence Number=SeqID_45350
  Homolog annotation: Hit_ID=Q9FI62; Match level="QueryCoverage=98%, HitCoverage=3%, E-value=2e-11, Identity=48%"; Hit description =Nuclear pore protein-like
MVNMALLLSFLVTATVLASSSHAASSGPHIADVNILLPPKMTFPVDYRLQGSDGCFQWSSSTFYHHTSHLLAPNFYS

SEQ ID NO: 162129 - protein, 67 aa, Glycine max
  Coding DNA Sequence Number=SeqID_45351
MVKECNSSRKIEGGGTTLGLELMCCVSNFWFLSKKAFRCSTIRISLKLMVIVVEAAARIFQVSFEKP

SEQ ID NO: 162130 - protein, 735 aa, Glycine max
  Coding DNA Sequence Number=SeqID_45352
  Gene Ontology: Mol. function=protein binding; Cellular component =integral to membrane; Biological process=protein transport
  Homolog annotation: Hit_ID=Q9FI62; Match level="QueryCoverage=99%, HitCoverage=35%, E-value=0.0, Identity=59%"; Hit description=Nuclear pore protein-like
SWDHHDILSVEPEYNSSSKCSTSARIRSIAPYSGRKETAVYAADLQTGIVIRCKVFIDNISRIQIFHNSIKLDLEGLATLRVRAFDSEENVFSSLVGLQFMWSLMPEANGLPCHLVNVPLKDSPLSDCGGLCGNLDIQIKLEDNGVFSDLFVVKGIEIGHEIVSVHLLEPQLKNLADEIVLTVAEAMSLDPPSPVFVLVGAVIPYTLKVIRGNVPQVVTLPSAHHQWSVSNASVAQVDSKTGLAYAWNLGMAAVIVEDTRIAGHVQVSSLNVVLPASLCLYISPLSSSGDPVEGIKSIALTTRWYVVSGHQYLIQIKVFAHDHDAQEIYITENDDVKVYDNDSGHWKTFWVSNDIAVKHGWRNSKILKAYSPGLEKLTASLSYPGGADDKKEIIKAVQEVMVCDRVKYTLGNESGIILLPWSPGVYQEVELKAIGGCAKTVSDYKWLSSDLSTVSVSAFGVVQAKKPGKATIKVLSVYDSLNYDEPKSVPMLYAVVFDCKNVVLSGVVMWYVLSLSILAGDVLVEVSIPSSMVMLHNFPVETVVGSHLQAAVTMKAANGAFFYRCDAFNSLIKWKAGSESFVIVNATQELLYLETVPNTQFQSSVDGSPCSWTYVYASNPGQAVIHAIFSKEDHHYSLGPGVLKASSRIVAYLPLIVRQAGDGNQFGGYWLDLVQAESNKQSHSLEELYLVPGTSLDIVLVGGPEWWDNGVDFIETVEVLDEGNALAEDGVLVHR

SEQ ID NO: 162131 - protein, 528 aa, Glycine max
  Coding DNA Sequence Number=SeqID_45353
  Gene Ontology: Mol. function=RNA-directed DNA polymerase activity; Cellular component=nucleus; Biological process=RNA-dependent DNA replication
  Homolog annotation: Hit_ID=Q1SLB1; Match level="QueryCoverage=45%, HitCoverage=46%, E-value=1e-45, Identity=35%"; Hit description=RNA -directed DNA polymerase
  Pfam annotation: Domain name=RRM_1; Domain location=20-90; Score =33.9; E_value=5.7e-07; Accession=PF00076.12; Description=RNA recognition motif. (a.k.a. RRM, R
  Pfam module annotation: Pfam domain module=RRM_1::RVT_1; Domain location=20-90::218-429
MDNDKSTIELIGEARKTTSFYFTQFPKDATEQELWHHFKKFGDVQEVFISRQRNKMGRRYGFARFKGVEDKHSLEKKLDNIIFGGLKMYVNIPKYGRVRAEQTIPEAKRVEGNEQKEMEAPSRRHSLPRMNQGSYAEVVARNNRRSVPRGILGSQNHSREGSWSSVYLDIPTTGNKWFNDAWVGRLKSGHVRQNLTDDRAQQMMEEEIEGGASPFHSLEKWNPTQLIQCETVLRTGIMQCELYALQAYIPFIIDETQSEFIEGRHLLHSVLIANEVIEKAKRNNKSSKWVKWIEECLKSASVSVLVNGSLSAEFLPQKSLRQGDPLAPFLFNVVAEGLNGLIRRAKEENLYKGFQVGINNVNISILQYADDTIFFRETIMENVTAIKTILRTFELASGLKINVAKSCFGVFGQSQQWKQQGAKYLNCRLLALPLVYLGIPIGANPRRGQMVPKSVADKLVRLQRRFLWGGGPDQNKIAWVRWNLMQHKGELWARVVESKYEGWRGAAYSKWPEVEAASGHPTDGKPQG

SEQ ID NO: 162132 - protein, 742 aa, Glycine max
  Coding DNA Sequence Number=SeqID_45354
  Homolog annotation: Hit_ID=Q9FI62; Match level="QueryCoverage=93%, HitCoverage=32%, E-value=1e-152, Identity=49%"; Hit description =Nuclear pore protein-like
MESKCTKGSNIEEKIGSDTILEGSLGPNSTPKASSWGETIIASVFANGNTVICEARSFLRVGVPSTVTLHVQSEQLGIGRKLPIYPLFPEGTLSSFYELCKNYQWSIEDEKTTEMEYCKLHKTCAASNGTANYQLSDYLPCIYHQAVTIVFLISTIINRVYHNTQLYPHISTLTKPATKVLSFKVAETLHEDSIQLTASAGSQVNSYFDDNDLGFINVLYGRSAGKTNVAVSFSCELSTSGSRTQSRFYSSSLSVTVIPDLPLALGVPITWILPPYYTMTSPLPSSSESHSQNDSRNRRGTISYSLLRSLEKNEALQKDAIFIDADRIKTTKSNNLACIQAKDRTTGRTEIASCVKVAEVTQIRIASKEVLLNIINLAVGAELDLPTSFYDALGNPFHEAYNAVPFYAETNYPDVLCVNKTADGKGNVHIKAIQHGKALVRVAISEDLQKSDYVLIRVGAHIYPQNPVLHIGSPLNLSIKGLSDTISGQWFTTNGSVISVDTLSGMAKAIGEGSAQVSFHYGRLRLQTTITVLKGNYIFVNAPKETLTNVPYPSKGYNFSVKFSESLGAPGEKKRILFNCRVDPLFVGYVKPWLDQDSGNSYCLFFPYSPEHLVHSVPKLEGMRPDVSLSISASLEHEHVSGSASALFIGGFSIMEMSKNSMQLNLTPGSNKTCITVLGNTDVEIHWHHRDLIMISLIHKEDFGIRGFARYEVKLLKAKRFKDRIIITLPANGYIFLKLNMT

SEQ ID NO: 162133 - protein, 97 aa, Glycine max
  Coding DNA Sequence Number=SeqID_45355
  Homolog annotation: Hit_ID=Q9FI62; Match level="QueryCoverage=92%, HitCoverage=4%, E-value=7e-25, Identity=64%"; Hit description =Nuclear pore protein-like
NERRIIKAAAQAERSSGRLRDTPVIVANGRSIRVSAVGISDSGEAYANSSSLSLRWELGSCEGLAYWDYAFDIVKSNSWERFLVLQNESGLVLKDSY

SEQ ID NO: 162134 - protein, 80 aa, Glycine max
  Coding DNA Sequence Number=SeqID_45356
MHDQQLRTFTLTHLHQVQDPSNEHPHETLKRKHRKQCPEVQIQSYTMLTSLRSPLLGGSTCSEKLLVVIFPLQNLVSSSN

SEQ ID NO: 162135 - protein, 329 aa, Glycine max
  Coding DNA Sequence Number=SeqID_45357
  Gene Ontology: Mol. function=D-erythro-sphingosine kinase activity; Biological process=protein kinase C activation
  Homolog annotation: Hit_ID=O82359; Match level="QueryCoverage=85%, HitCoverage=75%, E-value=5e-92, Identity=62%"; Hit description =Expressed protein
  Pfam annotation: Domain name=DAGK_cat; Domain location=37-189; Score =35.7; E_value=1.6e-07; Accession=PF00781.14; Description =Diacylglycerol kinase catalytic domain
MALGRVIYVAHTVCIRSELQPMAPDRIGSSSSSRQRDLVFVVNPLARKAELLVISLGIKFNFWKYWTIIGTQINCKKLEFQVLMGGQICESITSGPCHAIDITREAIREGADAVIAVGGDGTLHEVVNGFFWAGKPVVSQVKESTHSTALGLIPLGTGSDFARTFGWSSLGLRSMIDVGVITGESCDHHYFINVADIHLSAKAGFYASRYKRFGNLCYVIGALQAFIGHQNQDMRIRFNDGPWETCPQVTALCIGNAKYFGGGMKITPNADPFSRNLEVVTLQNFKWYDFVLKLHKLYSGTHLSVKNVSDRRYNLFQRSQSTILNFTFH

SEQ ID NO: 162136 - protein, 284 aa, Glycine max
  Coding DNA Sequence Number=SeqID_45358
  Gene Ontology: Mol. function=aminopeptidase activity; Biological process=proteolysis
  Homolog annotation: Hit_ID=Q9M314; Match level="QueryCoverage=99%, HitCoverage=55%, E-value=1e-109, Identity=66%"; Hit description =Prolyl aminopeptidase-like protein
KQVLITGGILQIGGGCTADSVYKAGFEQAIVQNEKYYKRFPQDIKIVQELVNYLAEQEGGGVALPSGGFLTPRGLQTLGLSGLGSRAGFESMHYLFESVWDPTFVPGAPKRISYNFLSSFEKWLNFDTNPLYALLHESIYCQGSANKWSANSVRTAVGDKFDAIRAAREGLPVLFTGEMIFPWMFDEIHALKPFKDAAHILAEKKDWPPLYDVQVLNNNKVPVAAAVYYEDLYVNFKLAMETASQIAGIRPWITNEFMHSGLRDDGSKVIDHLLGMLNGRKPLF

SEQ ID NO: 162137 - protein, 130 aa, Glycine max
  Coding DNA Sequence Number=SeqID_45359
  Subcellular localization annotation: CTP_CleavageSite=50; ConfidenceScore=5.06e-01
MAKEPIEARRLTSSSAPFVVLTCEVSFRQPGANESVDARRLTSSSAPFVVLTREVSKVTCGVTLWLSAPFVIQGKTSPLTRANEPVDARRLTSSSAPFVVLTLEVWANEPVDARRLTSSSAPFVVLTREV

SEQ ID NO: 162138 - protein, 163 aa, Glycine max
  Coding DNA Sequence Number=SeqID_45360
  Gene Ontology: Mol. function=aminopeptidase activity; Biological process=proteolysis
  Homolog annotation: Hit_ID=Q9M314; Match level="QueryCoverage=87%, HitCoverage=28%, E-value=3e-35, Identity=55%"; Hit description =Prolyl aminopeptidase-like protein
MRAHVIGNEIVFLSRKRDKTYYYVNGMMCLGREQERKLTWIYLDNQESFTWNCCWERRAKLAILIIFARWTWRGTGLSTPLTVSSMSQFKSADELADFLKYFRADNIVNDAEFIRVRLVPDAGPWTILGQSYGGFCAVTYLSFAPKGLKQVLITGGFLRLEVD

SEQ ID NO: 162139 - protein, 248 aa, Glycine max
  Coding DNA Sequence Number=SeqID_45361
  Gene Ontology: Mol. function=nucleic acid binding; Cellular component= ribonucleoprotein complex; Biological process=mRNA catabolic process, nonsense-mediated decay
  Homolog annotation: Hit_ID=Q9FM47; Match level="QueryCoverage=70%, HitCoverage=39%, E-value=2e-66, Identity=60%"; Hit description =Similarity to RNA binding protein
  Pfam annotation: Domain name=RRM_1; Domain location=152-229; Score =58.8; E_value=1.7e-14; Accession=PF00076.12; Description=RNA recognition motif. (a.k.a. RRM, R
  Pfam annotation: Domain name=RRM_1; Domain location=64-133; Score =76.2; E_value=1e-19; Accession=PF00076.12; Description=RNA recognition motif. (a.k.a. RRM, R
  Pfam module annotation: Pfam domain module=RRM_1::RRM_1; Domain location=152-229::64-133
MESPGNEHVVGGAEHNDVVTPFSHREEPHNSQPLTGDGASPGLDDNNVLRFGSNCTRPIICRKIFIGGLARETTIAQFIKHFGKYGEITDSVIMKDRKTGQPRGFGFITYADPSVVDKVIEDPHIINGKQVEIKRTIPRGAVGSKDFRTKKIFVGGIPSNVTEERCTCADEFRDFFTRYGEVKDHQIMRDHSTNRSRGFGFITFDSEEAVDDLLSMGNKIDFAGSQVRNLLFKMSTCIALFYLEDIGY

SEQ ID NO: 162140 - protein, 50 aa, Glycine max
  Coding DNA Sequence Number=SeqID_45362
MKRANPSPNKTRDRLGLSAIAPSASGFFTILELDAESPDIDLANMMFSRY

SEQ ID NO: 162141 - protein, 184 aa, Glycine max
  Coding DNA Sequence Number=SeqID_45363
  Gene Ontology: Mol. function=3-methyl-2-oxobutanoate hydroxymethyltran sferase activity; Cellular component=mitochondrion; Biological process=pantothenate biosynthetic process
  Homolog annotation: Hit_ID=O82357; Match level="QueryCoverage=83%, HitCoverage=43%, E-value=5e-55, Identity=73%"; Hit description=3 -methyl-2-oxobutanoate hydroxy-methyl-transferase
  Pfam annotation: Domain name=Pantoate_transf; Domain location=1-178; Score=22.2; E_value=3.1e-17; Accession=PF02548.6; Description =Ketopantoate hydroxymethyltransferase
MLAHCRAVARGAKRPLLVGDLPFGTYESNSSKAVDTVVRMLKEGNMDAIKLEGGSISRVVAAKAIVEAGIAVMGRVGLTPQAISVLGAFRPQGRTVASAIKNKSMKVVEMALALQEAGCFSVVVECVPAPVAAAATAALQIPTIGIGADPFCSGQAASAAFEAVQTMDTSKSNGEGQQRTKTTF

SEQ ID NO: 162142 - protein, 341 aa, Glycine max
  Coding DNA Sequence Number=SeqID_45364
  Gene Ontology: Mol. function=binding; Cellular component=ubiquitin ligase complex; Biological process=intracellular signaling cascade
  Homolog annotation: Hit_ID=Q9ASI0; Match level="QueryCoverage=82%, HitCoverage=75%, E-value=8e-33, Identity=35%"; Hit description =Putative arm repeat-containing protein
  Pfam annotation: Domain name=Arm; Domain location=124-165; Score =20.3; E_value=0.0071; Accession=PF00514.13; Description =Armadillobeta-catenin-like repeat
  Pfam annotation: Domain name=Arm; Domain location=166-208; Score=7.9; E_value=1.3; Accession=PF00514.13; Description=Armadillobeta-catenin -like repeat
  Pfam annotation: Domain name=Arm; Domain location=211-251; Score=2.3; E_value=6.2; Accession=PF00514.13; Description=Armadillobeta-catenin -like repeat
  Pfam annotation: Domain name=Arm; Domain location=28-68; Score=29.0; E_value=1.6e-05; Accession=PF00514.13; Description=Armadillobeta -catenin-like repeat
  Pfam annotation: Domain name=Arm; Domain location=82-123; Score=20.8; E_value=0.0049; Accession=PF00514.13; Description=Armadillobeta -catenin-like repeat
  Pfam module annotation: Pfam domain module=Arm::Arm::Arm::Arm::Arm; Domain location=124-165::166-208::211-251::28-68::82-123
MEKEVVENLWNGDRDSQIQAALELGRLSRKQRHKLEESGVMVPLVSMLHSQDYEAIEAALCALLSLSFGSESGTKEYVLGNKKRNKIRIIKSGALPVLVSLLYCHSQTVIIQLTLAAMLTLSSCKANKVAIASSGAIQLLAEFVNSNCSTQSQLDAIATLHNLTTCKEIMPLIVSSGVMFSLLELIHSTVKSSPLVEKAIELLENIVSSSESALCKAAGAGGAIGILVETIEDGSLLSKEHAVSILLLICQSCREKYRGLILTEGVMPGLLQLSVDGTWRAKSIAQELLLLLRDCSNYGSRCKQINHELIERIMEEIEAEGEKLADTTLRLVEEMIAKLNA

SEQ ID NO: 162143 - protein, 270 aa, Glycine max
  Coding DNA Sequence Number=SeqID_45365
  Subcellular localization annotation: CTP_CleavageSite=33; ConfidenceScore=5.13e-01
MASFSQMQSQMQSQGLARPAEPLVGPSGPRVVVSSTKPPPKPDPEVDDPVTWDATVFGVFNPDFLVYIKHEDLSEIAHGGQCLSISVLQLWILHLTETCMRARNSDIYGFLEPQSIQRSGQSQFESESYIKTWMQSSKCDVYLGAYLNGGHWQMVVILPKEQLVVWFCSLHNRPDNYLQGIINSALKGLDDAPQPKSKAPTRWIVVKCNRQKGSTECGYYVMHWMSTIILGTFRNNWKAYFNDPRPLEPERLKALRIQWAQYYLRVRDKT

SEQ ID NO: 162144 - protein, 79 aa, Glycine max
  Coding DNA Sequence Number=SeqID_45366
MGWQLPNKMVYGVRPSVDEYEKLIQFLCLKALDWEMVENLQEEMKGSGLHLKGMMTGLIRVVKEMEKEVVEVESITAVA

SEQ ID NO: 162145 - protein, 729 aa, Glycine max
  Coding DNA Sequence Number=SeqID_45367
  Gene Ontology: Mol. function=RNA-directed DNA polymerase activity; Cellular component=chromatin; Biological process=chromatin assembly or disassembly
  Pfam annotation: Domain name=Chromo; Domain location=655-703; Score =16.1; E_value=0.012; Accession=PF00385.14; Description='chromo' (CHRromatin Organisation MOdifier
  Pfam annotation: Domain name=rve; Domain location=412-573; Score =39.2; E_value=1.4e-08; Accession=PF00665.16; Description=Integrase core domain
  Pfam module annotation: Pfam domain module=Chromo::rve; Domain location=655-703::412-573
MPSRAMQPQRYSAYWARFHASFYTQTTTPLRVTVGNGDELQCHQLCKDVPSLGPILTDYNTLTMQFRYEDRVVELTPVTPRLLRRMTQSGTASTFFHLRIEPPSTQKTSSPNSPHHQSPAISSLIAQFHNLFQPPMTLPPARTTNHSITLIPNASSMNGLLQPSTSAFSSPVLLVKKRDGSWQFCVDYRALNAITVKDHFLIPIVDELLDELDDAKFIKGYATIAAPLMHLLTQEQFRWPLEADLAFQILKDVVSTTPVLALPNFAIPFVVETNASRVGHRFIVLTDHRSLKELMAQVIQTPEQQLYLSRLLGYDYTIQYRASKSNVVEDALSRVYEPPTGTLLLLSTPHFAFLEELKKELIANSDFLVLRQVIQFIPDSHLNYSITQDFIMKNGRSWLPNGLPFIQTLLSEFHQSPTRGHMGVCKTLARLNDNFTWANIHQDVRKFIPSWYHLGMLPIHHNAHLVALLFLDIVGKLHGMPRNIVSDKDPLFISRFWRELFSVSGTKLRMSSTYHPQSDGYTEVANRIVEQYLRAFVHNRPTSWGRLLMWAEWSYNTSSHSGSVFASLRKKLLKAHNCMKKVADGHRRDKEFQIGDWVMEEDRIGKVAYKLQLPEHSRIHPVFHCSILKPFHQSSLMIPEAVALPMSAVDNKPEVRPLVFLATRWDSTSYESKQQVLVQWTGLAPKDTSWEDWFDLKATYHLEDKVLSDAHGNVKKKTKEVQVGKNGPE

SEQ ID NO: 162146 - protein, 553 aa, Glycine max
  Coding DNA Sequence Number=SeqID_45368
MSDLVSTTDDLNPYADQLHPYKLHYTSKNGSRTTQEKGQLAYLDGGAPQCTSCQKRKTTTITPPIMLTENGRRRGTHMTKKQLAKEEEAARGRRRLSSRKKENGRRRKAWCTKLFKKYARNNSLCTVPSATAPNGIMEDSFRVRAERAFGSLPIPASSSLNSLWSLTEDEIQNTPSNRTPKPKPKPKTKPQSQSYSFSSSRVQLEKDLNDFDDDEEEEPRGPSKPPDYDDEQWQIKAGIGRDCTLDYEEEEDQYDKQAIGKENLGDRLYMKDINDDGVEISSCNVFPTSFRDLVRDPRANHLAARIRLKQDDEAAAKKIDALHVSEKSAPDIGSGGDAVNPKSILRSKDNPSEPRPQKRVRFDSECDDRGNDDVDGHEGTRDVRMKTSSMEEDTASDQLSKSQEFDSAVPDYIRNPSRYTRYTFDDSPSDMDDKSNKESCMSFLSQLKGSNAAKGTGSQADEALEDLPSVTFISKKKSGDANMCDSETVPKPKLDAGMEAMNRRAFPVGIAAGDSENSDACAMEEDEPEVEVVKKSLQKLNRQYRKKAQEEPV

SEQ ID NO: 162147 - protein, 148 aa, Glycine max
  Coding DNA Sequence Number=SeqID_45369
MGGGLLGRSDGGVETNDEELVVKRGDRGPMVEENRDRGGPENDNGAQSGPRRKTVQNRLRGRGEKETTRIVGHSETSIGAMPTLDHPWSGSGRSRERLDGLQSFQAKDKVVDLGGHVDLRVGMKVDNASSWAYLLKLLLAHSFPLAAP

SEQ ID NO: 162148 - protein, 328 aa, Glycine max
  Coding DNA Sequence Number=SeqID_45370
MGDMVDMDDDAEDRRRLDRARVLVKTPWTPTIRHTVEVHIGDEHFKVFIVEECGGDTHACRRGRRSFCESSEEIDSDESYSGSSTPRSSLGMVDAGLVAEVPATSKPLSIVDPPNNADEDRQTKFLPTGFSDHHYTPGKASISRVQGSRCQATSCDQTPSAVPQPTVTCHRDTQSKCGKQKDIGSATPAEMTELNHAKGKSVLEESCEESTSLGAMGRDICNKAELGDVAETHPTKRHQYKVKIQTYSVKHNAFNRQPTFGAWLNTLGLQELPMNIISYNVRGLGRGVKWAAIRRLVKMENVDMICLQETKKEVIEKAMCQTLWGDAE

SEQ ID NO: 162149 - protein, 157 aa, Glycine max
  Coding DNA Sequence Number=SeqID_45371
  Gene Ontology: Mol. function=nucleic acid binding; Biological process= DNA integration
  Homolog annotation: Hit_ID=Q1S7C5; Match level="QueryCoverage=84%, HitCoverage=15%, E-value=2e-14, Identity=31%"; Hit description =Integrase, catalytic region
MYYRAFLDPITPIKFGIKFTSTLAFIGNPVCDSFALQCVVGIPIRHEEYVDALFEGLPSDYAPLISIIESKMCTPSITEIEALFYGHETRLTRYNRDAQEISSTSLNYTQGYSHPNAHKTGDSGVPKGSYGRDGGHGAFSDRGARRSGGGFGKGCSI

SEQ ID NO: 162150 - protein, 250 aa, Glycine max
  Coding DNA Sequence Number=SeqID_45372
MVLQSLDDVVHQHLMVSTRADKSPGSKIVVANGGNGAKAEKKRRESEDSIMPLPRRSSARIQALQKAEELFARKRVEGVEEKDNCDDNLTPEKVKVKKRNRKSSGSEESVVVEVEFVSPAKKKRVAYRKCKVVGEMNGNGKGEELSGNGKVRKVNAKEELENAGGGLGEKSDLLKVKETIRLFTKHYLQLVQEEEKRCGKAEAERKVAKKASKKASKLKVRRIFLQFSSCILVQSIDKCTVENSPPGIQI

SEQ ID NO: 162151 - protein, 51 aa, Glycine max
  Coding DNA Sequence Number=SeqID_45373
MENNNQSNMKDFREIERFGDGKDNEERDCGREEEKGFCFGGMGNNSFTLGE

SEQ ID NO: 162152 - protein, 41 aa, Glycine max
  Coding DNA Sequence Number=SeqID_45374
MGANGYIIEVNDGTRMRLALDLALKPHNLNRKRLIERSLEH

SEQ ID NO: 162153 - protein, 82 aa, Glycine max
  Coding DNA Sequence Number=SeqID_45375
  Gene Ontology: Mol. function=drug transporter activity; Cellular component=membrane; Biological process=multidrug transport
  Homolog annotation: Hit_ID=Q1SD91; Match level="QueryCoverage=92%, HitCoverage=15%, E-value=8e-23, Identity=61%"; Hit description=Multi antimicrobial extrusion protein MatE
MGCYYAIGIPVGIVLGNVLDLQVKGIWIGMLFGTLIQTIVLIVITYKTNWDEQVTIAQKRISRWSKVDNADQENEAQRKYVS

SEQ ID NO: 162154 - protein, 98 aa, Glycine max
  Coding DNA Sequence Number=SeqID_45376
MSTWEDLNDSLFDEGSEEEANLYLMVDTSTRKAKPALYASSDDEDSQPNDLSTLMVKKGREVLKVLPPEIEKLYKEIKTLRDNQGKFIGGHEVLNNII

SEQ ID NO: 162155 - protein, 92 aa, Glycine max
  Coding DNA Sequence Number=SeqID_45377
  Gene Ontology: Mol. function=RNA-directed DNA polymerase activity; Biological process=RNA-dependent DNA replication
MMSAKSGLGNIHRGHVDLMKPLCKIQLRKPSGMAQVIQKLINGGRGKWSLTGKAWLVVGKEVRKFPMEVEALVVGVQTKQHRWYKVEDGRRQ

SEQ ID NO: 162156 - protein, 45 aa, Glycine max
  Coding DNA Sequence Number=SeqID_45378
MASLHFNKRKFLESGLRGLEGLKAWTRAKAVVLEPRGRSKAINLK

SEQ ID NO: 162157 - protein, 72 aa, Glycine max
  Coding DNA Sequence Number=SeqID_45379
MKAPKLLGTKNRTPRVRGLGNLPSIKVTIFLGPFQVKAQGDHPSCLRVGPRATLDFRSTSAMTLGIDNDYDD

SEQ ID NO: 162158 - protein, 68 aa, Glycine max
  Coding DNA Sequence Number=SeqID_45380
MMLFAKTTIVVLGDLANTLGSNTGPLIQQKAETILTQTDFVHKEFMPLQEEGGQDDDIVQSKYDSDED

SEQ ID NO: 162159 - protein, 182 aa, Glycine max
  Coding DNA Sequence Number=SeqID_45381
RKREKQNNPGIGRARDDESSNRHAGANFRRNMAIKDSESEGMLSDVENAMWESEDEEQENNDSGHLRKFSGNYRSSSSDDEYAHQTMSNKKSGVRDHESKVGGSAQYHDSFDAPNSVRGMHAVNKIDSESVDEFSSSENWLWPSDAEETGDYPTNQNSNNVIKSDIPKTKRRTPKETDEAWD

SEQ ID NO: 162160 - protein, 339 aa, Glycine max
  Coding DNA Sequence Number=SeqID_45382
  Homolog annotation: Hit_ID=Q6AUH9; Match level="QueryCoverage=81%, HitCoverage=42%, E-value=1e-77, Identity=57%"; Hit description =Unknow protein
  Pfam annotation: Domain name=CRS1_YhbY; Domain location=70-154; Score= 114.2; E_value=3.8e-31; Accession=PF01985.11; Description=CRS1  YhbY domain
MFYLQVSHPSAATLLKLKRHTIELVGACAARWKGECRKSLAKKKVALLLQKLKKYELPELPPPRHDPELLTPEQLQAYKKIGFRNKNYVPVGVRGVFGGVVQNMHLHWKFHETVQVCCDNFPKEKIKEMASMLARLSGGIVINVHNVKTIIMFRGRNYRQPKNLIPINTLTKRKLLLGLTAQICCLFFFPLKIHHFCPWLCTYYTKNLVLEEALFKARFEQALESQKLNIKKIEQQLRRMGVNPEDPAAMASIQRVASTFFNAIDQKEGSPYVFREGKQSIIEPAEGFEESEPTADSDQEELDRFIAEIEDAADKEYEAEEAKEKEEFGRIRYWNKEEF

SEQ ID NO: 162161 - protein, 483 aa, Glycine max
  Coding DNA Sequence Number=SeqID_45383
  Gene Ontology: Mol. function=DNA binding; Biological process =regulation of transcription
  Homolog annotation: Hit_ID=Q6ZI65; Match level="QueryCoverage=79%, HitCoverage=98%, E-value=8e-83, Identity=44%"; Hit description=No apical meristem (NAM)-like protein
  Pfam annotation: Domain name=NAM; Domain location=148-291; Score =89.3; E_value=1.2e-23; Accession=PF02365.6; Description=No apical meristem (NAM) protein
MTFCRFWTWVLHEFTNDNVRGTEFRVLLLRHSIASLRRSNLNEISSIIYVMAWEASSHGGGNKVIYHSGSVSLDFRGHKTATYEAKVRNFQSTVGGSWLIDIGGFARKVKNTNLSTDDQIKDCGTYLECQKCHYHIDNNDVSHEWPGFPVGVKFDPSDVELLEHLAAKCCIGDREPHMFIHEFIPTLEGELGICYTHPQNLPGAKTDGSSVHFFHKTVNAYATGPRKRRKIHHQDGMTEEHVRWHKTGRTKAVIEDGVHKGFKKIMVLYIRSKKGSKPYKTNWVMHQYHLGSEEDEKDDEYVVSKIFYQRQKQSEKNEENTVVEDSNIAAQAGPRTPKPNPPTRPCTGKCDDNFDENELLSFIQDAKPIPGESHAPPYDVQDEDNKDDPAWLAGESQADFDGLEDILLCKDMLDSSSLLNHSGLSSTYNANANKLVAPGTDNDYASYGVSVLDTLEFDTPPDFDLSNLQFGSQDSTLQWIDTP

SEQ ID NO: 162162 - protein, 391 aa, Glycine max
  Coding DNA Sequence Number=SeqID_45384
  Gene Ontology: Mol. function=phosphotransferase activity, alcohol group as acceptor; Cellular component=cytoplasm; Biological process =metabolic process
  Homolog annotation: Hit_ID=Q2R8T7; Match level="QueryCoverage=94%, HitCoverage=96%, E-value=1e-133, Identity=63%"; Hit description=GHMP kinases putative ATP-binding protein, expressed
  Pfam annotation: Domain name=GHMP_kinases_N; Domain location=110-179; Score=44.6; E_value=3.3e-10; Accession=PF00288.16; Description=GHMP kinases N terminal domain
MGIDSEYVISHKAYARVGLLGNPSDVYYGKTIALSVANFFATVTLRPSDQLILQPHPLHDLLHFSSLPQLVNRLSSQGYYGGVRLLMAICNVFYAYCRENAIDLGDDNFTLSYDTNIPRQAGLSGSSGIVCAALNCLLDFYNVRHLVKVEVRPNLILAAEKELGIVAGLQDRVAQVYGGLVYMDFSKENMNELGHGVYVPVDLSLLPPLYLIYAENPSDSGKVHSKVRQRWLDGDEFIVSSMLEIANIAQEGKTALEEKDYSKFAALMNRNFDLRRWVSHYPQQISRLGVCSPNSRWKGIMGPSTNIRAKLMFGDDALGDLNLKMVEVARKVGAASKFTGSGGAVVAFCPEGTSQVKLLEDECQKEGFVILPIEPLPSRLNEIDLKTLQIK

SEQ ID NO: 162163 - protein, 53 aa, Glycine max
  Coding DNA Sequence Number=SeqID_45385
  Gene Ontology: Mol. function=protein serine/threonine kinase activity; Biological process=protein amino acid phosphorylation
  Homolog annotation: Hit_ID=Q7XJ65; Match level="QueryCoverage=79%, HitCoverage=12%, E-value=7e-14, Identity=76%"; Hit description =Protein kinase
MGSGNEVHSVGDFNLDSKWLVDPKQLFIGPKIGEGAHAKVYEGNTIVLLLSMS

SEQ ID NO: 162164 - protein, 398 aa, Glycine max
  Coding DNA Sequence Number=SeqID_45386
  Gene Ontology: Mol. function=tRNA-pseudouridine synthase activity; Cellular component=intracellular; Biological process=RNA processing
  Homolog annotation: Hit_ID=Q0WVR7; Match level="QueryCoverage=99%, HitCoverage=76%, E-value=1e-148, Identity=66%"; Hit description=TRNA synthase-like protein
  Pfam annotation: Domain name=TruB_N; Domain location=192-350; Score =159.2; E_value=1.1e-44; Accession=PF01509.9; Description=TruB family pseudouridylate synthase (N terminal domain)
MYGSDEDESRRPDETFVELKPEVVDFPTLHKREEELYFYDAFTYPWEKDKHYKMVYQLEKKYFPDQCLDKAFLQPGQSNANANGKGKGRKKVVGGGGGEEKLVFFEEGNVEEKGEESGSGSRQLKEKKVEDFFKGLKKDPSPSLNKDVQVGEPFLSSRRTGLPPVWDTPHGTVLLVNKPKGWTSFTVCGKLRRLVKVKKVGHAGTLDPMATGLLIVCVGKATKLVDRSEQLFCFRYQGMIKGYSGVFRLGEATSTWDADSPVIQREPWEHIKDEDIKRNALSFSGEIWQVPPMFSAIKVGGEKMYEKARRGESIELSPRRISIFQFDIERSLDDRQNLIFRVTCSKGTYIRSLCADFGKALGSCAHLTALRRDSIGQYSADDAWEFQELEEAITKNYL

SEQ ID NO: 162165 - protein, 122 aa, Glycine max
  Coding DNA Sequence Number=SeqID_45387
  Homolog annotation: Hit_ID=Q1SJX6; Match level="QueryCoverage=66%, HitCoverage=18%, E-value=5e-08, Identity=55%"; Hit description =Natural resistance-associated macrophage protein
MEAKNHCGAAYGGWKSRQCHVWMSVIAAAALHGGSRQLMCVNVARVILSSDREGWSMKKPGWKRFLSHVGPDFLVSLAYLDPGNIVVGNTNRTRVCAYNSIIGYKCRRNHWKKGCSKTHIEE

SEQ ID NO: 162166 - protein, 113 aa, Glycine max
  Coding DNA Sequence Number=SeqID_45388
MHSIFLFGTPPKFVKSPSYISRLTHSLLGAASLATIAKEHEVVDHRLESHELREQAGNDVYYGLNNGHDGGFGAVWRHWLRRCWCLSVTVVLGGGGVQWSWRFGREATRIVLR

SEQ ID NO: 162167 - protein, 1196 aa, Glycine max
  Coding DNA Sequence Number=SeqID_45389
  Gene Ontology: Mol. function=binding
  Homolog annotation: Hit_ID=Q5QMW8; Match level="QueryCoverage=99%, HitCoverage=98%, E-value=0.0, Identity=53%"; Hit description=HEAT repeat-containing protein-like
  Pfam annotation: Domain name=HEAT; Domain location=524-560; Score =3.4; E_value=17; Accession=PF02985.12; Description=HEAT repeat
  Pfam annotation: Domain name=HEAT; Domain location=563-599; Score =9.3; E_value=3.2; Accession=PF02985.12; Description=HEAT repeat
  Pfam annotation: Domain name=HEAT; Domain location=602-638; Score =20.2; E_value=0.0076; Accession=PF02985.12; Description=HEAT repeat
  Pfam annotation: Domain name=HEAT; Domain location=923-959; Score =8.2; E_value=4.3; Accession=PF02985.12; Description=HEAT repeat
  Pfam annotation: Domain name=HEAT; Domain location=962-998; Score =18.7; E_value=0.021; Accession=PF02985.12; Description=HEAT repeat
  Pfam annotation: Domain name=LisH; Domain location=152-178; Score =15.6; E_value=0.022; Accession=PF08513.1; Description=LisH
  Pfam annotation: Domain name=LisH; Domain location=6-32; Score=2.5; E_ value=1.1; Accession=PF08513.1; Description=LisH
  Pfam module annotation: Pfam domain module=HEAT::HEAT::HEAT::HEAT::HEA T::LisH::LisH; Domain location=524-560::563-599::602-638::923 -959::962-998::152-178::6-32
MEVERSSLCNCVVNFLLEENYLLTAFELLHELLDDGRHDQAIRLQQYFSDPARFPPNQISRLNSLPTADPQTLLQLKNESDHKLSITDYELRLANEDIAKLKSQLYAAEAPQSNSGHVSEGQIQEQKPNHNNNHSSSFTASSLGPLKDTERRDLNCAVKEYLLIAGYRLTAMTFYEEVTDQNLDNWQNTSALMPQALRHYYYQYLLSTSEVAEAFEMKEKIAQVPENITLLKENERLNQEKESLLKDKDLADGQIAALTKSLEALQRDLKEKENMVQVLKQSLENQRKGLHASRVEISKLKMSIEGSGSGNSLVVSDVDNFQPVSLDEYKEEIKKLQMEVERLKEKNIGIPEPGNFVGSENETLQIEDKVREIHEDQGAISYHVDAPQDVIRDEDAQSTTSQTLNKYTDKHEDALHALFNPANGNSAFENIDNVSEQNVGKQEGDNRLNAKSDSANDEAISEKMATLLSEFGYDNKSNSSNDLGLGTIQILADALPKIVPYVLINHREELLPLMMCAIEHHPDSSTRDSLTHTLFNLIKRPDEQQRRIIMDACVSLAKNVGEMRTETELLPQCWEQINHMYEERRLLVAQSCGELAEFVRPEIRDSLILSIVQQLIEDSATIVREAAAHNLAMLLPLFQNMDKYFKVEELMFQLICDPSGVVVETTLKELVLAIIKWGNKLDHILGVLFSHILSSAQHCPPLSVIEGCIESHLHELGERERWNIDVLLRMLMELLPLVHQKAIETCPFLSRVESTQVVFSATLFELYARGHVEWDAFEWMHVECFPKLIQLACLLPWKEDNLRSRISKFLLSVSERFGDSYTTCIMLPVFLTAVGDDADLTFFPSAIHSKIKGLRPKSVLSEKLSILCVLPLLLAGVLGASGKRNQLEDYSRKLLVEDSLKENLATKHTVEIINAVRFICIYEENHGMIFNILWEMVVSSNVNMKISAAKLLKAIVPYIDAKLTSTHALPALITLGSDQNLNVKCASIDAFGVVAQRFKNEMIVDKIRVQMGAFLEDGSHEATIAVIRALVVAISQLTAVPTAASSDLMLRQERANAFCEAIRALDATDLPANSVRDYLLPAIQNLLKDLDALDPAHKEAIEIIMKERSGASVGGGASKSMASHLGIASSVSNFFGDGGLLGKKDSTEAQPQPERVVYPNKAAATSQPQPEDTRLKRIMLGHFSDILRTKGKSQDE

SEQ ID NO: 162168 - protein, 65 aa, Glycine max
  Coding DNA Sequence Number=SeqID_45390
MIVPHRLCADSIINKWELISKHRVLPQPNLRREDDARAHECIFQERKMRGVATNIYSTKTSEKPE

SEQ ID NO: 162169 - protein, 161 aa, Glycine max
  Coding DNA Sequence Number=SeqID_45391
MGNYISCTLSTAGSSKHWRGIKVIFPSGEIEQLEEGVKAAELMLEMPSFFVVDTRSLQIGRRFSALNADEELECGNVYVMLPMKRLNSLVKASDMGALLLTAKRVSAKKVIPAEKEPELKLDCDDIQEFSSPEFMHRLSMSRSKKPLLETIAEEPVSSRSS

SEQ ID NO: 162170 - protein, 248 aa, Glycine max
  Coding DNA Sequence Number=SeqID_45392
  Gene Ontology: Mol. function=hydroxymethyl-, formyl- and related transferase activity; Cellular component=mitochondrion; Biological process=biosynthetic process
  Homolog annotation: Hit_ID=Q9M4F4; Match level="QueryCoverage=95%, HitCoverage=67%, E-value=4e-85, Identity=68%"; Hit description=Fmt protein
  Pfam annotation: Domain name=Formyl_trans_N; Domain location=24-212; Score=90.3; E_value=5.9e-24; Accession=PF00551.9; Description=Formyl transferase
  Subcellular localization annotation: CTP_CleavageSite=35; ConfidenceScore=5.31e-01
MIRRLWCLQSGSPSVPPSSTKKKKPLVLLGAPHVSAIVLEALLNASTCPDSSFEVAAIVTQPAARRDRGKKLSLSPLASHALQRGFSPDLIFSPLRAGDDTFLSNLKALQPHLCITAAYGNILPTDFLHIPSFGTVNIHPSLLPLYRGAAPVQRALQDGVKETGVSLAFTVRALDAGPVIATETIQVDDQIKAPDLLELLFHKGSKLLIGELPSILDGSARVKAQPQDDSKATLAPKLSTVGAPVDQK

SEQ ID NO: 162171 - protein, 175 aa, Glycine max
  Coding DNA Sequence Number=SeqID_45393
MGRDFEVNRVGSKGGSRLSSHQKLENQSHGSKSGPTEKEEGVEYMVEECHERVVGEKHETLGEVNHTKLETESFGWQSESNTILEYVIDDCGCGLFLRIRVTIRFDIDKGSIRECIREFGLFKGGSGLGFVGESMNGVLSRVKDILGIEKSVVIRPKVCNHSIPNATSTPSMGRK

SEQ ID NO: 162172 - protein, 670 aa, Glycine max
  Coding DNA Sequence Number=SeqID_45394
  Gene Ontology: Mol. function=transferase activity, transferring hexosyl groups; Cellular component=integral to membrane; Biological process=carbohydrate biosynthetic process
  Homolog annotation: Hit_ID=Q652K2; Match level="QueryCoverage=88%, HitCoverage=81%, E-value=0.0, Identity=59%"; Hit description =Glycosyl transferase family 8 protein-like
  Pfam annotation: Domain name=Glyco_transf_8; Domain location=328-644; Score=392.0; E_value=8.7e-115; Accession=PF01501.10; Description =Glycosyl transferase family 8
METNPLPLPLILFVFSLLFSALDSSDSKSSPLLYDCDQCHRTKERDVSTTRSRDEKDVGIIATYSDSASGHVRLARLKMRDLSDSWIWENPTHQYQKTSREFMESFQTESNPNHSTDEHYPEQSRVQIPRSSSMTMTPMKIKRRVMRQDRRKARAAELTREDKENDDHIVSAAIEHTEGFDTTIKGKYGIWRREYENPNSDSTLKLMQDQIIMAKAYANIAKSKNKIVLYEALIKHSRDSQQAIGEASSDTELHLGLPFIAFARALDRAKAMGHVLSIAKDQLYDCLLVSRKLRAMLQSTEDKVNIQKKRSAFLIQLAAKTVPRPLHCLPLQLAANYYLQGYHKKGNLDKEKIEDPSLYHYAIFSDNVLAASVVVNSTVQNAKEPEKHVFHIVTDKLNFAAMRMWFLINPPSKATIEVQNVDDFKWLNSSYCSVLRQLESARIKEYYFKANHPSSLSVGSDNLKYRNPKYLSMLNHLRFYLPEVYPKLNRILFLDDDIVVQRDLTPLWSIDLKGMVNGAVETCKESFHRFDKYLNFSNPLISNNFSPEACGWAFGMNMFDLKEWKKRNITGIYHRWQDMNEDRTLWKLGTLPPGLITFYNLTYPLDRGWHVLGLGYDPALNLTEIENGAVIHYNGNYKPWLNLAVSKYKSYWSRYVMFDNPYLRVCNLSE

SEQ ID NO: 162173 - protein, 1029 aa, Glycine max
  Coding DNA Sequence Number=SeqID_45395
MDHVTPESLLPLDFNSPTGIKLLCSEWKTTPTLELNAVMADSCAVQSRHDSWSLLWLPIDLILEDAMDGNHVAEASAVEALTGLVKALQAVNGTAWHSAFLGLWIAALRLVQRERDPGEGPVPRLDTCLSMLLSITTLVVANLIEEEEGELIEEAEHSPANQRMDKQALGERHGELVTSLQLLGDYENLLTPPQSVIWGANQAAAKATLFVSGHSGYLEHTNVNDLPTNCSGNLRHLIVEACIARHLLDTSAYFWPGYVSAPFNQLPHSIPNHLPSWSSLMKGSPLTPPLVNVLVATPASSLAEIEKVFEFAIKGSDEEKISAATILCGASLVRGWNVQEHIVFFIIKMLSPPVPPKYSGTESYLISHAPFLNVFLVGISSVDSVQIFSLHGVVPLLAAVLMPICEAFGSSVPNVSWTAVTGEKLTCHAVFSNAFILLLRLWRFDRPPVEHVMGGAATPALGSQLGPEYLLLPLFMDSFPKLNIWYRQHQECIASTCNTLAPGGPVSQIVEALLSMMCKKINRSAQSLTPTTSGSSNSSLSSLDDALMKLKVPAWDILEATPFVLDAALTACAHGRLSPRELATGLKDLADFLPATLGTIVSYLSSEVTRGIWKPAFMNGTDWPSPAANLSIVEQQIKKILAATGVDVPSLAIDGNAPATLPLPLAAFLSLTITYKLDKSCERFVVLAGPSLIALSSGCPWPCMPIVGALWAQKVKRWSDFFVFSASATVFHHSRDAVVQLLRSCFASTLGLGSACIYNNGGVGTLLGHGFGSHYSGGFTPVAPGFLYLRVYRSIRDVMFLTDEIVSLLMLSVRDIANGGLPKGEVEKLKKTKYGMRYGQVSLSGSMTRVKHAALLGASFLWISGGSGLVQSLITETLPSWFLSAQGLEQEGGESGVVVAMLRGYALACFAVLGGTFAWGIDSSSPASKRRPKVLEIHLEFLANALDGKISLRCDCATWRAYVSGVMSLMVSCTPLWIQELDVGILKRMSNGLRQLNEEDLALHLLEIRGTSVMGEHGAYVMIPRPYGK

SEQ ID NO: 162174 - protein, 191 aa, Glycine max
  Coding DNA Sequence Number=SeqID_45396
MKGVGLNTCFAEPMQGSGNVFPAQGIGVVDDDIGGIDGEEAGGVLEQSFVGQGGFEKLRDESEEKENENDAGMRVEGGIELGEVKKMMDGGHDGGVIGEVDEEGEGVAAEEVHVESVGGGVEAAKREDAGGEEGEGKEGREEAEGHGFLEELPGDGKVIVEADVGDQAVGQLDGREGDAAGVEGGADLDGP

SEQ ID NO: 162175 - protein, 213 aa, Glycine max
  Coding DNA Sequence Number=SeqID_45397
  Homolog annotation: Hit_ID=Q9SWW0; Match level="QueryCoverage=34%, HitCoverage=18%, E-value=2e-22, Identity=71%"; Hit description =Ethylene-responsive elongation factor EF-Ts precursor
  Pfam annotation: Domain name=EF_TS; Domain location=1-73; Score= -51.8; E_value=0.00065; Accession=PF00889.9; Description=Elongation factor TS
MAIGQAEASGKPQMAIEKMVEGRLRKYFENAVFMDQKFIMNDTMNVKAVLDNLSKEVGSSVRVVDFLGMEVREGIARKRIQSRYPLSKNHISTQPGSKPPIMSKTNFSKRIYKTFCVVAKVEVEAEAAQWAKAKAVETLTDRRMPATNSNTPTTQAKIVSETMTTPVMEPSLAVSAIMVVVLTEVEVKVEHEAVTMAVVVALAVESEKERVRE

SEQ ID NO: 162176 - protein, 242 aa, Glycine max
  Coding DNA Sequence Number=SeqID_45398
  Gene Ontology: Mol. function=methionyl aminopeptidase activity; Cellular component=cytoplasm; Biological process=proteolysis
  Homolog annotation: Hit_ID=Q56Y85; Match level="QueryCoverage=53%, HitCoverage=29%, E-value=4e-66, Identity=95%"; Hit description =Methionine aminopeptidase 2B
  Pfam annotation: Domain name=Peptidase_M24; Domain location=1-154; Score=-9.5; E_value=2.8e-07; Accession=PF00557.14; Description =metallopeptidase family M24
NSFMEKLQKPNKWLLIPTPPYFYCLICVEAGIDVRLCDIGAAIQEVMESYEVEINGKVYQVKSIRNLNGHSIGRYQIHAGKSVPIVKGGEQTKMEEGEFFAIETFASTGKGYVREDLECSHYMKNFDVGHIPLRLPRAKQLLATINKNFSTLAFCRRLTASTRRQRQVAPIAKDVEHVNHAAEEGFFGGPHDTSVLMDYVHHVIVIVWNGEECPKLKLSSHERKVEKFGSLALEIEGLVIAT

SEQ ID NO: 162177 - protein, 227 aa, Glycine max
  Coding DNA Sequence Number=SeqID_45399
  Gene Ontology: Mol. function=RNA-directed DNA polymerase activity; Biological process=RNA-dependent DNA replication
MWKDGEKGNGVSKPGGWYRNRALCHHVFSYPNITPRGLLSSQVVLKEGLRWRLGSGKEVNMWSDPWLRFEGNPYIETPIVQGAEKLVVANIVDIATGTWNLMTLWNIWQRRNDAVWEGSLCDYELVIRRGDSFFQDWDRAKEAYKSRDISVEDVIQNRLIPLVHGRLKCNVDAAFLKETNSTGFGLRLRDPQVRMVVLRSCCVKPCMQFVEVEAYGLMLALQFVSNL

SEQ ID NO: 162178 - protein, 47 aa, Glycine max
  Coding DNA Sequence Number=SeqID_45400
MSSSFLATHHKKNEEADKYPSNILESNKLFSVVAAWVIGKGRGDDKP

SEQ ID NO: 162179 - protein, 263 aa, Glycine max
  Coding DNA Sequence Number=SeqID_45401
  Gene Ontology: Mol. function=protein heterodimerization activity; Cellular component=microtubule; Biological process=cell division
  Homolog annotation: Hit_ID=Q8H0T9; Match level="QueryCoverage=70%, HitCoverage=22%, E-value=5e-52, Identity=57%"; Hit description =Katanin p80 WD40-containing subunit B1 homolog 1
MEFNNLSLKDALVSTACCFAWLEESSISPGHHDVISLFLKVKQRAHSISTEKATISATDEDSIADVMEQHDEFLSSMLARSAKLQMVFRCWERNDVKEVIGIMAKMDDHAVIADVVSIIMEKIDIITLEICAGLLPLLTDLLQSEMERHLGISLEMLLKLVRIFGSVIYSTVSATQPVGVDIEAENRLERCNLCFTELEKVKRFLPSLSRRGGSIAKSAQELNLALQDALIAANSADIYSKPKLETCPSADGCTADYNLSSSA

SEQ ID NO: 162180 - protein, 429 aa, Glycine max
  Coding DNA Sequence Number=SeqID_45402
  Homolog annotation: Hit_ID=Q1S7C5; Match level="QueryCoverage=35%, HitCoverage=13%, E-value=3e-26, Identity=41%"; Hit description =Integrase, catalytic region
MASASYNPPPPPPLLPGNNEVSVNDAILVNAIPVHVETPTPDTDSIIFSQIPKFHRGLRRSLITMLATFRLSSCCGNNKTSWLQSMTSSEVLPRLISCKSSWHLWDKLHSHFQSIFCAKKKQLRNDLRNISLDNCSISEYLRIQTLIDSLSSIGEFFPGSEHVDIILDGLPDEFESLVALISCRFELLSVDEVETLLAHETRIDQQGSANNTVTAEPQVKVAQAQNSSARDTNSNYNNYYDSNRYLNNGCGGGWNFSRGGGRGISQKVDDYYVPTQPMAQQYTNQNSNQQWNSNPSFQYSNTYPNQYPNNPQPSFPPPQAHLTSVQPAPSQNCFILLFVWSKGSKEVLLKGMVGCDGLYQFPDLLQSASQQLKPPFTVNTISEPVSDVLSSNSTSVFVNRVTNPSHVNTVSSSDVSFAIWHSRLGHPNA

SEQ ID NO: 162181 - protein, 234 aa, Glycine max
  Coding DNA Sequence Number=SeqID_45403
  Gene Ontology: Cellular component=microtubule
  Homolog annotation: Hit_ID=Q0WV51; Match level="QueryCoverage=87%, HitCoverage=24%, E-value=3e-32, Identity=38%"; Hit description =Katanin p80 subunit-like protein
MTVLNEITAKARLSVSQNPDQLLKEIRSLGRLSVSQDSDSLKEGKCLASTGSAPSTPQRINLNSGPKAVPGGSTTVLNTTAQKRSSLKSHTASSVPLINKSDIIPIIVPRTSMRSEPVADSRKEVGVSGRTMPFPLQSKAEDIHKFPNNRDDVDKPLSPVNESAASKGIELSGFADKNNFPVSVSSMQEFGLAVRVTLTCIHHFGHITSQSEIPAQPFMPRTLPFELEKQMRTF

SEQ ID NO: 162182 - protein, 101 aa, Glycine max
  Coding DNA Sequence Number=SeqID_45404
  Gene Ontology: Mol. function=microtubule-severing ATPase activity; Cellular component=microtubule; Biological process=cell division
  Homolog annotation: Hit_ID=Q8H0T9; Match level="QueryCoverage=96%, HitCoverage=11%, E-value=3e-46, Identity=85%"; Hit description =Katanin p80 WD40-containing subunit B1 homolog 1
MVNPGSADRTVKFWDLETFELIGSAGPETTGVRSLTFSPDGRTLLCGLHESLKVFSWEPIRCHDMVDVGWSRLSDLNVHEGKLLGCSYDSSCVGVWVVDIS

SEQ ID NO: 162183 - protein, 213 aa, Glycine max
  Coding DNA Sequence Number=SeqID_45405
  Gene Ontology: Mol. function=protein heterodimerization activity; Cellular component=microtubule; Biological process=cell division
  Homolog annotation: Hit_ID=Q8H0T9; Match level="QueryCoverage=74%, HitCoverage=28%, E-value=7e-76, Identity=58%"; Hit description =Katanin p80 WD40-containing subunit B1 homolog 1
  Pfam annotation: Domain name=WD40; Domain location=104-142; Score =46.5; E_value=9.3e-11; Accession=PF00400.22; Description=WD domain, G-beta repeat
  Pfam annotation: Domain name=WD40; Domain location=146-184; Score =40.2; E_value=7.3e-09; Accession=PF00400.22; Description=WD domain, G-beta repeat
  Pfam annotation: Domain name=WD40; Domain location=19-58; Score=29.6; E_value=1.1e-05; Accession=PF00400.22; Description=WD domain, G-beta repeat
  Pfam annotation: Domain name=WD40; Domain location=62-100; Score =30.8; E_value=4.9e-06; Accession=PF00400.22; Description=WD domain, G-beta repeat
  Pfam module annotation: Pfam domain module=WD40::WD40::WD40::WD40; Domain location=104-142::146-184::19-58::62-100
MHLPSIFYLQISLSLSLSLSLLEEFVAHASTVNCLKIGRKSSRVLVTGGEDHKVNLWAIGKPNAILSLSGHSSGIDSVSFDSSEVLVAAGAASGTIKLWDLEEAKIVRTLTSHRSNCTSVDFHPFGEFFASGSLDTNLKIWDIRKKGCIHTYKGHTRGVNAIRFTPDGRWVVSGGEDNTVKVRIDFLNHDINRVRFPNMVINRVRFPNMVIYH

SEQ ID NO: 162184 - protein, 78 aa, Glycine max
  Coding DNA Sequence Number=SeqID_45406
MKVKDKRYATNTLDSTLHAMWYHFSVKNLVGCLGVHDGTCLTMGRPVWVALFCENAPTIWDQYRLKGALKLGVFTPKA

SEQ ID NO: 162185 - protein, 847 aa, Glycine max
  Coding DNA Sequence Number=SeqID_45407
  Gene Ontology: Mol. function=diacylglycerol kinase activity; Biological process=protein kinase C activation
  Homolog annotation: Hit_ID=Q5KR50; Match level="QueryCoverage=89%, HitCoverage=93%, E-value=0.0, Identity=81%"; Hit description =Sphingosine kinase
  Pfam annotation: Domain name=DAGK_cat; Domain location=290-448; Score= 92.1; E_value=1.7e-24; Accession=PF00781.14; Description =Diacylglycerol kinase catalytic domain
  Subcellular localization annotation: CTP_CleavageSite=93; ConfidenceScore=5.25e-01
LTIKNPNPGIQKVRHALAHARFSSLRVCQIDGTMRDMHRNSTGSTNNNTNKIPSALRLSSPQQSLRRLGLCSQIATGEHSSPIVFPEKRGKVKASRKTSVPTTIRPDDQDITKNFEHRIDIAGAGGGDEKSDLLGYVVFSGKLILDKRKLATNDNADAQQTSEITNQDAVDAKLTSKAMAWGSQVLHLDDVISVSYNAGLRHFTVHSYPLKKASCGLSCFIKSRRSRKDFRFVASSIEEALQWVGGFADQHCFVNCLPHPLLSSKKQASSELLHTDTPPELLFRCKTPPKMLVILNPRSGRGRSSKVFHGIVEPIFKLAGFRLEVVKTTSAGHARNLASSVDISSCPDGIICVGGDGIINENFSPPSHYPAKLVVGSAVVNVSHAHVLNGLLSRDNQKEGISIPIGIIPAGSDNSLVWTVLGVRDPVSAAMAIVKGGLTATDVFAVEWIQTNKIHYGLTVSYYGFVGDVLELSEKYQKRFGPLRYFVAGFFKFLCLPRYNYEVEYLPASKTEREGKLSGEKEVVDMSDLYTDIMSRSNKDGMPRASSLSSIDSIMTPSHISGVDLDTCSSTHASTEPSELVRGLDPKSKRLSSGRGNVIAEPEVIHPQLPLSTTPNWPRTRSKSRNDKGWTGLTTTHDTSRRGNTVTNDREDISSTLSDPGPIWDAEPKWDAEPSNWDVENPIELPGPSDDTEIGSAKEVVPRFGDKWVASKGQFLGILVCNHACRTVQSSQVVAPKAEHDDNTLDLLLVHGSGRLRLLRFFLLLQMGRHLSLPYVEYVKVKSVRIKPGKHTHNGCGIDGELFPLNGQIPNLSCKFLIAVTAELCKSFVPQQEAECIADHHFLELVN

SEQ ID NO: 162186 - protein, 331 aa, Glycine max
  Coding DNA Sequence Number=SeqID_45408
MASNDDESVLDPWAFILELSHISPSQEQILATAPFVGAVQDTATSASHDIDMLPLPDSVPEDVFHTPEEASLPTSPSENHCVVNYAFIDVDDVDAWFELGKDSELGSSDVHVEEVNGEEMGNLETLSGDVSISVSESAEGPKSSDGVVESPGKKKSEQGKNKSAVSGEQKTDKEAGPGLRRVLPPSTAASTPMTETGSGRSGNGGGGAKRKFLDAFFAAVKAFSELQSTVEELNEDHKEAGPELRRVLPPSITGSTAKTGSGRSGNGGGGEKRKAFDVFALLKAFSKLESTVEENNDDHRTLLDVARAKGVTFPRPRWWPEGDNFDPPPPQ

SEQ ID NO: 162187 - protein, 132 aa, Glycine max
  Coding DNA Sequence Number=SeqID_45409
  Gene Ontology: Mol. function=nucleic acid binding; Cellular component= nucleus; Biological process=DNA integration
  Homolog annotation: Hit_ID=Q1SEE1; Match level="QueryCoverage=98%, HitCoverage=13%, E-value=3e-31, Identity=46%"; Hit description =Integrase, catalytic region; Zinc finger, CCHC-type; Peptidase aspartic, catalytic
MKDLGPTKKILGMQITGDNQRGILQLSQVEYINYVLQRFNTSNAMTVSYPSTIGRLMYAMVCTRPDIGHAVRVVSRFMSNPELELQGYVDTDFAGEVDHQRGTASYIFTVGTTTVSWISWIQKIVVLSTIEA

SEQ ID NO: 162188 - protein, 469 aa, Glycine max
  Coding DNA Sequence Number=SeqID_45410
  Gene Ontology: Mol. function=nucleic acid binding; Biological process= DNA integration
  Homolog annotation: Hit_ID=Q1SEE1; Match level="QueryCoverage=94%, HitCoverage=54%, E-value=2e-74, Identity=57%"; Hit description =Integrase, catalytic region; Zinc finger, CCHC-type; Peptidase aspartic, catalytic
MAAKDVKVKIEKFDGTNFSFWKMQIEDYLYQKKMYQPLFGNKPKGMKDEDWTLLDRQALRVICLTLSRNVAFNIGKETTTTSLMVALFSMYEKPSTSNKVHLMRRALILLSSLPGSWNTTVTTVSSSLGSNKLKFNDVRHLVLSEEIRRRESEARAEANVASTSGEVHDALICSLESKEESRVSFHTTSKKEFFANYVPINLGNIYLGKEQSCEIMGKELNSDGYTTVFHGDQWKILKGAMTVACGNKSETLYMTDERLGHMSEKGMKIMHSKNKLTGLQLVEIDTCEDCIIGKQKRVSFETSGRTPKKERLKFVHFDVWGPTTVPSIGGRQYFITFIDYHSRKAFKIWKAMVENKTGLKIKKLRFDNGNGKDCGRLAKAILGISNQHNNLIIGSQNTRRGGNKLDPKSKKCTFIDYGEDEFGYRLWDNENERMICSRDVIFNERISIIANEELYLEQLDVKTTFFMET

SEQ ID NO: 162189 - protein, 173 aa, Glycine max
  Coding DNA Sequence Number=SeqID_45411
  Gene Ontology: Mol. function=ferredoxin reductase activity; Cellular component=phycobilisome; Biological process=lipoate biosynthetic process
  Homolog annotation: Hit_ID=Q9FHL4; Match level="QueryCoverage=81%, HitCoverage=98%, E-value=3e-20, Identity=36%"; Hit description =Similarity to ferredoxin-thioredoxin reductase variable chain
  Pfam annotation: Domain name=FeThRed_A; Domain location=97-169; Score= 147.1; E_value=4.8e-41; Accession=PF02941.6; Description=Ferredoxin thioredoxin reductase variable alpha chain
MRKQRRRLAGDEGMDMDIVEREWNRTKKMSGASSTIRLSPMVSVSPNCNCSSMMVMKKTTTAVAPLWMKSKSARGGIRCEVAINAVDESTTSPESKIGARVKVKAGVKVYHVPKVAELDLTGLEGEIKQYVGLWNGKRISANLPYKVQFLTDIPARGPVKFFAHLKEDEFDYL

SEQ ID NO: 162190 - protein, 135 aa, Glycine max
  Coding DNA Sequence Number=SeqID_45412
  Gene Ontology: Mol. function=microtubule binding; Cellular component =cortical microtubule, transverse to long axis; Biological process =positive regulation of microtubule polymerization
  Homolog annotation: Hit_ID=Q10PE0; Match level="QueryCoverage=73%, HitCoverage=25%, E-value=1e-20, Identity=42%"; Hit description =Microtubule associated protein family protein, putative, expressed
MVMTLCNSHGCCSDSKRISRSLKGFGVEGLGVLVLDFGQTVGDVHPSLHGTQVEQSTNISNSTLEGLEQAILKLKIERKTRISEAEVDRLAKLKASRMKELVFKKRSELEEICRLTHIEPDPSIVAEKASALIDS

SEQ ID NO: 162191 - protein, 104 aa, Glycine max
  Coding DNA Sequence Number=SeqID_45413
MVESPQEQVQMVEIAMGSELEWSPPLLVLREELVVEIYVGVGRITGISTEEERGSVEEEGPPVSDGAVEEASDLFPLAFLGPLKVIVGSLRFQQFFLISMRGGG

SEQ ID NO: 162192 - protein, 102 aa, Glycine max
  Coding DNA Sequence Number=SeqID_45414
MENGELANSATHNFAGLQTRRWRTHEQRQEMTFMGLRKKTLGNNIHGAPKKVENGELANNATHNFAGLQTRRWRTHEQRQEMTFMGLRKKSGEWRIGEQRYA

SEQ ID NO: 162193 - protein, 106 aa, Glycine max
  Coding DNA Sequence Number=SeqID_45415
MFKTLVIDYMLMVIDYCFVNQFEKNVGYCLWHHQNCGRNAFQDYFDDAKESRVKQVPKNKESKSFNNQVSRFKIQEQSSFKNQDSRTIKIKIQDSRIKRRLNQDKY

SEQ ID NO: 162194 - protein, 448 aa, Glycine max
  Coding DNA Sequence Number=SeqID_45416
MHASGSFIEYLGLGLTACKVRSEDCPSLIRTTLAISLVDVGSQPTKGRHPDKSLSFSGQPHYRHYAALAGIIANSVGEHLIFFSSPVTNYEEINGPSNAIRNPLQYSGGQGGWRTTHNERNANQPSNDVNGHHSRRSDDIGRFNYRQNTNRMDRRNTGSGQSSKHVHVSQSDHTAQPTSVFIPYVDQSSRAHPTADILTKRQRKRESPSGIMFLGSTGESSSSSQNPEVIELLSTPRGSSNSSRSSVLDHEVVDLLSTPRYANRSSEDLDDNDNSSEARARQMEADERLARELQEQLYHDDPFEGRGVGFSFLYCLLTFCEIDEDLAWDLQRAEALLRTTIDSHSMNQPTQLPRANRQSRTRFQQNPSRRRAMAQASFSNRMSQWRSRSTSRTRAPNTSSRGRGPQFPLDMDLDMRLDILEALEDSIGDFSDMGMADDIFNARRDFTE

SEQ ID NO: 162195 - protein, 41 aa, Glycine max
  Coding DNA Sequence Number=SeqID_45417
MVGNLSVRETGRVGSGRSEYVDESEQRKLNPRAKRSITTRF

SEQ ID NO: 162196 - protein, 131 aa, Glycine max
  Coding DNA Sequence Number=SeqID_45418
MRLTVLGLSTKCLLTVLGWDFQTLKIDNLNGAQKVKKPSPARPAKSCNPRLVPCLKSPVKAAISAQARNRQLHRRDAPQPEIASSSSGLPSTCPVLTNSPLKLAFSMQNPCRPRTKQHHGGNSFKTAPFGE

SEQ ID NO: 162197 - protein, 396 aa, Glycine max
  Coding DNA Sequence Number=SeqID_45419
  Gene Ontology: Mol. function=acetyl-CoA C-acyltransferase activity; Cellular component=glyoxysome; Biological process=fatty acid biosynthetic process
  Homolog annotation: Hit_ID=Q08375; Match level="QueryCoverage=86%, HitCoverage=74%, E-value=1e-148, Identity=77%"; Hit description =Acetyl-CoA acyltransferase
  Pfam annotation: Domain name=Thiolase_C; Domain location=258-368; Score=132.1; E_value=1.6e-36; Accession=PF02803.8; Description =Thiolase, C-terminal domain
  Pfam annotation: Domain name=Thiolase_N; Domain location=1-251; Score= 367.7; E_value=1.8e-107; Accession=PF00108.13; Description=Thiolase, N-terminal domain
  Pfam module annotation: Pfam domain module=Thiolase_C::Thiolase_N; Domain location=258-368::1-251
AYRTAHCKGKRGGFKDTLPDDLLAPVLKAVIERTNVNPSEVGDIVVGSVLAPGAQRASECRMAAFYAGFPETVPVRTVNRQCSSGLQAVADVAAAIRAGFYDIGIGAGLESMTTNPMGWDGSVNPKVKMFEQAQNCLLPMGITSENVAQRFGVSRKEQDQAAVESHRRAAAATASGKFKDEIVPVTTKIVDPKTGEEKSVTISVDDGIRPGTTVSDLGRLKPVFKKDGSTTAGNSSQVSDGAAAVLLMKRSVALQKGLPILGVFRTFAAVGVDPAIMGVGPAAAIPVAVKAAGLELDDIDLFEINEAFASQFVYCRNNLGLDPEKINVNGGAMAIGHPLGSTGFCIWSAAPKVLSLSLCPNSNLNIQKFLPLTCPLSKVALVTLTKNCQPLHFLPR

SEQ ID NO: 162198 - protein, 72 aa, Glycine max
  Coding DNA Sequence Number=SeqID_45420
MGTTQSKQKSDQDKRRKDLEFEAWSSGFDHQDYHNSIWSLSYDFCTEAMKYVGVGIHPELAQASFSWANSPR

SEQ ID NO: 162199 - protein, 97 aa, Glycine max
  Coding DNA Sequence Number=SeqID_45421
MVRGGDGQQQRRWRMIPFSSSMALPFDEVLVDFNRWKTREGKPWLRSVATYPSAGGRRETRGMRVPRKEYARSRHQRLFEENVGKTGKDAIYELLSE

SEQ ID NO: 162200 - protein, 170 aa, Glycine max
  Coding DNA Sequence Number=SeqID_45422
  Gene Ontology: Mol. function=zinc ion binding
  Homolog annotation: Hit_ID=Q1T1Y0; Match level="QueryCoverage=79%, HitCoverage=37%, E-value=1e-16, Identity=35%"; Hit description =Ankyrin
  Pfam annotation: Domain name=DUF1723; Domain location=14-63; Score =39.8; E_value=9.6e-09; Accession=PF08330.1; Description=Protein of unknown function (DUF1723)
TARVEVILPWEEDTDDRGLISPFVERWHRETSTFHLLVGKVFITLDDITSLLHLPIVGDFHAFQPLHINEAVLMLVKLLMVSPETQHWTAAARAYLLHLLGYTLFANKSVTHVHVVHLDALRDLTQARRYAWGTTGLVHMYDHLNDASISTSRQHFPSVAECNADPDYDE

SEQ ID NO: 162201 - protein, 130 aa, Glycine max
  Coding DNA Sequence Number=SeqID_45423
  Subcellular localization annotation: CTP_CleavageSite=59; ConfidenceScore=5.36e-01
HPLQASYPRHILGGEAPSSMAYSLVDAQRSGLHRSSTSKLPSLANRLTNPQVSLSSPFRGAAGLVKVHCYDGSFVVRGYRHGGCCGATAKKIVNLYVMRSSQGGDPTPEPWLGNSRMIRPGMQENVLGFS

SEQ ID NO: 162202 - protein, 321 aa, Glycine max
  Coding DNA Sequence Number=SeqID_45424
  Gene Ontology: Mol. function=helicase activity; Biological process =viral genome replication
  Homolog annotation: Hit_ID=Q9LTU4; Match level="QueryCoverage=99%, HitCoverage=25%, E-value=8e-90, Identity=46%"; Hit description =Helicase-like protein
MREWFAYRLQCRSNESKNLLNSGRLFQQFVVEQYTMVKSERLSYIRNNQKKLRVDKFWSLQHSLDDGSTKGLNKGKRVILPSTFVGSPRYMDQLYFDGMAICSHVGFPNLFITLTCNPNWPEIHRLLNPLNLKATDRPGIISRVFKLKYELILMDLTKNQMLGKVIASEIPSQQDDTKLHSLVKNHMVLGPCGILRPGSPCMKEGKCSRFYPKMFQPHTILDADGYPVYRRRNNGHTIEKNGVIIDNRYIVPYNPRLLRKYQAHINVEWFNQSTSIKYLFKYINKGYDRVTVVLIHDDHDPIHNGSTHNDEIKEYLDCRYY

SEQ ID NO: 162203 - protein, 169 aa, Glycine max
  Coding DNA Sequence Number=SeqID_45425
  Gene Ontology: Mol. function=helicase activity; Biological process =protein amino acid phosphorylation
  Homolog annotation: Hit_ID=Q1SN45; Match level="QueryCoverage=94%, HitCoverage=9%, E-value=2e-31, Identity=44%"; Hit description=AAA ATPase
  Pfam annotation: Domain name=DUF889; Domain location=2-167; Score =138.1; E_value=2.4e-38; Accession=PF05970.5; Description=Eukaryotic protein of unknown function (DUF889)
MVFGGDFRQILPVIPRGSRSDIVNATINSSYLWDYYQILRLTKNMLLQNNMQATDQEEIMTFAQWIIDIGDGIIGHDNDGYATIEISHELLITEYNDPIHSIVSSTFLDLCHHHNDREYFQFRAILASTNETVQQVNDYILALIPGEQMEYLSSDSVDKSETIESSHFC

SEQ ID NO: 162204 - protein, 159 aa, Glycine max
  Coding DNA Sequence Number=SeqID_45426
  Gene Ontology: Mol. function=cytochrome-c oxidase activity; Cellular component=integral to membrane; Biological process=cell division
  Homolog annotation: Hit_ID=Q66FW2; Match level="QueryCoverage=100%, HitCoverage=50%, E-value=8e-67, Identity=76%"; Hit description=Cell division protein
MANNAKTAKSKALRGGWREQWRYAWMNAIKDMLRQPLATLLTVMVIAISLTLPSVCYIVWKNVSTAASQWYPTPQLTVYLDKSLDDDAALKVLDAIKAEAGVEKVNYLSREEARGEFRNWSGFGGALDMLEENPLPAVAIVTPKMSFQSSDTLNTLRDR

SEQ ID NO: 162205 - protein, 134 aa, Glycine max
  Coding DNA Sequence Number=SeqID_45427
MTTSNSLAAWIIPTLEITTIHRDNEPSIHVEHFFNIQELEKVALKLNETLLFCGARHFFNKPKTIYPKLIETYWRNTEFVNKKTIASKVLGVKVVLSSDTIAKATGCLRQGSTYQGRWEKNYNSHVTRAFYQKC

SEQ ID NO: 162206 - protein, 474 aa, Glycine max
  Coding DNA Sequence Number=SeqID_45428
  Gene Ontology: Mol. function=RNA binding; Cellular component=cytosol; Biological process=loss of chromatin silencing during replicative cell aging
  Homolog annotation: Hit_ID=Q2QQH7; Match level="QueryCoverage=55%, HitCoverage=54%, E-value=1e-50, Identity=41%"; Hit description =Pumilio-family RNA binding repeat containing protein, expressed
  Pfam annotation: Domain name=PUF; Domain location=181-216; Score=1.8; E_value=4.2; Accession=PF00806.9; Description=Pumilio-family RNA binding repeat
  Pfam annotation: Domain name=PUF; Domain location=217-251; Score =47.5; E_value=4.5e-11; Accession=PF00806.9; Description=Pumilio -family RNA binding repeat
  Pfam annotation: Domain name=PUF; Domain location=256-291; Score=2.7; E_value=3.2; Accession=PF00806.9; Description=Pumilio-family RNA binding repeat
  Pfam annotation: Domain name=PUF; Domain location=341-376; Score =18.4; E_value=0.025; Accession=PF00806.9; Description=Pumilio-family RNA binding repeat
  Pfam annotation: Domain name=PUF; Domain location=377-411; Score =22.6; E_value=0.0014; Accession=PF00806.9; Description=Pumilio -family RNA binding repeat
  Pfam module annotation: Pfam domain module=PUF::PUF::PUF::PUF::PUF; Domain location=181-216::217-251::256-291::341-376::377-411
  Subcellular localization annotation: CTP_CleavageSite=92; ConfidenceScore=5.60e-01
MSSQRSSSSVFDNDQSPTLLTSSQQPLAMPRFLSQTQNPGQTLEDVFSRLSVSASPFNYPPSDFSAGSSYGVKTPSKILPCNGWGHGVTTLQSSNLWHPAFTSNNYSYYDDGFVDSKPLVRQREKTPTFGGGAFPVFPLSNGMQQKTPDDAGFLYGFLGGNNGSNNLGFSGNERRLRWFNDLRGRVLLLATDQHECRTLQETMRKLTREEFYIIFLELINHVTDLMVDPFGNYVVQRMVEICTEEQLSQIVLSLAQCNFQLVRICLSAHGIRGVEKLLERVTTQEQRDLVLSALCPGAAILAKDVNGHRVLLHCLKQFSGEDNEQCINHAQGETKQKLLDAIILHVSLLAEDCYGNYVVQHLLSLKVPGVAESLLIQLKGRFFYLACNKYGSNVVERFLQDSGEKHSTSIVLELLHNPNVAMLLVDPYGNYVIKSALSASKVSGSCSESLGATDQTKFPDYAEQPLWEEVTCLV

SEQ ID NO: 162207 - protein, 50 aa, Glycine max
  Coding DNA Sequence Number=SeqID_45429
MNGQAKRMSRRYELKECIGHHLPKMHLGRGRKMQPIGLKGQPMSVHSSQV

SEQ ID NO: 162208 - protein, 208 aa, Glycine max
  Coding DNA Sequence Number=SeqID_45430
  Gene Ontology: Mol. function=hydrolase activity
  Homolog annotation: Hit_ID=Q8L9J9; Match level="QueryCoverage=86%, HitCoverage=69%, E-value=3e-46, Identity=51%"; Hit description =Probable carbohydrate esterase At4g34215
  Pfam annotation: Domain name=DUF303; Domain location=104-200; Score =93.8; E_value=5.1e-25; Accession=PF03629.8; Description=Domain of unknown function (DUF303)
MSKVGQRGVLSENMPCLLLLLLFLIQAWPVKPQQAYDRNIFILAGQSNMAGRGGVVNNTATWDGVVSPQSRPNPSVLKLDAHLTWVAAREPLDADIDSAKTNGVGPGMAFANWVLEKHPEFGLIGLVPCAIGGSNISEWERGKELYNQMIKRAKASLRDGGTIRALLWYQGETDTVNLHDAQLYQTRVHKFFLDVRDDLRSPLLPIIQ

SEQ ID NO: 162209 - protein, 100 aa, Glycine max
  Coding DNA Sequence Number=SeqID_45431
  Homolog annotation: Hit_ID=Q8LDB7; Match level="QueryCoverage=95%, HitCoverage=25%, E-value=1e-07, Identity=37%"; Hit description =Somatic embryogenesis receptor-like kinase, putative
MVVLEMVTGKSVTKDVDATDNGVENLHLSMVAWLKEKDKNGSGCVSEILDPTVEGGYDEGKMKALARVALQCVKEEKDKRPTMSQVVEILQKSSRENDHQ

SEQ ID NO: 162210 - protein, 652 aa, Glycine max
  Coding DNA Sequence Number=SeqID_45432
  Gene Ontology: Mol. function=protein serine/threonine kinase activity; Cellular component=cell surface; Biological process =protein amino acid phosphorylation
  Homolog annotation: Hit_ID=Q5QLR7; Match level="QueryCoverage=95%, HitCoverage=77%, E-value=1e-142, Identity=43%"; Hit description=S -receptor kinase-like
  Pfam annotation: Domain name=B_lectin; Domain location=74-179; Score =104.6; E_value=2.9e-28; Accession=PF01453.15; Description=D-mannose binding lectin
  Pfam annotation: Domain name=PAN_1; Domain location=342-415; Score =11.8; E_value=0.011; Accession=PF00024.16; Description=PAN domain
  Pfam annotation: Domain name=PAN_2; Domain location=336-402; Score =0.2; E_value=0.0013; Accession=PF08276.2; Description=PAN-like domain
  Pfam annotation: Domain name=Pkinase; Domain location=519-652; Score=- 50.2; E_value=1.4e-05; Accession=PF00069.15; Description=Protein kinase domain
  Pfam annotation: Domain name=Pkinase_Tyr; Domain location=519-652; Score=-101.8; E_value=3.2e-06; Accession=PF07714.7; Description =Protein tyrosine kinase
  Pfam annotation: Domain name=S_locus_glycop; Domain location=210-324; Score=-5.5; E_value=9.4e-05; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=74-179::342- 415::336-402::519-652::519-652::210-324
MAAVYTLLLILLISLVISSSAVDTMHQGSSLSVEEPKDFMLSPNGMFSSGFFAVGENAYSFAVWYSEPYGQTRNATVVWMANRDQPVNGKGSKFSLLHNGNLALNDADESHVWSTNTVSLSSSVLLFLDNTGNLVLRQTESTGVVLWQSFDFPTDTLLPQQVFTRHAKLVSSRSKTNKSSGFYTLFFDNDNILRLLYDGPEVSGLYWPDPWLASWNAGRSTYNNSRVAVMDTLGNFSSSDDLHFLTSDYGKVVQRRLTMDNDGNIRVYSRRHGGEKWSITWQAKARPCNIHGICGPNSLCSYHQNSGIECSCLPGYKWKNVADWSSGCEPKFSMLCNKTVSRFLYISNVELYGYDYAIMTNFTLNQCQELCLQLCNCKGIQYTYVFESGTYTCYPKLQLRNAYRTPYFNADLYLKLPANSSYSYEGSTEQHGLDCSSSRTIQLERAYDMGHESRYIKFLFWFVGGVGGIEVFCIFVICLFLVKTSGQKYSGVDGRVYNLSMNGFRKFSYSELKQATKGFRQEIGRGAGGVVYKGVLLDQRVVAVKRLKDANQGEEEFLAEVSSIGRLNHMNLIEMWGYCAERKHRLLVYEYMENGSLAQNIKSNALDWTKRFDIALGTARGLAYIHEECLECILHCDVKPQNILLDSNYHPK

SEQ ID NO: 162211 - protein, 279 aa, Glycine max
  Coding DNA Sequence Number=SeqID_45433
  Gene Ontology: Mol. function=chromatin binding; Cellular component =chromatin; Biological process=chromatin assembly or disassembly
  Homolog annotation: Hit_ID=Q2R2X7; Match level="QueryCoverage=55%, HitCoverage=50%, E-value=8e-35, Identity=67%"; Hit description=MRG family protein, putative, expressed
  Pfam annotation: Domain name=MRG; Domain location=15-206; Score=-6.7; E_value=9e-11; Accession=PF05712.4; Description=MRG
MQFQEAGNEGMNLSSRYSLILSFNLYKALATYIHSSLKFMELFCISINFDLEKLVNIQIPPTLKKQLVDDCEFITHLGKLVKLPRTPNVKGILKNYFDYRLKKCGLMGDSVEEIMKGLSCYFDKALPVMLLYKNEHQQYQEACPANVFPSAIYGAEHLLRLFDGSVVIMPFVDSKMLALWVQACMSLLLYAHGSCKKTRAHSSFLLIMLQKVLRTAPTNKETRLVDNNCFCYVHSFTELLLYTMLVTIAVYFLHQNDVKSDLGSGSVTSTEGICTDPQF

SEQ ID NO: 162212 - protein, 287 aa, Glycine max
  Coding DNA Sequence Number=SeqID_45434
  Homolog annotation: Hit_ID=Q9M7N4; Match level="QueryCoverage=28%, HitCoverage=62%, E-value=2e-24, Identity=75%"; Hit description=MFP1 attachment factor 1
  Subcellular localization annotation: CTP_CleavageSite=37; ConfidenceScore=5.53e-01
MVKVGTSYVPINVSFSPKVGPGLPGAPVASVSISCPSCSATDGVVRNGKSTAGHQRWQAAQLLGRAIGAGLFAITPAGERGMCCKAIKLGNARVFPVTTLKPKVTLLLPTLCQTRPASPIPPTPLKMSDPENTPAPQSEQDSSSPPPAQDQPLAAAAKLGPAAVSFSIWPPTQRTRDAVITRLIETLSSPSVLSKRYGTMSPDEASASARQIEDEAFSVAASSAASDNDGIEILQVYSKEISKRMLDTVKAKSTAASAAVDNGTPASDAAPPPAADGDSAAVAESET

SEQ ID NO: 162213 - protein, 75 aa, Glycine max
  Coding DNA Sequence Number=SeqID_45435
  Subcellular localization annotation: CTP_CleavageSite=29; ConfidenceScore=5.09e-01
MLKLVRARQQDLKWNVFSITSFSWSINVVAGLSKRMLELQSPRAINEATNFVNQREQQVSILNSVKNHVNDKFRI

SEQ ID NO: 162214 - protein, 63 aa, Glycine max
  Coding DNA Sequence Number=SeqID_45436
MESEFRNMSMEVTTLVKLMFLKEDWLKAIVEDEGENHREEGNETSDYISNLPNKWTGFGVSIS

SEQ ID NO: 162215 - protein, 89 aa, Glycine max
  Coding DNA Sequence Number=SeqID_45437
  Subcellular localization annotation: CTP_CleavageSite=59; ConfidenceScore=5.63e-01
MPMKSLWIAFTIMLVLSSQLCLVRSRVLRSKVALTKVASDCVKLKGSGSSLWTTKSFVVSNSDNSSTPVSKRSLAFRLASGPSKKGPGH

SEQ ID NO: 162216 - protein, 338 aa, Glycine max
  Coding DNA Sequence Number=SeqID_45438
  Gene Ontology: Mol. function=structural constituent of ribosome; Cellular component=intracellular; Biological process=translation
  Homolog annotation: Hit_ID=Q9FN19; Match level="QueryCoverage=100%, HitCoverage=87%, E-value=3e-84, Identity=35%"; Hit description =Arabidopsis thaliana genomic DNA, chromosome 5, TAC clone:K8K14
  Pfam annotation: Domain name=WD40; Domain location=134-172; Score =46.5; E_value=9.2e-11; Accession=PF00400.22; Description=WD domain, G-beta repeat
  Pfam annotation: Domain name=WD40; Domain location=193-242; Score =17.9; E_value=0.036; Accession=PF00400.22; Description=WD domain, G -beta repeat
  Pfam annotation: Domain name=WD40; Domain location=245-283; Score =37.2; E_value=5.8e-08; Accession=PF00400.22; Description=WD domain, G-beta repeat
  Pfam annotation: Domain name=WD40; Domain location=287-324; Score =11.2; E_value=1.8; Accession=PF00400.22; Description=WD domain, G -beta repeat
  Pfam module annotation: Pfam domain module=WD40::WD40::WD40::WD40; Domain location=134-172::193-242::245-283::287-324
MDEDFSFLQPLDLITKGPSELHNIVKARKENLRQHKFESNKIINDLSQDDPRREETEKERKEKENEHTLEKIRLEKDKEPPKPEYKEIQHTDQNHTEKPEDKITVENLENRAQGGAEPMEISQSPMSSPDDTPCGYVKLLKGHTSEVFACAWNPSAPLLASGSGDSTARIWKIADGACDSSVQNEPVNVVVLQHFKESTNEKSKDVTTLDWNLISFAMIFITKGDGTLLATGSYDGQARIWSRDGELNCTLNKHRGPIFSLKWNKKGDYLLSGSVDKTAIVWNIKTVEWKQLFEFHTGPTLDVDWRNNVSFATCSTDKMIHVCKIGENRPIKTFSGHQ

SEQ ID NO: 162217 - protein, 93 aa, Glycine max
  Coding DNA Sequence Number=SeqID_45439
MNLRGRQVEISDPMCPLCNNSEEVAAHLFFNCSKVFPLWWESLSWVNSVGAFSKEQKDHFMQHSRRNATQTKDIRWSYWWIALTRTIWKHRNK

SEQ ID NO: 162218 - protein, 64 aa, Glycine max
  Coding DNA Sequence Number=SeqID_45440
VDCEGCQGMAEDLGAIAEDLERVINLRMVTEGTDLYDIMTHCLRRARGDATDESLRPHQRRCMD

SEQ ID NO: 162219 - protein, 256 aa, Glycine max
  Coding DNA Sequence Number=SeqID_45441
  Homolog annotation: Hit_ID=Q47522; Match level="QueryCoverage=14%, HitCoverage=45%, E-value=7e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRLLDFPFPLKDRDVVIKGKMSKNADGSISIKNNAIKNNYPEQPDVIRLTRYEGYADPAGAIPLSFVNMFVQQQPYQMLMKMKKEVNNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 162220 - protein, 69 aa, Glycine max
  Coding DNA Sequence Number=SeqID_45442
MGDLEEVQEQMKADMSALKEQMASMMDAMLGMKQLMESNAATATAVSSTTEADPTLLTAAHHPIPNMVV

SEQ ID NO: 162221 - protein, 86 aa, Glycine max
  Coding DNA Sequence Number=SeqID_45443
  Gene Ontology: Cellular component=cytoskeleton; Biological process =multicellular organismal development
  Homolog annotation: Hit_ID=Q7EYK0; Match level="QueryCoverage=44%, HitCoverage=6%, E-value=3e-11, Identity=79%"; Hit description =Putative WD-40 repeat protein family
MEPYRPWYQQSQSAASTSKCLIRLNNKALGCGTREYQFIPKKNAESCGRFLDHRATSQSTSASADNFREELAWRRKPGGVKQEDEE

SEQ ID NO: 162222 - protein, 370 aa, Glycine max
  Coding DNA Sequence Number=SeqID_45444
  Gene Ontology: Mol. function=kinase activity; Cellular component =nucleus; Biological process=regulation of progression through cell cycle
  Homolog annotation: Hit_ID=Q39877; Match level="QueryCoverage=88%, HitCoverage=89%, E-value=1e-113, Identity=68%"; Hit description =Mitotic cyclin a1-type
  Pfam annotation: Domain name=Cyclin_C; Domain location=281-370; Score= 36.6; E_value=8.4e-08; Accession=PF02984.9; Description=Cyclin, C -terminal domain
  Pfam annotation: Domain name=Cyclin_N; Domain location=152-279; Score= 201.2; E_value=2.5e-57; Accession=PF00134.13; Description=Cyclin, N -terminal domain
  Pfam module annotation: Pfam domain module=Cyclin_C::Cyclin_N; Domain location=281-370::152-279
MDDSSYDNIFSHSPNQDFNSISFSFYLFQINNTQKEEDGDYVAAKRKTNAATVVIVEKQHPKRKHVVLGELPNLLNVIVPTAQNPHKEKLQCQKNPNRISHLPQTTPFLHPRSMNLMFPTSSSIFMQWSENENRKQPENENNKFSCSVFSVENRNHISDMQRKRRPMIDYMDKVQKQVTTTMRTILVDWLVEVAEEYKLLSDTLHLSVSYIDRFLSVNPVSKSRLQLLGVSSMLIAAKYEEVDPPRVDPFCNITDNTYHKAEVVKMEADMLTTLKFEMGNPTVNTFLRRFANVASENQKTPNLQIEFLVGYLAELSLLDYDCLRFSPSIMAASVIFLARFIIWPEVHPWLIEKNVSSSCMTCICQERQPP

SEQ ID NO: 162223 - protein, 323 aa, Glycine max
  Coding DNA Sequence Number=SeqID_45445
  Gene Ontology: Mol. function=kinase activity; Cellular component =nucleus; Biological process=regulation of progression through cell cycle
  Homolog annotation: Hit_ID=Q39877; Match level="QueryCoverage=96%, HitCoverage=93%, E-value=1e-126, Identity=73%"; Hit description =Mitotic cyclin a1-type
  Pfam annotation: Domain name=Cyclin_C; Domain location=192-323; Score= 108.2; E_value=2.4e-29; Accession=PF02984.9; Description=Cyclin, C -terminal domain
  Pfam annotation: Domain name=Cyclin_N; Domain location=85-190; Score =108.9; E_value=1.5e-29; Accession=PF00134.13; Description=Cyclin, N -terminal domain
  Pfam module annotation: Pfam domain module=Cyclin_C::Cyclin_N; Domain location=192-323::85-190
METRAAAKRKANAATIVFVEKQYPNKRQRVVLGELPNLQNLIVSETQNSRKEKLLCRKNPNEKKPSPTNNNTFPSPQINESYDSDIHGYLREMEMQNKRRPMVDYIEKVQKIVTPTMRAILVDWLVEVAVEYKLLSDTLHLSVSYIDRKYEEMDPPGVDEFCSITDHTYDKTEVVKMEADILKSLKFEMGNPTVSTFLRRYADVASNDQKTPNLQIDFLGSYIGELSLLDYDCLRFLPSIVAASVIFLAKFIICPEVHPWTLKVENPLQTSSLCECSGYKPAELKECVLILHDLYLSRKAASFKAVRAKYKQQKVVVFAFLLL

SEQ ID NO: 162224 - protein, 122 aa, Glycine max
  Coding DNA Sequence Number=SeqID_45446
  Subcellular localization annotation: CTP_CleavageSite=44; ConfidenceScore=5.57e-01
MSSKIISTAFHKMTLFKTSNPPNSNYFTSRMNYATLTSSYGVILQMHAIARLTNLFSCIQDCVLCFLHGLNDNYERQLNIGMCPDPAALAIQTQTLPINFLSQALPNNGRTNHTVQHMLDQA

SEQ ID NO: 162225 - protein, 420 aa, Glycine max
  Coding DNA Sequence Number=SeqID_45447
  Gene Ontology: Mol. function=zinc ion binding
  Homolog annotation: Hit_ID=Q2HRJ4; Match level="QueryCoverage=87%, HitCoverage=86%, E-value=6e-84, Identity=47%"; Hit description=Zinc finger, RING-type
  Pfam annotation: Domain name=zf-C3HC4; Domain location=354-402; Score= 10.6; E_value=0.013; Accession=PF00097.15; Description=Zinc finger, C3HC4 type (RING finger)
MLPTKSATCTKRNQLNSTCRNNIERKIISEIVAYNIVSITLRYGYYGDSCILLGPASSRLMKTSSVFVKQLQVSNKDNNQVILHAFNEKPELSSQTNWTVSNLCLVEAYKSKGSTIRMGWEAHTTSSLDQLHGMVIKGLSQEPSYFAGEKKFKLPQAKQTSFPNAMALHKIVNGKEAEYKVEEDNMYHMGVLNMNARNIILNMKVNVSAKVYDTTKGKKMCSTANGSCRLSFVFPNTQYVIFTAPGKGDGGSYVEISFLARVLTYILLLGALMIVVYLILKFLGVYDGGDRNSRVTVDATYRTSDVVARQTETEPLMQVETNRWTYGTNAKDDEEEDSGASSSSSEELYDEKLCCICYDEQRNSFFVPCGHCATCYDCAERRFTLEAFCRIVDGESKVCPICRRLIHKGNQLLWLGQSSS

SEQ ID NO: 162226 - protein, 509 aa, Glycine max
  Coding DNA Sequence Number=SeqID_45448
  Gene Ontology: Mol. function=transporter activity; Cellular component= integral to membrane; Biological process=iron ion transport
  Homolog annotation: Hit_ID=Q9C6B2; Match level="QueryCoverage=85%, HitCoverage=83%, E-value=0.0, Identity=80%"; Hit description=Metal transporter Nramp2
  Pfam annotation: Domain name=Borrelia_P13; Domain location=241-404; Score=-69.1; E_value=0.086; Accession=PF05628.3; Description =Borrelia membrane protein P13
  Pfam annotation: Domain name=Nramp; Domain location=83-446; Score =717.2; E_value=1.1e-212; Accession=PF01566.9; Description=Natural resistance-associated macrophage protein
  Pfam module annotation: Pfam domain module=Borrelia_P13::Nramp; Domain location=241-404::83-446
MSAPSREEESKEEERDEEANRLLEEEEEAESSSEEGEKILVADLEFDRVDDGSVPPPFSWKKLWLFTGPGFLMSIAFLDPGNLEGDLQAGAIAGYSLLWLLMWATFMGLLIQLLSARVGVATGRHLAELCRDEYPNWARLVLWFMAELALIGADIQEVIGSAIAIQILSRGFFPLWAGVLITASDCFFFLFLENYGVRKLEAAFAVLIAVMGLSFAWMFGDAQPNRKELLMGILVPRLSSKTIRQAVGVVGCVIMPHNVFLHSALVQSRKVDPKKIGRVQEALNYYSIESAAALAVSFMINLFVTTVFAKGFYGTKQADSIGLVNAGQYLEEKYGGGVFPILYIWGIGLLAAGQSSTITGTYAGQFIMGGFLNLRLKKWLRALITRSFAIVPTIIVAIVFNKSEGSLDVLNEWLNVLQSMQIPFALIPLLTLVSKEKIMGTFRVGPVLELEISISLVKNGSVTLSSLAARVNLLIKSRVIERIKMYVGYSTTIYAYFLGKNRNRSAVIY

SEQ ID NO: 162227 - protein, 441 aa, Glycine max
  Coding DNA Sequence Number=SeqID_45449
  Gene Ontology: Mol. function=protein kinase activity; Cellular component=membrane; Biological process=protein amino acid phosphorylation
  Homolog annotation: Hit_ID=Q7CKA9; Match level="QueryCoverage=64%, HitCoverage=77%, E-value=1e-105, Identity=65%"; Hit description =Putative solute-binding periplasmic protein of ABC transporter
  Pfam annotation: Domain name=Peripla_BP_1; Domain location=116-390; Score=-54.3; E_value=0.0049; Accession=PF00532.11; Description =Periplasmic binding proteins and sugar b
HGGAVPAKRQAANIQGNTRGINEYELSFRQRMNENVEAKMAIAKRALDFISPESSRPLQRAAVSAPSAWVENILTVMKISTASSQSSRYGNFRSIRSFFPAAVWAMTVIYAKAADKIRMGIVVKIGGIPWFNAMEAGIKSEAAKRGIDAWMVGPTAADPALQVRAIEDLIAQKVDIIGVVPNDPKVLEPVLKRAREAGIMVITHESPGQKDANWDFELVDAPTHGINHMKALAKCMHEEGKYAMYVGSLTVPLHQEWTDAALNYQKQHYPKMQLVTDKFGVGESLDDSIRTTNELMSKYPDLKGIMAFGSQGPIGAGRAVMNRNKIDQVCVIGAFSPGQGASLVQRGAIKGGYIWNPQTAGEVFVRIADMMEKKEPITDGMTIEGLGKVKVDEATHTILGHSTDADCARQPVENIWWQPRTERYLADPAGRRSALSRWHQR

SEQ ID NO: 162228 - protein, 75 aa, Glycine max
  Coding DNA Sequence Number=SeqID_45450
DHAHKTPSGPEEVQQGPRVSSSDYEPLLVLRSARRPQQGNRRTATTSRVHLSSSTKAEALPTTRGQPAGDQVQNQ

SEQ ID NO: 162229 - protein, 127 aa, Glycine max
  Coding DNA Sequence Number=SeqID_45451
  Homolog annotation: Hit_ID=P17583; Match level="QueryCoverage=82%, HitCoverage=27%, E-value=2e-08, Identity=33%"; Hit description =Cyanate transport protein cynX
MGYEPTCQYVNAGCTGTGRAEHAPAADLGQSAAGPAAPQPASVRAGRLAAAGGADCDDGRGGAVQRQADAARGLKALTAGRVDAIAAGTGGARRDRQRQRAGAQRAVCWHRRRRGADGDAGTDSTAF

SEQ ID NO: 162230 - protein, 212 aa, Glycine max
  Coding DNA Sequence Number=SeqID_45452
VVSNSLTFERLSPVINWAYIRKNYWNPEDLTVSIRGARRARARPVELPSTSVIPTLASTSAASSVPTQTDSQRFEAMLQSIHQGQITLLQRSIPSVEQFREMVAWPRTQPSLHKEDEGPTAQVPQHVEDESSEATIPEPFVIGEEAEPPAPVVDLPSPQCTTDPSTPIVQTPEDPTTPDLAMDTSPPATPVLHLTNEKDVQTHDTQDQSQEF

SEQ ID NO: 162231 - protein, 81 aa, Glycine max
  Coding DNA Sequence Number=SeqID_45453
  Homolog annotation: Hit_ID=Q1SAS4; Match level="QueryCoverage=98%, HitCoverage=3%, E-value=2e-18, Identity=44%"; Hit description=RNase H, putative
MVEQENREVKPHQEETEVVSLGDGEERKEVKVVIGMSTNIRDELVALLRDYQDIFAWSYQDMPGLSPDIVQNCEGSSSRCP

SEQ ID NO: 162232 - protein, 237 aa, Glycine max
  Coding DNA Sequence Number=SeqID_45454
  Gene Ontology: Mol. function=carboxypeptidase activity; Cellular component=cytoplasm; Biological process=cytoskeleton organization and biogenesis
  Homolog annotation: Hit_ID=Q1S5P6; Match level="QueryCoverage=67%, HitCoverage=27%, E-value=1e-38, Identity=49%"; Hit description =Ankyrin
MELRDIVAIDEPLQNENPVIDMINDAFGNNRHYNVCPNMYEEASEFVDTMPNEVNEEISYLLRDGTKELYERCRKYSKLFFLLRLYNIKCLCGMTNKAMTMILESLKDAFEYGKIPTSFYKAKKVIYKLGLNYTKIDVCPKNCMLYWGEDENLEICKHYRKSRWKTKSTNGKKNLPAKVLRYFSLQPRLQSASNSIQLTSLGVHEAIFLVSASNSIQPTSLGVHEAIFFDSFYGHSS

SEQ ID NO: 162233 - protein, 101 aa, Glycine max
  Coding DNA Sequence Number=SeqID_45455
MVYHVDDEVNKGWSVVVHMMPRELYDMGEVGEDITFEITPPKPKCPTKVALTQQLHFPPHMAHTQQPYIPSPMAPIQQPYILSLMALTHQPYIPSPMPPTQ

SEQ ID NO: 162234 - protein, 216 aa, Glycine max
  Coding DNA Sequence Number=SeqID_45456
MWLKWVSELHTRGSGGGDVRTSPCVRRSYSDGSSLPTPTIAGQEWVRDDVLKYKSSLTSTTSVATLQRQVLGLILSLTAFQCALLEHLNVTPSQLHPNSWAMVSLNDMSKKLFKFDSNIFPYFKDYFFKVLATGVVVDGLPLMFNRDGEPCFHSTGSLTLPDVRAILSLPSASDPLIALNGKVPNLALFNPLVKQVGLAGGIVLPSTIVGERGHSS

SEQ ID NO: 162235 - protein, 70 aa, Glycine max
  Coding DNA Sequence Number=SeqID_45457
METDPMSANGIGVPSPFMTDISKTGFKDIKDLGSYDMCCDAPESRIQMEIIPDKLEEDKPFKEEVDMACD

SEQ ID NO: 162236 - protein, 92 aa, Glycine max
  Coding DNA Sequence Number=SeqID_45458
MTEVDGIYDNQEGLGCEYTSQPTTSETSRPDLLSGPHVPAKIISGLKAVDFRQPEVLLVNKVDEFEVRKRPLEALANMGLNGEYNLKELMTL

SEQ ID NO: 162237 - protein, 184 aa, Glycine max
  Coding DNA Sequence Number=SeqID_45459
MTMGYTYEAMDKEDKTIMKYFENASRYMDVFQIIDKRCDVQLHHPLHAANHFLNLEFFYDNPRMAFDGEDSNCCFNAERNCPKLTEIDECNEWLLGEIDEDGDDEDRVSEEEDDDLNWRHISIVLRILASLDIVGQEGTSQRASKKDKGGASLTRKGKMVKVKEVLEDNTSEEGKLEANLSKED

SEQ ID NO: 162238 - protein, 67 aa, Glycine max
  Coding DNA Sequence Number=SeqID_45460
MKPDHGKIFYIGCPNNRCRMSEILHRSLMQFYPARVLGRRLQVDWARDPREGPRVLMSLRVDFEPMG

SEQ ID NO: 162239 - protein, 203 aa, Glycine max
  Coding DNA Sequence Number=SeqID_45461
  Gene Ontology: Mol. function=CTP synthase activity; Biological process=pyrimidine nucleotide biosynthetic process
  Homolog annotation: Hit_ID=Q1T018; Match level="QueryCoverage=25%, HitCoverage=8%, E-value=5e-15, Identity=80%"; Hit description=Zinc finger, DHHC-type
  Pfam annotation: Domain name=CTP_synth_N; Domain location=1-166; Score=-217.2; E_value=0.026; Accession=PF06418.4; Description=CTP synthase N-terminus
MQEVSLSLLGEEVVSHITDAIKDWIEGVVIPVDGKEGPADVCVIELGGTEEAVSGFEPMTNKSPRHNFTAAPGLTLLVRYKTVCMEVYGRIVGDQNVVSSTQGTRSKRKMKNSGRQCIPVSLVWLIVECGVGIAVLVGCFVHKKGTENQIAEKLGAGFSRVPFAIIVGITTYDYVWENYLSLEGCFCSGIENFPLSGKLTLLN

SEQ ID NO: 162240 - protein, 222 aa, Glycine max
  Coding DNA Sequence Number=SeqID_45462
MRLVRQEALISALKLEMPHEIVLWRRGQVEVHVLTAFSGKDKLFDHIAPFEGHNIAWMKSCYKGSLLILGLSMRAFSEVSPATMQGSSGTTRSSLTTKGDNQVEWRHAPTVHSSRGFLCLWEEGKFQLLDCVRILYILNLKRKVGDRVWCIIEDFNPILNSDERVGSSDSSQRRYREMVEFNAFIDHMEVVELPSVGRKFTWVTAAGGAMSRLNRALVSFEW

SEQ ID NO: 162241 - protein, 224 aa, Glycine max
  Coding DNA Sequence Number=SeqID_45463
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=71%, HitCoverage=80%, E-value=7e-21, Identity=40%"; Hit description =Ethylene-responsive element binding protein 1
  Pfam annotation: Domain name=AP2; Domain location=64-129; Score =133.2; E_value=7.1e-37; Accession=PF00847.10; Description=AP2 domain
MTNDVSCVQSYELEHDSHTLMNVSDHPNNNPFQNPTHIDDVIQLFACDTEAPLAAREVYAPRKWKRFRGVRRRPWGKFAAEIWDPKKKNGRVWLGTYETEEEAGLAYDRACFKMRGSKAKLNFPHLIGSHAPPERVSVVAARKPNSPEPCFLPSPPPVTEDSSQPQGLKKRRNLADLLNRLAKNRSQIVLYSVMSNSALCICNSVSPIVLSISALEILLLAFVL

SEQ ID NO: 162242 - protein, 166 aa, Glycine max
  Coding DNA Sequence Number=SeqID_45464
MAERGKLDHIEERLRAIEGGEDHAFADLAELYLVPIVVIPPKFKVSNFNKYKGTTFPKNHLKDLMVAFVRQYQYNSDMALDRMQLQNMCKKGHESFKEYAQGWRNMAAQVAPPMTEREMITMIVDTLPVFYYEKMVGYTPSSFADLVFTGERINVGLKRGKLSGIL

SEQ ID NO: 162243 - protein, 384 aa, Glycine max
  Coding DNA Sequence Number=SeqID_45465
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=84%, E-value=1e-108, Identity=35%"; Hit description =Leucine-rich repeat
  Pfam annotation: Domain name=LRR_1; Domain location=116-139; Score =8.2; E_value=8.3; Accession=PF00560.23; Description=Leucine Rich Repeat
  Pfam annotation: Domain name=LRR_1; Domain location=141-163; Score =0.7; E_value=2.1e+02; Accession=PF00560.23; Description=Leucine Rich Repeat
  Pfam annotation: Domain name=LRR_1; Domain location=15-37; Score=0.6; E_value=2.2e+02; Accession=PF00560.23; Description=Leucine Rich Repeat
  Pfam annotation: Domain name=LRR_1; Domain location=189-211; Score =5.2; E_value=31; Accession=PF00560.23; Description=Leucine Rich Repeat
  Pfam annotation: Domain name=LRR_1; Domain location=214-236; Score =8.3; E_value=8; Accession=PF00560.23; Description=Leucine Rich Repeat
  Pfam annotation: Domain name=LRR_1; Domain location=238-261; Score =9.4; E_value=4.9; Accession=PF00560.23; Description=Leucine Rich Repeat
  Pfam annotation: Domain name=LRR_1; Domain location=287-308; Score =12.6; E_value=1.3; Accession=PF00560.23; Description=Leucine Rich Repeat
  Pfam annotation: Domain name=LRR_1; Domain location=311-333; Score =9.7; E_value=4.5; Accession=PF00560.23; Description=Leucine Rich Repeat
  Pfam annotation: Domain name=LRR_1; Domain location=335-357; Score =10.5; E_value=3.2; Accession=PF00560.23; Description=Leucine Rich Repeat
  Pfam annotation: Domain name=LRR_1; Domain location=359-382; Score =12.7; E_value=1.2; Accession=PF00560.23; Description=Leucine Rich Repeat
  Pfam annotation: Domain name=LRR_1; Domain location=44-66; Score=1.6; E_value=1.4e+02; Accession=PF00560.23; Description=Leucine Rich Repeat
  Pfam annotation: Domain name=LRR_1; Domain location=68-90; Score =12.3; E_value=1.4; Accession=PF00560.23; Description=Leucine Rich Repeat
  Pfam annotation: Domain name=LRR_1; Domain location=92-114; Score =10.4; E_value=3.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=116-139::141-163::15-37::189-211::214-236::238 -261::287-308::311-333::...
  Pfam module annotation: Domain location=335-357::359-382::44-66::68 -90::92-114
QLEGNIPTSLGNVCNLRVIRLSYLKLNQQVNELLEILAPCISHGLTRLAVQSSQLSGNLTDHIGAFENIVLLDFSNNSIGGALPRSFGKLSSLRFLNLSINKFSGNPFESLGSLSKLSSLYIDGNLFHGVVKEDDLANLTSLTEFGASGNNFTLKVGPNWRPNFRLSYLDVTSWQLSPNFPSWIQSQNKLQYVGLSNTGILDSIPTWFWETPSQILYLNLSYNHIHGEIETTLKNPISIQTIDLSSNHLCGKLPYLSSDVFQLDLSSNSFSESMNDFLCKHQDGPVQLEFLNLASNNLSGEIPDCWMNWTSLVYVNLQSNHFVGNLPQSMGSLADLQSLQIRNNTLSGIFPTSLKKNNQLISLDLGENNLSGSIPTWVGEKLLN

SEQ ID NO: 162244 - protein, 240 aa, Glycine max
  Coding DNA Sequence Number=SeqID_45466
  Gene Ontology: Mol. function=transcription regulator activity; Cellular component=nucleus; Biological process=regulation of transcription
  Homolog annotation: Hit_ID=Q1SGR4; Match level="QueryCoverage=65%, HitCoverage=78%, E-value=8e-43, Identity=61%"; Hit description =Prefoldin; Helix-loop-helix DNA-binding
  Pfam annotation: Domain name=HLH; Domain location=74-131; Score=11.0; E_value=0.0098; Accession=PF00010.16; Description=Helix-loop-helix DNA-binding domain
MVSRENTNWLFDYGLIDDIPVPDATFGVNSSAFTWPPNALDAPSNVGESADKDKKCGRNESDEVDEVRSESCAASSSKACREKLRRDRLNDKYTVYFQIPTTSPVFLLSLPAKTDKTAILIDAVRMVTQLRGEAQKLKDTNQGLQEKIKDLKAEKNELRDQKQRLKAEKEKLEQQLKSLNGQPSFMPPPAAIPAAFAVQGQAHGNKLVPFISYPGVAMWQFMPPAAVDTSQDHVLRPPVA

SEQ ID NO: 162245 - protein, 96 aa, Glycine max
  Coding DNA Sequence Number=SeqID_45467
MVLSTTPKEPRFASQSRTHCLRASSTAREVLRPHHPYLMRGATLTKQMIGSFIAKSTSYTLAVTCKVTLEKETCTHAKRAAQAWREYASPSPLQQL

SEQ ID NO: 162246 - protein, 108 aa, Glycine max
  Coding DNA Sequence Number=SeqID_45468
  Gene Ontology: Mol. function=protein disulfide oxidoreductase activity; Biological process=cell redox homeostasis
  Homolog annotation: Hit_ID=Q1SGR2; Match level="QueryCoverage=70%, HitCoverage=61%, E-value=3e-32, Identity=85%"; Hit description =Thioredoxin domain 2
  Pfam annotation: Domain name=Thioredoxin; Domain location=12-97; Score=-17.0; E_value=0.004; Accession=PF00085.10; Description =Thioredoxin
MKGQQQLKKSKVVKIDSRKSWEHHITNATNKGYPVMVHFSAYWCMPSITMNPFFEELASTYQSVLFLNVDVDEVKVIYLYNLWWEGHPSSFGVYIKLLLLIGRTCNAI

SEQ ID NO: 162247 - protein, 115 aa, Glycine max
  Coding DNA Sequence Number=SeqID_45469
MNNTSFQGLENQKTSESFWYKEEEEVQRDSRLQKFTNNSIKFPLPYSDSKLLQSRMGGHRGLNVLPKKRWSDKRFVATMEQLKREETRKREAELCLDRLRVAQGLALSISIFFPS

SEQ ID NO: 162248 - protein, 78 aa, Glycine max
  Coding DNA Sequence Number=SeqID_45470
  Gene Ontology: Mol. function=oxidoreductase activity; Cellular component=membrane; Biological process=fatty acid biosynthetic process
  Homolog annotation: Hit_ID=Q2XFW1; Match level="QueryCoverage=98%, HitCoverage=31%, E-value=7e-31, Identity=82%"; Hit description =Oxidoreductase, short-chain dehydrogenase/reductase family
MARDLGPRGITVNNVQPGPVDTEMNPDAGEFAEQLKQLMAIGRYGKDEEIAGFVAYLAGPQAGYITGASLSIDGGFSA

SEQ ID NO: 162249 - protein, 59 aa, Glycine max
  Coding DNA Sequence Number=SeqID_45471
MVTFKYERLGTFSFVCGILGHNDKSCETLLKKKQRRKEGIDGGWWLWNNISSVESGSAA

SEQ ID NO: 162250 - protein, 41 aa, Glycine max
  Coding DNA Sequence Number=SeqID_45472
MLKLANCYLCPARHNWSSMSVHDSHLMTVLHIALDQVLNVQ

SEQ ID NO: 162251 - protein, 45 aa, Glycine max
  Coding DNA Sequence Number=SeqID_45473
MVALEGMSMTSLRQVSKVTTKVVADYGGHGRVKGESEMCGDCYKA

SEQ ID NO: 162252 - protein, 87 aa, Glycine max
  Coding DNA Sequence Number=SeqID_45474
DSTIPTATDSDDNQDNLECLKRVRSLYQPLSVILPLAAVSDNDDDSVDNLETVRAIMKRFSTYGEVNGFEWVILNRYGEEGLFPMKA

SEQ ID NO: 162253 - protein, 137 aa, Glycine max
  Coding DNA Sequence Number=SeqID_45475
  Homolog annotation: Hit_ID=Q9M4Y9; Match level="QueryCoverage=52%, HitCoverage=27%, E-value=2e-08, Identity=41%"; Hit description=AP2 -related transcription factor
MNPHALNINMNTLDDIELPITTSFNDASALVPPTTAMFGWNSNFRNVFLVENWAELPLKEDNVEDMVIYGVLHEAATTGWLPANANGVSNVGITVKMETKSQNSDNSVARGTHAPPRRGLSYRGLRRRPWEKYAVER

SEQ ID NO: 162254 - protein, 70 aa, Glycine max
  Coding DNA Sequence Number=SeqID_45476
  Gene Ontology: Mol. function=structural constituent of ribosome; Cellular component=ribonucleoprotein complex; Biological process =translation
  Homolog annotation: Hit_ID=Q2QD65; Match level="QueryCoverage=92%, HitCoverage=65%, E-value=2e-24, Identity=76%"; Hit description =Ribosomal protein S12
  Pfam annotation: Domain name=Ribosomal_S12; Domain location=1-70; Score=39.9; E_value=8.8e-09; Accession=PF00164.15; Description =Ribosomal protein S12
GDLSVNFSTITPIKPNSALRKVARVRLTSGFEITAYIPGGRVKDLPGVRYHIVRGTLDAVGVKDRQQGRS

SEQ ID NO: 162255 - protein, 375 aa, Glycine max
  Coding DNA Sequence Number=SeqID_45477
  Gene Ontology: Mol. function=phosphoric monoester hydrolase activity; Cellular component=integral to membrane; Biological process =dephosphorylation
  Homolog annotation: Hit_ID=Q2QT46; Match level="QueryCoverage=99%, HitCoverage=57%, E-value=1e-118, Identity=59%"; Hit description=PTEN, putative, expressed
AYSWLKEDIENVVVVHCKAGMARTGLMISSLLVFLKFFPTAEESMDYYNQKRCVDGKGLVLPSQIRYVKYFERVLTYFNGENPPARRGFRLLRCPYWIRPSITVSDHSGMLAILYEGFLCDLSFHNLQPEDFWFSAPKKGVMVFALPGEPGLTELAGDFKIHFHDRQGDFYCWLNTTMTENRKVLNTSDLDGFDKRKLPSPGFMVEVVLVDYNGNDVTSKTETTTKKSDESSSNNPASSAPVERSTTPAQNADKESDSHDKDDVFSDGEAEQSASSRSKQTKAPSEAVETVTNDTRISESNRVSNEIANLSHATEQVSLGNKSSTPIRHASEPGSNVDGKTVSSLEVPSAESEFKAMAADASVFTFGDDEDYESD

SEQ ID NO: 162256 - protein, 500 aa, Glycine max
  Coding DNA Sequence Number=SeqID_45478
  Gene Ontology: Mol. function=oxidoreductase activity; Cellular component=viral capsid; Biological process=lignin catabolic process
  Homolog annotation: Hit_ID=Q9C9A4; Match level="QueryCoverage=99%, HitCoverage=85%, E-value=0.0, Identity=68%"; Hit description=Spore coat protein-like protein; 24980-21957
  Pfam annotation: Domain name=Cu-oxidase; Domain location=155-309; Score=0.3; E_value=0.0002; Accession=PF00394.12; Description =Multicopper oxidase
  Pfam annotation: Domain name=Cu-oxidase_2; Domain location=344-499; Score=22.9; E_value=3.3e-06; Accession=PF07731.4; Description =Multicopper oxidase
  Pfam annotation: Domain name=Cu-oxidase_3; Domain location=1-142; Score=-4.6; E_value=3e-05; Accession=PF07732.5; Description =Multicopper oxidase
  Pfam module annotation: Pfam domain module=Cu-oxidase::Cu-oxidase _2::Cu-oxidase_3; Domain location=155-309::344-499::1-142
DLAPATVYAFGTTKHTATVPGPTIEAIYGVDTHVRWQNHLPPKHILPWDPTIPTAMTNSTRGIPTVVHLHGGIHAPESDGNANAWFTSKYNERGPTWTKKTYHYPNNQQPGNLWYHDHAMGLTRVNLLAGLLGAYIIRHPQIEDPLGLPSGDEFDRTLIVFDRSFRTDGSIFMSSTGNNPKIHPQWQPEYFGDAIIVNGKAWPRLTVRRRKYRFRIINASNARFFRFFFTNGLRFTHVASDSAYIEKPVTTNETLVGPSEITDIVVDFSQSKSNLAILANDAKYPYPAGDPVNEANGKVIKFIIVPDQEVDTSRVPKRLLEYPVVDLSSVAHTRYVAMYEYASDIDEPTHLYLNAKPYEAAATETPKVGSTEVWYVINLTEDNHPLHIHLGLFKVLDQTALVKPDDEFRECMKKINDAVKCHVDKYARGKKEEVPAHERGWKNVFKMIPGHVTKIAVRFSYIHTNASYVFDATTEPGYVYHCHVLDHEDNAMMRPLKIIK

SEQ ID NO: 162257 - protein, 201 aa, Glycine max
  Coding DNA Sequence Number=SeqID_45479
  Gene Ontology: Mol. function=phosphoric monoester hydrolase activity; Biological process=dephosphorylation
  Homolog annotation: Hit_ID=Q06H25; Match level="QueryCoverage=81%, HitCoverage=98%, E-value=8e-55, Identity=67%"; Hit description =Tyrosine phosphatase
MDSVPADVSNSHPINEPSNSPPAEETDRQASASVASRQDNSPHEASPRLSPTGISSWAKNLKISQPFSGNQDDSSSGNVGKSTFSRITSNFGLRLSPKSPVADDSSNETAGQSNLFGTITKGLVDSSKNAVKAVQEGGFDLDMTYITENIIAMGFPAGDMSSGFFGYVEGFYRNHMEEVIKFFETHHKLYIEGQPLEAPVR

SEQ ID NO: 162258 - protein, 407 aa, Glycine max
  Coding DNA Sequence Number=SeqID_45480
  Homolog annotation: Hit_ID=Q2QXS5; Match level="QueryCoverage=18%, HitCoverage=10%, E-value=4e-24, Identity=75%"; Hit description=Heavy metal-associated domain containing protein, expressed
  Pfam annotation: Domain name=HMA; Domain location=16-76; Score=52.0; E_value=2e-12; Accession=PF00403.16; Description=Heavy-metal -associated domain
MTKEEDFKLLKIQTCVLKVNIHCDGCKQKVKKLLQRIEGVYQVQIDAEQQKVTVSGSVDSATLIKKLVRAGKHAELWSQKINQNQKQKNNNAKDDKNKGQKQALVKGLEAFKNQQKFPAFSSEEDEYYYDDEDDEEDEDEEMRFLREKANQLQMLKQQTANANNVRKGMGAIAAGANNGKTNNGDNANSGKKGGPNHQNMGMKDSPNGGLDQKTMAALKFNNGHLGGDGLNLNLGEAKRANDIGAMMNLAGFNGNNCANNVGSATVLGGNNNSNGLGGFPVQSNNNMIPGSAAAFSNGGLSGGQYPSSLLMNMNGFNNHPSPSPLMMNMNMQQARQAMQQQPQMMYHRSPFVPPNTGYYYNHSSYSPAHYSYSYGLPSYPAAAGGGDDHSAAHMFSDDNTSSSCSIM

SEQ ID NO: 162259 - protein, 85 aa, Glycine max
  Coding DNA Sequence Number=SeqID_45481
  Homolog annotation: Hit_ID=Q9C9A4; Match level="QueryCoverage=54%, HitCoverage=7%, E-value=1e-08, Identity=57%"; Hit description=Spore coat protein-like protein; 24980-21957
MDTRTLLLKLLITLVALSGCSSSASDHLVNVSKLEKFVDELPHMPKILGYHLSDGVPKSKSLKIGMFKKKWRAMPSSFYAGFDDC

SEQ ID NO: 162260 - protein, 610 aa, Glycine max
  Coding DNA Sequence Number=SeqID_45482
  Gene Ontology: Mol. function=actin binding; Cellular component =cytoskeleton; Biological process=sensory perception of sound
  Homolog annotation: Hit_ID=Q9LV35; Match level="QueryCoverage=98%, HitCoverage=99%, E-value=0.0, Identity=70%"; Hit description=WD40 -repeat protein
  Pfam annotation: Domain name=WD40; Domain location=135-174; Score =24.2; E_value=0.00045; Accession=PF00400.22; Description=WD domain, G-beta repeat
  Pfam annotation: Domain name=WD40; Domain location=178-216; Score =31.7; E_value=2.5e-06; Accession=PF00400.22; Description=WD domain, G-beta repeat
  Pfam annotation: Domain name=WD40; Domain location=223-261; Score =40.0; E_value=8.2e-09; Accession=PF00400.22; Description=WD domain, G-beta repeat
  Pfam annotation: Domain name=WD40; Domain location=315-354; Score =8.7; E_value=3.5; Accession=PF00400.22; Description=WD domain, G -beta repeat
  Pfam annotation: Domain name=WD40; Domain location=439-476; Score =10.4; E_value=2.2; Accession=PF00400.22; Description=WD domain, G -beta repeat
  Pfam annotation: Domain name=WD40; Domain location=47-85; Score=25.2; E_value=0.00024; Accession=PF00400.22; Description=WD domain, G-beta repeat
  Pfam annotation: Domain name=WD40; Domain location=482-520; Score =20.9; E_value=0.0045; Accession=PF00400.22; Description=WD domain, G- beta repeat
  Pfam annotation: Domain name=WD40; Domain location=525-563; Score =30.8; E_value=4.8e-06; Accession=PF00400.22; Description=WD domain, G-beta repeat
  Pfam annotation: Domain name=WD40; Domain location=569-606; Score =23.5; E_value=0.00078; Accession=PF00400.22; Description=WD domain, G-beta repeat
  Pfam module annotation: Pfam domain module=WD40::WD40::WD40::WD40::WD4 0::WD40::WD40::WD40::WD40; Domain location=135-174::178-216::223 -261::315-354::439-476::47-85::482-520::525-563::569-606
MATLSETYACAPSTERGRGILISGDAKTNNILYCTGRSVIIRNLDNPLQVWVYCEHAYPVTVARYSPNGEWVASADISGTVRIWGTHNEFVLKNEFRVLSGRIDDLQWSFDGMRIVACGDGKGKSFVRAFMWDSGSTVGDFDGHSRRVLSCAFKPTRPFRIATCGEDFLANFYDGPPFKFNMSIRDHSNFVNCVRFSPDGSKFITVSSDRKGIIYDGKTGNKLGELSTEDGHKGSIYAVSWSPDSKQVLTVSADKSAKVWNVVEDGSSGTVNKTLACTESGGVEDMLVGCLWQNDYLLTISLGGTIYLYSAKDLDKSPLSLSGHMKNITVLTLLNRSEKMLLSSSYDGVIIRWIPGMGYSGKFEGKQFGLIKLLVAGQDEVIAAGFDNKVYRVPLHGDNFGPAETVDVGSQPKDVTLALNNPEFAIVAIESGVVLLNGSKIVSTINLGFIVTAAAMSPDGSEAIVGGQDGKLHMYSVSGDTVTEQAVLEKHRGAITVIRYSPDFSMFASADLNREAVVWDRASKEVKLNNMLFNTARINCLAWSPDSTLVATGSLDTCVIIYEVGKPASSRRTIKGAHIGGVYGLVFIDQERVVSSGEDGCVRVWNLISE

SEQ ID NO: 162261 - protein, 78 aa, Glycine max
  Coding DNA Sequence Number=SeqID_45483
MSVLTQKHEYLALSSRALNQQVFNYLQSYTLSIRVCPKDAYPLLSIDRLVNGAFGFQVLSFLDAYSGYNQIQMHAQDE

SEQ ID NO: 162262 - protein, 61 aa, Glycine max
  Coding DNA Sequence Number=SeqID_45484
MANFLAEFARNNQTTSNWWSLYVDNAPNMKGSQARIILEGPNDVTLEHAIKLNFKASNNQP

SEQ ID NO: 162263 - protein, 95 aa, Glycine max
  Coding DNA Sequence Number=SeqID_45485
MSPEWVWARTASGMPMWLTLGVTRTNMSWGMSTGDLEEGMHRQDSRQIGHGPVICEDRSFEDSNNEGLIIDFDREVSQTINKEEEEDVLSPDWRG

SEQ ID NO: 162264 - protein, 136 aa, Glycine max
  Coding DNA Sequence Number=SeqID_45486
  Subcellular localization annotation: CTP_CleavageSite=85; ConfidenceScore=5.55e-01
MKMNMNVGVLISGQITLMAQSNSLRLGFPSLITTLCMAQGTSTVPAPIPSAPVPATSGPSTQSTDLMMVAWLGVQPSSNGGGEVFAAQESQPDPETTTAAQEDDSKATPPESFVHHAGAENPARITSRHACAAFDR

SEQ ID NO: 162265 - protein, 76 aa, Glycine max
  Coding DNA Sequence Number=SeqID_45487
MQIAGQKTLFSTTCVNGSPSSGSWSTVTDTDCWIKQIAMNKLNTKFKVMKCQNGRVARKIILKNEGHDQNSQIDVG

SEQ ID NO: 162266 - protein, 60 aa, Glycine max
  Coding DNA Sequence Number=SeqID_45488
MARSVFAPCPYLRDLQGREQTRHLAITPQGIILFEEHIAAVGTTSNNKFSKRKALDEGSL

SEQ ID NO: 162267 - protein, 83 aa, Glycine max
  Coding DNA Sequence Number=SeqID_45489
  Subcellular localization annotation: CTP_CleavageSite=66; ConfidenceScore=5.37e-01
MLPMVASLFLTHLLLKVASWTLWAQHVSTAKCSFSGLSVTRESGRAQESRPRAKREISSLSKVLVYGQAERTAGGKLKPTYSR

SEQ ID NO: 162268 - protein, 656 aa, Glycine max
  Coding DNA Sequence Number=SeqID_45490
  Homolog annotation: Hit_ID=Q010S1; Match level="QueryCoverage=58%, HitCoverage=56%, E-value=3e-31, Identity=28%"; Hit description=[S] KOG2477 Uncharacterized conserved protein
  Pfam annotation: Domain name=CwfJ_C_1; Domain location=599-656; Score= -25.0; E_value=0.0005; Accession=PF04677.5; Description=Protein similar to CwfJ C-terminus 1
MKSSKRRRLNETHDRIRRSLRFRLLLISSLPENTAALVQSRNLENAFRGEIHFPGPGEYSYRSCILVHDEDLDSVSKERKKSDRRREKNKRKRRSSRDSSDDDDDGLEKIKKGSRKKKWYSSDEDSLIYTTESESEKDEKKRRRRAKKKRDDGSSRDSGERSKGRSRSRSGKKEYTSEDEEDSYSSDGSDSFSGLKGKHQKSDRKDGSKRNKIEGGTVNSTSEMEIARKEMGLDWMLRSESKKPVVTESEEKLSEEVPVEESKKANPKELNPYLKDNGSGYPEESGAKVGADQLLSSSLVGDGGASWRLKALKRAQEQAARDGRRFNEVVEERWSSLGELTAAVASHAAAPARAHLRAIKNRQRGITEENSQDSDKHGRRDSKRDYLKDVSVRHHEMKAPKVRDSLSWGKRKSQQVVAEGAGVISAAVSSLNKFANDGSFMHDFGSKMSNNSDGSVLDSSELEKVSLEANRPEESSAVVKNEMSENQLAAKVMQLRLKGKHEEADKLMQEAKVMNTKQGNQDHSIRSRTEGSSSRYAMQKISAEQKKGEDDADMHLARKIMHNKQFRASTQADDEYDFEDGPSRKSRKKQGGDDHKSIQKKTNRFLTQQERCLFCLENPNRPMHLVVSIANFTYLMLPKWQPVVPGHCCILPIQVT

SEQ ID NO: 162269 - protein, 84 aa, Glycine max
  Coding DNA Sequence Number=SeqID_45491
  Homolog annotation: Hit_ID=Q9LIR4; Match level="QueryCoverage=65%, HitCoverage=9%, E-value=2e-14, Identity=67%"; Hit description =Dihydroxy-acid dehydratase
MNHTCITDEELRFLKGVALVPHRGDANLRLGHVVLGETHTMEHGLGSALGLGLRDAEVVLVELHWLLHGGGDVNKERERERERE

SEQ ID NO: 162270 - protein, 121 aa, Glycine max
  Coding DNA Sequence Number=SeqID_45492
  Subcellular localization annotation: CTP_CleavageSite=43; ConfidenceScore=5.16e-01
MDSPLPPKPLHPSSPTPPLFFSLGLFLNGGLVHHGCSWVIVMHVALVGGKVMVGLEVVFGCKNGAEVVMEVVFVAVEVGCDGHGDLGQRWSWKFAWEREKKKDKKGILGILGAHQATIRMI

SEQ ID NO: 162271 - protein, 186 aa, Glycine max
  Coding DNA Sequence Number=SeqID_45493
  Gene Ontology: Mol. function=heat shock protein binding; Biological process=protein folding
  Homolog annotation: Hit_ID=Q1SZB3; Match level="QueryCoverage=75%, HitCoverage=33%, E-value=4e-49, Identity=67%"; Hit description=Heat shock protein DnaJ, N-terminal
  Pfam annotation: Domain name=TPR_1; Domain location=106-139; Score =17.2; E_value=0.047; Accession=PF00515.18; Description =Tetratricopeptide repeat
MSVTKANLLKVKVLIADKEYESAIAESGFLLKEDENNLEALLLCGCAYYYLADHDIATRKAHFGLKNLPKKSKSVEDNANKGKLCVVVEEFKASLAVDPIHLAHNVDLHFGLCKVLVKYGRGKDALDSCSEALKIDEELVEALVQVHYNLKHHCAFVLVSTFNYRRLQEDWVKDAREDPRVLMSHR

SEQ ID NO: 162272 - protein, 100 aa, Glycine max
  Coding DNA Sequence Number=SeqID_45494
  Pfam annotation: Domain name=L15; Domain location=43-74; Score=24.7; E_value=0.00033; Accession=PF00256.13; Description=Ribosomal protein L15
MWIEVKGKFIEYNGLNSNTLHKVPLKLLSLNLTSPRSFSRSVEILGEGDLSKKLTLKARAFSTSVKEKLENASCSLTEDFRLGTYIKYINITLHKLNNFL

SEQ ID NO: 162273 - protein, 175 aa, Glycine max
  Coding DNA Sequence Number=SeqID_45495
MCYKREIKIEAQTSEKNRKLDTDLQLPTASEVLGLLHHFQPGRKNAETITPVNHMYTLNCEFHTCSSEILLSCASSPDTDIGSAATNASNCRRNQEYEKGLTVRFYIKPINFVQDQEQVILFLLFRDISPKVENFPNRKALPKIGRMPLEVTSTRYSLVKGERIVRSVLITRLRE

SEQ ID NO: 162274 - protein, 681 aa, Glycine max
  Coding DNA Sequence Number=SeqID_45496
  Gene Ontology: Mol. function=RNA binding; Cellular component =spliceosome; Biological process=protein modification process
  Homolog annotation: Hit_ID=Q1SIS0; Match level="QueryCoverage=97%, HitCoverage=83%, E-value=0.0, Identity=74%"; Hit description =SWAP/Surp; Ubiquitin
  Pfam annotation: Domain name=Extensin_2; Domain location=399-671; Score=-142.2; E_value=0.097; Accession=PF04554.4; Description =Extensin-like region
  Pfam annotation: Domain name=Surp; Domain location=71-115; Score =66.1; E_value=1.2e-16; Accession=PF01805.10; Description=Surp module
  Pfam annotation: Domain name=ubiquitin; Domain location=607-676; Score=38.5; E_value=2.4e-08; Accession=PF00240.13; Description =Ubiquitin family
  Pfam module annotation: Pfam domain module=Extensin_2::Surp::ubiquitin ; Domain location=399-671::71-115::607-676
NQSSGQQPPPQPADSAVPESAPDSNNGVAAAEKPDVSAQFKPVRKVLDPPEAEQYTVRLPEGITGEELDIIKLTAQFVARNGKSFLTGLTSREVNNPQFHFLKPTHSMFTFFTSLADAYSKVLMPPKGLTEKLKKSVSDMTTVLERCVNRLEWERSQEQARQKAEDEIEQERIQMAMIDWHDFVVVETIDFADDEDEELPPPMTIEEVIRRSKVTAMEEDIVEPGKEVEMEMDVEEAQLVEEGMRAASLEDRDDGKQNEVRVTEDPEPPMRIVKNWKRPEERISAERDSTKFVVSPITGELIPISEMSEHMRISLIDPKYKEQKERMFAKIRETTLAADDEISRNIVGLARTRPDIFGTTEEEVSNAVKAEIEKINDEQPKQVIWDGHTGSIGRTANQAMSQNIGSEDQNDASNNEAKNLLGPAAPPPRPGMPSVRPLPLPPGLALNLPRVPVQYSAPHSGALPMPPPRSMMPSIRPALPPPMPMNTGQQSIIAGQPPPMHPSIPMNNHGIPIPPPPGSQFTPVPVPRPYVPLSVPPSVMPMMHPPPLPQGLPPPPPPEEAPPPLPEEPEPKRQKLDDSALIPEDQFLAQHPGPVRISVSVPNVDEGNLKGQVLEITVQSLSETVGSLKEKIAGEIQLPANKQKLSGKPGFLKDNMSLAHYNVGGGETLTLTLRERGGRKR

SEQ ID NO: 162275 - protein, 224 aa, Glycine max
  Coding DNA Sequence Number=SeqID_45497
  Homolog annotation: Hit_ID=Q1SIS0; Match level="QueryCoverage=27%, HitCoverage=8%, E-value=3e-18, Identity=70%"; Hit description =SWAP/Surp; Ubiquitin
MSHKENKNAIEFLDEQAFYYDEEDEQWFKEKDDQWTKNIPCYKEDAAKVVLNSIDFDFDMQDLDEFLKVLGTEDSSPERVPDPVVPVTPPISGRVQVPSPPRVHAPTPQRIYTFVDLVSATFAPTARVLASQESPEETFNGIAFGQGQEAGSLPILPLPAPPSDGNLGPLPESQVIEEEQNKSNSASVPAPATVVTHTRTIGIIHPPPDIRTIVDKTSQFVAKN

SEQ ID NO: 162276 - protein, 348 aa, Glycine max
  Coding DNA Sequence Number=SeqID_45498
  Gene Ontology: Mol. function=GTP binding; Cellular component =intracellular; Biological process=RNA-dependent DNA replication
  Homolog annotation: Hit_ID=Q5QN81; Match level="QueryCoverage=83%, HitCoverage=81%, E-value=2e-76, Identity=33%"; Hit description =Pentatricopeptide (PPR) repeat-containing protein-like
  Pfam annotation: Domain name=PPR; Domain location=127-160; Score=4.5; E_value=2.2; Accession=PF01535.11; Description=PPR repeat
  Pfam annotation: Domain name=PPR; Domain location=161-195; Score =23.4; E_value=0.00083; Accession=PF01535.11; Description=PPR repeat
  Pfam annotation: Domain name=PPR; Domain location=196-230; Score =30.2; E_value=7.2e-06; Accession=PF01535.11; Description=PPR repeat
  Pfam annotation: Domain name=PPR; Domain location=231-265; Score =22.8; E_value=0.0012; Accession=PF01535.11; Description=PPR repeat
  Pfam annotation: Domain name=PPR; Domain location=266-300; Score =46.6; E_value=8.2e-11; Accession=PF01535.11; Description=PPR repeat
  Pfam annotation: Domain name=PPR; Domain location=301-335; Score=8.6; E_value=0.72; Accession=PF01535.11; Description=PPR repeat
  Pfam module annotation: Pfam domain module=PPR::PPR::PPR::PPR::PPR::PP R; Domain location=127-160::161-195::196-230::231-265::266-300::301 -335
MAFLWSSKRFTTPNLLSLPKYSSASLPPSIFDHHHSIPTQIPNGPSETHKFAFHTAQPRPTPDAEAICRILSTTRGFTVDASLAAVSAKPSPELVLEVLNRLSNAGVLALSFFRWAEKQSEFKYTTEAFHALIEGLGKIRQFKMIWTLVNGMKQRKLLTSETFALVARRYARARKAKEAIETFEKMEQYGLKPHASDFNRLVDVLCKSKCVEEAHEVFDKMRHLRLDPDIKSYTILLEGWSQQQNLIKVNEVCREMEDKGFQLDVVAYGIIMNAYCKAKKFDDAIGLYHEMKAKGLRPSPHVYCTLIKGLGSHKRLDEALEFLKYQKLVVLHRRLPLTMLLLGLIAGL

SEQ ID NO: 162277 - protein, 139 aa, Glycine max
  Coding DNA Sequence Number=SeqID_45499
MPHVSLNLVFSSSPLKTLSFSCIPPNLFQKNNDLRLIHHWIVVKFKHKVRNSILSSLIVGNYEKVSELREILFTLEKDALHIGPWNGGFNSFSFSLTFRNPNRATGGEDLESTRNATIDNGERLSDYIKVRDELFTIGD

SEQ ID NO: 162278 - protein, 95 aa, Glycine max
  Coding DNA Sequence Number=SeqID_45500
MGEVIEEQNRDIQLNPQRLTPSTAKSPYWHLPEGRVPPECDTWCGLQALESGADWVGSALHAGAKGRALHAGALTRGLPRGALFRALAPGTSRRP

SEQ ID NO: 162279 - protein, 266 aa, Glycine max
  Coding DNA Sequence Number=SeqID_45501
  Gene Ontology: Mol. function=acetylglucosaminyltransferase activity; Cellular component=membrane; Biological process=electron transport
  Homolog annotation: Hit_ID=Q9ARU3; Match level="QueryCoverage=91%, HitCoverage=57%, E-value=7e-91, Identity=62%"; Hit description =Putative xylosyltransferase I
  Pfam annotation: Domain name=Branch; Domain location=1-145; Score =19.6; E_value=2.5e-09; Accession=PF02485.11; Description=Core-2I -Branching enzyme
MDGVRDITNGTCPRPTVKKTHVYLSHVFSSVSRDLNFIDHTGDLGWKESDRFQPIVVDPGLYLARKSQIFQATEKRPTPDAFKLFTGKSFLSCHLCSPWVILSRPFLEFCIFGWDNLPRTLLMYFTNVKLSQEGYFHSVVCNVPEFKNTTVNGDLRYMIWDNPPKMEPHFLNASVYNQMAESGAAFARQFQLNNPVLDMIDEKILQRGRHRVTPGAWCTGRRSWWVDPCSQWGDVNTVKPGPQAKKLEGSVSNLLDDQNSQTNQCQ

SEQ ID NO: 162280 - protein, 172 aa, Glycine max
  Coding DNA Sequence Number=SeqID_45502
MPQKCSLRCHWDISTVVEVERIDIGEPENTGIKSGSKRSFDHLNELPINTSPDAKNEVEEHQDIDIHDLFGSETPEDDHNVEEKDNVGFDMNVPHTDDEIADVDDSGDEVDKGPNAAEALEDQVNALGRDEQTSTSSSSSGSSSSESGSESGSGSSSNSDSEGSDEDSVHSI

SEQ ID NO: 162281 - protein, 353 aa, Glycine max
  Coding DNA Sequence Number=SeqID_45503
  Gene Ontology: Mol. function=transcription factor activity; Cellular component=nucleus; Biological process=regulation of transcription, DNA-dependent
  Homolog annotation: Hit_ID=Q8GWK2; Match level="QueryCoverage=95%, HitCoverage=81%, E-value=1e-86, Identity=50%"; Hit description =Putative AP2 domain transcription factor
  Pfam annotation: Domain name=AP2; Domain location=16-84; Score=95.7; E_value=1.4e-25; Accession=PF00847.10; Description=AP2 domain
MNMKSYIEDVKGMFRSQVLEGKHRWTGRYEAHLWDKSTWNQNQNKKGKQGAYDDEEAAARAYDLAALRYWGPSALINFPVTDYARDLEEMQNVSREEYLASLRRKSSGFSRGLSKYRGLSSRWNPTYGRMAGSDYFNSRYYGEDSAAETKYLSSFCIERKIDLTSYIKWWGSNKSQQPDSRVRFSDVRKHGFAGDFCIEHKTLEQNVHPSEPYQLLALGMPCERIKHEHSSVSALSIVLQSAAYKNLQQRASTRQENSNYNDENENKDTIINKLDHGKAAEKSLNNDGGNERLDIAMGMSGSLPLQRNVYPPASLLIAPLLTAYNTVDPSVDPVLWTPQVPILSAGLSGVAEV

SEQ ID NO: 162282 - protein, 163 aa, Glycine max
  Coding DNA Sequence Number=SeqID_45504
MGKSRDKPMSIVALYAASEGKKVVNIDYNMDLIGSSLVPIRKFNGPPSWMSLGEEIDHVILSEYWDMIQKSNHAELDSTISMLIRAVEDSFNNALKQVEFMHPKVHPTHLGASGIVNEYFVGHETPDEEMAYGFIDTLDANFDDKISRTSNANADLRDLKGPI

SEQ ID NO: 162283 - protein, 99 aa, Glycine max
  Coding DNA Sequence Number=SeqID_45505
MQVLCMVCIFYLHFYLSHLSIHVLSSLLFEGILGLVSFLKMSSQKISLKGSFGRGALSHSRNPKNSPIASDRGGGGRNFWDNEDATERGIELCPRRHLN

SEQ ID NO: 162284 - protein, 146 aa, Glycine max
  Coding DNA Sequence Number=SeqID_45506
MMHKKGKKCVLISKRGRKNVKSIKKPSVGNRDSYKNKDKMWRGVERHVSTLIGAKVENIEQFVFQNSSNVKYLTKDHDKEAQISNQAYEDKESRRSGAKNGARAVIYRSRHTTKIDTQNGTDQSTNKKIKGIINECRLQYRRLLRR

SEQ ID NO: 162285 - protein, 38 aa, Glycine max
  Coding DNA Sequence Number=SeqID_45507
MKNELLVAAQTNILPQTCKMGDSIAKQAHVVGIPILLY

SEQ ID NO: 162286 - protein, 62 aa, Glycine max
  Coding DNA Sequence Number=SeqID_45508
MEGGVWYRICAQTGFVADLGVAFVDDWMFLADRVVGTVVTTWVPPSFLFSPFAPGFLFIKAG

SEQ ID NO: 162287 - protein, 88 aa, Glycine max
  Coding DNA Sequence Number=SeqID_45509
MLPDYLVPAKYHITPVEQQPMEAEKEASFTQGKRKLSDFEPDILIGVSDSGKSRNMLLEEHDRHIKDRLFRAMKIEAFVHLLNDLQAE

SEQ ID NO: 162288 - protein, 150 aa, Glycine max
  Coding DNA Sequence Number=SeqID_45510
  Gene Ontology: Mol. function=helicase activity
  Homolog annotation: Hit_ID=Q5PMR9; Match level="QueryCoverage=76%, HitCoverage=84%, E-value=1e-46, Identity=66%"; Hit description =Putative ATP-dependent RNA helicase-like protein
MQEFNKTKVSNDTSEPPQPERMTKEEGEDHFSVLMNSVTPVWYWRAQRRCSDLNSAVYKYYDNIKKRCLNGEKVSYSDLDVLNLRQCFREFSLEAYPELVALVWPEYARPEVNPDNDFMERFFENAMYASRWILAPVYFGLSLALIALSI

SEQ ID NO: 162289 - protein, 99 aa, Glycine max
  Coding DNA Sequence Number=SeqID_45511
MAGDASKFIHISPKDSEYVIYGDNKQRIIKQGCFQDYFNKHSKVKHCFKIKTRLLQQISIASRFIQDQLFPQNTLFPTYQGSSNRLPEDKFANQLLKRV

SEQ ID NO: 162290 - protein, 119 aa, Glycine max
  Coding DNA Sequence Number=SeqID_45512
MESTKEVVMILHEIRRPNSLKTVPSGVTNCRNLPFDGRATWGSRVRLPREEGARSRHQCLFEENVGKIGKVWSTNFECERRQEGGGCRPTSPGELSSPKRAGLLLPKGTIFCWNPLEGP

SEQ ID NO: 162291 - protein, 190 aa, Glycine max
  Coding DNA Sequence Number=SeqID_45513
MHKALRLNAPLPYPQLVTLFFRHFQIPLDSEPYVPIKRSFLIGAAMIASFGYHKERDGSWVKKGVPPADDEGHIPVEDNSTLLQRLMDKFDAMELQVDMRFDAMESRITRVEEDVSFIRTCFDPPPPPPHPLRLYFFLMLPKGERTWENTYGYCHHQKRGDCRQRIKLNVLMMPKDYMNHMLLKDLLKTK

SEQ ID NO: 162292 - protein, 113 aa, Glycine max
  Coding DNA Sequence Number=SeqID_45514
CPYQTRARARVLSEVEEVQEQIKADMEAMKEKMATMMEANISMKEIMEVNVAALLRDGPHDVQIQNKHAFPPYGLPPNCTPPNVAYTPSENVNNSTPIPIESQQPQIDHAHVS

SEQ ID NO: 162293 - protein, 331 aa, Glycine max
  Coding DNA Sequence Number=SeqID_45515
  Homolog annotation: Hit_ID=Q1S7C5; Match level="QueryCoverage=25%, HitCoverage=7%, E-value=2e-09, Identity=37%"; Hit description =Integrase, catalytic region
MRAVSLEGKSIDEYLCKIKGYVNELTGVGVPVHHEYVDMILEGLSFDYTLMISVIESKKHTLSIAEIETLLYGHETHIVCYNKETQALSSPFLNYTQGYSHPNSYKSGDSGGSRGAYGRGSGGRGGFLDRGAGRSGGAFAEVEVVADLPIFSVKSALSMTTLQMFVTSGLIRSQFQACCSSIKSTNAMLTNSSSHGNGHPSSTWIPDSCASFHVIGESQNIKQFTHFDGLDQIFVGNGEASRQPSLLLSTSTSTSDNYLSNVAPVVNKNVSVASNSVISSPSNASLWHARLLLLMLYGKVSDCLIDCYLTPLLLFNLLWNLSTQIHLDISY

SEQ ID NO: 162294 - protein, 241 aa, Glycine max
  Coding DNA Sequence Number=SeqID_45516
  Homolog annotation: Hit_ID=Q1SRN1; Match level="QueryCoverage=66%, HitCoverage=10%, E-value=5e-07, Identity=24%"; Hit description =Integrase, catalytic region
MVKSLSEQSDNAPAEMCVQNLFGMEKQGVYRSMARRLATLRPLTCRSSNSEYNGVVTSQKDHWRMVAVDEKGAASRRVYWNAENKGKNHQLLHFIQDLQIPKGFATIAYQDVGRVTKAYRAWEQQDQLMLSWLQSIISALILFIRCTSSWFLWDVDLLFFDKVRGNEREIGEKTDIIHSEKSVTELVIKRIVSNGYSTLAVTIKNKNSEGSLQFYHQDIKFGPRKMAAPEVEEVIHETRYK

SEQ ID NO: 162295 - protein, 597 aa, Glycine max
  Coding DNA Sequence Number=SeqID_45517
  Gene Ontology: Cellular component=spindle pole body
  Homolog annotation: Hit_ID=Q5JK69; Match level="QueryCoverage=77%, HitCoverage=43%, E-value=2e-63, Identity=33%"; Hit description =Nodulin-like
MLDLYYFRIREVSQIKKPGISQDLLACAYELWGLLPSFCRHATDTHQHFTRLSDVLVTFLKKDPSMHQNVSTALQILVNENKAALIPKKSMEDCHAEYDFLSEFGMQPTYSKKAATKNIKSLVSCSNQLLYVLSDLFISSLPETRFCLKGAIGCLASVTDSSVTKEVFVSLLKSFQFVDCEGEGEILTSPAGVVDSDQNDLKGYSQRCLILELAYCLVQGAKDNLIEIIYNFTIHSFQATDESVHHEAYNTLCKILEENPCLSSARYIELIDLLHGLKPPTSIASLRSRYACFHMLMVHAVKVSLEEEENSKAFLILNEIILTLKDGKDETRKEAYDYLLNISSTLRDSSFIGSIEPYHKLVSMIMGYLSGSSPHIKSGAVSALSVLLYKDTNLPISVSDLVPSLLSLLQTKDVEIIKVTVIFEILLRKCGSAAVKLVTPEKYKVFLKTVLENRHGKSSEAVTNDTKNMPEDSSAKRPERRKPENSDNLEKNSLKDNKRKRDKKFETDMPGQKGSLMSTSNDGLRLPKRSRYSNDKNPNVGRPEESEKGKKSWNKSFTGGGGKRKVKVTSTGKDKAASHVPIQPSKSHKLQRKFKRN

SEQ ID NO: 162296 - protein, 440 aa, Glycine max
  Coding DNA Sequence Number=SeqID_45518
  Homolog annotation: Hit_ID=Q5JK69; Match level="QueryCoverage=91%, HitCoverage=33%, E-value=2e-36, Identity=28%"; Hit description =Nodulin-like
MEDEHTEPFKDGADLCQQLMDRYANSAAPQHRHLLATAAALRSNLAVERLPLTPPAYFAAAISALDAAEAALDPVALSALVSFMAIALPLVPPGGIAALKSHEAAAILIVALAREGEGVGVACVRAMVKCLGVLIGFCDLEDWDGIRLGFETLLKFSICKRPKVRRCAQESVEKVFKSIKSSTVTKEASKFVLSELKSCSALALKLNALSTSDECKEDKVLKHEHLEVLHLLNLINLIAPYLSAEVILKVLSEVRKLFSFKFSELARHALKTIKAIFEALRIQNIVLETEDIVVSLASFVSLGDRNPLDTVIFAAKLLGVAMDLLYNGQSNLWIKNLPPVCRSVMGLLAFEGNTASQASSILNDVLKHHVGSLSLLMGTDQTFHDNCRETVEANAIKATCAVFENALSASDGIPNDHVIWTEQGCHVLVEVAQPQFNQLT

SEQ ID NO: 162297 - protein, 244 aa, Glycine max
  Coding DNA Sequence Number=SeqID_45519
  Gene Ontology: Mol. function=nucleic acid binding; Biological process= DNA integration
MQNCDDKKENEEEKSVGLKKKVVEEKGIDGRKNDVRGENNQEKEKQIMVNKKELNDQEKEKEVEKEKENKKIEKDEKNENEKKSRSEMVVNEAAEVPYYMVPSKKEKDHHLVRFLDIFMKLEITTPFEEALQQMPLYSKFLKDMLTRIHKYIHQENIVVEGNSSAVIQKILPPKHKDPRSVTIPCSIGEVTMGKALIDLGANINLMPLSMCRRLGELEIMPIKMTLQLADHSITRPYGVIEDVL

SEQ ID NO: 162298 - protein, 154 aa, Glycine max
  Coding DNA Sequence Number=SeqID_45520
MFLSLVITLDQQRGTGAASCECAQINNSKEPREWREMANMMQNVAAPPKIFFHTVHARDQIFGEVNKLSAQIIPKMTLYTIKCQVLSPSRFISLSRKLLVAVWTFQVTCIIFLKTKVKLICTWRTLQNASLCSIIGGRHLKLELYGNIYAKPCP

SEQ ID NO: 162299 - protein, 179 aa, Glycine max
  Coding DNA Sequence Number=SeqID_45521
  Homolog annotation: Hit_ID=Q014K3; Match level="QueryCoverage=73%, HitCoverage=49%, E-value=2e-29, Identity=50%"; Hit description =Homology to unknown gene
  Subcellular localization annotation: CTP_CleavageSite=42; ConfidenceScore=5.14e-01
MFLESTILDLPDMKPAVSCPHSLLDYAHNLQPSLSRRSVTAVQSTPFSRWGDLVFFQNGMMEPWLESKGLEDANQVLAYFVVSKIGETPIDGRTDTNPERLIAAYGKWASIVAARLNVGGLSCKVLDKEVFQKQMLEKRIWICSVMLVGATHGGVSVGAVDIEFHTEVSFAIDIFSKIK

SEQ ID NO: 162300 - protein, 68 aa, Glycine max
  Coding DNA Sequence Number=SeqID_45522
MGTSITLSEFNHCSFDYGLTRDETFTLLTSPKAFCLGNAIQCHGSNFSSYDRSDGRSLNRDDSNNEGS

SEQ ID NO: 162301 - protein, 72 aa, Glycine max
  Coding DNA Sequence Number=SeqID_45523
PPLAASLVGIEDLRLHSLVPPSRVIGRVIGREDNRDLDDVFQRRRPTTSARRQQEVIVVAKDAPHGDDTAEE

SEQ ID NO: 162302 - protein, 119 aa, Glycine max
  Coding DNA Sequence Number=SeqID_45524
MGVGNGHVNVNGCSKKVETCHALRFKLNGIKTREKIGGIYVFRAVLAWERDTESEREREIPPTQRQGRNAATKGMQHRVPAPPPPTMAEHHCYFCCLHQPQIRKGGGGVDEKKQHFNGS

SEQ ID NO: 162303 - protein, 104 aa, Glycine max
  Coding DNA Sequence Number=SeqID_45525
MGNSQTSIQDRMGLLQEPINRLYDVLGEYFTPTTIHRLAGLVTVMARTSSNIPTEIRSDEGIVSTELTEAALAFAASSPVTAAAIPAIQSHTPASQLQGNAISV

SEQ ID NO: 162304 - protein, 108 aa, Glycine max
  Coding DNA Sequence Number=SeqID_45526
MKAFSFSGVWILLFLSSVSAFSPTGSIRHPVKFIIGEEEENLGSWKSEFTQVAPAPGPKGDDVLILAANKTNRPDILRGFRRYRGGWDIADQHYWAVSATVTSLTIVF

SEQ ID NO: 162305 - protein, 70 aa, Glycine max
  Coding DNA Sequence Number=SeqID_45527
MTPVIVQSNERLGVLIRKTKDTKEGGQKGLFLAFSRPAFGSPGPSNNFKGKEPARLGELMTSGLSLCSLG

SEQ ID NO: 162306 - protein, 114 aa, Glycine max
  Coding DNA Sequence Number=SeqID_45528
MQVVAPPGTILIVEQFMEKVAWLGTQPSLVKEGRGLSAQVPQQVQDASSEATIPEPFVFEAGGTLVGQEAATPERSPQISPDPPSPVDPATPVLGLTTTSSATPVLHFTDKEGT

SEQ ID NO: 162307 - protein, 98 aa, Glycine max
  Coding DNA Sequence Number=SeqID_45529
MDRARLVMGLVTHMDMNIGALISALITALCRARGVTSDSMTYQSLSLAINLAYIRKKCWNVDDLTVNFRGARKARARPADVPSSSTPPAPPGPSAQDF

SEQ ID NO: 162308 - protein, 205 aa, Glycine max
  Coding DNA Sequence Number=SeqID_45530
MLEHKPMHEFLLRIKCIVDVLGLYGDLVLPCEHLDTVLESLPEEYSLVIIVIKSYISSSNSYNSSLNNSNSQNQSNYYGNRGVFNRGGGYSCGSNDFGLGRGRHGGSRGRRCYANFQCQVYFKLGYITVVCHFCYDSNFQPNASLTLMEPVFQRNSSITFGLELNQGTNSHKDFQLVQCWLIMKIKILTLLPGYLILVLLVHPST

SEQ ID NO: 162309 - protein, 123 aa, Glycine max
  Coding DNA Sequence Number=SeqID_45531
MIICKVLYIDANLKEELARKECQIERVRWIQVEPNRRSIYKHLHVRSLSRRYLKRCMMQAPLDLVGLGSSSSMDSFASWKMNGSGMEKGREREETPLQGEDESRRSSPPQEAMDKSLEEEGDE

SEQ ID NO: 162310 - protein, 78 aa, Glycine max
  Coding DNA Sequence Number=SeqID_45532
  Homolog annotation: Hit_ID=Q1SAU7; Match level="QueryCoverage=81%, HitCoverage=7%, E-value=1e-07, Identity=43%"; Hit description=Paired amphipathic helix
  Pfam annotation: Domain name=PAH; Domain location=19-56; Score=22.9; E_value=0.0011; Accession=PF02671.11; Description=Paired amphipathic helix repeat
MCDALVYLKNVNVTFQYEKEKYNIFVDVLRDYNAKRINVESVRDIVKILFKGQFLPKSETVTCQGDVVEWDPELHMSS

SEQ ID NO: 162311 - protein, 192 aa, Glycine max
  Coding DNA Sequence Number=SeqID_45533
  Gene Ontology: Mol. function=DNA binding
  Homolog annotation: Hit_ID=Q1RUD8; Match level="QueryCoverage=97%, HitCoverage=38%, E-value=7e-20, Identity=30%"; Hit description=IMP dehydrogenase/GMP reductase
MIEVSIEAIASLTQYYDQPLRCFTFGDFQLVPIVEEFEGILGCPLGGRKLYLFFGLYPSMARVAKVVKISTQELDRVKQNRNGVDGIPKKHLEEKAKALADQGEWTSFIDVLALLVFGFILFPNVDGLVDLATIDVFLAYHYSKESPAIVVLADAYDMFDQRCEKSSARIDCCTPALYVWLVAHIFHHESRP

SEQ ID NO: 162312 - protein, 159 aa, Glycine max
  Coding DNA Sequence Number=SeqID_45534
  Homolog annotation: Hit_ID=Q1SL48; Match level="QueryCoverage=39%, HitCoverage=50%, E-value=2e-09, Identity=46%"; Hit description=Zinc finger, GRF-type
  Pfam annotation: Domain name=zf-GRF; Domain location=77-123; Score =18.4; E_value=0.00017; Accession=PF06839.3; Description=GRF zinc finger
  Subcellular localization annotation: CTP_CleavageSite=43; ConfidenceScore=5.21e-01
MAKGGLMSFRDFMDMLSKSQPRKLLASSLSPGWFLRGKSLTFKAVEIPTPLLSCLGLKGGDRKTSLLPEARRHWNYSHGKKLLIAPLVTSWTEDNLGRHFYGCVLYKVTGRKGCNYFEWHDPLGNSCEKRIIVALMKKVDELKFRENGMCFLVGVFIMQ

SEQ ID NO: 162313 - protein, 43 aa, Glycine max
  Coding DNA Sequence Number=SeqID_45535
MKPEMSLKIKEEVKKEFDAGFLAVTQYPEWVANIVPVLKKDGK

SEQ ID NO: 162314 - protein, 100 aa, Glycine max
  Coding DNA Sequence Number=SeqID_45536
MTKPPETIQARSDDESCEANKAEDEEDEDTGFSLELERMVTQEDREMKPHREEMEIVNLGVGEERKEVKVGTGMTTLIRDKLVVKTTKTFSLGHTKICPV

SEQ ID NO: 162315 - protein, 65 aa, Glycine max
  Coding DNA Sequence Number=SeqID_45537
MKSQGKCKRPYLLTQICPIPEHNISRCSKLKLKAQGKFNRPYLLTRMSDSGKQYIETLEIEQRKL

SEQ ID NO: 162316 - protein, 95 aa, Glycine max
  Coding DNA Sequence Number=SeqID_45538
  Subcellular localization annotation: CTP_CleavageSite=40; ConfidenceScore=5.50e-01
MATDPTSPPQSGGQSEATSKRSRTTTRLRTLTLRTVDQPRPAVYVDPATGRASGPMREKFHSYLGVVAREKVPIINNNWKDVPETLKEIVWNDIL

SEQ ID NO: 162317 - protein, 199 aa, Glycine max
  Coding DNA Sequence Number=SeqID_45539
  Gene Ontology: Mol. function=transferase activity, transferring hexosyl groups; Cellular component=membrane; Biological process =carbohydrate metabolic process
  Homolog annotation: Hit_ID=Q1T0I6; Match level="QueryCoverage=58%, HitCoverage=18%, E-value=2e-44, Identity=74%"; Hit description =Glycosyl transferase, family 28
MPNSRHLQPSKIKGGDRGSPCLIPLLQSKKTAAEPLTDKESFIHLLQVHHGGAGTTAAGLKAACPTTIVPFFGDQPFWGERVHARGVGPPPIPVDEFSLPKLVDAIKLMLDPKVKERAIELAKAMENEDGVTGAVKAFFKQLPQKKSESDADPQPTGFFSGPIRIEMPWRYSVYNWNDIFESSILTGCVTSHLSHVEVA

SEQ ID NO: 162318 - protein, 225 aa, Glycine max
  Coding DNA Sequence Number=SeqID_45540
MSPNATFEETPFFPSSMQDFNSVQHVLLVLLIHYCLQYMKSLLWTQVKPPLQLALPALLHHLTLLTTTTNKRKPPPPSLSDHRILHWRKPINSYDAIYAMSKLPTVFATYSESHLPCNSMSALFVQQFQLMTTLGGQLLLGKALESSGTWELVPVPPRKKTVGCSWVVSQLQTPHTNHWNAVIRIRRYIKRAPRQGLPYEDTGNTHVSGYCDADWAGSPIGRRST

SEQ ID NO: 162319 - protein, 93 aa, Glycine max
  Coding DNA Sequence Number=SeqID_45541
  Gene Ontology: Mol. function=DNA binding; Biological process=DNA integration
MRKERFPEQRKSKLQPRGDGPFQVLERINDNAYKVELPDGESDLRTNPSQEGENDEDMTKSKGKDPLEGLGGPMMWRPQNNDWFDGRMYQPLL

SEQ ID NO: 162320 - protein, 528 aa, Glycine max
  Coding DNA Sequence Number=SeqID_45542
  Homolog annotation: Hit_ID=UPI00003835BA; Match level="QueryCoverage =36%, HitCoverage=85%, E-value=3e-63, Identity=63%"; Hit description =COG0602: Organic radical activating enzymes
MAKISIDFFNRENQGRVFLEWKGEGRTGGFGAAGRVMQGGRAAASLASAHAGNHPCLPWATSARQALPRQAAGACCHVDLRAHAGQAQVGAVVAVVVRGQDLEDDGGQVLGGGDAVQHHGLVAGHRVQEAAHGGVAFVDQEGVVPDVDDVGLGDALDVGEVHQHAVVGLARGLDDVAGQGDFEHIAVAVQVAALAAVAQAPLRVLHAVLDGLFGVGQAGGAVHGLQEEVVEVQVFEARGQGVGLGVDQLEFVAAFDDDGGGALGADADPVDAGGRLDGAVGFDGDGEAARVDDGQQRFVQLQQRFAAGEDDVAVGGVGTPGGLDGIGEQFGAGEFAAAVAVGADEVGVAEGAGGAGAVALAAGPEITAREPAEDRRAARVGAFALQGLEDFFGGLLEVAHAEAPALDVAVGQAREGLLGDLAVQRHVGVELGDVDLADLLEGQAAVAGQGAQQVARAQLILLAALDAQGHHGRAQRPVGLGAQRLERISSGEHRLRARPFWSPAAAAADAVHVDFGCLGDVDVDDRAQ

SEQ ID NO: 162321 - protein, 168 aa, Glycine max
  Coding DNA Sequence Number=SeqID_45543
  Pfam annotation: Domain name=RRM_1; Domain location=1-73; Score=8.5; E_value=0.024; Accession=PF00076.12; Description=RNA recognition motif. (a.k.a. RRM, R
MVNGFKFPTWVKEKDLWQIFHRWGKVWEVFIPKNKNKEGHRYGFVRFKEVEDETWLERQLDNNIFFGKTKMFVNRPKFERGKIVRRNQKDNSTPDNGKPQGVINYEERVPRTNINGGRLRSYAEVVTMAPPGDSALHNQGADSSQALQAVHRPPAVVTTNMEQNKWIQ

SEQ ID NO: 162322 - protein, 146 aa, Glycine max
  Coding DNA Sequence Number=SeqID_45544
  Gene Ontology: Mol. function=transferase activity, transferring hexosyl groups; Cellular component=membrane; Biological process =carbohydrate metabolic process
  Homolog annotation: Hit_ID=Q1T0I6; Match level="QueryCoverage=82%, HitCoverage=19%, E-value=3e-65, Identity=94%"; Hit description =Glycosyl transferase, family 28
MDFIIYPRPTTEFPHPLSRVKQQAGYRLSYQIVDSLIWLGIRDMINDLRKKKLKLRPVTYLSGSQGSETDVPHAYIWSPHLVPKPKDWGPKIDVVGFCFLDLALNYEPPESLVKWLEEGDKPIYIGFGSLAFKAMMLRMMEVYSFD

SEQ ID NO: 162323 - protein, 352 aa, Glycine max
  Coding DNA Sequence Number=SeqID_45545
  Gene Ontology: Mol. function=DNA binding; Cellular component =cytoplasm; Biological process=DNA integration
  Homolog annotation: Hit_ID=Q1S325; Match level="QueryCoverage=75%, HitCoverage=77%, E-value=6e-70, Identity=41%"; Hit description =Integrase, catalytic region
  Pfam annotation: Domain name=rve; Domain location=207-350; Score =50.2; E_value=6.8e-12; Accession=PF00665.16; Description=Integrase core domain
MSQFEAKFSLRLIFLQLKISSPVSYVSIAQKVMEDEVAVGGGRGGHGAVNITQSWDDGKEIAPKNTKHNVLHDEEFKDFMQFKASQASPSVTIAHTGNSTVCLSQSSPIGPWILDFGAFGHVAGSEYEADNWYGYESRGLYYLQSSPSVACTISESPSLLHCQLGHPSLQKLRKMALKLSHLQSLKCESFQLGKHAHSFFSSSTQSQAHGPLDVIHSDIWGPNRVTSVLSHKHIVTFIDEFSRCTWVLPKERSELFSVFQTFFKEIQNQFDCSIRILQSDNAKEYFSTSNSVMANNGIIHQSSCPHTPQQNNKVPHSVLFPDEPVFRIPPRVFGSTCFVHDLTPGLDKLATR

SEQ ID NO: 162324 - protein, 169 aa, Glycine max
  Coding DNA Sequence Number=SeqID_45546
  Homolog annotation: Hit_ID=Q2R358; Match level="QueryCoverage=53%, HitCoverage=33%, E-value=9e-07, Identity=32%"; Hit description =Expressed protein
MGNYVSCTLAPPLMKNSKATRVIIPTGEVKQFREIVKAAELMLEHPSYFLVNSRSLHIGRRFSALGADEELESGNVYIFFPMRRVNSVVTPTDMAVLFLAANSAAKRLSGGKARVLPDNCDGGAWQHKEESSKDGSLSEIPRLSLEGVESGFQCSLNVAKFKMTTVSVF

SEQ ID NO: 162325 - protein, 161 aa, Glycine max
  Coding DNA Sequence Number=SeqID_45547
  Subcellular localization annotation: CTP_CleavageSite=59; ConfidenceScore=5.02e-01
MVISLDQSPSAESALSSLLLPPLQLSLPQILTHRKQDSQSVRKEKSYSKSRQDHSSATRVSLLAALLLTTDAVSVNVAPSLGHYLVAERRAESTHRRNNQCSTIYGPNDFFPIRESNSLFVGGQGAHSSSTSLGEDCGREPNKVLDQSNGYAAPIICCVCR

SEQ ID NO: 162326 - protein, 45 aa, Glycine max
  Coding DNA Sequence Number=SeqID_45548
MTRCHNEDIDGDKDNKKEDESWEKVSSNLEKVVGVAKGNVKRWKS

SEQ ID NO: 162327 - protein, 201 aa, Glycine max
  Coding DNA Sequence Number=SeqID_45549
  Gene Ontology: Mol. function=acetylglucosaminyltransferase activity; Cellular component=membrane; Biological process=electron transport
  Homolog annotation: Hit_ID=Q0WS14; Match level="QueryCoverage=67%, HitCoverage=52%, E-value=7e-41, Identity=60%"; Hit description =Putative RING zinc finger protein
  Pfam annotation: Domain name=Branch; Domain location=52-198; Score =71.3; E_value=3e-18; Accession=PF02485.11; Description=Core-2I -Branching enzyme
  Subcellular localization annotation: CTP_CleavageSite=57; ConfidenceScore=5.53e-01
MVIPTVTICFLLLFLPLLPLTKPSSSSSSSSATWSSSSLNLTEELEVGVPRLAYMLTATKGEGAQLKRVLQAVYHPRNYYLLHLDLEASDAERLELAKYVKSETVLAAFGNVLVVGKPDLVTYKGPTMIASTLHGIALLLKRAPHWDWLINLSASDYPLLSQDGQSLLFLSMLWAIISFASRLHWFVGFFSSKEEKGHSSA

SEQ ID NO: 162328 - protein, 124 aa, Glycine max
  Coding DNA Sequence Number=SeqID_45550
  Gene Ontology: Mol. function=binding
  Homolog annotation: Hit_ID=Q1SEK1; Match level="QueryCoverage=68%, HitCoverage=27%, E-value=5e-31, Identity=78%"; Hit description =Tetratricopeptide-like helical
MYQEKDESMKSNPDLYFNSATVNKYLENYQRALSGFEAAALKDPGLNAVEEVQKIVNLLDKVDNLLKGHVRAKRMASLASSLVAVDLKSSYRRVTIDLLSEGPNRALAVEGKVFFFVSSESVAP

SEQ ID NO: 162329 - protein, 67 aa, Glycine max
  Coding DNA Sequence Number=SeqID_45551
MESMITMASSGLLDIILSPVEASRIILLCSIIKVMVRAPPQQSFESFPRLKEVCQILGKMSRWQILR

SEQ ID NO: 162330 - protein, 66 aa, Glycine max
  Coding DNA Sequence Number=SeqID_45552
MSNTKDLTSSFKGMLDKKASSSPDTKLGMKYSALLEHALRFLTFLAISIPENAKLFAAPFVPELLD

SEQ ID NO: 162331 - protein, 103 aa, Glycine max
  Coding DNA Sequence Number=SeqID_45553
MKDSILGPMVEVGAFGGFFFSRIQVHGLAFFERTSGEYDLYIEGLGLRVCNLGLVLGFRALAYWLKAKVSLMHLRKANVALTHWLKAKVSLMHWRKAKVALTH

SEQ ID NO: 162332 - protein, 396 aa, Glycine max
  Coding DNA Sequence Number=SeqID_45554
MDAKRFIQLVEEKKKKIMERKEAPLKWEQKLEAAAEAKERKLKVAKHTKRSGSDSDSDYDSDDESRKTSKRSHRKHRKHSHYDSGDHEKRKEKSSKRKTKKWSSESSDYSSDDSESSFEEERRRKKKQSKKLRDRGSRSDSSNYDSTADELSKRKRQHKRQRPSKFSGSDYSTDEGDSLVQKRNHGMHSKRHRQSESSESDLSSDDAPHKKGHRKHHKHHKRSHNVELRLSDSDYRSHGQRSRSKSLEENSEDESKKRSMDKKSGRHHHHRHHHHRHHHHRHHLDDERNYMQQHSPKFNGKHGEELDKTETEKKDGGHHESRAMVENNDETDSSTLVSVSVEKTCEYLPWTIIAGSSKSSEKMLGRYVLHAMRKAKNCSYVYVCMKYLPMVVGRFF

SEQ ID NO: 162333 - protein, 80 aa, Glycine max
  Coding DNA Sequence Number=SeqID_45555
  Gene Ontology: Mol. function=binding
MVHQFKSYFRVNWALIIQIKEGDQLTLLDPYFRDVYLSWKEKHYQFKSIRLDFYEQVLVNGKALTPQQAVGTSIYAQHKP
